United States Patent 8,067,671 (METHODS FOR GENETIC CONTROL OF PLANT PEST INFESTATION AND COMPOSITIONS THEREOF) - sequence listing, part 14

SEQ ID NO: 13508 - DNA, 1411 bp, Heterodera glycines
ttttctaattgttcgccatccaaccacttttttaaggcgcaaaatcagcggttccaagacattgatcatgctccatttgccatttgaccaacactccaagcttcatgtacggccaaatgtgtcgtgccgtgaagcaatctccacaatactcaaggttggcacaaattattttatttttattttttggcccagtcggacatttttttcccattttatggtcataaaatgctgaaaatggtatacaattaacacttttgctttgaagcaattttgacaaaaaagtttttgaccaaataaaggggcctaaaagttaattaatgccacctttcgaagaatgctgccaaattctgttatgatcaacaaagaacaaattacgtggtagggcattcgcttaaaaaatgacaaatttttgccacttttcgggacaatttttcaaaacatcttggtaaaatggggtcggaaaattctttgaaattttaatgcaatatgaaaagaaaattgtgcgaaattttctaaaagtgcttcaaatatcttcgtaatgttgtgtgcccatagcatatgcaatttgtctcgaatttgccatttttcccacccaaaaaaaaaaaaaatttttttttcaactttcagaaacgtaacattgtgccggagatgtgcacagtgtgcgtgtccgaggacccgcaaagtgaacagattgacctgtccgttgagttggaggtgctcgcccgccaattggtgcgtaaagaattgtgggtgcacagcgaggtcagtaatgggtgaacgggatggacatggacattctcccctctcgccacatgagaaaattttgaaaagttttaccaaaaactaataatttttcattaatgagaacctaggaaattaaaaaaaaaatttttttttttggaaaaaaatgaaaacctgaaaaaagtaattaatttacacttaataatctctaaagatttttcttcgtttccatgattttttgggcttaccagtggatagaaaattcttgaaaaaattaacgatttcaaacaatcggaattgggggtagaaaaaaaaattttccaggtccgttgatcatgaaaaaaatttttccaagatggggtgatatccaattttgagcatttttgggttcatttttgaagcatttaattgaaaatttagtcgtcccgacgcattcgacacatttttccatgtttttcccccagtgtatggagctgttcaagagcattcaccacgaatttgtgccaaaaacatttctgtccgtcacttattgcggcgtgtgccggcgaatgatcattttccagggctaccgttgtgagaagtgccaggtttgtacaacaacacacagacagagttttggcatttttgttgaatttgccaatttcgatgttccttttaacaataaaaaagc

SEQ ID NO: 13509 - DNA, 1703 bp, Heterodera glycines
ccccccccccccccccattatttttttgcttcaaatttttcatgaaattttgaatttttccaccccctacctatccctccatttttttttttgcagttcaatttccacaaaaagtgctggggccaagtgccgacgttgtgcgaaccggagcggatcaccagcgaaatggaggaacagttgcgcagcgtttgcgaaaaatacgacggaccgcacgaggaaattgcgaaaatactcagcaatttgttgcccacaacatcggcgacaacaaacagcaacaacaataaccacagtgccaatgccaataataatagtaattttacttattttcttggaccaaattcattaaaaattccaaaaaaaaaaaaaaaaaattcaccaagcagcgaattttattttttgaggcggaatttttggggaaaaattgcaaaaattgacaaaaataatggaaaaaatgcattttatttttatgaagttaggtattaggcatatgcaaatgttgtaaacaggtttcattgaatttattaaaaaaaactaacaataggaggtgagtctccaggttcttccgaaggagggtggaaaattttaagcatttttatgagaatttttcaaaaaaaaaaaaaaaaatttttagctccaacaacattgacaccgcgttcttccgagcggacaacaatggacagcaacgccgacattcattacacacaacagcaacaccaccacaaccatgtgcagcaacagcagcagcaccattttgggtatgatggggttttttttttgaaaaatgcgttgcaaatccaaaaaaaaattttttgaaaatttttccaacgattttttgtttttttgggagaacttgaaaaataagcattcaggaggtggcactggcacctcctactagtatttaaacaattttcaattcctctccaaaaaattcagagacaacagcgccgccgctagtttaacggctgtgcatgagccgtgcaattgcggtggtgacggtggagcagcaccagcggtggtgggcgacgatgggacgacgacggcggaaacggacaatgaacagcaaaaccggcaatgccatcatcatcatcagcattgctatcaccaccaccaacaacagtgccaatgccaacaagggcaccatcattactactttgacggccgaacgcgggaccgttcctcgtccgcgccgaacattaacagtgtgatccgtggcggtggtgtcggtggtggcattatgggccgtggcggtggtggtgggatttgcttgaagttgcacaccaactcaatgcactccggactgcacaacatcatcaacagtgagaaatggccatccgaaaaaaaatttataaatttttaaaccccacgcggactcgaaccatcagtccaatatgacagccgtcagtaccacttgaccactgtatctgaatggaaaatgcaggggaaaatttcgattttcgaggcccaaaaacaatttttttttttcacagccgctaattttccaggcatccaattcccgcccaactcggccggcatgtgccgtcgttctcagaccccgaccctgttgcatgaggtggagtgttcaacgacggttgtggcaaatgttggcggtgccggcggtggacaccatcgccatggcaagggcagaggccaaggcggcagtgccagcaccacgacgcagtggacttggtgagtttgtgatgcat

SEQ ID NO: 13510 - DNA, 665 bp, Heterodera glycines
ggaggacgcctcacatgccttcttcattgaacagcgaatacatcggagcaaaagtaaacacattgtgatgttgatgatgggagaatggcatgtcgagggggtaaatttgcatacgacggcacaaattttcgcgactttagccaatttttgagaaattttgattttaggcgacgctgggaaatgttagaaaattttacttaattttgagtcgaattttggaaatttttttgcagagttttgggaccggtgatgctgctaggcgacacgaaaggaaaaatcaggcatttttgcccatgttttaatagtttttcaacaaaaatttagccttttctatggtaggtacaggtcacacgctgcggtacaccccaaaacacagccgagacataacacagccgggaataaatttttaaaaattttcaaacagaaatttttcaagaaaaaaatcttagaaaaatttttcttgaaaaattcaggcgatttttttcaaaaatttttgaaaatttttagtaaatttaaaaaaaaatcgctgaaaatttcttgaaaatttttttctcatagaattttcaaagaaaaattattctaagatttttttcttgaaaaatttctaagtttgaaaattttttaaaaatttattcctggctgtgttatgtctcggctgtgttttg

SEQ ID NO: 13511 - DNA, 2251 bp, Heterodera glycines
agagagagaggtgagaggatgagaaagagagcagagagagagaaagagagagaggtaagagattgggggagagagaggtgagaggatgggagagagagagcagagagagagaaagatatcaaagagagaaaaagagagagagagaataaagaaaaaagtgagaagggagaaagcagtgagagagagcgaagagagagaggtgagaggatgggaaagagagcagagagagtgaagggatagagagaaagagagagagatcagagagaaaaaagagagaagggagaaagcagtgagagagagtgggagagagaaagagagagaggtaagagatggggaagagagagcagagaggatgggagagagatcagagagaaaaaagagagagagcaaagagatgggggagagagtgcagagagagaaagatatcagagaaagaaaaagagagagaagagagaaaaaagtgagaggggagaaaccagtgagagagagaacgaagagagagagagagaggtgagaggatgagaaagagagtagagagagcgaagggatagagagaaagagagagagagaggtgagaggatgagaaagagagtggcagtcctaatagttacgtaaataccaattatttctgtttatgcgcgaaaaatatgagtttcgggttttatcgttgtaataatattttattttttccgtatataagaaatttatacccatgatccaagcttaaaaactaatttaagactttctagcgaatgttacgggtcgggagtggggtcaatcgacgcagtttttcaagggctataagggaaaaatagtgcggtttcgatcggtttagaactgttcgaactgtgttcgaaaaacgagtcaaaatttgcacttttttggttgtcctatttttgaacgctttttgcatgccttaaaagtggtcaaatcaaaaatcgaaacaatttcgcatgatatacaaactcttggctttcgaatgataccagggttgtttgggtacgggtccgggaagtgccctaaaaagggattacaagcacttttggtcgggttttcttccaaaaaagaaggaaaaggaaaagggaactaaaagggatggaggcaagcgacccagtggttaagtggttagtgcgtctgcctgtgcttttgtggctctatggttcgggtcccatcaatctttgtgttttcatttatttattttattaaattttttgaatgcttttttttttaaattaatttttatttttttattaattcaaaaaataataattttataaattacatattaattaaaataaaataataagtatagatacaaatagtaaatattgactaattttaattccagttatgtagtaaagaagttattatgtaccattttgcatttttttttctttatgaaagtagaatggttttttgccattttttcaactttccttttttcattgtgaaaccttttttttattttctttcaactgaaatttaattaatcgaaaactaggaaaagatactaattcgaatgaaggaatgtcaataaaaaaaattgattacgtttcattctttacctctttattctatgatgttgtgtatgttgtgcctactctatatgttctttgacctcacccggtccactagcataaaagggtgctttccttacattgctcagtcaatctctatggttaatgtgtaatcctttttttgttctttttcataatagtaacattttttgtttctcttcattttaaaggtattttttaaagttaaattcttctaacgattcctttgatttatttttttatcgaccttttcatttgttttttgtattttaacaatgttttatatttttcagattatatttttattgttatgcctagaaagcgcacattgaccggatatagagaccacaagttacaacgcgaagctacttctcgtgttcggaaaacattgatcaaccattttcggcatcaatggctccattgactcaagctcaaactgagcaagggcgcattgactctttatcaagtgacacccaattggaaaatgaagcaattttggtccaagacagggatgtcgcccaacaaaacgaggaccatggtcagtcttcatattcaatctgataacttttaatttgtttttaaggacaaaaggcccggggacgcccgccaaaaaagacaaggggcccaggccgaacgaacataacaaaaactgctgggaatgggggcacccctttgtttgttgaaagcccgtccgg

SEQ ID NO: 13512 - DNA, 1820 bp, Heterodera glycines
  misc_feature (1748)..(1748): n is a, c, g, or t
gttcggaaaacattgacttcttccgaagcaggggcgtcttcgtcttccaatattgacacaagacaagagtccgaaactgctgttttacgtgacctggaccagggcaatttgaccaatactctgacaacgcccgtggcaaaaagccaaaaattggatcaaccattttcggcatcaatggctccattgactcaagctcaaactgagcaagggcgcattgactctttatcaagtgacacccaattggaaaatgaagcaattttggtccaagacagggatgtcgcccaacaaaacgaggaccatggtcagtcttcatattcaatctgataacttttaatttgtttttaaggaccaaaggcccggggacgcccgccaaaaaagacaaggggcccaggccgaacgaacataacaaacactgctgggaatggtggcacccctttgtttgttgacagcccgtccggtaggggcgacagtggtgtcaattcacgcagaattgtggtcagattttcggttgtttttaaaattaagcatttgtttaagctacgatccaaacatatatgccaaatcgaagagagactttacaaagtgctttccgattattctcagcgtccttggcccttaaagaaccaaggtgggttttgaatattttcagccatttttcaaattttaattgtcaattttagctaaacataattggactcgctgcaagggcgattgcgattgtacgtctgctgctcaatgtcaacagaatgcgcaggcctacattgcctctgcaaaatatgaccgtgaatttaccccaaagaagacaatgccgttgaaattgacgaagatggcaaaacagtgtcatcataaacatgcttgtgcttcttctgggacaaatcacagggtggattagattagggtacctcaattatcttttcatttcaggttgattattatgacagcggtcaattcggcgatgcaaactgtcagcattgtggtgctgttttgctagccaatgaagcatatgcaataagaaagcaggggcgtgtgtccccttgctgttccaatggccagtgtcacaccgagcaaatgaaagcggaatttgccgagctgcaaaaccctcctcaaaaattgaaagatttggtcgcggctccggatgaacgcatccgttttgagtttttggacaacacaatgccactcaataatactttttcgtttgcatctgtccatagcgagaaggcaccagcagatcaaatggcaggcagaatggataccgttaaatataatggtgattagggagtaaagcttttagagaatattttatttttaaggcgagttttcgttcatgctaagcgacctcatctctccgcaggggcgtcgtcccttatttgctcaagtgtatacattaatgcctgaggatgcgctgttattgcgctctgagaatttatcagattcgttgacaaaaaaaattcaaaatcaaatccttgaaaagttggagtgcttgatgcgtgaaaacccctttggtcaaacctttgtcactgcaggggcgaagcttgctgaagcgactgagcgtcttggcggagcagtgccacattttcaggtgtgcttttgtaaattgtgttaggaaaacaatgctttgagatcgtcttattgaccgatcgtgacctgaaaatggatgctgttcgtagccgtgctgactgtacggttatcgagcgtgcagatgctcccacagctaagcaagtggccgtaatatgggtgcaagaagacgnctgtgctccagaaagtaatggtaaaactgcactattgctttatgaattaagttttttaaggtttctggctga

SEQ ID NO: 13513 - DNA, 4012 bp, Heterodera glycines
  misc_feature (59)..(59): n is a, c, g, or t
  misc_feature (3966)..(3966): n is a, c, g, or t
caacattttgttgttgttggttgaacgattgccatgccaaaggaaaagcaaagagaagncattagtagcagcaaattgaagcacattgcagcgacaaatgccacaaagtcagagattcaaatttggttttagcaaaatgtattcacatatgcaaaaattaaaaaaattggatttgaattgacatttgtaattgaggtaattctgatcagcaattaatgattgggagagaatggtacggatcaattccctgattaaaatcatggacaacaattttggcttcattaaagtaaaaactctgtgatttataaatttttaaaaaataagttcaaatttaaaaaaaaaatttctcttgctatactggttttacaatacaaaaatgctaaaaatagtacaggaaaaaaagtttggctctgataaggaaaaaaattcttcgccacgaagtgataaccaacagcacctgaggacctgatcaatacaataaaaataaacctatgaaagcagtggatttgggcaaatgatcaattatgaaaaatggcatgctccatcatccaatcaaatttggtgaatattttgatcaaaaaagaaggtaactgatctgataatccgatctgattataaccagatggatgataatttgccgatcaatgaatgccaataatgtattgtgataatgattagaacaaaaagcgcgcaatgcgttggtcaaaaggaacatataatgttgagagtggtcatggaatgtgtgcgggttgatcaatcaatacacaacacaatagcctcaggtctttttttattgatcaatcacagctaattatcacattccaacaaattaaacgcaattagtggctcaaaagagggcttatcaaaacatagaagaattttttagtcaatccccctaattagtccttaatatatatttatatttttagtaatccccctaattaggtcgtcttaattaataaattataacgcgccgacttttttttgccatttttagcccaaaatggaattttgcaattaagcgcaattagtggttcaaaagagagcttattagaacatagataatatattgggcagaccccctaattagcccttaatgtatatttaatttatctccctaattaagccgtgtcctaattaataatcgcgcgccgactatttttttttgccaacaaaaatggaatttgtgttgattgacaaaaacgggaacttacccgccataaatcgatcagtctgtcagttggtccccgtgctcattcccagccctcccgccccccgcaatgatacaaaataaatatagtacatacatacagccctcaaaccgtaagcgcccggggcgtcagtgtcggcggtcggcggcccgtccatttttgggtgctctgtgccccccacccccgccccgttgtccctctcccctctccctccccaacaacactcctcgagactctcgacagcaactaatgatgatgatgtgatgtgatgatgaggggacggatgatcgagactgttatcactccgttcgctgccgccaaacaaatcgcacaaaaattcgcaaattatgaatacgaatgaatgaatgtggcggcggcggtgttaaaatatgatatgtaggtgctgattggtgatgatcagcacagcagatcagggcaatcattcacgccatcccatccccaatcactcctcactcacaacacatcacaaacacccgccgccgatcgccgcctcgtcccacccctgggcgaaattcgggggggggggggggggggggaacctgtcgatcggtcggtcgatgtgcctgtccttgtccccccccgtgatatgccctctgctgctgctgtcgaatttaggccccattttcaacttttggactgagaaaactaaattttgtgggacgcgccaagccgagaccaaaaactctgacggtgagtgctaggctgattagatgattgattagttctaattaattcattaatttagctaatcatcaagtattcagcacccatcaccatcatcatccaagtaaaaagcgaccgatgctcgagactgttggggagcgggagcggtaatcagtgttctctgatcaactttgctgtttagcctaattataccacgcaacagcagtgctgatggtcgagagtctcggtctcggggttctcgctctcgggttccggattttggtctcgggcctcggggttttcagtctcgggtcttggggttttcattctcaaactcgaggatgaagcttaatttcggggtcaagtctcggtttcgagagtgtcgggaaattttcggtctcgaactcactaatcagcacccaccaccacccgactaaaaagcgaccgaccgatgctcgagagtcttgagagagggtttggggtttgcgtgtgtgttgttgtgttgccccccccccccgcccctcggtggggcgggaggagggggcgggaaggccaagatacctctccccccgccggcgctctcaaattttcccatttcttcgttttcgtcccatccttccgtctcccatcattttggccccctaacagaccatcatcatcatatatatcaccaccatcagcagagtcatcactcatcattccatcctcgtttccccgtcccctctcccctctcccccccccccccccgccgattttgtcttttcgactttccaaatttggcatcactttttcccaccatttgcccccctccgacgcccaccgccggcggggaaaaagggaatatgaaaatgttttgttttatgtgtgtgtttgatgattgatttgggcccccaattttgggggacaaccagcaggacaatgcacattcgttcaattcattcatttgttcattcctcgaggggttgcggggacgacggcgatttttatttattttattttttgtaaattattttccccgccgaaacgccgcgttgtgaggacttatttttggcgctcaaggacatattttgtcgggtttacactttaaacggttcgaatggacgaggaaaaatgtgaacatatttgggcataacgaaaattcagacaatttaattggccaattatgaggtgatcaactgatcaaccgccgaaaagtgtgaaatgatcattggtcatatttgtgcatccgatcgccatatgggtgatgaactgatctgatcgaactggaaaggacacgttattgatttcctggaaaaactcagggtaattaatatgtatttaaaattaattattgggtaaataactaaattttgaaaattggttggcaatgctaaatattaattatttactaattaaaccaatttataattaatttatcaccgaagaaatacatataattaattttctactgtgaatttcaaaaaaaaaagaagttattttgaaaatttaatattaaaatttcgtttttataagaaataataaaatattgtacatttacagtagtttattagtaattgtgtcaattaatggagctcttaacttaaaatgaaatataaaaatttatttggtcattttcgcacaaaattttatttcacggatatttttttatttttagaatgggcaaatgatgtgtccttctgctgataaaaatgtaatcaattagtttaattaaatggtttcaccgaggcattcattgtaaaaattatgattaaaaatttccatttttgcacacctcccattaattaattattatttgtaaataaatatggaaatggttatcatcattaacattgcactgattgcaattaattgttaattattttcagacggaattttccgtactgaattatttatagtaagatccgtggggagcagggctgggcgaaacttcggcttcggcttcgaaaacttcaggttttttgagcttcgaacttcgtgcctcggtttcggctattttacccgaagtttcgggaaaaatacacccctgaagattgagttttcaatgtgaaaatgcaccactagtgattgactnttggtaaacttaaaattaatatatatttaaactattttgcttattt

SEQ ID NO: 13514 - DNA, 3162 bp, Heterodera glycines
catggacaaaacttcgtcttcttgtctcctactgcacaacggcatgctgcatttacgtcacattcatttttgggcgcgatgtcctgatacccttggtatgggtctacttgatggggcccgtcatcgttaccgcccgcaatttggtaacgggaaatcagtggacgcagcggaacagagctactcgaggcacacggcgagcaccggcaatttcaaggattgaagcaattgagctggtaccgcctccaatgccccaggagatgagagcgaatgaaacggcaagttcgcaacaagaggaccccgagccgtcaccgctggtgatggaactgaaattgggtgccgttggaaatctggggcccaaaggaaccgaattcccgtccctggccggggtcttttctgggtttggacagacgagcagatggtgcttctccccgcagcggaaacagagtgcttttagccattcctatttcgggtttccccaaccaccggaaaagagcgtcggatgggctcaacaaaacgtggtggtgccctcgggggatgaggttgggtgggtccaggattgttgtcccacggggcgtggacggccttcttaagcttaactacccgtgctaagcgttccctccatgtttttgatgtccaaggtcctccctcttccatttccttatcgaaaagctgtgcctttatttccgtaggcaatttttccttaatggccacagttaggaaggggttgtcatctaagttgttgcccagactttccaattgtcggcaaattctgtcaacattctcagaaaaggctcttaatgatgaggaatgccccgttggcttagctaagtggaagagctcactccttaggcggtccgcccttttatcatcgtcgccataccgcccttttaaaaggtcaacgacgatcagataattggggtcggttagtgcgaacccgtccaccaaagtgcgggcgttaccccttaggcgaccaactaaataggtgagtttttgcgcgcccgtcagagaggcattatcgtgaattgtatgggaaaaagcggcccagaatgagggccagttgccttcgtgcccatcaaagtcaggtagctgaagcgcaggaaggttaatttgggggcgaattgctggcgcaggaaaggacccttgagtggggggcggtgggggagccaaagaacgaattcggtcaattttgatgtccaatttcgtctgaaccccatggcccttggcgatgatctccccgggggatttccctcccaccaaaaaactggaaaacaaagcattttcctcatcccgaatttccgggttcggggaggctaggacatacgtccactctttcaaaagctcctttgtcaccgccaaggtacgagcgagattttcgctcgttgagcctatggcgtccaatgagcaaggctcattgggcaaagcctcaagtggtggcccctgggcaacatccgccaaaatgtccaacaacaaaggttggagttgttggcgaattatggcggacataattggggggaaaaaaggagggtaaaataagcaaaaagagaaaaaagagggtacggtaagcaaagggaaaaagtactgcaggcaaaaagagaaaggaagaaaaaggcacggtaagcaaaaggcagaaaaaggaggtaaataagcaaattaggagttcgggagtctcccaaaaaggtaaaactaaagttgcccggttagctcaattccgtgacaagagcaccagactcttaatcccctgtgttcaacagctgggaatcggagggggtacgcccaagagaagggggggggggccctcaaattcagcagaacactcaaaacaatcaaaacaaataggcgccaaaaaagtttccgtttcccgaggcagtgagtgctaaccaggggaaagggataggaaaagggcgaccgaagggaaaagccaagcggtcggccgacgtataggcaagaaaaagcaggcaaatgccgagggcgaaagtgccaaagggttggacgaagcaaaggcgagaaagcaaagtgatggccaaatggctaaacgccaaaattggtcaacgcaaagggaaaagcgaagaatggccaaatggcaaatgccaaaattggtcaaagcaaggcgagaaaggagaaaagcaagggggccaaatggcggagcgccaaaattggtcaaattgtaagcaagggaaaacaagggaaaatgtgaacaaatgagagaaagttttttttgtttttgttttatttaaaatgacttcgggaaaatttgggtgagaaaatccgtcgttggtgatcagcggagaaaaagtgagaaaaaaagcgagtggcccagtcattggcacatccttcttaaatagcagcgtccatcggggtgggcggggcacagtatataggcgattcgcggtgggcggaaagcgttgattggtgggccgggccgggcgcggggtgggcaacagatggaaggagtcgcgggcaaaggcattgaacaattcgggccgggccaagcgtggggtggtcaacagatggaaggaatcgcgggccaaaacattgaacaattcgtgtcatttcgctgatacatttttctgtgcgattaatttgggagggaatgtttgggcctggcccagattagcaatgtttagaaaaaatggaaaaaagtgccaaaaaactaatccccaaaatgttattatcttaacaaaaaatcggggtcgccaaatccccaaaaaacaccaaaaataatatttatttataacttaatttaaatatggcgaagacagcctcccgcccccctttaaactgacgcagcgcgtgaagtcgaagaagccccggaagaagatgccgccaccaaattgtccgcagcctcgattggagcattttcacccgctggtgcatccgcgatgaccgggttgttcacaacacccactggcgggagcggagcctgtccttcctgaaaatgtgaccccgggggccccccttgaatgtccctcaacggaacggggcggcgtccggaattctggttgttacgccgacgttggcgcttatctccccctcctctaactggtccgcccacctgccggccaatctggttggccgtcatttgcacaacaagtcgttccaacaaaccccgttgggcttgtgccgtgctcgttaggtccatcaaagtcttgttgatcgacacca

SEQ ID NO: 13515 - DNA, 4483 bp, Heterodera glycines
  misc_feature (4351)..(4351): n is a, c, g, or t
  misc_feature (4411)..(4411): n is a, c, g, or t
  misc_feature (4430)..(4430): n is a, c, g, or t
acgctttacattcccttttatagacttaactcgaaatataaattaggcaaaaaatttataccttttgcggggcgggtaactaaaatttggaaccaactcgataaaaggctcattgaaataaactcattaaatcaatttaaaaataaaattaaaactatctctattcccgtaaaatagaccggaaaaattaaagtcgaatttttaatccattcaaactaaaagtgatttggtcgctatttatttatttgtattgatttcatattatattttattttttggcggcgatctcgtttttaattgttttgcgctttcttgaggacattttttaaattaatgttttgtcctcaatgtaagcggatttttcccttttgtggactttttctttattgacaataaataaataaataaagaaaaagatggaatgtaaatattaaaaaatacaatatcaacaaattaagttgttgtgttgtgctttgatgacattgtccaattgcgtaaatttgcactgaatttatttgatggcggactctacacaaaggtcaattaattaattaatgagtggtcaaatttacgaattataattgataaaataaaaaattaattaaggaatatgtgtacataatgccggacaatgatttgtatttgtcttgtaaggggttttagcaatgataattaattagtttattttgttaattactctcagtcaatttgtcgaggttgcccttttgggtgcaaaggaggtaattttatgattttaattaactgttttggtttaatgactattttaattgccttcattcaagtaacaattcgattgttcttgacggaagagacgcggacgcggaagcaattggccgattattcttttgggtatgaaggcaaattttgacaatggcattcagccttttttcgattttactttttaaataattaaaaaaatgttttaactttcaaataatttactgacagtgacaatagaaatattttccgatgtgatgccagaaggaacggagtgtgggagaaagtgggataaaggacctgagagaacctctacaagaggcgcccgtagctcagttggttagagcacggcacggattgctggggtcgtgggttcgagtcccactgggcgagttaccttttatgttctacaccgaaagtcttatctcttcttcaaataatgagctcttgtagaccaaggaggggggagaactccaaaaactattttctaaaattctgaaatcatcttgttttttttcaaaaaattcacatgaagctaacaaaatgccgtaatagatgagtttaaaagccttgtaggacaattaaacgaactgcttttgtggtgtttggcataatgctttaccgtctcacttcagtggcactatgacatcactttttcgacactgtccaaccgcaattattacggcttttatgagagagttgtgaaccgaacgtacggttggcccttttattgccccgagtcggactgtggcactgttgtaaatgcgtggcatttgagcagatttctgatcagtttgattgatcaccacaaccctttagggatcagtatattccatccttctctacgacacaatttataattatggcattgcgttaaatgaaagttttaagcagtttggcatacgacctgaagtgtaccgtaatgggtcattgttggccagcttcagaaagccatttatgggtatgaaaactggggggggggaataataggctaagggcttttaaaatgaatttttttttttgatttgtgagtgttttttttgtcatcaggtttgagcggatatgtgattacggagtcggatcgtaatacgcgcgttttggtgctgtccaatcgaaggtcggaaggaagcaaaaatgcgtttcgcattttgatgcaattgggatggaaagatggcgaattggtgagcagcgccaactaattatcaaataattgacaaaaatgggtataggtagacattaataactaacattttttgcgcctgtcagaatgtttcaatgagtgccggcagcagcccgttcatttggtcttcccatggcggaagcgcgccgttggcggtgccccggtgcggttttgatggcaacggatgtgccgtttcagtgttcgacatgtataaagtaagaccagcagcagttcactttcactggccagggttggcattccgagtaaaaacttgggaagctgctatatccgagtcggaaggcatttccatggaagataccgaacccttaattctgatcctactcaatgattattttagggatattttttgagtggcatcgctttgtctgcgctgctcattatcgccagtgttacgataattgtctatttgatacagtaagaaagagaaacgaatggaacatttttttacaaattattttacagtgccaaaattgttgaaactcgtaaaaacaatttactgtggaaaataccatttggattgttgaagcgacagaagcaaagggtgagtggttgaaaagatttattgggatattttaaagcgtaattacatgttatatatatatatatatatatatatattataaattaattagccgaaacatttcaatttttaaagttatttaaattgctatcaaaatacaattaataagcattccataatttcatatgccagacatttttcttgcaaatttaagagacccgaacggactgccgaacgcagtcagcactctctgcgctccaaccaaacaaatctttcctcgctgaccaattcgaccaccgacagtttggcacagtccaaaacatttacgctttactcatacaacggggagaagtgcattgtgcgcatttactgctcaacctccttggcgacaatggcattttccgtcgcgcaaatggccgagtgccgaacggtggggcgaggggggcggggggcaatgaatggaggaggcatttagggggaaatcaaattttggaattaaaattcacgtagaagccgaatggggaggaaacttagcaagattcaaatttctgcccccaaacctcatcagcgactcgtcaatacattgaaaattctagaatcagcaccaactaatgctaatgaatcttccaattttaaaatccctataaattttgttttttttttattaatatacaatttttatttctgtttttataagtcgtgatttttgatggaattaatgccttttctttcatacttttgcttgctcattatttttaagtcataagagatttataattaaataaaatttatttaaatggtgtaattcctttaaatgttcagctgcgattgttcgaccatgagaatttgaatcgttttttggggctgagtttggatgggcccaatgttttggctgtgtggaatttctgtgccaggggttcgctcaaagatgtgatattgtccgaaaatgccatggtcaaggacgtggtgttcatccaatcggccatcaacgaactgtgcgaggtgaaaagtcaaaaattaaatgccgaattaaatttcatttaaatttctaaaataaatacattatataatgtttatttcaattagcaatttaaccctcctaaagttcgaaatccaaaaaccgaataagaactcattaatctgtcttttgattaatattattaaatcatttttcttgattttttaaaacgattttattaggtttttagattttccaatgaaaaaaataaatggtttttcacaaaagcttatggtcaaataaatggaagaatacagtattttcttttttttgatctcagggactgtatttcctgcacagttcgcccctccaattccacggtcggctcaaatcgtccgtttgtcttatcaatgaccgctggcaagtgaaaaatttcgtattttgggcttcgctggctcaaaaatgttcaaaaaattgaaacaaaaggtgaagcattgctccgaatgacttctcttaattgaataaatgcctttaagactttttgtggttgtcgcctgaacaattgcggaaaatgggcgacaacactaataataataataatgaccaacaaattgacggttccaaacaaccggacatttacacattggcattgattttcactgaagtataaattaaatgcattaaattttgggttcaatttcacctgcagaaggcggcaccatcggatcatttcatctttttaaaactaaaaaaacatttagatcgttttccatagaaaaattagtgtttacaaacatactttggacacttttggctgtaccatataagatggaattgtgaagcctttatagagtattaattttaattattaatcactaattaatgggtatttgtatggagaaaataaaatattattgtctaaagcaagcactanattaatttcatttataaataattgttaccttaattaactttgtgtcccaatttcgatggntgatatgtgcccgtgttgngaagagagtgacaatacgccgccatgaatacggggaaaacgagcggcgagcag

SEQ ID NO: 13516 - DNA, 1358 bp, Heterodera glycines
  misc_feature (9)..(9): n is a, c, g, or t
ttgcaattntgggacgccaagtggagaaaagggacggcattttgccggataaatagccgaagtaatgcgctgggagggcggaagaacgaggattggtcgggatgagtggacgagaaaagaatcgttggctgatttagggtggacgattggccaattggcactgatcactgggccggggtgggaggggcacgcccagctgtctgtttggcagagtggcggtgatcgatggtggatgaatcgcccttgggcccgggccattggccgaaccaactcatcgtcccttcccttcacaaagtccccaatcacggggatttgatggggagggaaggaaatgagcactttacaccgcaaaataagaaaagcagaggacaccaataagaaggaggaaagcatataacataatgtgagatgaaaattgagcatttcgggggggggggggcaaacgacgacaaaagtgagccgaaagagagggcggggaggggtgggggatatgaccgaaggatagggaggatggatataaaggggggggggggcgagcaacaaaatacacacaaaatataggagcgacaaaggcaatgacatgatgctcgaagggttagtgccaaccagggatggcatttcgaggccccaaaaattttcggtagtcggaattcggaccgccaaaaatgacggaagtcgaaattccgtgccaacccttttgccactcattccttttggcattccgtttaacttttgaactgttcctttgcctgtctctcacctctctccaacagttccatcctctcggtcttccatctgccaatgtttttcccccgcatttccctccctttcccatcctccgccatttttacacattcttcgcacggatcgtcactgaacggaagtgaaagaatgtctcctgagcagcgccggtgggaatgaccggctttgttgcgaatacaattcaaaagcatggccaaattgtaacagataaaactggtgaaggagcagtttattaaaggagcgggaaaccgcaaaacaaactgacgaatgtttcgttgggggagcgggaaggggtcggattggcaaatcagcgaaaagtgagtacaaagaggggagggggggggggaccctcttgagaatgtcattcataatgattgacaagtgccgaggcgaggagagggcagttgtcacaacggttggggtggtcggaggggggggggaaatatttgcagagcaaagaaacggggggggggaggggagggcgtccaaatgcgccgattccgtctgttttcattcgtcgtctccgaccagcgtgttcaaacacctcttcttccggcaatggctttcgcttccacctcgggttcaccaccaacaac

SEQ ID NO: 13517 - DNA, 1422 bp, Heterodera glycines
actccgaaatgccaaggaaagcggcaccggtacagcaaagaaaaatgatcaggccgaacagttggtggaaaggcagcacaaattttcgcagggaaagcgaagcgccggggaagagaaaggtgagaaagccgatgatgaactgaaaaaggagaaaatgagaatttggacaccaaaaggtggggaggggtggacctgaatgaagtaaaaggagacggccgaaatgccgaaccaactgtgcaacgagtacaaattgggctgtggctgtaactcgccgttgggggaacgatggaagtctaacggagggatgaggagtaattaggagtccgatggctaatgttttggcactttgtcaatgcgttcacttgccatgagagtcccagaccgcctttagagagacaacagccaataatagagcaaccgaatggatgctcatgtgcaggagcttaacaagtccaatggaaaaaggggggtgggaatgccatcattggcgttgcaattggcacagaattttttggccaagccgaccttggtgaagcgtttgcgttcatttctaaaaacgcggtagacgagaatggcctcgccctgtaggaaaagtatgcccatggccatgaactgcagcaagggacgggaaggagagattattgcggttggagacggctaaggagaaaaagcagagaccgtcggatggtaacggaactgcctgaaggcccgaaaatgccaagggctgaaccaccgtccaataatcacctgtccgggtcacttcgccacgcaaagccaccctcgccacccatccaaacggcgacgaaaagaacggcacaaatgccgaagaattgggaaaggacgaaagcaccattgaacagcttggcactctgttgctcattcaacagattggggtattcgaggagcagtgacatttggggggagcaaaaggagacaaattggacagaggaagataataaattaattttgttttttaaattcaatggatttccgaattttaattttatcaaaaataaaaataaacgtgggacgacaaaaacaaatgaagagacagagagagagaaaaggagaaataaatgccaatgcaaatgacgggaggggaaaagggacgggcgccattcgcccgcttttgcttcggtgtgccattcgcttttccctcattttccccaccttttcagcactgagagacaggcggaagaatgctttttttgattgtctctcaacaaaatgagagaaaattaaggaaaagaataatgggcaacgaacagagaaggcattcgaagggaaacgaaagaaaaatggtggcttaattgagttaaattttgaatggtatcacagagggattaaccactaaaacgaattataatttattttaagagtataaactttaaagcgtggaaagggacattttaatgaaaactg

SEQ ID NO: 13518 - DNA, 2283 bp, Heterodera glycines
aaaatttcggaccgggtcagtttagtacggccggtttagtacggccgttttagtacgaggggtcgttttagtacgagggtcagtttagtacggcaagctgtttttgtccaaaatagattctactgcttttttccgaaaaaatgtttaaaattaataacataacatatttatcaatgtgttaacaacaaaaaaaaataacaagcattgaaaaattacgggcgcatttcataattgcgagaaacaccaacgagcaaatgattgatgttatcgggattaacattgacattggcatggtaattgtggtcattttggatagccgggttattgttgatggcattgtagccctgcaaaagtcgaagaattctttcatcggcggcacgatatttgggcttctttagaggagggacttcaccagcgatgcatcgtgagatgtctgcatcaattgacttttgctcacatcgaattgtgttgatgaagtggaagacagtaggatgggtacaatcaaatgcccgttgaagttttcgatctgtcaaagcaccgttgaaccacggtctcccggtgtaattaaaaaaattgagttaacgtttcaaaaaattcaccaattgaagacgcccataagttgttgaggaagttgtgcctgcaaaacagtgaggccagcagagagatgatggacaggaagaaaagccatagaggtgatcattttgctcttttcagcaaagacggcattgttgttgtaagtcttaatatgaacaattctattggaaaaatacaaaaatgcaatacctgagttaaaccctcggcagcaattcgtttcttcatatttcccactaaatggaaaaagcagaactgcacacgacagagtggcaacattgtacggacagcaatttttcataataccgctccattccgaagtcgaagaacgagtaaatatcaaaattcttaatatggaaatttgtgaaatttaatggtttttattttttcacctttgcggtccagcctgtccctgaatttgaaaaacgccggtatctgccaacaaaaaattctcctcgtcattctctgttcgattgtacattctgtacgagggcggcaattccaatgcgtccaaactgagtggtgcagcaggtggtacatcttcgtcatgacgaacacgttttataacctaaatcaaaggaaaaaatcaaactttggcataaaaatttgcaaacgttgacctttttgtcgcagctttggtcggaaccaacacgggggttgcagtgttctgcaatacttgcgcacggattgtagccggcgcttcgcacgtctcaactgcacgccgcttgagctgggttatatgtcgctgacactccacatgtgcggcgctcatgtcgcatgtgtggcttccaattattttgaggacattaccattaatgtcagtgtgaaggcgccctgtatttgaaaaatagtttttattttattttatgcatttacctttgcatttgtcgttagctccgaaaaactcgcatcgccaatacttccgaagtccatcgtcactgagtttgtgaagaacataaagtgaaccctcatgttccagcttctccttgtttcgctttgtctttatttcctgattgggctgttccatttgtattgtagctaaacatagatattataagtttttccttctttataattgacaaaaaaaacatttgtaacagttatggacaaaccgaccctcgtactaaaccggccgtactaaaccgaacctcgtactaaaacggccgtactaaaacagccgtactaaaccggccgtactaaaccgaccccgacccaaaaatttgtctatgtttgaatttttttggcgttctgtatttattttttatttttttggtcactacctccaaattagagtgccacgggaccgggaccgggccgggaattcccggtcatccgaggtcccggtcccgggttttgaaaagctcaagtcccggtcccggtcccggtagggtaaccgggaaccgtgaaaaacaagcactggtaagaatgcggtctgagttaaaaattagtgaagaaaattggagtcaaagggaaaaatagaaaataataattaatatattctttataagtaacactgcccaggtgtgcaaatggcctaatggctagtctccttgactttcccttcttctttcccctgcctctatctctctacagaaattagattattttcagttttttttttttttgtatcctcgtgtgtttcctataaagaagatatgattcctcatagtttttttttaaattgatacatat

SEQ ID NO: 13519 - DNA, 3374 bp, Heterodera glycines
  misc_feature (12)..(12): n is a, c, g, or t
tgatttgacacnttttcccttacaacgccatcgtccactttccgtccgtcagtccgttcactcattctttcgtaaaaaacaacacttcgcggccatttgtactttgaacttaaaatttaatttattatgatgggtgccatttcatttcgttattacttgtccgataatttttttcaatgcgttttccgtcactgtctctcaccaagcacagaagagacatctgtccaaacagataaattaacaaaaagataatttttgagggaacgaagatggatttagaaaaatttttaaaaaataatccaattgcaaacattttagatccttctgctataaaagttaaattttccggaaccctcttaaaattttcaaaatttgtcacgaaaaaggcagacctatacgctttagtgtttttaaataacagtaaaaattaaaaaattcacttttttggaattttttgtattgatttgtgttttcatttaaaattgatttgaccaataaaaagttttgccgctcacttgctcgtccgtgatgacaagagggtcggtgaacattgtccacgtgacgccttcagtgtacggatgggtcgttaaggagctttaatcgttttgaattaaaaaagacaattgttttggcaagtttacccctgataacggagaaaaggcgacgcgggatgatccatgtttgatgatgatgacacttcttggctgttgttgtctggcaatttcgatgacagcgtgtggtcgccgccgatggtgacagcacggcgtttcagtgccgatagctcgaaattgatcggggactgttgctcaactgccaagcaaattgatatatgaagtgtttattttacaaaattgtttggacttgtggcctaacaaaaataaacaccattaaatgcgtaaattaaaaaaaaacagatttctctataggaatgaatctctataggaatgaatgtggtggcccagttcgatttttttttctggcctatataggcgctgacggactctaattcccaaatttaaggccaaaaattcaaaatgggcatatttgacgaatcacaaataaacaattaagcatcagtcactataaacactgaaaacaacaaaaatggagaattaccgcgtccggctttccgtttcggttcctgtaaaaaaaatcaattagtacataaaatgaatgggaacttgtgaggatttaagcggttttgaaaagcaataaaaaggtcgtaaatttatataatgcattttacctccgccttgatgcttctttcgcctgctttttggacagtccgttcgtcaatgtcttcaccacgattgatcatttggaataatttaataattgaaagaggcgtaggcaaaatggtctgtaatgcatgaatcagaatagaagaatatacgcctagggctgaacttgccaaaacaccttacaaattagggactgataaatcggaattttggataagagaagggcccggatttttaggcgttcacttatttttttgcggataacatatggtgagataaacgcaaaaaacatttaatttagaaagtatttttcaactattttcgcttatgaaactattttgcttgtgaaatttttaaaaaactatttttcaactacataatttttgcatataaacaaaaaaaattatgaataaacaattttcaaatttttggcataatgtaaccgaaaattggcagaaattttacatttttcaaaatttcccctggcggcgcctgtcgacaccgccggactattttcaactatttctgcttgcttgtgaacaaaaaatttattatgaaatattcaacaaaaaaaaataaaatgggcgctagtgcactttatgagtccaatcagagtttatgagtccgatcaaatattttgaattctgattcaactttttgaagaattttcattttacatcagtaaaaaatataagaaatcctttgttttcgcgaaggatctgaaataacaatacgactactgttgggtaaatcatcggatgtacttcgttgatccgaatgacccatgtcttccaggattgggagtacccgtaaaactcccgctcccgtaaaaaacctgatgggtagaaaagtacgggagcggggctcccgtaaaactccgacggataaaatattttattggactcaaaatacctttgggctcataaaagtcaattgaactcataaaggacaatagagccgaaaagggcacccctgagaatcgacttttcaaaaagcaaaatattggccatttggcgggcaataaatttttttacgcctgaaaagcttgaaatgtttgatttacaattattcaaccgaaatgggtaaagaatgcggcaattttaaaattcactcgtaaattttttagcaactaattctgtcattataattatttttttggtacacattttagtatttggtgtattttattctaaatccagggttcggattaccttaaatgcaaggacatcctggaactaaggccctctcacttgaaaatattcttgaaatcaagatgtccttgaaagtgagcattcaaaaaaatagtttcaaaaatttacaatttttaaattttatacataccaaattcttattaatttatggcatttttgggtgaactatagtcaaggccccattaaaaaatggcacaaattatataccaatcgattcgtctcgacgagctatgcacgaaaaagtaggtctccagtttcttttatatttgatttttttcctttttttgtgactgaccggtttaaaacagttttaacgattttgaggacccataacttttgtcaacttcttttttgtctaaaaattctttcggattcgtgcttttcatgctgagaggaaccctttggtatctattttatcgcatttccatgcgttttaagtcagtggacggttcagtaccaaaggtatttggccacttcagtcccgggtctgtaactcatcagggaatggtcgcccccgaaaaattccttcggattcattcattatagaccgagagaagtcgaatgacatatcatttatatagaaattcaattacttcagtattcttcacttttaccaaaaatttcaaaaggctaaaaaaatctgaataataagaaagaacgcacagaacccaagagactaaccagtaagccacgtgagcaaccaaatgagtagggttggtaattatatgcacatgcatatttttttcctagactgtgggaggcatgaaacgcacgaaaaacatgtttttagcttggtttgaagcttctaggacgtatttccatatgcatatttgtgcatatttcgcgatttatgtgaagatttgcatatttgtgcatattttggcatttcgccttgggggagtgtgcatattttggcgttttt

SEQ ID NO: 13520 - DNA, 2577 bp, Heterodera glycines
  misc_feature (2343)..(2343): n is a, c, g, or t
aattttcagtaaaaaaaacttgttatctgaatatttaccatcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccagtttgatgctattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcactaaaaaacacgttttctgaatattaacaacaaaaatttttagacagtttctaaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtttacaaacattatttattgcgtttcatcctgtagtgtgtaaaaaattttcagtaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctagtagtatatgacccctaaaggttgcgggttggttgcgggtgtttcccgcacgagcccgtgcctatgggaggggtgcagccctttgaagttgccgccccatcaaaaatccacgatgggggggtgtttcaaaaccaaaacctattggaccactttgaagttgccgcctgaccaaatccgatttcccaaattgttgcgggtgtttttttcccgcgccgcgcagcgccgcgggaaggtcatcaatcatccacctgtcaccaaagtgacaggtggaggaaattcaatttaacttttgcaaattttaatcttttgtttcaaaaccttttagcgttttattttctcaatcctgaaattttttttatgatgattttttgatcctgaaattaaaaattctttttgaaaattagccaaaatcgtgaggtttttttcatttccactcactccctgccgatgcgccgcgatgccgagtcgcgcgcaaaaaaaaaaatcgataacggaatttggaagaagtgcaaattaattgatattggcagcaaataattttgattatgaattggacaataaaattactatttaaatccaatttaaaagtaaaatcaaagaatgaataaataaattaaaaaactttttcaaaagtaggtcacctgtcaactaaaaattgattgatgggttttttatttttcttcccttatttctcaatctgcacgtgactttttgttcaaattatttcgcaatatctcccctaaattaggtcaactgtcaataaaatgtgattgattggtttcttatttaaatgtctccattatttttgggtccaactatttcgcaatatggcccgtaattttgcaaacctgtcaaaaaaaaatgattgatgactttcgaaataaggaatatccaaacgatttttgcacggtttttgaataaaatgagacagctgtctaccgaaatgattgatgaccccctaaattaaggcaaccccagacagtcatgtgactagacccctcccctctcgcccaatccgtacacccgggccaaatcgcaaatcattcaactaaatagttggatttcattaaactctcttcacgctctaattttatttctctccgctctatttttatttgcattaattaaatcttctattanattcccgtctttttcttttcaaatctctgctctctttaattcttctgtttcaatttcttgttttaaaatgtcttttaaacgcgtgaactccttccaacccgacgtgccaatggccaaaaaatgggatttccgatcaatcgggtaagtgattttaataaataaataaaaaatatttctaaacaatataatacattatagatataccccttgaattatttcaaaaaaaattttttt

SEQ ID NO: 13521 - DNA, 1701 bp, Heterodera glycines
aattttgaaaatgcccgtgcgctctgggaaaaattatataaggagaaggatttaaaatttcgaaaaagaaaaaatttaaaatcggtgatatcgtcgtataccaagggaaaagggaaaatctcaaaggggtacctcccaaactttaccgaagaattgtttaaaatcgttgttgccaattcgacgacacccgattcatacaggatcgaagatttggaaggaaatttaataaaaggcatattttataaccaggaattagtgaaaacagatggatgatttttacattgtactaccttcgaacacaccagggcaggagaacactacgtcaaaattcacagttcgactccccgagactttggaattgggcacaaattggtcagtagctcagctctctcatcaattatttacccctactcattcaccgcactcggtataaacggtcaagagtttattaaagtatgggaaaacgacatcagtgtccctactcaagtttatttaccggacatgaattttaaaaccgccgggggcctgggaaataaaattaatgaggcattcacacatcattacaaaatcaaaaaacaacgtggaaagagagaagccaaggctgaagataccaaagattcaaaaattgatgtcgcaaagagggccgcagaacgcgccgggagagacgtagaaagacattttaatcagatcaacaatatatcgaattccatccaaacccaactaaacacactacgagaaacaaatcctcaaattttagaagagcctgatataaaaatttggtttgacaaaatggttgagatgggaaccgaaattcaaacatcccgaaatgaacttaaatcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgaggaatataatgataaatcggaaaagggttttagcgggatggtggttaggcttaacgaggcgctcggtgagcattttaaacataaggaaattgaaaataaagaagtttcagaagctgaaaaagggccgcaaaaaagagagagattagccaatgaggatgttcaatttaactacgacagtattgatcaaaaatttattgtctatctttcctctgccgtcacccatatagatttgtcaaaacacctcgcatatgttctggggtttaagaatacaaggctatttcacgcggaagaggcgacttatatgccggatttgacgggaggtgtaaggcagctatacatttatgcaccaaatttaatcgaaaacacaattatcggcaaccagatggccccactcttaagaatagttaacgtcgtcgatgacccgggatcaattagtgaagttatatatagcaccgagtattttcatcgtctacagtcgaaacgaatttcagaaattacaattgaaattcacacaccatttggtgaattcgttaaatttcactggggaagttgtattcttacattacattttaagaaaagtatattttaaaaaatgacacatgtgtttttcgatcccgagtcggtcgattggtcatcttttatcactccccaacatggaagaggacagaaacaatattttgtcaaaagcaagtatcaacggggattcggtttcctcggtaat

SEQ ID NO: 13522 - DNA, 1028 bp, Heterodera glycines
ggaggaggacaaagttgggaagggaaagcaaaacgaaaagtgaaattataccccggcgggggaggagaagcaaattgggattgaaaatggagaaagtgccgaaaggcattggcaacacattatgtaattaccaagaaaggaaatgcaattggcaaatttgaatggcatttaatagggcgcaaatgacaggtaaaattcacaaaacaattttaattaccaattatttcaaatgaaaaatcgcaacattttccaaaacgatgcgattttcgtttttgatctgctgatgaaaattgcgcatataaaatacccttgtcgattgctgataatcgcgcaaaaaagtcttgcgaaaagcgagacgatattcggtgctaaaaagagatgatgaaaccaagaatgcctaattagcattggcattggcacctgcaggcacaaagcaccggcgcactgcttgtgtaagcgaacacaaaaatggcacagcaaatgggcgaagcgacaaattcgttggcattggcactgagcaaaggtgcgacgaagacaatgaagagggcattctgaaaaggaatgatgggaaatgccaaagcaagccacggactaccccaatgtagcagaagaagccaatggacatgatcacactcagttaaagcatcagacgccgtccattttcagacactgaacttgccgactcaattagtaccactaattacctaattagagactaattaggtgcagtgccccactcactctgcgctttgcgccaccaactgatcacccaaatcagcacatagcagcaaaactccccgaaataaatgcacaaattcagtgtattgaagtagtaattgttctccgggtgccgtgccgggttgccgagtcggcacatcacaggcctaaaatggagagatgccaaactagggcagaccagattatccataatcagcaatattcgcacatttccaattgctttggcaccaacaagtaaaagttgcacacatcgaaaggcgtcaaaagacaacaaagtgccaacagccatt

SEQ ID NO: 13523 - DNA, 1319 bp, Heterodera glycines
gatttcgatgaaaccaaaaatcaagaaaaatggcaacgaattgaaggtgccaagattgtcttcatattcattttccagcagatttgcaactgcttattcttcataatctccagtttcagatttttgctgccttttccaattgatccgttgctaccatggcattttgcttggcattttcgcaaaaatttttcatttttcgttcaaattcaattcgaagtttagcaatttttgtttccgttccatttgttgatgcattttcaccacttttgttctctttaatttcataatttaattcctcttcatttaccaaatccatctcccaaataacactggtaaacaaaaatttattttgatcattttgccaaaatttgcaaatatcattcagcattgtgacaacatcaattaaactacaataaaaatattgttcaataaatattggcttcatcaatggtggcaattgtttcaaaactgtaaggtttttagcttaacaaatttgcatcactagggatatgatttttaggggtgtattttcaggaattttggctggtcgattcttaggagtttatttatcgtttttattgcattttttgttaataattttgggcaaaacgccaaaataggtttttaaattttttttaaagttttgtgtcataaatagggctgggatttttatgtgctaaaaatcctgaaatatgtaataaaatatgtgccaaaaaaacccaaaatatgtgctaaaaaccaaaaaaaaggcctaaatatgtgttaaaaatgcaaaaatatgtgctaaaaattggaaaaaccaagtgtatttacgcaaaaaaaaaatcatatttaatatcagtctttatcaattttcgcccgaccgccagtcaaaattttggcgatatcaatcaacttgtaaagtcccggattaatttttccatcagttgaataagttccttccgggaactttgaaatccagtgacgatttaacacagcgtttgatttggctgctttaggcatttaaatatataaagaaattttctaaattcttaagaaacgtaaagtagtcaatttttagggtgcattttcagattttcttgtatttttcttacgatttttctcaaaaatgcccaaatatgtgctaaaaaatccaaaatagcccaaatatgtgcgatatgcttttatgtgccaaaacgccaaaatatgtgtttttatgtttttataagtcgctctaaatcaaaaattgttcggagaaaatgctatttttgggcttctctcgccaaaactaagctgcaaaaaaatatgttaaaacagaaaaatcccagccctagtcataa

SEQ ID NO: 13524 - DNA, 889 bp, Heterodera glycines
  misc_feature (853)..(853): n is a, c, g, or t
tgctgcacagttctctcaagcaccaatccaaatttgtcacccctcccccctcccattctcgtccccctttggcgctgatcggatcggtcagcagcatcagacccatcaaaaagaacggcaaaaaagggtgcgcttccctttacaacaagcgaacggagtgagcagaaagcgaaagggacgagagcggtgaagaggagcgggaaccaatcccgcctcagcttggcccaccccaacccccaagcgcgcggcgcaaataaaagattggcgacacaatggatcagaagaaaacggccgatatcgtccatccatttgaacgtcaattgttcatgagtcaattcgtttggtcagatcgaagggcacaacggtgtcagcaaaagacggcggaaagcgaatgacagcgatgaaattgacaggagatgaagccgaggcaaaagcctaaaatgatggaaacagttaaaaatttaaaaccattccctgagttgaaatataatagaccaaaaataaaaccattaaaattccacaatttgaatgccgtccaaaatatttttgtcagcgaacctcaatactaaaatgccaaataaaatcaatagtaacaaccgctttaaaggcatgaattgaaacgcgaagcaatggacattcgtcgagaattgacgggacgtaatgtcgcaaacggcggaaaattgcaaggcacaaattttagtcgcgatcaatggccaaatgttgcgcaaaatggactccaaagtatggtcactggtcgtatagacttcgacgatggccaaattaattggagaggcggcgaaaattggatgaaaacgatggagaaaagcgatggcattgttcaaatttgggccanatttccaaggaattaatcgcccagcgccgcgtcttg

SEQ ID NO: 13525 - DNA, 3047 bp, Heterodera glycines
ggcaaaccaaggttttaatataattaaaacaattaaataatctttaaataaaaattatagaagtatttaaatatgaacttgagctgctggattcatcctcaaatttgcttagccaagtttaaaagggaaaatttggtgccaattcggccattgaatgggtgcagaaaaatgcgattgccattttgtgcaacgaagcatttgaattaaatatggatgaaaaaaatatgcaaaagcttttctgtgactcattgaaaaatggaaatattacaaatgacaaaaattgagaagaaaacatttgacaaaagccaaattgaaaaagccttagcaaaagaccaaattctcaatgccaacaacaagacaatgtttaaagtattccagcaaaattcttgaaattaaagaaaatttaagtgaaggtaaactatttgaaatttattaatttctgtaagtttaacgacatttctttcgtaaaatctgcatttaaattaaaaacctaataaaaaaaacgttgtttcaaaaaaatgtgagcaaaaatgatttttccttgtatttaaaaaagtgattttaaaaaaaaattttaaagattttattttagtctgcacatacttaggttttttataagcgtaataaaacggaaataaataatgtttttattacataaaaaatcagcaaaagaaagcaaccataacattcataaagaaaaaagttttattttggataagattcccatcttttatgcaatttcagcacattgaccaatcattgccctttttcgtgcatttttttggcacattgatcaatcatcttgcctgttgaatgcctgatctactttaagtgccataattattaattattaaccctacacaaatttatttttcaactcaattcctgggtttattttaggatggtgtccagtcttccggtgtccaattttctggtgtccaatttaacccggtcctccttgaaatgttcgtcgacgtaaaagtcaaatcggtggctaatcagcgaaattccgagtccaagctgacgaggcggcagaaaaatcgaacacagaaagccaactcggcggagataaagctgaaaaaagaaaaaaagaatttaaaattggcatttttggcgctagttgcaaagctactgttttgaaaatttttttcactttttttggtctaaaattttttttgtttattttgatacagaatgatgaacattaagcattaacagcacaattatggcgaataaaagtatattcacgagtttttatcaaagaaaattttgcaaaacaaaagggtcccccctttgccatacttttgttcactgtctgtatgttttatgtgtattgtcatcagccaccaattattgtatatacatatgatgtatcgggcaataaactttgaaattgtcttgctctttctaattatggattttggtgtcacccccccccccccaatttccgaagaattcgaacaaccaagacagaaaaattcgttttttagcgctacaaaatcggacccgaaatgggtagactttttgctcgtctaatcgcattaattcggattcccccgtgccgaaaatcgttcaaatcatatgtttattgacttgaaaatccaaatggaagtaactttttataaatcaaatgaaaaacaatcaaaaatacgaaaaactgtaattcgtgccccccccccccccctaaagcggaacacagaaaatgcaactgaatttctctcccttaaaggtggccatattacatccgatcagtggtggccgaaaattcacaaattttgatgaccaattaaatgctttatcccctctcccccattcaattgtcttttaaacatcctcactttcttggaccataattttcattttcatcgttttttcgaattgataccaaaatctgttctttttcgagcatcaaaaaaggttatggtccaagaatctgaggatgttcacagttgattggaatcataaaatgtaggaaaaataaaacaattttcgattgtattgttttcttggaagtgcattcgagcgccgcagagttctgaaattctcggaaacattttcaaatttttgcctacatctgcccttgtcccggtttaagttggcatctctctcagcagcagccgatgacgggacaacgataaaatttgccaaaatttgttgtctgtccctttacaaatcccgcaaataacacgtcatcgtcatcctgctaaatttgacttaattaaattacccaaatcattaaatgctttcttctcacccaaatcaatgagtcatcaaattttgatctccaaattattttatgtgcgtcttcacttatttcatttgcactccatggaccgttttctttggccctttgttccgcctttttaaacattttctttaaatttcgatcaaaaattattcggttaataatttcttccacaatttcatccgattggccatcattcgctgtgtaaattgccaactttaaaatgggttcgttaattggcatttcttcctgctcattatcattaccaaatgcgttcaacaattttggttcaaattcattaataaaatgtttgttactgaacaaattgtttaatttgtattgataaagattgctaataaatggatttaaataaaagcgcaaaactttggccaacgaatgcaaaacgtaaataattgatggttcttccatttcaaattggtatcttttaagcatgaattttggcttcactgtgttgtgaccggcgaattctctaaacaaatattcgtacaaaatccccaaatatttgcgatatttttggcattctgtccgttcatattgttcaaatctcttccctattttggcacattgcaaattctttcccataaaatacacagtgccaaggtaagcttcatatttttgcgtggaatatttactaatttgtgtttgttgatgacatttcataaaagcaattaacatattgtcgtccatctaattaaaatagaccaattaattaaataccctaacatttggtcgacaagtaaaaactcaccgatggatttgcatgtgaaattggaataaagaa

SEQ ID NO: 13526 - DNA, 1054 bp, Heterodera glycines
tttttcgatgaccccaaacagcaaaagttcaattttttcgtttttgttatttgacagaattcaatccatgtcggatttttaaaacattttcaattgggaacaaaatccttttttaccaagctgtgcaatgcgcttttgctccccaatgcttttcagctgttgatcactgactgacggcgaattgacagtgtccattttacgcacaaaaattgcagacaattgttttaaacaacaacaaaaatgaaaaaacaaaacaagtaaacaaagaaacaaacaaatgaagtaaatgttgtttaatgaaacagaattaagcaagcaacggaacaaaacaaacggcgccaaatattttttatcattgatttttatgatggtaaaaacaaatcaaatgaaattttggaaattttgtcaaaccaaaaaatggaaatagtgtgacgtgcgattgattgattgattatttgacaaaataaatgataatgatgagccgtcaaaaaaagagagagaaaaataggggtaaagagaggattcaacaaaaataaataacatattttaggaaaattggagggggagggggcggctttataagatttccaagccaaaattcatccttttcgaccatcatcaatcaccacaaccacaacaacaacactcatcgtcggcgaccaccgttattgtaacgctggtgatggtcgtcgtcccggctacggcggtggcgatcaccgcccccacgtggcggcggcgacggtgaggcagagcgacggcgacgtgaccgcgagcgggtgcgacgtcgacgcggagagcgggaacggtcacggccacgtgacgagcgacgcggtgagcgggaacggtcacgcgatgagcgacgcgtacgggacggcgtacggcgacgtcttaaatggccaaattaagtattaattgggacacaatttgtgtcaactacgctccacaaccccgctacataggtaagtaatttagaacatgatgccgtcaaagtaaaaatcagaaatttcctccggtggcggtcccccccccccctccccattttccccgaattttt

SEQ ID NO: 13527 - DNA, 934 bp, Heterodera glycines
accgatcacgactcagctgtggctcaccaccgtcggagatgacgtttcgcaagagtctcggccccacgtggcggcggtgaaggtgagacagagcgacggcgacgcgaccgggcacgactcagctgcgtctcaaccgccgtctgaggtggcgattgcgcaagaggttcggcactaagtggcggcggcgagggcgagacagagcgacgcgaccgcgagcgggcacgactcagctgcggctccaccaccgtcgtaagtgccggttgcgcaagaagttcggccccgcgtggcggcggcgatggcgagacacggcgatgcgaccgcgagcggctgcgacgtcgacgcggagagcgggaacggtcccgggacatgcgacgcggagagcggtcacgtgacgagcgacgagtacgggacggtgtgcggcgacgtctaaaagagcggcgaattgaattatgtcaattacggtaagcaaaaattatacattagggattttaaatggttttatgggattggaatttaactgtgattcagcattttatttttgtaataaaattttgggtaggtgaaaggaggcaatcaaaataaggcgcccagtgaagctgtatgtgcgtcgccagcaatagatgaactttttgatattgttccctaatttattttttttaggggggggggataacaattcgtttttgacccccatttcattttacacggggattcgttttcactgatgctactagtcatacacacctgcccggagaacgtgaccgatccgtggcgcccctcttgcgcggcggcgatctgctcctgccacggtgctcccgtcgatggtgatgatccaccgccatcgactgatgttgctgctcttcacgaccacgaccaccattttctactgcagtcgtcgttgtttttgaatgctgatgatgtttactgtacgatt

SEQ ID NO: 13528 - DNA, 3531 bp, Heterodera glycines
  misc_feature (3411)..(3411): n is a, c, g, or t
  misc_feature (3423)..(3423): n is a, c, g, or t
  misc_feature (3428)..(3429): n is a, c, g, or t
  misc_feature (3439)..(3439): n is a, c, g, or t
  misc_feature (3451)..(3451): n is a, c, g, or t
  misc_feature (3485)..(3485): n is a, c, g, or t
tacacccctaaggatcgactttttgggaatttaaaaaataaataattaaaaatcgaaaaattttgagcatgttataagaacttttggaaaaaatttgtttatgtaaagatttaattttattttagcatataataaaaattttaaaaattcgaattgcaaaaaataatttagaaaaaaattttttgaaatatccaaaaacgctgctttagcaattgtttaatgtttttaaagtcaattctgattttcaacccaacttttgacattttttgaagggtaaaagccattttttgcagtttttaagttgtagatttgggcatttttcgaaattttaaggcatatttaggatattttaatgctaatttatgcgcatatttgacaacttataacccgaataattaataaaaaatatttccagaaaaatagagaaaatgaacattcattcggcccaggaacccgccaatggatttgatttttttacggattgacatttcggtttttggactgaaaataataaaagcaaaattcagaaaaaccttaagaaaattaatttttctatctaattcttgaagaaattaataattatttagcgaagatatgaacccataaatattgtaaaaaacccaatttgaaatagaagtcaacactttttaaatgtttagtcatttcttgccgcagcccttttttgccatgtcaaaagctttttgccaacatttggtcatgcccaattatgcattggtaaatttcccgcaaaaattcataatcgcgcattatgcggaaatacaacaaattaaatgcctaaaaaaaatgtattttcgattcgcgtttcggtcttgcactaaaccttttttttcttgaaaattttgacttttaatttttttaaccgtaatgcaaattaataggcagctaattatcgcaggcattgaaaaaatatgcttttacttatatactcatttaattcttcgttaattatgaccggaaactacatggacaaatcacaccaacttctatttacgacaatgaaaatacaaaaaaaaggatacggtagacggcgggggccggcgctgcggataggcgccgccggaaaattttgaaaatttgattgtgatttgttaacagattttcaccaaaaaaagacaaaatttttgcgattttggtcaatttgttaagaaaaattgtgcgttattttttggggttgggcggtgccattggcgctgccgggagaaaaattataacttttgacccttttaaacagattttcattgaaaattgtctatttctaggttaaatttagtaaaaattaatgattgttttgacaaaaggccaaaaaatttaatttttttttcataaaatctacatttttacttcatacgcaaaaatgcgattccaagtacaatcttggaaaaaagtacagttaaacttttccaagcacaaaagccgaaatccaagtatgtacttggcattcaagtacgaatccgagccctgaactattataatgcgaaaaatactaatattttaataataaatttaataaatcagatttaagcaattgtttaattcatattcattcattatggattcataatcactgattatttttaatcattttttggcaatttattaattaaagaattggccatccagaaacaaaaagtcacaaaatgaacatttattcggcccaaacttattacaacaacacatcgccagcagaagtgaaaaaggcaatccaaatggaattggattttgttcatcgccttttgctcggcatacaaaatgacaatttgtgggcaatcgaagcgaggcgaattcaaaattttgtaatttttgtgaaagcgccatattatccagttgcaaaaaagttattgccagatatgcacaaaaaagcgactttggaaaacttttacggacaagtttaatcttgattttcagtttggaaagagagaacatttagtggtatcgaatatatcaagattttcaaattgggttggttatgaaaaaatagacactgttaaagtcaaaatgggtcaaaatatgaagctaattttaaagcagaagtcaatcgaatcaatggaaaattggcagcagaacagaactcattatacggagataattgacgaaagctcagagcaacagaacaataattatggacaagggcgatcaaaacgccaattggcaaattgtaaaatatgcggacgacaatgtcagtacattttctacggtgtcaaaagctgtgaaagtgagcagatttgtttcaaaaatgagaaaatgcaataaaatttttaattaatttttttattgttatattaatttaccagattaaatattaattaaattggaattgtcggatattgtaaaatattctttttgaaattgcaggttgtaagcaattctttcgtcgtgtcgtcacaaaacaaattttgttcacttgtccaagacgaaatggagttggaagttgggacaattaatttttgccaaaatcaattaaaatattctgaggctaattagctaataccgctggtactgcaaatcacaataatttttgttttatggaaaaaagcggaacggatttttttttacttttactataaaaatcagttaattatatttatttgaatttattgcctatttcactttttacgaagaattttttccaaaaaataaccgtatagcgggcggtggccttgtccagcttggtatggaggcccaattctgtaattagaaatcgggcactcggcgccaagctcgtcgagtacatgcaatagttaagtccggttggtggcgactcgccccgatgtttgtccccggccgttccggcatgctttgcaccgcgacactgcggcgccgttcgttgtcttgtttcccgcttagatgacccagtcgtcattggctccggaattacgcactggtattgctgaacctgctgcacaaggtccacacagatttgaagaagttgtttggtgatcgaatcggcacagttgttgaccatttgttgggaaatcgcctcaagttggtcattgagaatggtgtagtgatagtctgaagtgggcttctttgaggcgttgtctgatagggtagaaagatgtgtagaaggacgttttccaaactccatgagaatttttgaataataataattttttgaataaatacaatttttgaattatgacaaatattactgccatttttgaccatcatttattgtgtgcaactaattccaacacaactttgctatgcatcttccaatttgtttgttcatcaaaatatgtaacacaaaatctttgaactaattggtttaacgcaatttacatgcatggtcaacaattccatcacattaaattatatggccgaaattctgcataaaatacacgtgaataagcaataaaaattgtcaaatggaaaaaatgaataaaaatttanattttgaaattntaatnncgttgtctanatcactgacaantctgcagggcattaagaaataatggcgcgagttnaaatcgacagattttgatttttataaaaactaaggggagccttttt

SEQ ID NO: 13529 - DNA, 897 bp, Heterodera glycines
  misc_feature (23)..(23): n is a, c, g, or t
  misc_feature (71)..(71): n is a, c, g, or t
  misc_feature (891)..(891): n is a, c, g, or t
cactaactatttttgaataaatntaatccgtaagaatttatccattatgtcatgtgataaaacgcaatttntaaattaatttaacaggaatcgcttcatcattaaattatttcattaaccgctccaattgacagtggtgctggtgtcatcgtttttccatttctaagattaataaatttgaaaaattaaatgaaatcgcagtttttttaatcaaagttttattacataataagcattttaaaacatacatttgtcctccatttccgttctaaaaaatttaattttttatatcatatgtttgcaaaatattaataataacttaatatatgattataataaaaaaaacattttgagcacaaaattagacacatctctgtttagaaaattcaataacaaactagagcgtgaaaattttttctggtattaatgaaaatggcaattataaaaagcagaaaaatctttatgaaattgaacgatggttcaaagcaagggcgtagacagacccgtggcttcaggggggcgggggggggggggtggctgaattcaaaaaattcgatttttaggggtgtatttttcttttttcttcaagaatgccattcttgggtgtgtattttttcagagattcagaattaattgtttcaaaaaatttgccattttttctttaaaaaattttattttttgctaagtagggcccgggaattgccatccgcttcacaaaataaatttcgcactaaattttgggctgaattttgtggtgaacacattttttggctacatcatctaaattttggggaacttttataacacattttttcagggattactgtctgacctattatacttggtcgcatactgttttttaattaatgtatattttatagttttacaaantttggt

SEQ ID NO: 13530 - DNA, 2075 bp, Heterodera glycines
ttggaagtggcgggcaatttgtccgataccatccccacttaatgccatttaagggattgatgactgggtttaatgggtgggaaaatggcattgaattcaattaacaaaattatgattgatttcatcaaatttgatgtattcaaatgccattttcccttttgccgagtgatttacgaatgagtgccaatgacaaaagtgacgtcactccaagactgacctaaactcaaataatttaatcaactgacaattctttctggcatgccttctccgtattttctccagtggtcgaatggggcgtgaaaaagccgaccaccgtaatggtggtgatcagtgccgacggcatgatcagcgtgaacaggtagtaggaagggtttcgtttgatggagaagtaatagcaaatgtccgggtaagggttggggcaacaatcgtaccatctcaaaacgtggcaattccaatcaaaatgataagatttgtaaaattttcaaaccttctgaacgctttaatgtccccttttataggtttaacacaaaatataaattaggcaaaaaatttattccctttgcggggagggctacaaaattgtggaatcaacttgataaagaaatcattaaaataaattctttaaatcaatttaaaactaaaattaaactccttaacgatactcgaggtcgacttaatctatgacatgtccgcagagtaagtggattactcccttttgtggacttttttcttttttttgcataaataaattatcgctaactaattaagcatcgattgctcttttttgcctgacttgaggttggaccgtgtccggaagtcgatcagagtccattccatgttcggaatgtaatgggtcagtgaggtgctttgcatgaatgacggtcgccttgtgctttttggtccgccggcgggggaagaagcgcgctgcactttgttgaacttccgctcgaccaccgatgtgttcatgctgctccgattgaggcccatccaaaggcccgggtcctcctccgccgggcggagcatcacctgcgagtgatcagttttcgctattcccctcctttgatttgggttaccgatcaatttgactttaaattgttaaaatatttgttttaattttcctaggctttccaatgaaacacttttactcaaaaacccattttcaatgttaataaattcccaattgcataactttttatgctgatcaaaaaagacatttcatcaacctggacaggtctacttcaaaaaatgatcatgaaatcgggaaaaattttgacaaaaatttgaaggggcctggaaatttcgtgtgaataaaagaaattttaaagattttgtcataacgaactgattattttggcataatactaaatttatctatcggtgtcttttatattccatggtgtccatgaccaattttgcggcggggtcctgtcaccccctgcccattccccccccccccccctccacctgagagccgtcgtaactccacgaggccagcatcagatggcagatctgctgatcaaatggaaaccgatgcttaaggacagatgggtttgtttgtccggaccatatggcggtgattgacccagaccaagttcaggtggcaagtgatgtcggtgataatggcacggaaaagcgacacgcggccgtcgtgctgcaccagcgcattggtcatcatctcactctcgcgcacgttcatgttggcactttgtgcaagtgagaattacaattcaaaaaaaccaaaatgcgagtaatcaccaaggtaagtgggcaattagtctatgaattagattggactcggattgaaccgggtccctatggaaggtgattagttaatgggctaatctggtcagtcgtcggtctgaattgatgccgatccgactgagcaattttataaagacccaattaacaatcaaccaatgaaaggggaagctgaacttgttgtatacgagcagatcgggccgccagatcatttcggcgggaacgtgaagctggcggatgtcgccgaattttgacggttcccagcgaaggaattcgtcttgccaatacttcaatttttgcgtaagcaaattaaaatt

SEQ ID NO: 13531 - DNA, 1479 bp, Heterodera glycines
ttttaattaaaaaatatatgcttataaattactggtttataaaatatcttaatttagcggggtttaagaaggcattttagtttattgcactgcatttttggagttctcatgaatggttttcttatcaataacaaataatttatttgtttgacctccgtttctcgaccggcccaaaaaagagtgaccatgccagtcatacctattactgaaaatatttttgaattgctgtgaaaaatgtcttctggttctaccccctccccgccctccaccgtctgttctgtgtccccctcccttttttgtgtgccgtccgccactttctcacaacggtgccaaaaatgtcatggcacactcaaactattggcatttttaaataattaataaaagaaaacttgttaatggatttgaaaaaatgccatttccgagttggcgaactggggggggggggggggggaactgcttaactctgcggttggcaagcaaataaatatgaaaattaaaaacgtgccaatgagtttggcttcgcgagactgaccaatgctatgcaaaccatactttagccatgttttctggttttcttctgaaaaagtcaatcgaacttccactcaaaagggaaggaataaataatagaactatttttctttgttttttccgatttttacaatttgattgtgacactgtatgaacagacgaaatgagcaataatctttttgtctcgaacatgatcagaatttctcttattaagtgacgtttcctgttaacgattgctttgtctcccctctgactctgtgctctcccggtctgtcaacgcgtcgtccgccggcggcattttcagagggacaagtcgacggtagaagaacaaccaaaggacgatcatcaacacaatttcgcccatttccaccagccaaatgacacgagggccattgttagtgtacataaagctgaaagtattagaaatgggattgagaattcaatggcgcgttaaagcatttatttatccgactcaaaactgatcaatgtaatcagattcaagactctcgactaccccccgccctccccgtccaacccgatgagtagcgggcccaacattcgtccaaaaccgccgaacatctccagcattccctgctgcttggattgcattcggggcccaatgatatgcgagaaaagtgtgttcatcgttatgttgatgtttgagaaggctattcctatgcaagagctgatggcaatctgtctagggaaaggaattttcttaattttttttctaaatattccaatttctgaaaattatgcacattaattttgtgtcaagttttttcggattattatcttctaaacttacgtaataaatccagatattgacgcgggtcatatctgcacaccaattcaattggctgatatcgcaacccttcgaggaattaactgaaatcgaaaaattacgggtataattaaaaccttctaatggccccaaatgatgctaaccta

SEQ ID NO: 13532 - DNA, 1770 bp, Heterodera glycines
ttgccgggccgggtttgaatcatgttacatctttttcgccacccacacaaaacggagacaaagccggtatttcaaacgaaatttctataaaattatttattacttaattttcgtagaaatttttttcaataattttctagaagtatgtgggatgtttggcagtgtgaaccaaatttttttttgtagaattcgtaagaaaatttgaactatacaaaatgaaatgatccataataaaaaaatgtttagcatgggtgttttttcaaaaaaatgaacgcggatccgacttgtcctccacaaaaatataataaaaattaagcctcagacaaaaactatacatttaatgcacttgggagtgcgtggtgggttgaccgacgaaaaatgcaaatttggcgaccgacgaaaaatgcaaatttggcgaccgacgaaaagtgcaaaatttgctaaaattttgactaaatcaactcataactttgcatagacgcattttggtatcgtacgatagccttgaattgcgctattagcttgcaaatttaaaaaatttttatcatgtttttcaaaagttatgacaatttttccggttttttgactttaacctaagcttttgcggacctttcacccaatttgtaaaatggtcggaaggaacgaatcagtgaattgaattggagaagcagcaattttataacgcccaacggcagcagcaaagggcgcatcaacagcaaatacccagcaaaaagtgatggtactgaattcaggagtctttttgtgtcggaattccgtgaattttttggcttacgggatttcagacaaattggaaaattttggggaaagtatgaaattttcccaaaaaaaaattggctcaatttgctgttccaaaattataagtacagaattatttaagacatttttttgtgcacttgataaaatttgaaattcatgctatgtaatacaactttcaatgctgattaaaaagtaaattgcatcatcctgatcagaacactacctccggagcaatcggtgtgattaaaatgttagcatgcccagcggagttgggtctgctctagcaactttctaacatactaaagcggtttacctcagttgggccggcacggttgggcacaacatatatttttccactgtaactttctctaacttttttctttgacatacaaatccaacatagttggtatcattcgaaagcttaatctatttagaaacattttctgaagagctttcgaattcattttgtgagattctgagcatgaaaaatcgaagttgatttttttgcggcactttttccaaaaaactttgggaattgggggggggggggcggggcggcggagccgataggaaactgttggacggatgagtttgccgcctttggccgtgaagtaatacttggccatcttctgcgagctttggttgtacgacggtaccaattcgagcgctttgctgaaagccgagccgccgacgccggccatcagcgaagtgatcaggtcggggggcaccgcgtttttgtccagcaaagcatcgatcacatccttctgcaatgtcgaattactacccgatcgctctatgatttgtctctgttttccatttcgtccccaatttcggcaccttcagagtgctcagtcgctcggttatcgtctgcggaagttccacgcccattgcggaagaacagtccgtcatcgactgaaggagccagcgtcggaatgttcggctgaaaacaaatgaccgcgctcattttcctacggtgactaactactatctctc

SEQ ID NO: 13533 - DNA, 2181 bp, Heterodera glycines
  misc_feature (2163)..(2163): n is a, c, g, or t
  misc_feature (2178)..(2178): n is a, c, g, or t
attgacctatcaaaaagccacaaaattaggatacatcctcagatctgtctaccttgattttgacccctgttgcttttgctgctcccacagcactttcagctcccacaactatttttgacagccattacatgcaggctggaagaattcttcgcagtaatattcctgttttaatttgcttatattaaaaaaagtccaaaaaaccaaatcataattaatgagaaaagcataaaaaaccataaaatgatcaatcagctttaatgaatttcttcatcagagagttgtcaaatcgaatttgaaattgggcccaaagtttgcctcaatttggtcattagacgagcacaaagaaacgaatggatgtaaagaatcatcagcaaaagatgaaacaacgaaaaatttggagaaatctgtgaaaaagttaatgacaattgaataaattactatttatttatttatttgcccacccaaacgaagtccatttttggtgaaaaagatttgccgattggacgaattgaagccaattcctacggtatcaccagcaccgtatgaatattgggcatttctttcctttacttcttcgttaatccaaatatcgccataacagtcatatgcataataagtgccctttttaatcatcaattccaattttgtctgctgtttgacggcgaatccaaagacgacccaactgaaaaataaataataaaggaataattattaaaataataattatatttttaaattttactgaaaaagtttaaaaatcttacaatttcttatttttaattgaaatttcatagtaaaaaatgtcggacgaattattgttgaggaaaatcggatatttagcgaagacggaacaacaaccttttaaagagaaatataatattaagtaaattataaaaaaataccatattcatttcccttatgatggacagtcaaatttttttcgccaatgattttgagattaccataacaaacattggtagcccaataattttgtcggaaatttaaaagtgccttaaaaaattcaaacaaaattattttgattaaatgcataaatacccaattaatgaaaatataaaaataaatatatttttaccccttaatttactttctctaattcattgacgttttccaatcgagtcatttgatcaatttgcaccattgataattggtccaaagttgctaaattaattttaaaatttaaaaggataatttaattaaataaaaattcactactataataatatcctctaaaaaattctttaaaattgaaatttcttcgtcgttacattcactcacctttgttgttcatgtttttgttctactgctgtttttgcttcttctcaaattcacttattttttccaacatttttgacaattgattcttagtagcttaaaaatcgaatcaatttttaaatttaaatataattatttaatattgacaaattttattttcgttttaatttctcctcgccttttgactgttctttttgctttttttccaattcattgactttttccaaaagtttcttctgatcattttgtaattgtgagaatcgttcctcagcagcagcttaaaaagtcaaattatttattttaaatgaatgactctcgaggaactaacaaataagcatgaaaaaatagttttccagttggtatcattcgaaagtttgtgcttagttgccccaaatttttgtcagggtttgatgcttaccttcgtttgttggcatttcactttcttctttcttttgcccacattcgtcgtccagatgaaactcattatcatctgatcctgaaaatattttaaaatattaagtttttgacattctttaaaaagttcaccccaaaggtttttcttggtaaaaatttttggttaaaaatttttcttattcgaaaactttaaaatatttaactaatttcgttacaattgaaatatttaagttttacatgttttttttttacctaaaaagcgttaataaaaattttatgctttatttaaaaatatttatgactatttaacagtataattttgatactgtatccttcaatttcctaccgtttccgtcttgtccaaacaaatcagcagaacttgcgattgatggttcaattgtgttagctcgattcagctcagcaattctggcaattagaacactcatttcctccganagtgctcagatttgngaa

SEQ ID NO: 13534 - DNA, 3113 bp, Heterodera glycines
  misc_feature (22)..(22): n is a, c, g, or t
gtgcagtttacgtatgatcacntcgtcggttgtgaacatgtgaagatttaattaatatgtaatttatttctacatataaatttttgcaatatttccccttttttcatatgactttaacattgtaaaaccaaaaaatttcaataaaaataagatgtttaattatttattcttggttaacctccaattcacacgcagctgttcttcacatggattatattttaattagtttttgaatttagaaatgaattttaatttgtaataaatatattaagatttaaaatatatatttttatattttcttcttttagacatataaatttaaatttattttcattttattattattttttgttcttctgacgatttttatattgctgaaatcttaaaaagtttatttattttttctcatatatttaaattattaaaaattcgaaatattactcaatttttttatataatcctgggcaggattatttaaattttctcatttcgtttaattataataaaaaggaacaccaaaacattttttagataaaattatttaattaataaattttccttcatcaaatacatgctataataatataatttttttgttcaaaatataagaaattttattttacatctgaaactgtcatttcctaactatattttaaagtttacgtatataattatttttaattttctaacaattaattttaaatgtttatgatccttttgattaactttttactattttgttctaaggccataaatattatttttaagtaggaaatatgtaactaaaagcgcgagttattaaaattttaatttctcaattttcgtaattatatgtaaatatgaattcatttttgtataaaaaatttaataactttaaaaaaataaaatattttttttattatttcatttctttttttaatagatattaattatatcatattttcattatatctttgattaatggttgaaaataaattgtatttatttattatttaatcaattttattttccatttcgaaatatacatattttaattttgagtaaagaattatttcatttaattttcttgtaaaaatttattctcataaatgcatttttattcaagtaggtaattagtttataatttgttgctttatcgtgacgtctttctaaataataattttgctcaattttaatctattactacttaagataaaaaattatagtattcgatttttgaaacattgtttttttattttattatgtaattaacttcataaaaaagtgaatatttttattttttagattataatgaattcgtttaacacaacgatttttattaatgataatgtaaatttatttattgctaaaacattcagctccaaatattttatgataaataaattcctaatatcagaaccatgcaaattttttcttaaaccatttagtttccaaaatgcattttgttttttatcttcaaaaaaccgtggtaaggaggtggcacttttcattgatttaatatatttttattttgtttttttctctcaatattttcttttaactataaattattattttcattttattattttttctttctagtttaaagatttgatgaataattttgagggttaaattattttaattgttagatatgacgagactttttttaatggttaggaaaatagattttggtagtttttggcacatatcttggagatttttaagaaaattttttaaagattggccataaacgatcataaattttcctaaattctttcaattcggattaatcataaaagaaagtagttagagactccattttcaccggattacggtagccccccataggtgtgggaggggtgcatggccaactgagcgccagccatttgagcgccgccaagtgagcgcgggccatttgagcgccagacttttcagtactgaagccaaaacctattgcgcgacttttttttgaaacccaaacctattgcgcgacttttttcttgcaaacccaaacctattgcaggggggtgcgcgacttttttttggtgcgcgactttatgcaaattattttaattaaatttatttaattttaaattattttaaacgtcttaaaggtcaaagacgttgaatttaaattcatttaaaattctccaaaaattccccgcaccaagcggatccgaaccccaggggggcggccagactgacgcactaaccactcggccacattggcaatggataataaacattaatttgctctcataaagggaaaaattacgtcaccagcggcgggagggggcgagagaagcaacaagcagatgagagtggctgtaattaagaacaagagagacacgctgtgaaactggcgagggctaatgtcatgcgaaaggccgttggcaagaggtcaaaaaaaaaaaaaaaattaaatgaccaaatttcgaatttaaaaaaaaaatgttccaaaatgaggggtttattataaattaatatttttaaataatcaaaaaaaaaaaaaaaagatttatataaatattataaattcttgacatttaaatttaatctaatcgagttttttcatttaagcatatatgctgttttttaaatgtattacatttttttaatacttttaaaaatatgttatttaaaaaaaaatcaaaaaaaaaatccaattcttttttattcttttttgtctcaacggtcaccagacaccaaagggccatctgtcacaacttttgaccaaaaagtgagaagggatggcctaaaataaacacttttgaccaaaaagtgagaagggttggcctaaaataaacacttttttaaggggaaagggtatccgaatgtgtattttgcttttttcgccatttacatccaatccaaacaattaaccctttaatattaaaaaaacattttttaaggaaaaacccaccaaaaaaaatttttgtttacagtatggacagcgataacaaggaccgccgggcagtcgttggggttgtataaatagtcaaatatttccattaataataaaattaaataatgtgattaatgaatttacagatgtcatcacattaagtagcgatgaaggcgaaagacataaggaggaagaggtggagctggtcacgctgagcacccgacgc

SEQ ID NO: 13535 - DNA, 1288 bp, Heterodera glycines
aaaagaagaggacaaaaaagcggacgaaaaaggagaagaagggtcggtggatgaggtgaaatacgaagtaccagccaagaagaaaaaaaagtgaaatttgttatgacatttggcatgaaaaaaatgctttgttgtgaaaaataaattgttaagaaaaggaaattgtctgttttatttgtgaaaacatatatatatatatatatatatacatatatatatatatatatatatatatatatatatatatatatataacattgaacaaaattgaaaaaaaaaattttttcagaaatataaatcagtaattttattatattttaattaatgattaatctgtttatcaaagattattatcagggctgtcaaaatttacaaattaagtcgtaaaatatgcacacaaaaaaaacttgaaaattaggggtgcaaaataattaaaaaattttattcctcataaattttatcggttatttttgcaatttcaaatcaaaaatttgtcaagattttcggcaatgatgcacactgttgacacacacgcgcaaccattccgatttgtatttatttttagacataatcattttttccaaagggattttcaaatcggaaaattttgacgaaaaagggcaaaatatgcaaaaaacctgaaaatattggtaaaatatgcatgaaatatgcagaaaaaaacatgcataaacccaaaaataggcaaataaaagtcccgatttttatgcgcaaataccaaaaagatgtttttcctattaaataccctacggagaacccaggagaaaaaatgcatttgcatattttgacagccttgatgattatattattttgaattttgcaaaaaaaaaaattaaacacaatcgaagtacaaagtttcaggtctttgcggcggcctttgcagggggctccgatagttttgcttaaaaaagtgctttttattgaagggcctattaaatatatttcatttgtacatacattgaaggcaattattggggcactaatgtttggtcgggctctttgcatggcgggcattgtttgactgtgttggcgtcggtggattctcttctgaatataatagtagcttttaaccataataaacttttaataagtaagtaaaaattaaccataagtaaagatacggcaccaatgatggtgaaagtgcaaatcttgcaaaaaatttttttatttgttacagttataaatattaacattaccatcagaataattgtgataaaaattgataataataataataatgatgatgatgatgatgatgatgatgatgata

SEQ ID NO: 13536 - DNA, 1818 bp, Heterodera glycines
  misc_feature (103)..(103): n is a, c, g, or t
  misc_feature (1710)..(1710): n is a, c, g, or t
tgtgctcgattatgcattcgaaaattcgggaaagtatggcgcaattcaaaaataactaatgttaattaattaattaattaattttaaatgtattttagtccanccaccgcttttgtggccgaatctttgctgggccccgttggttataaattcttcgccggcacattcattatttcattttgtagcacttgctgttatgtgtcaatttttgtgatcattcgatgcaaaaatggcggtaaattttggcattcatttgtttggcattttattttgtgccaaaattcaattcaaaatatttttacagtaatccaacagacgaacacacgagttttacggtcaatggtcataattttgtcgattaacattggcggatatctgaccaatttggccatatatcagttgctgtatgcatttggctcacttttggggtattttaaattaattttaattttaaatttttcaaagttcttaaggcccccaattcgagcttggcaagttggttttatttctggcattctgttaaacgctgctgcgggatcaaatgcgattgttctttattttaacaggtcattatcattatcggattattatttttttttcatttaattaattttaatttattactttattaataattaacttttagcactgaatatcgccgcgtgttcaaaaaagaatttcgcattttattcaatcgtttttgcaacacaaatggtcatttttaataaataaaattttataaaaatattaatctatttgtatttaacttttaattttagcacttgttgttctactatcaaaaaatattgaatacaatttttttaaacaaatatttaaaatttgtttttagctgttcaaactattggcacaaatcaagtgcgaagtgccaacccaaacaataaaatgaacaaaatccgatcaagccaacagagaaatgttcatacgatcaatctgaatcgctaatgatacggaattttcgttgatatttttaacattttttatttaattgaaaaaataatggaatttgattggaattttgtattatgcaagataataattttgtaaaactagaaaaatttattttaaattaaattttaaaataattatttgttttaaaaatgcctcataaacattgctataaactgaaaaaagttaaaataatttgtattatgtttcaaaaaatttatggtcaaaaaggtttcaaaactcaactttttgtgagtacttttgaacataactttttttttgaaagttaattaattttttgaagaaaaaatgcatgccaatacaaagaacatttagcactaatgtagaaaagcctttcaaaaaataaatataatatcctaaaattttgaaatttcgattttcaatttttttattaattttttttattaccacccctcggtggatttatggaattttctaccaccttaatttgcattgcattttttctcggctttgttgacacagttgcgagaatggcgtcggactgccggaagtcaaaattggcacgacctttaattagccttgggcaataatgtttagctaattaaaaaaaaatcataagataaaaatgattttaaattgagtgtgaaataatgaaatttgatttttgtgagaaaattttaaaatagcggatttagtaaatttactaccaccttaattgcattgcagtttcttggcttttgaaattttggcattttcccatgngaatttgctaaagatttctgtgtccgttaatgaaatttttaagatgattgtcccacttttgtaattaggcgaatttataaactatattttgcactttttttatttttt

SEQ ID NO: 13537 - DNA, 2280 bp, Heterodera glycines
  misc_feature (320)..(320): n is a, c, g, or t
tgctcaaatatgccgcctaaaagaaaaacagtcattatcatcgaatgcgtttggaaagccgccaacacgggccgatttgcccattttcagcatggaggaagtgcgacgccatgggaaagacgctgacagaatttgggtcattttccaccaggtagaacaaatatcaattacaaaaaaagtagacacaaaaattatgtatagcaaattttttagggggtttacgatgtaacagaattcattgcaaatcatcccggtggcgacagaattctgctggcggcggggggctcaattgtaattcccatttgcgtatttaatccggnattagcattccggaaccttttttggacagtttatccctcacctaaaaagggacaaagggatgggaaattttgggagggaaatggcaaatttgaatcgtttaaagctttaaaaattccccaggaaatttgaacccccacaaaaaaggttcccccccatttcaatttcccaataaaaaaaaattttttaaggggggcccccccggggggggatcctttttttggtgcggcccccccccaaaaaaatccccccctttttggccccccacacggggaaaaaaccctttttttggcgggaaaaacccccccccccccgtgttgttttaaaaaaaaaatttttttttaacaccccccaaaaaaaaattttttttttttccaaaaaaaaaacacggggggggggcccccccgggggggagaaaattttttattggttgggggaaagggggggggggaaaaaaaaaaaaaaaaaattgggggggttccctccccccaaaaaaaaaaaaaaacccgcggtattgtttttttttttttttttttttttaaaaaaaaaaaaaaaaaaaaaaaaaacccccccccccccccccccccccccggggggggggggggggggggggggggggaaaaaaaaaaaaaatattttttttttttttttttttttttcttccccccccccccggggggggggggggggtttttgtggccgccccgtgtttaaatttttgggggcgcccccccctttttttagtggggggggcccccccggggttttttttttctttttttttttttcccccaagaaaaaaaaggggggaggatttttttccccctcttttttttttgtgattttttttgtggggcccaaaaattctttctaaaaaatattttttacagtaacccaacagacgaacacacgagttttacggtcattgatcatcattttgtccattaacattggcggatatctgaccaatttggccatatatcagttgctgtatgcatttggctcaattttggggtattttaaattaattttaattttaaatttttcaaatttcttaaggcccccaattcgagcttggcaagttggttttatttctggcattctgttaaacgctgctgcgggatcaaatgcgattgttctttattttaacaggtcattatctttatcggattattatttttttttcatttaattaattttaatttattactttattaataattaacttttagcactgaatatcgccgcgtgttcaaaaaagaatttcgcattttattcaatcgtttttgcaacacaaatggtcatttttaataaataaaattttataaaaatattaatctatttgtatttaacttttggaaaataaaacagtttttaaatatttttaaacaaattttaaattaaaaattttttagctgtccaaactattgacacaatccaagtgcgaagtgccaacacaaacaacaacatgaacaacatccgattaagccaacagatgaatgtgcattcgatcaatttgaatcgctattgaaatggacttatatatttttttattttcttttatagtttttttcttaaaaaaataaaattttttattacgatttggcattatgaaaaaattaataaatttgtttgctagctgtttaatgatgtcaagaatttggcacagtttctattttgttccaaatttggcgttgacagtttctcatttcattttagtttttttcattttcttttttgtatagtttttccaattatttttccattttccaatgaaaatgaaaataaattcctttctgcatgattctgcagaatgttagatgatgcagaccaatgaattccgactttaattagtcattagcagaatttataaatcaaatgattcggtaaattcaaagaaacttaaaaaatttttaattccaaattgtgccaataattaataaagcctataatctgtttgcc

SEQ ID NO: 13538 - DNA, 3480 bp, Heterodera glycines
  misc_feature (3373)..(3373): n is a, c, g, or t
  misc_feature (3379)..(3379): n is a, c, g, or t
agtgagtaaaaatgccacaatagtgaagaaatagtgacaaaaagtccgaaatagtgacgaatagtgacatattttcagccaaaaattaagcaaaaataatttttattcactgattgcattgcaaatgagtagggctgggattcttaagggcaaaaaaacaaaataggtacataaaaaataatttttaaaattaaaattcttgccacgaaaatacctttttgagaaaatttttttcatttcttaggagtgcttttaaaatttttttttgtcgattcttaggggtgtactttttgaaaaaaatgtttaggtatatatttataaaaaaattacatcaaccgtaaaataatctaataaaagttcgccaaaaataatcaaaattgattagccgctacagatgatgataactattttaattaaaaagaaaataaaaaattatatgaacaaacgaaaatatagatttttacattcagcataatagaaaagaaaaattgaagaatcactattttgattaaatatttaaacagattatattccttaagtataaagtgtttcaaatttatttgattttaaaataaagaaaagtaaaaaataattgaaacaataaataaaaaatttgttaaataaattttgaatgtctcggaacagttgaaagcactaaaagacactacaaaacatgatcaacaagagaatgtccaatttaagtcattattaactgtgaaaaatatattatattatttattttattaatttttattttgcatagtttttatcagacgattggttaatggcgatgtgctcaaaaaaataatattgtatcaatttgaaacttaattcaataaaaaaaagaaataaaataattatttaaataaatacaaattagtgaataagaaatggagttataaagactgtactacatttcaataaacaaagatatgattaaaatattaaaaatatccaaatatataggtacgtttaatacatcgaactctttctacgctaggagttatcacatttcaacaatttcaatttgccattatattatgaatacagaagcaatagtgcaattaaataattactatgacaatgaaagtcatcatttttaaagcgatgtatacgacatcaaaaccaaaagaaaaactaaatgaatttttattttaatataacgatttactaatttcttctaattttatttaatggtatcaaaagctaaacttttatttattcagacaaattaataaaagctgtttattattcaagaccggaggcatgaagtgtcattgttgaataatcaaatacaataattacttgcttcatattaaagaaaaaaataatacaacaatttttgttttaaattaataaaacaaaaattctatcaatgggtctaacttggactatgaattcaacgttgttacgatcgatacgtgactatttataaagaagtggggaagattcaaaagtgaaaaaatttgtgaattattatatcaaaatgaatcaacggatattgatcgtaaataacaatctataagcttattatattttataaaaaatgaaagaaaagaaaaaaatatatgttattgttaaacaatgatatttcttaaaaaaataaaaacctatttaatatgcaataggtaatattaatggaaaaatattatttggatactaaacaaagaaaatatggcatgcacatgtcttaaataattatcttatttcaataaaaagtaaacatctgtaaactaataaaacaatattaatttaaatatttaatttagacataaaacaatatctaaaaaatctaacaaaaaaatttatacacaaaatttttctctaattgaaaacctaaacactaaaataatcaatcgatgtaattaaattaaaatatatggaataaaaaaaaatatttataaaaaattacattaaaattaactattagtaaaaatattttaaaatttattaaataaaaatttattttttatttatactttgaagggtcgaaatcggcaaaatccagattgtgaagttttgctcgaggaaaaaacatttaaaaattaattacaaaacgctaagttatatatatgttatattgacaaggcaactcatctcaaaaactaatttgagaagaacgggaatagctggggggctgaaattttgcacacaggggtaactcgagacggcgcatccgggaaaaatacggattttttggtccggtggccaactgagtcccagcggctggaaaactgactttgccgccagtctcagtgttacgaaattttttgcttttgctttcagagcttagtggaccccaaaagcgaaatgccccaactatggcctacaactttgccagcaaaaaatttttgatcagatcaaaggcctgacctgtaggttaggcaacgtaagtatcactttttttggacacttcagtaccaggcgaatagctcgtaagggtttgctcggagcagggggtcgccagcggacttattgtagagctcaatgagctcgatttttccaaattttaaaatttcgaaaattttcaaaatttttcgagttaggcctaaaattcggtttttcggtttttgaattttatgattttttaacgatttttccagggaaaacgaagaccacttccaaaacatcgttttttgagctctatcgattagtgatgtttttagaaaattttcgattttttccaggaaatagaaaaattttttggcctaagcgggacatttgagtcccgggcccataactcgtcgggggttggttctagccaaaaattgccttagagcaaaattgtagagcttttaaaatgctatcgaatggtgtactacatgttcgaaaattttcaaaaattttcgagctaggccccctagaaatttttgaaaattttttttgggttgaaaatgggggtgaaaaatttttttctgtggtattttgaaatgctgattacgaatatgacctttgtttttcgtttcataatttttagaattttttaaaaattcgaaatttttttcattttttttgaccctcgggattttggggtaaatttgaaaattcataactaacctcagggtaagtcaattttcatacaacaaagctttaaaaatagcaaaaaatcaggagaattttatgggttttatttagattttctatcatgaaactaaaaaaagttattccagaagttctggaaaaattcgaattttcagtaaaaaattcataactcggttctgaaaagatattttggaaaagtaaaataatataaaaatccgcaattttttgctctattttataaaatttatttggtatttttatcacttctttaaaaaaagatataaaaataaaagtgattttgtgcttcgggtccaaaggggggtgaccaggnattttngagtgaaaaatttttttaaccaaaaatctttcaaaaacatgtcattagggctattttatgacgctgatcacgaatacgtgatcagatttacttttgacatc

SEQ ID NO: 13539 - DNA, 3396 bp, Heterodera glycines
tgggtagccttttaataaaaatagaaaaaaatattcactgtataagagataatttaacacgcccccaaccccggtcttattttacttcataaaatttttctacccaatttgctttggttttggtttcggctttttaagcctactcacggtacccgcgtcgagaacgcaccaaagctcagagtaccaaaggagcagaggagttctgtgatggttaaagggattacttaatcccgccccaccacacgccacaccctcctcattaatgtggcgattaacttaccttaattgctccttttaaacttacaaaaaatttaaaatttcaacttgttttaataaaaatgtttcaatttgaacaaaaatttatttaaaaaagttttatgagtttcatacgcttatcatttttttttcatttgcataaagtatttcaaactaaaattaacataacatttacaatgcttctacccaaacaatatttttaatctttttttctatgttttcttttgcaaatttaattttaattctttcccaatttcgtgttctcgataatgccacatataattgtccatgtgaaaaaacttctcttgtcaaatcaatgcctattttttcaaatgtctgcccttgagctccattaattgtcatacaaaatgctagttttaaaggaaattgatgtcttttaaggacataaggaaattttttttcttcaatcaatgtaattctcggaataaaatcaatttctccttttctatctcctgttaaaatcattactcttaaaacattttttccaatgtcaagtatttgtagacgtgttccgttgcataaacccaaactaacatttatatttctgattaattttgttatacaattaatttttaatttaagttcatggtttggaaggctgggtgtttcaagtttattgagtaattctggaagaattggtgctcctttgctttctgcttcatcaatgctattaaaagtataataacttcccggaaatttagataaaatttgttcattatataaatcgatttccctattatatggtgctaaaatacaatgattacaaagttttgaaaattcttttttgctaattatttcaccaaaaatttcgtcaactaaattgttttcttggatatcacaaatttttggaagggttatatacattttatcaccatttcctatttccaaaagttgttgagaaaaaattttggcctctggatcagatcgcatattttgtgttaaatgaaaaattttaaaatttgaccacagttcacttttttgtaatgtcaaatcaattatttcttctttagttgctttgttttttataggtaaacactgtcggaagtctccacttaggattaagattttgccaccgaatataatattatttttatggatttctctcaatttcctatctattatttcaatagcatattttggagccattggtgcctcatcaaatataaaaatatcagtatctcgtatttctattccttctttagatgaattttcaattgatgaagaagaattgctgtttagatctaaaggtaatttaaaacgattatgaaccgttcgcccattttttaataatgtggctgcgatgccagaaaatgccatattcgtaactctttttccgaaaccccttgctaaatgaaataaagcagattgaagaaaagattttcctgtacctcctggaccatcaatgtaaaaacaattttttttattttctccaggatgttcaattgtatcttttatatagtcaaaaatatttttttgttcctcattcataattgaatatttatttaaagtcaaattaagctcttctttaggattgattatatgatcctctgaaaaattattatagttttcatttattttaggcatatcgctaaaagactccaagcttttttcttgttttaatagattttgatttaaaagagataaagctatttggtaagctatattttctggatataatttcttaagatcattacttaaagcatctttatacttctcccataataaacttggatatttgggttcgcaattaataagaatatttgcaaaaagtgctcgtaatccctttggaaatttaaattgacttgcttcgtttaaacacttatcccattccatatcatctcgtgttaaacccatagctaaacatgcttcagcataagttttaaatttaataccatttacagtttttaaatcctcaaaacttgttgcatgtttatgcaataacatgtaccgaagataatataattctttattttttgggtttactgtataaattcttccaattactttatgtgttccttttctcggccatttccattttctattcttattgtcaaatgtacagtaagttggcatttctacgtatttaaatttaggcgcatttggacagtctttaaaaaagtcaaaatatgcaattaatttgcttcttttttgcattgcttcttctaaattatcatcgttagcattttcatcaaaataaattacttgttcattttccaaatgaacatcaagacgttcaattttatgcgactttccttgtaattcatacttaaataatcgataacacgcttcaaccggactcaaatatcttgcttcaagatattgtccaacttcatcatattttaaaagaatttgttcgccatttggcccctcttttacacattggacaattgcagcatcatagcctttataaatatatttatatatatattttaccgcattaatttcagaacaaacttctacattaatatgcgattgaaatcttaataacaaatatggattataaggtgcaatattttgatttgttaatttaattcctttaacgtattcaaaatctccattatttgctcgtttatacaatgcataaccgtcttctcctaattgagtttcttctctaaattttttcgggtatttaaacctacattttccatttcgcatacacggagcatttttatttaaatctgaacatggcccatgcatcataaattttttcactgctgatcgtaaaattggttcttttttactatctggtagttcggcgcgtattaatttgtcaatatcatttatattttttaatttatcttttggatgtaatgtaactaaaaaatgcaaatgcggcagtccccttttttgaaattcaactacccaacagtaggcaataacagttccaaagatttctccacttacaacttcttcaattaatttgtccgcttttaatttaaaaactcgtgcaactatgtctggtctatcctcggtcttttgacctttcaataaacattttttaatatcgatatcttctgggtttattgtataggtaataaataaatctggttttccattttccccaacaattgccatagaatcaataaaattttggtcttt

SEQ ID NO: 13540 - DNA, 2020 bp, Heterodera glycines
  misc_feature (9)..(9): n is a, c, g, or t
ttcaaatanaggggattgaaaaataaaattaaaatctggctttctagcaattttgaaatatttttatttcgctaaaactaattggttttaaattacttttttatgttacttttttgctatttttccatttgtgccatccctctttccctccaattgttcccattgtgtcgtcctctatttttccccttcggggggtttaattacccaagtttgagcctaatgataaattggattatttctgcgcactgctccttgggtctttatttcaacaacttgctctgaatactctgatatcctctcgccccgacccccaacaaaaaaccatttagtaataggtaaaatctttcctaaactgttaagcttttaaatgatataatatgcgaaaaaaatatatttatttttacaattttagcaaaaaaaattctctaaaatggctaatttcttcatcattccccgtcgaaaaacaattcaacttttattgtttattattttatttaaaataacgcttcaacaaggtgattaattttttgtttttggcattatcatttttatcatacgacattctgtaaaattctttcaaataaaacgccaaatttttgcttaaactttgacgaaatttttttaaataattttattgaaaataaaaaaaatccaaagaaaactaaagaaaaaaataaaatggtttttttaaagacaaattttcttttatttcaaaagtttatttgatttctattttagactcgctcattgaaactaaacaattggtagatcaagcaaaaagtttgtttaaccaaataaaaaagggaaactttggtgccaattcggccattgaatggatacagaaaaatgcgattggcattttgtgtaatagcgaatttgaatcaaaaatggatgaaagtttgaacaaattgcaaaacaaattctgtgattcattggaaaatggcaattatcaaaatttgaaagaaatgttacaaacgacaaaaattgaggaaaaaacatttgacaaaagccaaatggacaaagccatagcaaaagatcaaattaacaagggcaaaaacaagcaaatgtttaaacaactatttaacaattctagcaatctttttgaaattagtgaaaaaattttatgattttgctttctaatcagaggggtgaaaaaatcaaaaaaaaaatttctataactaaataaaacaaaatataaaaattttaaaaagaataaaatttttgtcttgggaaacgattgttgcaaaaaaaaagaaaccaaggaacggggaccgcgctttacgaacggggaaatttggatgagaaatcccgaatgaaataaattatcccaaaattaaaccattaatggagatgactttttatatatgtttctattttacttaagctctaagtttcgattttcgcattaataaatttttaattacctggtgatttcttattattgttttcattaatttggcaatttcgattttagcgttcataaattaaattattttggccattttcattaatttagtttttgctaattgatttggctacccgacatttgaggatttgacatttgaggacccgacatttgaggacccgacctttgaggatatacacaatttaaaaaaaataaatgaaattttattttatatcatttgggccagagatgtgttgtccaaatgttgtcactgttggaataaatatttattgagaaagaaattgggaagcggcagaataaatggagagatgataaattgaggagaactgcagaagaagataaaaatataaaaactgaacgaacttgaatgagaaaaggaatgatgaaaagagggatggattttgggactgaattgggaaattgacaaaataaatgatcgcggtaatacaaaatgtttaaattggatcgttgtccgttggtatgacatcaccgtgctccgaccagctgagctcatgcgaatcgttcatacgtttgtcctccctccgcaacgaaccatggaggcctcctggccgacgatgttgttgaacagtggcg

SEQ ID NO: 13541 - DNA, 1216 bp, Heterodera glycines
  misc_feature (1210)..(1210): n is a, c, g, or t
tgatgccgattcgtccatgaaatggatacagaaaaatgcgattggcattttgtgtaatagcgaattgaaatcaaaaatggatgaaagtttgaaaaaattgcaaaacaaattctgtgattcattggaaaatggcaattatcaaaatttgaaagaaatgttacaaacgacaaaaaatgaggagaaagcatttgacaaaaggcaaatggacaaagccatagcaaaagatcaaatgctcaatgacaacaataagcggatgtttaaaaaactatttaacaattctagcaacattcttgaaattcatgaagatttaattgaaggtaaataataattaaaattttaaatataaaaaaaatccaatttatcgtactcaattgtttcgtaaatcaaaattcgttgaatatttggcacaaagtgtcaattataagttaaaatttgaaaaattcaaatattacgcttaggtaaaatggctaaaaaattcaaagatgttcaaatttttcgttttcagcagaaaggcttgccgtgcgccaacaacaaatgccaaacggttttatgggcagaagaaaaaagcgtgcccgcgacagtgcaattaagggctgtgtcactgcagtgcttttaacattaatctctgctccatatttgggttattattctaacaaatatgccaacgagggcaatgtcatggttcaagtcaatagatgtaaaaagaggtttaatgtccgacattgttaccaagtccagcagtcggttgtcacgcagatttttgagtggacaattctattagccattggactaatctgtgcactgatattttgttcttgtgtccgttgatcatctaattattgtatgattacaattacggtacatatgactttggtgctgctttctgttcagtctcatcacaaattttctgttataaaaagtcgtgaaaacacgttttatagggtttttaggggtcgctgatcacaaatctgacatgcattttgaccaatttcaaaacccggacccgaattggaacaaaaagtcgaaaattcaaaattcacttttatgttcgtaccccatgaccattttttaatgttgcaatggtttttaactaaatttagcttatttagatcaatttaggaacaaaagtgtgaattttgaaaattttgaattttcgactttttgttcgaactttaatgatggattcgaaattggccaaaatgaatgtcangattcg

SEQ ID NO: 13542 - DNA, 4586 bp, Heterodera glycines
  misc_feature (4513)..(4513): n is a, c, g, or t
  misc_feature (4572)..(4572): n is a, c, g, or t
  misc_feature (4577)..(4577): n is a, c, g, or t
agaaaagaggagggagagaagaggagagagatagaaaagaggagagagagagagaaagaaagaggagggagagaagaagagagagatagaaaagagaaggaagagagagagagagaaaaagaggagaggagaaaagaaagagaggtgagagagagagaaagaaaagaggaggaagagagagagagagaaaaagaggagagggagaaagaaagagaaaagaggagagagatagaaaagaggaggaagagagagagagagaaaaagaggagagggagaaagaaagagaggtgagagagagagagaaagagaaaagaggagagagatagaaaagaggaggaagagagagagagagaaaaagaggagagggagaaagaaagagaggtgagagagagagaaagaaaagaggagggagagaagaggagagagatagaaaagaggagggagagaaagaaagagaggagagaagggagagaaaagaggagggagagaagaggagggagagaaagaaagagaggagagaagggagagaaaagaggagggagagaagaggagagagatagaaaagaggagagagagagagaaagaaagaggagggagagaagaggagagagatagaaaagaggaggaagagagagagagagaaaaagaggagagggagaaagaaagagaggtgagagagagagagaagataataaattttttcaaagctcggctagcgcgaggtgcgcgagcgaagcgagcgcgcctgcgctagtaaataattaaaaaaagaaaagaattgttttaaaattggcgtaaatgtccgacctttttgaaaatattccttcaccatttccaaattttcatgaataatttatgctcgaattcccattcttaccaatgcaaattttaccaggttaataccactaccggtggcactagaaaaccgccactggtacttcttattttgaaatccataaaactaaatattgctaatgagtggcctttgttccaatatcaattgatcgttaaaatttccatcattaattaccattttattatttaaattaattaagaattatcattttttacaaattaaactataatccttttaataaaataaaatgaatataaatgacgcttttctatcgcaatattataattatcagcagaacatcaccataattttacgctttcatcgcacagaatggcgaagccaatagaagtgaatcatcaaaaaaagagcgtttgcatagaatcgctttatgtaccagtcaaaaattcattcattaataaataacattcatttttttaactgaaaattatctaaatatattattaaataacttatttatgttttgattcaattagataaaataatataattgctttttgtcttcaaaattgacattcattaaaatggcaaatttattggctgttattttgtttaccatcatccgatttgaagtaggagattcaaatgatcagataaccgcagacaaaaatggtacatttcacaaaacaattttgataaaaaatttccaaaattttgttttaatttagcatttaatgccgaggaattgtgtcgtcccatcgatggcactcactttcacgagcagtgccttcagtcgtcagttgtcaaacagaagggcttcatcccacggaatttgcatccgccatggctcagctcgtcgctgtttgaggacaacgaactgaacgaagaaaaagccaaaaatgacggatgttatgggtgttataaggggacaaaagggagcaatggcatggcaccgggggaagaatactgtgcatgtacggtatgttaacctaataaaattcatggttaatgggcgggataaaaaggtgaaaagttagataaattgacaaaaactttcaaaatattttcaaagcataaaaaataaaaacagaatttttgtcaggaaaaaaattgagggaattctttgataaaagcttatatcttaggatatgtttatgaaaaatttgaaagatcttatatttttgagcgcttttttttgttaaaatatttttcaaaaattcaaaattaaatacaaaaagcaccaaatgtcaaaagaagcataaaagataaatgttaaaactaatttaagcaaattaagcaagaaaaacttgcgaaattgtttgagggccgtgtgatcgtcccaacttcgcttcgcagtcgaatcctaaaggcattgcacatcgcacatccaggcattgtgcgcatgaaagcacttgctcgtcgccacgtgtattggccgggaatggactcagagattgaaaaagttgtgagcacatgcgaagagtgtcaactgggccagaaaaagccaacaaaagcacctctttcaccatggccaacgacagacaaagtctttcagcgtgtccacgtcgatttcgcaggcccctgctcagacggtcaccaatatttgattttgatcgattcattttcaaagtggccagaagtttaccgaatgaacacaatttctgcctatgccaccgtatttgtgctccgatcaatcatttttcggctcggaatcccagaagaaattgtttccgacaatgggacccaatttcgatctgccgaattcgctacattttgtaaagaatttggtattaagcacactttcactccgccatttcacccacaatcgaatggccaagtggaacgtttcgttgacaccttcaaacgttcgatgaggaaaatgtcaaaaggcgaaaaagattggatcgaaagaatgctgttcgcctacagaaccactccccacgtcgccttgaatggtttttcacccgatcagttatttttcggcagaaaattacgaaccaaactagcgctcgtccatccaaaaggggaaaaagacgaaaattttgatcaaaattcattcaaaaagggacagatgaaatacaccgacaaaatggctcaaaattttgatcggaagcatggatcaaaactgatcaatttctttccaaatgatcatgttcttctgatcaattatcggaacaacaagacggaatggctccaagggaaaattgttgagaggctccataaatcgcccacatatcgtgtttatgtgcctgttctgcgtcgcgttgttcatcggcacgcaaatcagctaaggcgacgacatcttttggaagacgaagccgaaaaagaggcacctcaagtcaaacagccgccgccggttgtcgaatcgcctcgtcagccccaacaaattcagccagccaattccccgttgaaagtccgccgatcgagccgaatcaagaaacccacacaattttactctccatcgagatgaaaaattcaggcttaaaccttcgggtttcgaatttaagaggggaggtgttagagaaggaagtaattattgattaggtgtatgaccccacgccacttcgccatcttccccctcccattcccctcattcagttggttatttgtgcctaccaattttgacctcccaatttattctctgcatttatttattattttattttcttcggcaaataaacttatttaatttgttatcttcggacataacagaaatataatttgaaatacaaaaaattgtaaaaattaacctagtggattctaacggcaccgccagataacctagtaaatttcactatgtttttttacctgctgggaaaatcccggttttgcgttttccataattctcgattctctcagcccaattatcattttaaattttgtctattttagattgatgacaacatatttcttagcttcttgaaggaagagaagagaagcaattttgaaaaattttgtagcaaattgagagcagaaaatttgccgaaagttaatgctttaaaagcgaatgttagaataagaaacgcacagacaaaagtgcctgatccaatgcaacgtttgattcatgaatatgtcatatattttgccattttttatctgatgagagagaaatggcaatgtgcaaaagtcgagcgctaccaaaatgagtgttcaaagtttcgcaactatttcaattttatgtacgaatatttcttcagagcatataatcaaggtttgaaaactctaattgtttacattaaaatcagggttatcaaagatccagattttcaaagcaggtttgaattttataggggtaaaaaagattttaaatattcgcattttgggcacaaaatatatttcaaatatttggtccagaatttgaagcaaaaaataggaaaacatataaagctaaaaaaaattaagcgaaccattggggagtggcaccacaatttgcggcagtgaggccgaattttaaatttggagaagaaaagattgaatctttgcttgacgttgtggagcgactgggcacaattgcggcattcattttcgatccaacttacgcaaaagaatttgacaacaaattggacgctttgtttaaacaatggccggagccaaaattaattaatgagacggaagtgagtggcggagaaacacttagccaaaaaatcattggaagtgttctacaaataggaaaaagcccaacaaaaaagggcaaagaanaggttaatgaagagagttcatcagcagtagaacaagaagcattcgccttggatcgtgcnaattntgaaaattt

SEQ ID NO: 13543 - DNA, 2794 bp, Heterodera glycines
aaaaattagcaatttttgtacaatttatgctatataaattgcatagaaattttcaattttttttccgacggcacctatcggcaccgccggactcaaaaaaaaacttaattttcttgaaaatttgctcaaaatcgctaaattttccattttttggacaaaatttgttaacaatttacattaaaaattacaaaatttttcccggcggcgcatatcggcaccgccggacccttccttctccacagtttctcaaattctctttggataaagcgcgccgcaaaaaaagggtgtaactttcccaaaaaaaaaatccaaaataatgtaaaattacttaaaatattttgatctttttaaaaaatatagaaataaactaaaaacagtttgaaattaccttttacatggttaaaaatttagcctattaaatattttttaaaaaatttattatatatttttttgaaaaattccgagttccgacttccgacatttttggggtcggaattccgacttccgaattccgaaaatttttggggcatcggaattccgacttccggaaatttttagtgcctcggaactccatccctgctccacaaccgacactattaaaaccattgttcattcattaaaaacatttgcatttttaactcgaactcttgctcatttggcaaaaattaaaaacattttttcttaaaaaaaaaccagggattctctacccaccaataaaatttcattcggaaatcccacggacacctgctgctggagaccttcctttgtaagcattactaggcacgagagaatgaatggcattaacttaattaattattttttgcggtggatgctagccaattgtaactccttatttatttcttgcatttattttgaggacataatgtacatatttatttcataagtataaaagggaaatctacatcatttggtggttcattaattcaccgagaccgaatgtgactgatcgtccacaggtccgatttgttttgatatgccgactctaaccgactatgtattaacaaaaaaaaaggagaggaaaatagagtgtttgatgaaagactgccatcactgatcattccaaagcgatcggacggtcaaagcgctgtgtgtcgtgcctcgcgttgctcggtctgccattgtccgccgtccggcactcattccgtctccctccctcaggcgacccccgccaatttggcacttcccgtcgacctccgtctgatccttttctcttccccctttcgctcttgcttttcctccctttcccttctttcctctcccaatgggcggtggttttctttgctttcgtctccacttccgttgtcttccgtcgatgtccgttcttcgtccgatgtgctcaaagatgagtccaaactaccggcgccaatttgccaagcggccgttctaaacgtttcaattgtttcaatttctctttttatgctcaatttgttcttcacctgtacactttggtgtgaattacgttgttcagcttccgtaaattgaatctctgctcaaatatcatccgataccaaaactcctccttcgtttgcggtgtttggagtgggaaaagcattgtccgatttgcgaagtttgtgtcccaaaagcggaaatggccaaatgatttgaacggttaacttttaccccaatgagtccttctgcgtgctttcccagaagttcgccaagatcaacctgaagaaacatcggttaaacagcacgggactcttcggatagcattaacaccttccccaatgcttcactaaagccttctttgcttctccaaagcacttcccccggcaaaaggttttgaaaggcattgcgcagaagaaacttctcagttttgcccgggatgagcttgaaactgaaatttaagggcaaatgaaggacaaattgatggaaaaaccttggcggaagttgggcaacaaaagaaacgaattttttgtcgaggaaagggacccgaatttcaagcccatggcaggaagtgcaactgaatgacaaattagcaaagggaaagcggaacaaacgaagcaccgatcacagcgaaggacgtcgtattggtggagcagtcggagacgacggacgatctcacgctggagaaggggcgcggacggcgcccgctgcatgtaagcgtaagagccgaacagttcgtccgccccttcgcctggaaaagcgatgaagcgaactttgggagagttaagcgtacctgagagaagcactttcacttcactgctggcggcgatgtgcttacagagcagaaaatgggcaactccacagcgcacgacgagcggatcgaatgtctctaaggaaaagacgacttctgaacggaaggggggggataaagcggacagagcaaaaagcggaccggggatagcctcgacacactctcgagcactgatcaccaacactctgtggcaaatgcccaaatactcggccactttacgagcattcacaaggtcgggagagtcctcaaagccaactgaaaatgcgatcggagaagcgcaaaagtcattcgagtggaggaagcgagttgccaacgctgaagggaacggaagttgaagaagcggacaaatggcacaattaccggcgattagcgacgagtccaaccccccggagagcataaagccaaattggcgattgcccattagcctcttttcgaccgcctcaaccaacaatttgcggataattgcctaaacatcgtgaaacctttcttataatgctaaatttgctgacttttgcatcaaaagcactgatggaataattgacaattgaagggatttgaaagaattgtgaaatgcga

SEQ ID NO: 13544 - DNA, 939 bp, Heterodera glycines
aaaattggctcgaacaacagggggggggggggagaggacagtccgaacggacgaattgtccagcagagaattgtccttcagcgtccgatggttgtaaatttcgccgttgcacaccaccgaaagaccgtccgcacaaatgggctgttcgcttggagagtcgccgggctatccgcggaaaatgaggagaattgggaccagggctgggcgtaattacggattacggatttccgtaattggaaatccagttacgcccagccctggattggactcacctggacaatggccaaacggtggaagcccagccaaactttggaagacactcggctgataatggtcaagtcgggacccctcccgacaatttgcaggaattctctttgatgtttggtcggcacatattcggcgcccaaaataacctgggaaatgaaagtgaacgaacgatgggacgagcaaagggacggaggacggacactcacccaaatgccgcacatttaattcactgagccaaacctaaatggattaagagagagagagagatttcgacagaggattaagggttgaattgagttcaaaattcattttcttgttgatccgtccgttctttgggatttgtgggggggggggggcacggccattcgtctggcgacaatcgattggagtggacaaccgacagaaggagaacgactgactgatcgggtcaattcgcctcgttttgcggatttgtcggttctcccggccaaacctcccccgcctgctcctctgctgatgagtactgccgcatctgctcggatgagtctcttccgttgtccctttccgatcggccaattctgtcccccccccacctctgacaacaacaaaaaaagcatttgcccgcctttgccagtccatcaacaacaatctgtccgaccgacttctgactccgactggttcctcctcctcccc

SEQ ID NO: 13545 - DNA, 2188 bp, Heterodera glycines
aaatttcggtatttcaaagggattatctttgtattttttaaatatttaaaaatagattgttttccctttgaaatagccgttttttcaatttgtgaatggaatttatttgtttgtatttttatgtgtaaactaatgctatcataaagtgttttttttgttgggtcaattttactttgtttatataattttgctttttctttaatggatgccaataaatgcctaggatatttatggaccaaatcatttttggtcaatcgttttattggaatacactcatctaaagtttctaacaatgcattgttaaaggagacatatttttcatttacgctaaaaagtttaaatgataaagctctaagccttgaggcaataactacattgaaaagtgacaaataaattaaaattaaatgatgaaagaataattttataattattaaaataaaaatattttcgatagaaaatcaaataatatttttaaaaatccaaaagacagaaattttaaaattaaagcttcttttacaaattacttgatttttatttattttatttatttgtcacaaagaaaaataatccacgaaagggaaaaatccacttacttcggggacatatgaaaacataaaatagtgcacaagcaaatggataataaaataataaaaaatcatcgtcaaaggaaacaataaataaggtcaatacaatttgtaaaaacgatcaaatcacaatcataagcattactcaagaatttttaattttatttttgaataagttaaaagagtttgttttaatgagctctttatcgagttgattccacaatttggttgccctcccagcaaagggaatgaattttttgcctaatttatattttgtattaaatcggtagaaaggaatattgaatcgtgttgatggtctaaaaatggagaaaagtttcagatctgttcggccataaacaattttatgtgccatgaacagatcgaataagtttcgcctattctcaagtgttggcagctgaaggtactctaatcgattttggtatggaattggtggaaggttgcatttaaaaaaaactcttttagtgaaatatttttgacacttctcaatttttttaatatttttttgaagagacggattccaaacttccggagcgtattccaataaaggtctaatataagttttatataatgtaatccaaattttagaagatttagatttaattattctaaacaaggaacgcatacgtaaatacgcattccttgttatttgatttacatgatcggaaaattgtagtttgttatcaatgtttactcctaagtccctaattgtatccacagcatttattgtattcccatcaaatttataagtttcttttgggttttttgaacccaaatataatacaaaagttttttgaattgaaacttttatttgccatttatttgcccattcgaataaattatgcaatgttttatgcataatttctgtatcagctcttgctttatagcatatatatattttaacatcatcagcatataatttaatattcactcctgatggtataacatcaggaaggtcatttatataaattaagaataaaagagggcctaggacagagccctgggggacgccagagccaacttttttaacagaggatagagtatcccctattttaacacgaaaagttctgttacttaaaaatgattttatccaatttaataatttaccctgtataccaatttttttcaatttatccaaaagcaaattatgaggtaccgaatcaaatgctttttgaaagtcaatataaatacaatcaacattttttccgttaataattgcttcgtaccaatcttcgacaactgttattaattgatttgtcgttgacctatttcttacaaaaccaaattgggattctgaaattttattgttatatattctttaaaagtaacattgcccaagtgtgcaaatggcctaatggctagtctccttgactttcccttcttctttcccctagttcaatccctctacagaaattaaattattttgaattttctttttgtatactcgtgggtttcctatagagaaaatatgattactcatagttttaatcaacacatattttatcattttttaaatgaaaatccatacaaattgagcctactaatcccaaaaaccaacctttttttgttgaaaatctgtaacaaat

SEQ ID NO: 13546 - DNA, 888 bp, Heterodera glycines
  misc_feature (4)..(4): n is a, c, g, or t
ttanaattaaatattttcatgaaatgaaaaaagaggacatttaaacattaattcttgaaaatttcttatggaaatttgtcaaaattttatttttatcaaaaattctttaaaaatttaatcggcgcaatgaaagtgaattattattatataaaagcaaggggggaatgagcccacgaaatgtttgttaaaagcttctcttcttccgacccttcggacgatgccaaaacatttctatgagacaaaaaatatattgaaatttaattattactaccagggcatacgtacaataataaatggatataataaaatcatatttatttatttatggccataaattgtgtaaaaatgggcataattttcttcaaattcattgcatttgactgaaaatatgatggcatcatcttacaattagaagaaaacaacataaaatttaaatattattttcgcaaaaaaccctaatgatttttcgaaaagaaaaatttaatattatacaaaatacggacaaaaaagtcaatccaaaaagcttcaaaaaggcattagtaaaaaggattaaaatggaattcttattttttcatttctaaatttgtcaaaattggaagaatgctcaaaaacaacaggtaatttgatcattttttatctcattttactcaaaagggccaaaattataacacaaaataataaaacaaaaattgctttgacttttaaatttcattccgccaattttcgtccgttctgttcagctgtccatgaatgtcttctgcgtttgctcgtcctgttccaacgctttgtctttgttgtaaaatgggaggtgcaaattttggcctaaattgagaaaaaaccaatagaatatttaaatattcgttaaatgatcggttggaatgaaagaat

SEQ ID NO: 13547 - DNA, 2918 bp, Heterodera glycines
acatcggtcatgaacccagccgcaacagttttggctcttggaaagcgcacccttcgggggcgcatcagagttaggtgcggtgcccctccaaataatgctgcacatccctcttccgtaaatttttcaacttttttcgcgcctctttccacagcgctgtaacacctgcgaacgccgctggggaggatgggtcgttgtacagcttgtcaagcgtggagttgatcaactccactttttcgggcgaaattccttcttgattttcggtgccgtcctggtggttgtgctctgtgctgttttctttggaggagccgtccatgaatacaaaattggatcttgcctaagcctctcttcaaatatggccgctccaggtggcttaatggtagggcggcccgctctcctgtcaattatatacctgatggccattcgcaaattgctatgcgccaacggtttgccgtttgcggtgttaattgtattgccacggacacccatacgatccgcataacggttgcatttgatgtacagtcgttcaacccgctgattcatggtcagctgatttgacgggatggtaaacagttctcgatgttgttgttgttcatcactttgtgcagatgttgatggacccggctcgggtgagtactgtactcgcaccctcctcgcttgcctcacgcgttttcttatgcgcacctcaccatcattctcaccatttacggggtggcggcgtttggtccccctcctaggcggaggaacaggaggcatttcttcgacgacagcagcaggaagtggttgctgttgcctctgtggcgtttcttcaacaattttgggttctcttttcgggatacggtatggcacgggtctctttgtcggctcatgttttggtacaattttgggtgccggaggaggaatgtatccggcttgcctggatgtggatggccgtgggtcaagcgggaattcaggctcttttttcgaccgaggcgcgacttttgatgtcgatggtcgtgaatcgggttcaaattttggctcaatttttggtggttttagttccaacttttttggcttctgttgctctctctttgtggtcggttggcgtggtggtggttttggtttcgctcgagatggggaagggagccgtggaggtgaacgctgataaatcctgtattttttgtgatgcaaagcatcatcatcatcattatcttctgcttcatccttttttaattttcttctggttgcaatcctgcgctgtgcggtgtccatctcctcaatttcgtccgcgttgtctggtagcacaggcaaatcgccatagtattgtgatggcgctggcagcgcgaacccgctctccaacatatactcatcatctgtatcactttcgggtaaaggagcggcagctgcttcagcaagaaggtcccgcacaaccggtcgccgtcgatgtatatcgtatcgccttttctcccattgctctagacgaccacctctccgagaagctctactcggtctgggaggacgttcaggacgaggcggaggactccctggtggagaagggggagcgggaggaatgggtgggggccgaggacgtctcccgggcggcggaggtggagggggaggacttggtccacgccaagcgcgtctttcaggcggcgggggtggtggagcgggaggccgcggtggtgtgtccacaacttcaccatcttcatcttcaccacctctcctcatcagtacactgattcctttggtgagctcaactttggccggtctgtccgcgagctcccttctcattttcaaatagcgcctaagctgttggttgtagtggacattctttgcagatggatgtgttcgttcggcccgggcacggttcaaatcgtgccgaacagcatccaaattgatgtcacccgtctccgacatggaggtgagaccacgataaatttcttgtgggacaagtaaaaatttattcgccataaaatgaatggtgaatgcatgaaaaaacaacaatggtgtgtggtatttatgcatttttggtggacacaacagattttgccacttcaattagaatgggtgttaaaagggcagcgaacaatccgccaaatcctgcgcctttctgaacaaacacgcgcctggcgccccgctcacttctcgctctgctcacccgacgtacagtgtccgcatggggcatcaatcgtctcttctgacgagctgacaaacggaagcgggaagcaactatgttcaaacaaatttccactagcgctagcagttgctcagtgtttgcttttcgtagcattttcttgcatttgttcgctgagcgagttctggccaatgcacagagccaatccgcattctcttttatcagttcgccaacctttacttgctgctgctgcttatgccgctccatttttaggaatgaacacaactgtcccttcatcttcctcctgctcatccttaaatatgttggttcgcagcctcaatgatgggtccgacgatgcatgcatatcaatcaacaaatagccatagggacgggcggtcgcttttcgataggcgtcaagaaagaagtcaagctgacgcggaaaaagttgaacgccaatgttacggatggacagcagtgaatttggggcccgcatcagtaccaggtactgggcggacagacgggccactttgatcttgcgctcaaacaaattttgagtgacaaacacaacagcaaactggtgatggtgagcctttttggtgaacagatctgacaagtatcgctcgtcgacggacagcatcagatcatcgagtatcagcaataggggcttgggaagacgcttgattaattcttcagatggcactcccgcatacacatcgactcccgcatgttgaagcacaggcaccgctgcattcatttcaccaaaagtgaaagagcatggacacaggctttggtgtgattaattggcccg

SEQ ID NO: 13548 - DNA, 3512 bp, Heterodera glycines
tgggttgacctttgaaaaaacaaataatgctttaagcttttgcgtttttggcatttctaccgtaggctttgccctccgcccaccgttgctacgctcgcatttttccacccatttgcgctggccaaatctttggtttctctccgctgccgaaaactcttccgaaggatttgttgccaatttttgatccttaaattaggagaattattttaattagtgtgtgtttgtctgactgacttattttttgtgcaatttttaactgtcctcgtcggtgtcggcgtatttattttgtctaaatttctcgccgaatttgtgccattttcatacgcaattgaattgttgttggtgttgcctaaagaaaaacaaaaaatttttatttttccaaattcaattatttttttgtatcgttaattattttatacagtggtggaaaaaagtcttgactcaagatgattaatttgtagaattttaaaattcgactggaattttagctgattactttttgtttatgtatatttatttaccccaatacatgggcctttcatacaccacaaaataatcacaatccgctttatcattctcgtgaatgaataagtcgcctgatcagattttgctcaaaaaaggggcggaaaaaagtcttgactcaaacttgaaaaactatttcatgtttacccaaaaatctgaaaaaattccaatttacattatttttgatactgatcaaaaaagtctcttacaccaacttggtcagatcactccttcatagtgatcgggacaccacaaaatagatagaaactcggggaattttcgaaaaaaaatttctaggcggttggttccctgaaatttcgactttttccaccactgtatttattttatttatttgtgtgtactttcaacttcaactgtcaacacgtcaattcgaataccgcctttcaaagtgccaattacatttgcatatctggacaaacattatgaaataagctaaaactgaattggtttttcgagaattcttcaacttacagaacagtcattgtaacgagcggaatgacaagcagcacaaaagtcatataaatctgaaaaatgtgccaaaaaaattttaaaaaatggaaaggaattgaattaaaatgccacctgatacccaaaatggacgattggctcaaattttggtgcacaattcagcccgtttcggttgtaagtgcgctcctcatacataaacagcatgaacacattggcaatgacggagacaagccttaattagacggacattttcattgtgctatcctaatgagaagtgcgacgtttaaactgttccccggcaagagcttctgatggactaaaaaaaaactcccgatcagagggccagaaaaaaatggaattacctaagtttaatcctaatacccctatgtccccttttcgtgatttacataaatccatttatatatgtagagtagaacgggaacgagacctggtactgaaaaagacgggacaactgaatacctaagtcccggttttggccggaccgggactagtcccggtttaccagccaaaaattcccggtttttcaacccgaaaaggtcccggttttgcccaaaattcccggtcccgctctactctaatataaagtgtaaaaataattattataaaatgctaataaagaaaaacttaccaaaccaaactgatgacgaacatggcatgggtgggcgtgtgccaaacacgtgaatgcaacggcttacaaatggcgtaatagcgttccaaggcaattgctgccaatgtgtaagctgaagcggttacgacgacagctaaataacaatatatttaatatatatttatttaagctaatttttaaaaaggatttttattttttatataaaataaaaaagcgaacgttgcaaataagcgagcaatttgcataacaaatcgccaaaaacccagcagtaaacgagcgaactgaccaaagttgggggcatgccttaaaagaaaaattaaataaattttaaaataaaatttaattaaattgtctaaaataattttaaaaaattgacaacatacaaacaacgctcagcaacaggtcactgagtgccaaattaagcaaatataaatttgtcacggagcgcattgaacgttgctaaaggataaaatagggagatgaaatacaaaatttaataatgataaataattaactaattaattaattacctgtaaaatgacgaccacaacaattgaatttcctacaaccgaaagacagaagatcacacagaaagcaaagatcatcaaataattgtcaaaggttggccgaaacacgcagtcctgaaaagacggattatttggataaatttactaattatggtaattagtcaatcaaaattttggcgaggattccaaattttggatcttaaaaaatagagcttggtaaaaaatattacgggaacggcggaagcaagaaatttgctgggagcaggaccgggaatctcgtaaaaatctcgcgggagtcccgatcccgccgggctcaattaaaaactgctaaaaattttatgataaaggagtttgggcaaaatgccaaaataagaaagcaaactttggaaatcccgacgaatttcccgccccccccctccaatttttgccctttttcaagtacattgatcattccgaattgttccagcaaatgctgtccaattccgctgctcaaatttttgctgccattgttggaatggatttgcgttacattttggccaatttcaaagcccattttgtcgctgttattatcgagtgccattgtctcggttccattcgaaggcatttctgctgaaaacaaatttaacaaaaattaaataaaaagtaaattaaaatttgaaaattaaattttatttatgaaaaagagaagaggaggaaggaagtattcttagattcatttatcccccccaccgtcaattgcactttaaatttaaaaacaaatgaaattgttgctctgatcaatcgacaaaaaagtgaaccgattggagagggaaattcaatcagacggaaattaatggaaataataataaaaaatcatatttttgtttaaaaaaagaaacaaaaattgaaaataataattaatatttatccaacaaatggaaaaaatgggaaggaatgagagagttaaacggtcataaaagctactttcgcatttttgtctgatgctttttttaacgcacttcctcgttttaaaccccggaaatgttaaatttaaaatttaattattttaattgaagaaattaaacattaaaaacatgctatgatgctattaaaatgaaaaccaaagcccacgcaaatttacggcaacaaaaaaagtaaatcaaatcaaatttaattccaaaatctataaatataattttgaataataaatatttaaaatgtgagtaggaatcatttaaaaaataataatataattttttgtttcttttcattaaaaattattaaaatattcgtcgcaacgcttaaatataagtaaaaaaattgagcattgaagaggggatttatca

SEQ ID NO: 13549 - DNA, 1582 bp, Heterodera glycines
ttatacttcaaaatctattttttttttctttggcattctgatttgtttttgtatatatatttttttaaaattttctcacccatggaatggacacagcggcttcatgaacacaatttggccccgttgtccgtacaggcatgtacagggcaggtcctctcccggtgccaaatagcgtccgccacctgtgctacgctttggcgaccggctgctgctgctgctgctgctgctgctactgttgttttgctcttcctcatctgtctcctcctgaaaaacaaagcaaaaatgccattcgctagtagtccattaagcaaaagcaaaaatgccacaagaaagcaccgagaggaattcgtgccgatatatataatccatggaaaagataatcgaacccggcagagacacattatcggcatttattttccaagcatctcttatgctatagaagtgccaaaaattctttccccattaaggcacgaaaattaccgggtttctctagcgtggtacccattcgttaatctcaaatcctggcaccgtccaaggccacactcccagtaaagaccccgatcctccgatcataccactttttaccattctcggtttcaatctctcggctacaaagtgcctgcccgagggtggactaatgtaaagccccccccccccccctcaaaatgaatttttacgtggaaaattgtaagtttaagtcaccgtccctgcgcgggtgacaactgctccgcccaaaaaaatcacctgaatgaccaccgccaccggtggcacgactgtgccgtcgccctgcacagaggcggctttcattgacgattttgtcgatttccgggaccgtactgaacccttatggacagaggaagataccgatgaagtggtggaccgcttcttttgaatggatgccacatgttggagctgttgctgctttcttaagcgaagcattgggtaaattgtctgttggccctcgaactgatcgggaatttctcttgtacttcaagaaggtttcccgatctcaaaattttgactaatcctcatcggagtcttaataaatctttgccattgagaccctcaaaaattaccggcgtttcaaaaagtaccaaaatcctaatcaactgtttcaaagtacgtgcgaaggcgccagattttgatcacatatgattggtaatcagggtgccattcctagagttttggcctaaaggcctagactcccgtggccaatgtggtccatttattccaattctcggcactacactctccccaaacttttatttgccacccactttttgttccggtggtaatccgtgcagaaccagatcagctggaacacctctaaaacgctgaccaccgaaataccaatccaaaggccggtcagaccgccaaggtcggcaaacagacttgtcagactgtacgccacgctctctgacagtgtctcgtagttcagctcctcatagaacacttgtaccagcgctaaacaaacgcaatggatcactattgattgatcactctcgatcactgaatcacaccctatcatactgactggattagtctgtctcgatcattgaacgcatcagtccttgatcactca

SEQ ID NO: 13550 - DNA, 2602 bp, Heterodera glycines
  misc_feature (32)..(32): n is a, c, g, or t
  misc_feature (2440)..(2440): n is a, c, g, or t
  misc_feature (2544)..(2544): n is a, c, g, or t
attagcagttttgatccattgatcacgccctnaattgtgtgtctctgatcatttttgatcattccaaattccttacccgcattggtccggtatttttccatgcacatgttgtcaccgctttcgcactccatcagttttgttgtcccacttggccaacgggcagccgaatatgtcacttcataggctgtttctctatttttaaaggaatgaatttaaaaatttttccggcaagcgccgcctgacggcaccactaaactccctaaaaacttttgtgccaaaaaactcccaaattttttgccactggccacacctgcacggttggtggcatttgcagttgcgcaatgctccagttgcgatcagatcgccaagcattcgcgaggtgtttttgatgcaatcgcgtgccactggatcactcacttaaattgcttgccatacaaaaagctcacaaaaatctgatcacattggaagtctaaatataattattcgagagtctaaagtcgagaatttcgtatatttttgtgattttggatctcggtctcaaaaagatttaatgttcgagcattcctctaatacagtacagtacagcaaccaacctttacatgatcgtgcattttccggcaccgggtagagcgggtcggcacacccacaaatcctgatcacctttagaaggggacagaagggagattatttaccattctccaattgatcaatttatgttgatcacttacctcattttgggtgcaactccgatggcagccttcgattgagtagctataccccttgtagatgtacgactcggagttctcgcccccctcgctgcagtgcccatacggtggctcgaggcgaaaaaattttttctacggcaaaaaattccttttttgttttagcgtgtcaaaaaataatgtgaaaataacatttagctaaaaattggaaatttcctagaaatccacatattttacacagtaagagctgcaggttcccaccaagaaattcaaaaagtttttttttaaatttttaaaaaagcaattttcacaattataaagattttttcaaaaagtcaattccaattttttggaaaaaattttcgatgaaaatgttgggtgaatcaaacgcaccccttaccattcgcactccaaatgaagaccttaaagccaaaaataaaatttttccacgaaaattttaatgcttacatgaaccccgtcggtgcattgtagccaaatgcatccgcaaatggcactgtccacttgtcgtgcacagttatccggaagccaactgcttccgaggttggcaaatactctgacacgttggcatatagcatcactcgtaagcctgaaaaggattttccgattgacattaaatgaagggatttaatagggccattaataccatcagaagggaaaattttccttgattctctctctatgctctaaatagtaagaaaaacattttgtttttgggattttttgaaaaatttttctcaaaaaagagatgttaaaaattaatttttaaaaaatattaaacattattttaagctacttatatttaggcctttttttatagccttgttcattcaaattcacttttttctaagaattttttgtccaaaaactcacattataatattttggtacaaatgggtattgtgcatatttcttatgatcccccgaatagaacggctatagattacttccccttctccattataatcaacaaaattgatcactttttcccatcctgatcactatgtgattgattacatcccagtgcactccaatagacaatatttgtctactatagattattctgatcacttcaatctgcccgattattgcttctctaacactactgatcggcgattgcttagcttaattttccgatcagtctcacagtaaatatctatttattattatcatacttttatcataaatttttcttaaattttccctgatcattaatgatgattatgatccctcttcctcaaccgtgctcaccatagttggcaccggcgcgatgtgccgtcaccatagcatcccggtcccagttgaatgtgtagcaattgccatacgtcgggtcgtaatacagtttaaaatccctgtcaaataggtggatacagataccgtactattggtactacggttgatcatcatttacttttgtatgtcacagtcatactgattgaaggagcacttgaggattagctcgtccttttgctgggacagctttatccgttcctccttcggcttttcctccacggcgaacatcagattttcacgcgctctcgacttgatcgcaatttcgtctttcagttcctgaaaatgtgcgcaattttaatttatctggcacactcggtgatcactgatcaaaatatgggcattttatgctcccctctcccctattactttttcacattttgtccctccccctcagctttttggcattntgtccttcctccgcagctttttgcatttttgtcctcccccccccaattttttgacattttgctctctcccccaactttttgcggttttgtccctccccccactntttgaaattttcccctccccattaacccaattttgcccccccccccccccaacttttt

SEQ ID NO: 13551 - DNA, 853 bp, Heterodera glycines
  misc_feature (844)..(844): n is a, c, g, or t
tttgctcattgatttgaagaaaggagctcaaaaaacgcatttccgcataaaaatttttcgattctgatgtcattatcggtcactagaaatcactattttggcgacttcgtcactaaaatagttaaaaatcactattttggcgttttgtcactattttttcactattttgtcatttttgggcaaaattccttaacaaaaatgcaataaaaccaaaaaatacacccctaagaatcgagctaaaatttttcaaaaaaatacacccctaagaatcgagctaaaatttttcaaaatatactcctatgaaatcaaaaaaaaaatttctcaaaaatttactttcttggcaaaaatttttaatttaaaaaatttttttggcagattgtaaaaactgaaaaaaacttctttttttaacaaataaaatctgttatatattatacctatgtgtataaaagaaatgtatgcagcccaaaattgcaattattggagcaaaaatttttttttaagtaatctcttcttcaaaactgttttttacccaaaatccatcgtaaggccacccgaaaaatttctcacaaagttgctttttttggctaagtttgataaatatcgtttaaaattctgaggaatttcttaaaaagcagcaccgcaaagacgatgtgcggagaagcgctcgctcgagagtcttggaaaattttctgtctcaagcagcactagtgcgagtaaggacgggcgaatctgggcttagcactcgaagccgaaggcgaagcccaatttttttcgaagcacgatgttcgaagcccaaaaacccgaagttttcgtagctcgacgtttcgcccacccctggtgcggnggcctcgaa

SEQ ID NO: 13552 - DNA, 2180 bp, Heterodera glycines
ccccccccccacctcggccaattgtatgtcgtacgggaatactgctggtagaccccttacacacttgtggtcataatcagggctcccaactaaaaattagcattttaccaacaataaacagcaattggggtcaaagagcagcttataccccttgaaaacggcaaaatgttgataaatcagcagagttgagagccctttgaccataatgaattacgttgcaaaaaaacaaatttcagaaataagcacatttgaaagttaaaattagaaatgagaagtaaactaatctctcttatttcagagaagtgattcctttcaaatctcacaatcaaggcaattataacttttatcaaatttatttttttatttttggctaacaattgttttatttattaaagaattttttgtagtatttaaagcaatgtgccaaactttggttaaaaatttttctcagtgacgaaatgatcagtgacgaactgaacagtgacgaaacgatcagtgacgaaatgatcggccaccagtatttcatgtcttcgtgatttcatgttttcttgcttgaatattttattttatttttcataatgccattaattttgtaatttgttaatcaactatccatccatttttaggtatactgatcattactttctctcggcacttctttattccattttccttggaccttttgcggttgatcgcgtctatttttcttcgaagcttcacttcaaaatattggtggaatatttcggtgggaacgaaatcggaggaagcggatggaaacggcagcgcattaagcgcattttgattttattaagtattatcggcacttctacggccgctttcaagttgggtggtgggagtggatctgtggtgagttaaatatcattattaaaataaaattcaacaaaaaatatttattggcactttttcgtacaatcagccgtccgagcgtccgggagatgaaaacccccgccgccggcacgataatcgcctccgttagagcgcacaaaagaagtgatcactaaaggaacggctgtccgcaaaaagatgaataccttttaggttgttttgtatgtattagtgtgtgtatttattgtattgtgcgtgtaatatgttttgatagattatatacatatgaatatgtaactgttcgtcttaaatatatgagtaagaaatgtattgttccattttttgaatttgccttcgtatttggggcacgactttttcgactatctagttttataactgattattagggacgtgaattttaggttttaactattttttttgctcaattgatttgaagaaaggagctcaaaaaacgcatttccgcataaaaatttttcgattctgatgtcattatcggtcactagaaatcactattttggcgacttcgtcactaaaatagttaaaaatcactattttggcgttttgtcactattttttcactattttgtcatttttgggcaaaattccttaacaaaaatgcaataaaaccaaaaaatacacccctaagaatcgagctaaaatttttcaaaaaaatacacccctaagaatcgagctaaaatttttcaaaatatactcctatgaaatcaaaaaaaaattttctcaaaaatttactttcttggcaaaaatttttaatttaaaaaatttttttaggtaactattttgggttttttggtcttaaaaatcccagtccaactcatttgcaactgcaaatagtgaataaaaattagttttgctcaatttttggctgaaaattatgtcactattcgtcactatttcggactttttgtcactatttcttcactatttcggcatttttactcactattttagttaactatttcggcatttttcttcactaaaattcacgtccctactgattatgctattgaaatcaaatttactactactgtgtgtatgtatttttaaaaattagattattattattgaaaattttggtctttcaattaatttgtttgatgacagtatttcatgtcttcgtgataaatcgtgccggatctctcatatatgattgggagaataggaggtttctctattttacataaaaatcattcaaattgtttgacagacatggattttcagatctgttgatccacaaattgctcctttgaccactaatgagaagattgttttggcccagtgtttttccacgacct

SEQ ID NO: 13553 - DNA, 4669 bp, Heterodera glycines
agttgtccgtgttttggtcccggttccgaccaaccctaaacaaaatgatttgaatgggtcaatggagaaaaacaaatgtgtgtgggactgaactggacattacgcaagatgccaaaataataattttcttaatttttaactctcttttcaccttaattaattgtgcactttcttcacccggaagagagagcagcgtatggagaatatatttgctaaataattttaagcctttaaggtttttgggtaaatattaaaaaaatgtttgtttaatgttaagctggttttgttcacttaattcaaaatgtttataaaaattttagaatttttcctatccaaatgaagatttttgaagattttctgcgtttcaatgaggatttataaaattttaagaccaaagctccggttacgattatttaacaaggaggcactggtgaatgattttaaaatttaattataaaatgtttattaattcacaagaaaatccgccgtaaaaaatatgctttttattttattcaaaattttttatatttttttttctaaataatttgtagatagatttattatatggacagtcggaaatcataacaatgatggttcgttactaagaaaaattatttacaatagaagcaaattcagcgtatccaattgagaaaaataaacggattatatgccagttattttgacaatggttcgataaaatataagaattaatcagtttttatgtcgtaaataattttcttgtttgaaaatttatttaaatcctccaaaatctctcctccaagctgtttcttccattttgaaatggtcgttctatcaatttgcaatatttttgcagtttctttgtcactcatttttggattttcactttttattttccaatattttttcattttttccattttttctttctccgttattctacagcgaatgccaaattttttcttccatttaccaattgcgaattggcttactccgattttcttgcaaatttcggcataattttgtttccattcttttaacgaatattttcttttttgtttatattcatttgtcattttaatgaatttttgaataatttcaattttttcttcatcagtttttgatttatgacatttatttttttgaacaccaaattctttaatccatttttgaatataattactatttgtccccaattttttcgctattttctgatcaattttatgccattctttttttggatattttcttcctttttgcttaattttttcttttattttataatattttctgattatttctctttttttctgctcatttcgttgtttttcttctttttcttcccatttttctccaaatatttcatcaaatgacttttgttgcagctttttctcttctgatccaacttttgcaatttcaacaattaaaaacataaataaaaataaaaatagacacaatttcatatttcaatgataatgcttgacaaaattataaattcacaaaaaaaaattactaatttaataatttaacgaaataaattttatagaattaatattttttcgattaataggaaatgttttccaacgctaataattacgtattaaaaaattaaaagccttggatttattaccaaatctgcaggacaaaaatatgtaaaataggacagtttatgattaaatattacaaagattttcatttccttaggacaaacataaataacacaacacacatttaagaaaaattagttatctttttaatatgttaatttttttacaaaatttaatcgaataaaaatatttcgtcatcagtgccgtctgatcattgctgatccggaagctgaaatcaatgccaatttgacgtgccaaatttcgcggcacttttgtgcaggctgctgcgattggtggtgaaacggacacgggacagccagtcaatttttggggaaaagataaatgtgagcactaattgcggtcgagaatccctaaagtatcgagccaaaatacctgctggactcggtttttgcccaactacatgggcccctccccttcaaccctagatgaaaccaagatgaaaaattttcgctattagttttatttattggtcgatttatgaaatcattggcttcataatataaataaattaaataattaattgctataaaagtataaattccacttattggagaatgttatttagtttttgaattttactcaatttcaattaaatttcactttctgtccgaaaacccctggtgatcaaagggaggggtgatcaccgggttctatgccctcgttctcggcttggtcgacccctttcgaattgaggcccaaggggggccgagaaaggagaagagggagggcgggacaaagagggaaggaaagaaacggcaccaccactcaaaggaggagtgagtggactccaaactgcgaccgtcgggattgacccgactcgttcaccggtgggaagggaagaagtgaacctcggatcatccgatcccgttcgacagttgcagttttcgagaacggaccacggggcagaggaaggccccaattgtacgatttgctgttggcaattccgaagggagggaagggaatttgccgcgaccaaaggagcggtcaacaaacacaatttatttgccgtaggataaacaacaatcggagagagcaaagtggggagcgaaaaagataaggaaaaaggggagcgaaaaaaatggatcagtcaagaaaaacagaagcaaggaaaagaaaaaaggagccggggggttaaataggccccgggcagggagacaaaaaatgcaaaacatgtgaatgggtcggcacctgcgataggcgatgagaaggcgaagggaaagcacaaatttgaaaagattggtgatggcgaagaaatacgatgaataggacaaagagggggcaaaaaatgggaatctgagaaaagagccccaatcgggtggacaaagaacatttgaattttagtgaaatagcgataaacaaatgcaaattaagcgatggaaataaaaaaggaagagaaagagaaaatgggaaagggtacgaaatttaaaagtgagagaaaaataaaatgggaagaagtgtccaacacattccgatcggatcaaaaattcgcctccctggtcccggagagtccgcagggaaatccccgatcattcaacggcgcatccagcggcgcctccaattctttttcttttggctgggacggcggcttggtggcggaggatggtcccgagcgcctcccccaaaacggtcttcatcatccgacgacagttctcgaggagtcccgtcgttggcgttgaacaccaaaaagcccttgcccgtgattcccggccctctgtggagggcgctcactcctttctttcctctgtcattctcgtcgctaatttttttgcgacagggacggccttcgaagaatccctccctccctcccgaggccccccgcacccgaaattttttaaggaaaaaagtttttccttgctggtacccccccccccccagacctagcctcacccaaattttccaaaacttttgctaaattttcaaaaaaccgacaattttttgatgaaaatctgctaaaaatggctcaaaagcgcgaaatttgtcacttttttggacaaaattcgttaacaaatcaaataaaaaaatgcaaaaaatttccccggcggcgcctataggcaccgccggactccctgtcccccaaaaattttttggaaaaaccgccgcaaaaaaagtaatgttaaaaacaaaaaaacgcccgggcgggtgtacccccaccccctccccccaagccaaaatcctgggaccgtccctgacttaagaccgtgactttttttacaccccctcattaattaatagctttttgtaagcttgattaatctgtttttagcactttatgcttccgggtttctcccattgtggcctagtgggtttctcttggttctgtttcttatttttgcgttggctcagttcccctccgtgtagtttttttcttctaatttttcaaaaaaaattttctttttgattccaaaaaaaaatttaatattctgttgattttcaatttaattcaagcatcaaatatttacacaaacatattttaaataaatctttaattagtgccagaatttttcttctggtgacgcctaaaagccctaaatttttcttaaaaataagataaaaattgcaaaaaattacatattaaatcaaaatcaaaaaacgaccaaaagtgattaagacaagattcaaaaaaggttttcaaaggtttttaaaggaataagaaatttttgaaaaaagtctcgggtatcgcgtttttgggtctcggtctctgggtcgagtctcggggttctcgggatcgagtctctgtcgtgggaaattttcggtctcgagcatcacttgtagggagggagctaccgaatgatacgaagaattaaaatttggtttctctgagtaaagttttaatattaacagatttttttttgtgaaaagtggctcggttttggccaattgacgaaactcactcaaatttattaattgtaagtaattttacctcaatttttaagcctttcccatttccccattcgaataaatcccgataaacagctttaatcgcttccattgctgagctcagttggagttcgccctgctccacaagaaagcgtggcttcacacacaaacatctcactaaattt

SEQ ID NO: 13554 - DNA, 3467 bp, Heterodera glycines
tcatctccaggcgactttatgccgaccaccgacgtcacttcacagttcaatccgatcatgcagagccaatgtcactcatcgaaattgcatgctgttcacgtccgagtatggcaacaccggatgtacgaaagtggacctctccaatactttacgcatgacgctgtattgatcacttggctttgccggcagtgcaatggccgtttctttcatacctttgagttctccacgtccggcaaatcagatcggtgagttttgatttatttttagaaaaaataaacaagccaaatatttttttagttggggccgttatcggctttatcaatcaaaggaaagacgattcgacatcaacgtgacttaccaggacataggccgggtgtacgatcagatgccgggcgcgggagagtaccacataatataccaaaactgcaaacattgggcggacaaatttgttccccttggtgagtttattcaaatataattaaattattaattaaaataaataaatcatttgtgaataaattcagttaaggccaaatctcgggtcgattatgttacttgtgcgtgtgacaatggtcactaggattgaaggtaatcattaaatttataaataaggaaaattgggttttttcaaaaaaaaaattaaaattttatgcaaaatttacagtgtccatgaatggcgaagagtgggtgatcttggtgcgatatatctgcgacaattgccgccggtttccgaatatgatggtcagcgtactttttggagaatttggaaaagtcatgaggtaagtattttccgaaatttaggtaccaaaccccctccttacccctccttgggtcatggcaactcgtacaaaaggcaactcgtacaaaggcaactcgttcaaaaaaaagtctaagaattttcaaataaaacttagaattttttcattaaaaaaattaaatggatgttctagaaactttttaaaacacttaaattttcaaaaaatttaagaaaattaaaaaaatcagctgaaaaattagtaaaaaactttaaagaattttttaaaggtttttctaggctagaaaatccatttaaattttttttttatctaaattgtaaattttagttgaaaattctagaaatttttttgtacgaattgcctttgtacgagttgcatattcgctttctctttcctcgcctccactctctctcccgctctcttcctctcgctctcacatctctgcgaaatttaccatcaccttctaacgatgacgatgatgatgacgataacggtctctggtttggctcgatgcccacacaaaacagtgttgcggaaacaccaccttgcaaacctgctacttcttttactaaactatgcattgttgtacataaaatttgcaacttgtcacgcattcattattttaaattttaatcttccatttgttatttatgcattttaaaaaagtgcagttccgtataatcatgcctttataaagccaaaatcatgtacaatagcattcatccccacaaccctcttagttacaataggacgataacgtttcgacaactttacagaaataaccgtcccgtccttaatgttgggcctcaggaaattggggtactcaatcaaaattgaacaaatgtcgtcatcatcatcatcttcgttgacacacaaatggatacttagaatatgcgtcaacaactataaaaaaattcgtcccccaaattggacccgcgaggtctgcgtggacccgttcgaatggatatttggcctcaggccatttatattcggggtccacacgcggttcatttgacgcatttcgttgacaaatgtgacactcttccacataattttcaacttcttcagaccaattatgccaccacacgaaatctctggctcgggctttgcatctcacaatgccaaaatgtgcccgatgaatcatttttaaaaccctttttctcatttcctgcggaattattatttgtctccccaactttttccgaattattttcccatcgaggtataatttatctctctctctaaagtacggcatcaactcatcatcatcgatcggttccacccagcttgcctttatctgtgacagtactcgggacagtatactatcttcaaatgtctctttttctatagtttttcgatgtaaacctatttcatcatcaactgtcaataaaaaaggaatgtcctctctgctgtttccttctatttgttcccatttaattgcaactctcgataatgcatctgccactaaataattggtctgaaattttgtacggcatgtactattgccgctaattccccgtgtgtgggcggaagtttgattctgtggtagacaaagttcgggaccaataaccgacagagtataaatcattgccattttggctctgcataagcgctcacgcataggcaatagcagacgcatcggtgaaaagataaaaaggcaattcgtaattcggcgcccttaggcattgggcattcagtaaattattttttaatttctcaaatgcctctttttcgcgatttccccatacaaattcagggatttttcccctcgttaactgttgtaacggatttgcaatttccgcaaaattttggataaatttacggaagaaagacatcatacccaaaaatctttttacttccctagcatttttcggctctgggaatccttcaatcacttcctgattattcaatgagggccgatagcccttcccatttaaaatatggcccaaatatgtgcattcatttttcaaaaattcgcatttctctctttttaattttaatccgaattcattcaatcggcaaaatactctttccaaagtctccaaatgctcctcttccgtatttgtatggaccaaaatgtcatcaatgtatacggttacattccgaataccctccaaagctttgtccatggtcctctgaaaaatgcttggcgcatttctcagtccgaatggcaattttaccatttgataaagtccccaaggggtaacaatgccacatttataagaactttcggaatccaatggaatctgccaaaatccggaggccaaatccaaggttgaataaaatgtttgaccagcgacccgtaaaattgtcttatccattctcggtattggatatgggtcgggaatcgtgattttgtttaatggtcgaaaatcaacgcaaggacgtaattggccatttgatttttttaccaaaacaacattatgggcccaaggggtaaagctttcagttataacgcccgctttcagcattttttcgatctgtgattttaattctcgttcatatttctctggcactgggtacggtttcgttttagcaggtacatcagaggtggtcaagataggaggtgcttttcctttacaatccccgaggtcataatggtgggtcgaaaatacatttttgtgtttctcgatgacatttttcaattcccgtttttgctttttgaccttcgtgtcccatttcgttttcact

SEQ ID NO: 13555 - DNA, 941 bp, Heterodera glycines
  misc_feature (31)..(31): n is a, c, g, or t
ttctcacgcaaaacatgtccgctgcgtcctnttcgtcggttttgttgacatttccacacaactccgcactgtttgcatttcttgaattgtcgacacacattgctcgacaaatgatgactgaagcagtcttggctcgtgaaatccttgccgcatgctgtgcattctctgtaataactggcgctgttgtcatccgctcggcacggtcgtcccactcctatccgaccacaatttatgcactttgctttacattgcagtgaatgatcattagcattatcataggggcattcacacgaaaaacagtagtagtcacgtccaaacaccgctttgcccaccccgcatcgaattccgtcgaaatggccgttgtgatggtagagcgggatttcgatgttgtaattgtccggcccatatttaaattttggccgatagctgcctgtgacgccaaaaatgaacaccttaaatcgctggtttgctgtggcgtatttccgattccaatagtccacgacaatcggcacatagacaaccgcatcatattctctcagatgtattatttgtgcattttgaataaaatgattaatccgtatgtgtgtgtgtgtgtgtgtggcgcgtgccaattttagtctgcctcggggaaagcgcataagggatgattgattattttattataccacggcgcacgttgcgcgcgctgttggtgcctgccgcatatatacaatgaattgacgcgggaaaggctcacttttttcgcaaaaatcaattatcaaaataaaataataatgtccttggaagaccacaattattgcggcgagttaggcggcaacgaaacgcccacaaagagaagaaggagaaatgacgatgatgatggggagggagagccgaaatttcaaaaaaactgcattcgcacactgagcgccgacaaacagtacaaccaaaagttcaaagtg

SEQ ID NO: 13556 - DNA, 2518 bp, Heterodera glycines
  misc_feature (9)..(9): n is a, c, g, or t
tttcctttnaatcatttataataagcattcataattatgttttttgagttgtgataattcttttcttgcctttgcctttttcatttttaaatgcctttaccctttttttgtgtctttataaaattccattccatttctttttttctcggaacctattaagttaacatgagttcctttcaaagtgtctgcgatagttttatttttctcaaatgattaatctcaacttcaagcagttcatatgagctgttgtgcttcgacaggccgacatcaacagaatgacgcacaaaatgcggttgacccgtgtgctcacgtggtccacgtgctcatgtgctaccaaatggttagaaaattgcgaattaaattcgggaaagtttttatggcattttgcattgccatttaaggcggggaggacgaagaatttgtgcgcaaggcaatcgaaagtttggtgaagaaattgaaggtggtcgagaacggcgctttgttggtttcaaggttttgacctctcgttttaaggatcgtcgtgagcaattgtccgttcgtttttcattcccctcctattttttgtgtccatttcggtccctcccaattttttagggaatcgcttatttccgcggtcacttccggcggcaaacaatcaaccagttgtgttacaattccggtcactaattgcctcaatcacattaattgtcccatttcttttctcagcgttcattggatggccgactgcaagtggccggcagaaaagggctgccccacgttgtctacgcgcgcatttggcggtggccaaatgtcagtaattggccattcgtttgcccatttttccggtgcctttgactcccatccgtccttttctgcttcctcttctcaccatttgccttccgtcccaattgaccaccaaagtgccaattccaatgctttcgatgcgccattccctcccattccgtcgttcgttccccaaccacaacaaaatcagcagcggtgtccactgatcgttcactgtttaggcgagggacaacaacagcaaatcgggccgtttcagcagcaggtaaagtttcaatggcatggctttttaaatgctctttctaaattaatttgtccatcttttttcagatgtgtccccaaaatacgactgaccaaagtcaaacgcatcggttcactcattgtattttctgaccaatgattcctttgccgttaaacaattctttcattgaagacaatttcgaactgcttcaactcccttcagttcggagtatcttttaattgtgcctttgagaacatttcactgtcaacggatggttctttttcagaattgcccgaccattggtgttccatcgcttattttgagttagatactcagtcgggcgagctgttcaaagtgccatggcaaatcaaagaggtgccattgcataaatgttaatttgtttcatcggacaatatttaattctttcaatttcaggttgcaattgacggcggaatggacccttccggcgctttgtccgctcgcttttgtttgggcgcacttgcgaatgttcaccggaggttttaccactttgtaatgaaagaaaatggcactttaagtgaagcatcggaacgggcacgaatgcacattggcaaaggggtgggcacacaaagggacagaaaaggggcaaattggcactgccaacgactgatcagttggattttggggaatgaatgacctaaaagtgatcaaaatccgttgacaattggatcaaaggaggaaagatttgtacaacagttaaatcttatcttacaatgatttacactttcataatttataggtttcgttgaaatttgctgacaattgcgaggccgtttttctcaagtccgtcgggtcaaaattaaaaaatgtactgaatttgttttctgttctctttttctcagatgtctctcccaaaaaagcgttttcgtacgaaggtttatgaattttgtagttattggtcaaattttggtaaactttcagccattttatggactttgagtttggcggaggatccggcgggtatgcctttttttaattgtcataaatacgaccacatgtttgcattacatacctcaatgcttttgtaactataaaaaacctcaagcttccaaaaaccaaaaaattttaagattttttatcggaatttttttaaagaaattagaaagtaaaaaattaaaaaaatcggggaaacgatggggggagggaaatagtgtaccatcagagacttgtatacctttttccccttttagaggcgactcgattgttcacaaaatttgtcccggcgtcgagcgaaaagtgttcgaccttcgctgggcgtacgtcgaaatgtgccgtcgacgtgaaaatgcccaactctccggtcagttttggcatgaagttgtcatgcagatatttatagtcaaattcagatccgtttttttttcctttttatgcttaggcatcattgcttttccctttctttatagccattgcccatagcgtacgctcgttgccggctttccctcccaaatgccctcg

SEQ ID NO: 13557 - DNA, 1936 bp, Heterodera glycines
atagtcaatacaatccgttttttcctttttatgcttggtatcattgcttttccctttagctattgcccatgcgtacgccgtcgccggctttccctcgcaaatgccctcgtcttcgctgtgcagtgaacgcagtgccgaaacgggggtcgaccatctgcgaagggtccggtcaaaacagtggcaattgttgttgtgcatttgttactttgcttctgttcagatgtgctgcaccgtttcgcttagttttgtcaaaggatggggcgaagggtacggacggaggacaatcaaagagacgccatgttggattgaggtgggggggggacggagaatggacggacggagaaagacaagcgaaggggaaggacggaaaaacccaatagcaaactttgaacagcccaaaaacaacgagttcaaaaccgcaaagccatgcccaggggacgaaaagcccctatagagagaggcccaaattagagggaggaaaatggcactgtctttctctctgttgctcatcccacttaattaagttttgagtgcaatttgtttttctcgcaggtgcaacttcaccgacctcttcaacttctcaatgaactgcttcaaaaacccgaggtgattagttgctcattccagatggatttgtttgtttcttggcctgatcagtgatcacttcccttccctcctcaaaatgccaatttttccatttcctcccttttttcattatgcccttctctccctcttttcccctaatgctcatttgtgccatttctctgttgtgctttagatttattcattccaacaatgtccatgcacatttcccatttcattcatttcgatagcccgccaaataaacattcattcggttttctttatgcccccccccctccgaattcattgctccgtcgaccttgggatggatggccactcatccgatgaacgacagtccgaccgaccatctgtccgccgttttctgctgtacaaacattgccattgttggtcatcccccgttgggaacattcacttgttcaatgataaaatgcatacggcgatggtttctgctgattgaccaactttttgtccaggacaattgccgaactttgtcactttaattttgaaaatcaaattgactttggcgaggcttcgcctttttcttcattcgatgcgcttctttttccctccccttttgttgttccccaattttgtggtgtttcccttcccaacttatgcaatttgattggtccgattggattgcccccccccaattccatgcaaaaccaaagcaatgaattgggggggggggggggggaagaaaagattcgtttccttttgtgtctttgaatttgcttttgtgtttccttcccttttgctggtaaataaatttaattacacaaaaataggcatttaattggtaaaaaaagaatcttttttttgtctttcattaaaatgttatttcgttaattgccaacaaaaacaaattaattgccatcttttgaaaggtcagtcgattttggcactttcgctcgccctttgcttctcccaattcccttcccggcgtcacttcagtcggtcatttgtccgtttgttattttttggcaattgtttctgggaagaaatattgcgagacaattaccaaaccaacaacagcaggtgggaggatggaaatgggagaatgaatggcaaaaatggcatggaaaaggcgcggggggaaggggaaatgggcatttgggaggggggaggtcactcactccgccgtcacccgtccattcatccgttcattcattcgcttttccttggccatgcttttccggccaccaccaccaattattattattaggccaatgtacgtttctccctccaaacagtgactgtttcattcttccgcggtgaacagaaacatttgaatgcttttgcttttcccgtcctccgatgcttttccttcccc

SEQ ID NO: 13558 - DNA, 2811 bp, Heterodera glycines
tttttattattattcaattaagaactttttgataaaactttaaatagtgacgaaaatttcgcattaatttttttgcggcgccttttttaaaaacttatggaacaagagggtatcgataggtgccgccgggggaaaaaagggaattttgacagatttgggtattggtgaaaatctgttaacaaatcacactcaaattttcaaaatttccccggcggcgcctatcggcaccgccggacctcctggtctccaaaaattttttggaaaaagcgcaccgcaaaaaactgttttgaaaagcaaaaaaaaaagtccgctaggcaaatatttgaaaaaatggtcgatcgtaatggaaatgggctctgacccccccccatggggggccaaagtcgatcgtaagacccattcactgaccccccccccccttgttcaggtatgttttgcgcgcccttttattaattaaaatttttgatgtggcctcaaaacaggaaagtaaaaaaaatcaattattttttatatcaacttatttaaaaagcacttattttttgttgcaatttttactttccccccctcccctccctggctacgcccttgacccgtattgacggggtatccaagcatcgtattttctatgccacaattactagtacatccatccctgtccacaatcctcagtgtgcaaaaacttcatggtggtaaatttgctttaacgcaggaattgagcaaattgttggagattgccgactacggcatgcagtacagggcggtcagccacgtgggcgccgttctcggctcttcacgcgacacgggcaccaaatcggccgaccccaatgacccaaccgtgccgaaggagcaggtgccaccacgatggttggagaattggcggaatcgacgggcaaaagcggcacagaaaagggaaagcaatgagaaagggaaagagagcgaagtgattttggacggaaatcgggacaattaaattcttttatttttatttttgaaattcactgaatttattacgcctttttctcaacataaaatttcaaaagatttcttccattcctttttcccctcattttattctctttggtttctcattcgttcagcaaatccatcttcacatatcggttttggcctcgtcccccatttcctccgttcatcgcattaaattgttcgtcgatgtttcggaatcggctccccgttatttcttccggtgcgttcacatacggactgattgtgccgtcttttctgtgccattgcctttccctttcattcgcttttccatcgtttcgtccgtccattttaatgcgcgtcccttccggcggtggattaatgtctgcaattgttttaagcattttttgccttccattccatgctttttatgctctttccgtttgtcccattttacccgtgtcttcccttccatttgtctgttcgttttctctgtcgatggcttttaatgggccataatatcctggaattgttttttactttctctctcgctttgttactcttcttaacttcgtccgtttgtcttcgtgaactgttttccccagtcttctttgtattcgttcgtttgtcccgcatatttcgcctgaggccccatccgttcgccgtcaacggccggtcggatgtcttcgtgtaggaattcggacaaagggatgggttcgttttctgaccattggatttaattttatgaaaatttatttcattccccccccccccctcccccacctttcaatgttaaattattcgacttttgtccatttgggaggtcaggcaatttggcaatccgttcattcgtcaaaattaatgtctttggccgttcgattccattggctaataatttttgagagatttttattgatattttccacaaaactgctcgagagtctcgtgctttagcaacctccgtaatttccctcttttggcttttcctccgttcgttcgtcagttttcttttgttttgttcgcttctcttcccatggatttgcatagccatcgttgcgaattctttctacaaaaattggcgggagtacaattcaggttgttggcggcggctggggctgaggcaaagcgcgacaaattggtgacgaaattcggggagggcgcccctcgcggggccgtcggtgggaaaacgattggaccgtaacaattgggcggacgggtcgagaaagtgtctaaagggggaggggtggacatactcgtctaaaggggggagtgacaaagtgtctaatcgaggggggggggggggagcgtggacaaaatgtctaaggggagggggggggggagtgaccgcgattcattggcaattatcctcactttttcttttattacctgctgctgctgctgctgctgctgttggctgatcatttgttgatgtaattgcctttgtttttctaccatttgtccaattgtccatcgtccgttgatcgtttgtctcggtttccccgtcccaaactgattgtcggcatttgccatcacattttccagcatgtcccggtcactcaattggtcatttcgtaatttccatttgttttctctttttctctaccaacccttctctctccgaatattttcccattgtaattgcggcggaatttatccgtcgttgggccattgactcaaaatcatttgggctaatggcgaagaacatttgaggaatggaaacgatgaaaaacaaaaagaatgtgaacatttgcattataattgactatatttgaagttttttaaaattaaatctgccgaaaggaataattgaaattagtaaatgctttggtttccctgctattaaaatccattgattgattcattgtgatt

SEQ ID NO: 13559 - DNA, 1131 bp, Heterodera glycines
  misc_feature (448)..(448): n is a, c, g, or t
tcaaatggttatcataaaataaaataaaataaatatctgaataatgagatgttagatcgaataattctttgaagaaaaatcaaaataaactcatcatctgtcgagcggatccgaaccaaataagtgaatttttgctggtttttttatttgatcacttttttttttgttgatcagtttgaggctcataagaagtgtgtgtgtttttttgggatttttaattcaaaacaatgacaattttgggcaaaattcactaacgaatttcaaccaaaatttcaatttttaaaataaaaaaaaactaacaaaaaatagttttatttaatgcaaatatttaaataaattaaacatctggcattggtcttttgcaacaaatatattaaaatgatgagattaaaacggtgattgttcgtaaaaatattaattaaattatatttatttatttgttgccatnctctgactttttctgcttgcgtgtttttccatgcgaggggagaaaagagaggggcaaaaggatactgatcaaacaccaccaaaggccgaaatcacatcagagaatttgaagagcctaccacactcactctcattcattcactcaattgtcattagccaacgaaaacgacaatttatgcaacataataatcggtgcttttcaattccaagaaaatacaaaattaaaatttggcacttttctctctttttgccactaaagttctccgtccggcacgcaatcgtccgcttcctcctaaactcacggattcatttcggcaattagtaataaactgacaaatgtccgctcaatttgcccccttcctaagtcacttccgtcgtccgcgttcattttccggaaagtcattttgtccgtgccgatgtccaacacggcaaaagaacattcgttctgaagagtgacatccctaaaattcatttttatattttttcttttatacatttcgcccattttctcacgatcgatcgatacccaccacattgtgccgatcgtcgtactgaacgttattcgggcgagcttcgcgtccggcgtttcctctttttcttggccgaaaatgcgaagacgtttcgaaaaatggacgaaaaaagggcttgaatatgggggaagccgaacgaaaggaaaaagcgacc

SEQ ID NO: 13560 - DNA, 1394 bp, Heterodera glycines
aatttttcactcagacccctattcttcaccagtgatcgtttttcccggttcccggtcgccctaccgggaccgtgacccgagctctctcaaaattcgggaccgggacctccgatgaccgggaattcccggcccggtcccggtcccagtcccgtggcactctaaaattaaccaatgccggttttaatttaagccgcaaaaattttcgattgtaataaaattgaacgactctgtggcattcgcctgagtctattaaaaagcccagtttgagacttctagttatcatttgattttgacacttaattttgacatttttgtgcttattgtgcataattaaatgtttttaaaaaatttattaaacaaaaatgcattaaaaaaatatatcctttaatatgattttttttaccaaaaactttccccaatgtttttttcttatccaaaacataatttttttattttcaaaagacagaaatttattatcaaaaaaattcggattttctctgtgattctcacaaaaaggacaccaaatcgaaaaaattttatgcttaattttctatcttttgctaatttagcatttttatgttttcacctgctcatcatacaattttgatgctttatttaagtgattaattttaaaaattcgctcctctctactaatgaaaaagggaggtcataatcactaactactaccaattaaaattcagttaaaaaacaacaatcattaccgcaagtgattgtcgcacccacttttccttggcggaatgttgtcacaccgttcatgcgcacctcggcattttgcacgacggcaccaggatgcttgatggtgtaaatcaatgcaccgaatccgtcactggtcagaaaggcacgccagtcaggctcaacctgcacgaaaaatggattacctataacatatatataaccagttaatttttgtcaaattaaggattaaagggatgatttcatcaaaattaaattttgttttgccaaatgattttgtaaaagaactttttttttaattcatttttttttgctcttttataaaggtgcattttttgtattttatttaaagcgcttatgtattcatcgatttaaaaagttttaattttatcattaaaagaagaaataaatataaaaatctaacgctattcgccctagtgcttagaaaaacaaatattttataaccaaatttcaaagtataattaattttagttaattttccaatttaaaaacattttttttagttttattttatttttgcctttctgtagacgccgccgctcttttcggcaaccgaaacaaaattggccattggcacgccaccactgcgcaacaacggtcgtatgtattggtcacgcacgcagtcgtaacggagttcaaaactcccgtggccaattctt

SEQ ID NO: 13561 - DNA, 3439 bp, Heterodera glycines
  misc_feature (64)..(64): n is a, c, g, or t
  misc_feature (83)..(83): n is a, c, g, or t
tatgatcgggtcagagctaaagggaatttttcgcaaaagattatgagcgcgcaaaaaaaatgtntaaaaaattaataacgatntaaaaaattcatatagaaattgtgaaaaattttggcgaattgataaatgggatgggattatatatcattattaagtatgtgaaaagaacaaatgagaaatttggtgtaaacaaagagagcagaaatgaaatggagtaaacaacaaataggtatgttagtaaaataaagttcatcgggggatgggattgaatggagaagaatcaaagaggaatgataaacaataagtgattaaaaaccaagataaattttctaataattttgatatgttttgtttgcaaatgccaacatttagagtgccattgctttggttaaaaacctatttaaaaactatggaattttcaatactaaaaattcctccttctaattatgataatatgaaactaaacatacatagctttaagctgaatggaattaattactgtttaatttttcaaaaaaagccatttataaaataaaaaatttgaaattatttaagataaataaaaagttttgatataaatatgtatatcaaaaatgaatggtgggaaacggccaaacatttttttgttgtgcattagtttaaacttctaaaaaataaataatttggcgttggtggtgaaaatggcggcggatcggcggggcaaaaaacgaggagagggcggggggggggaattaatggcggaacgcggaacaattaatgaaatttaggagagggcaaaaaatctgcccatttaatggcagaggaggggaaagggacgatttgtggctaaaaaatagcccggcccatcccatcgatcgtcgtttccttcttttccgcagtttttctgagccaaaactttacatgcgaagaaataaacaataacaaaaaacaaatttattaatctttgatctctaaacgggcaacttttaagttttaatataggtacatattttttcaaaaagctgaacaattatataaaattattaacaatttatgcaaatataatgttaaggtaaaattgtttttattttttgaaacattttcgaatttggactaaagcaatattgttttaaattaaatacgaaatattaaattaaataagtttattagatctttgatctctataattggcaggttttggaattttaaaaatacgcaaaattattaaaaatttgtgtaaaagagaatgctaaaataaaattgtttgatattgaatttttgataaaaacaattaacattaattaattaaatatgaaattattaaaattaatagcaggtttaaatatgtatataagtagttttttcagccgaattattataaaaaatattttaattttaaatcacttaacattttttaccctgctttgtttcaaaatttaattaaagaaagtaaaaattgtttctcttaattacatagcatgttagttaataacatttaataggctcccaaaaatgcggaaaacttgttgaactgcaattaaaaaggtaaacgcaacaacaacgaccttgattttatgagtaaccaaatgaagaaaaataattaaattgaaacttgtaattggataatttgcaattttaccaaacttaaaatcaatatttttgaaaggaatttatttattttattttttaatataaaaaattacatgtaacgtaagtgtaaaatgcataatttgatcaaatattcatattctttattatgtgttcagttgttttttaccatcctatgcatttcacttcgccatgtgttccgttggcaatccatgcgcaatcaatcggagtgtattgagctaaatgaataataaatgttttttgtcaattgatgctaattattctaatttttaaaaagaagaggaaaacccgaacgccgaaaattaatcgagcgttggagagaaaagaagaattaaaaaaagaaatgtatattaatttctagagcccggacgggactggagccgtcgcgattttgccgggacttccagccccggtcccgttttttggacaaaccaccgagaccgggagtcccggaaaaacgggagtcccattcctgggatcccgacccgctttattttccaagtcccggccccggtcccggcaatttcaaaattttgggctctatagtcgctttttgattacctatatgtgtctccccgcaaattattccaaaatcccaatcacatggaaccctacaattaaatgatgctaaaaacaaaatttttatagatataaaaaaagacattgacgattgttttttgtaaaaataaatacaattatttttaaatgcatttaccaaagagttcttcggtgcttgttgggtctttggaattgcagctcgttttggttgcgacgcccaattggatccaattgtttgtgccaattttcagcatcaatggactaccgctatcaccctacagtaaaaaaatattaaataattcatattacctaattatttttattttctatgcattttcccctactaattgtatacagtaagtttgtacagtattaattctaccgtaccggttcgccaatgctcggatcgggcaccacacaaaatgttgtgtccaacccgtatgtttcaaattcatttagcatcgattcaatttcagcgtcatcgctagcagaccattgaaacgctaaattcaataatttaaaattaaaaatgaagtaaatctaacaatttacaattttttttttcattggccatttctcggcatttttgtgtcgaaatcattcgcattttgccataattcaattgatcatttcgagtcttattttggtccttcgcgcactgtggccgagtcattccccaaccggcaataataaatttggtagtttctgattttgaatttctcatcagaaattttgcgcgcgttgaatcttaaagttttgttttttcattgaaaaccaaatattattaaaaatcattttgtaaaaatattacaaaaatatattaacatcaattaaacatttttttttacaaaaactaacaaaatatttttttttttaaatataaaattattttgggagtttattgtgttaagacttattgggtaaaaaatattaatttaattgaattaaacttattaaaaattaccaccaataccaaataaacaaattggtcgaacatttgatgtaaatttaattgggtttttaatctaaataaatttgaatgattaatttattcataaatatttaattaatcaattactttaattattgcaatgtcatgcaaaattaaatctgcccttgatgtttcatcgccaaaattatcataaattcgataatatttcgcatttggatacaattgtatggaaacaactgcagatttatacggttggcttgaaacatattcattcccgtatgaaattcggagtttttctgttaaaaatttaattcggca

SEQ ID NO: 13562 - DNA, 1277 bp, Heterodera glycines
attttcgaaggtttcctaaggaattgctttcatttgagccattataataaaaacggcgcggaaaaccaaatcaaaaaaaaaaatcaaaattatttattttatgtgtaaaaattaacattcatgtttctctgaacaaagtacatcataaatttttcctgttcatccatttccaattcttcctccgagttcccatcattcgtttcgcctttcttcaacaaattgctcagcaagataccacaaaaaatcacagtgcctaaccattgatttgcaagaaacttttgccaacaatcacttggatcatcaacatgtaaagtgcccaattgccaagccaaatgagacccagaagctgaaaagaattgagataagtgactcaaaaaggacaaaccgaataaagaaagaaaatagggccataactgctctgaaacaaatcccagaaatagcaaattgctaagcattccaagtgaggcaaaagtaagccacaaattgctatggtcaccaaattggacagcggtggacccaatgccaatcaaaagatcgtcttttttatccttaatcaggttaaatgcgtatttgattggcgtttaatggatttgcctgttgagcataaatcgtgtcgtaaatgatcgtccaacaaacgcaagccaagtaaagcggcacacacacagcggaagagaatgtgccggttacagccgtaaatccgagtagagcaccccaattgaaagtgatacctttagcataagaagggggaagtttattaacagattttgaattaaatggtcaatttaattattatttattaggcaaaaatcttcgaattatcatttttattattttttacaaaaaaccgaaaagtaaaatcttttctatatgtatacttattcagtaccaaagatattttgccatcccagtcccgggtttttaacttttgatagagtagttgtcgaaaaattatttcggattcctattttacagaccgaggtagtcgactgatgctataaaaacactttttctaatttgtttggaagtgacgattttgaataccaagaatgagttgtggccaattggtgtaacgcttagccaacgggtagagagcaacgaaaaaaaccgaagacgaaccaagaacaatgcttaaatagcaaattgtggaaagcataaataggaaattgcctgagccaattgaattgcatcaaaatggccagagagacagtgagaagaccggaaaggacaaagaatgcttccttctcagtcacttcaccactgacaagaggtcttgattt

SEQ ID NO: 13563 - DNA, 1492 bp, Heterodera glycines
cctccatcacatatgcttgtgcctaattgtaatgcattgttttgaataccgatgatgaaaaagcagaataattgacgagatttgaatccagatgaagaaaatcgaagagaattgtcagatttgagtttcagtaatgaaaatgccgataattcattggaattgtttaagtttagtgatgcgaataagaaaaaaagggcttcagattctcatcccttacgagtatttctggttacggacttgctgaagctataggatgataaacctataccaatttggttgctcgaatagctacttacccgtttatcgatgtcttggtcccaaagatcgttaagaatgcatccggcacttctcatcaaaaatgctccgcctccgaagagagccaaaaaatatggacttggaagacaacccggaggagcagcgaatgcaattgaccaggcacatggccaatagagtagccaagtacctaaacttggaagaagtggtaattaatatattacagatgcaaattttttaaattgattgatccctaggaaattgaaccgaccaatcggcttgtctgcacgtatcaatttcaaataagaatgaatacgcgacccattgaacagagggaccacggaataactgcggtcactctcgaatctgcgtgaaaattgaagcaaattccacaccggacttggttagcacccacctcggttcatacaaatcatctggttttggcgcattagcagaggaacggagagttgggtagtgccgacaagacgggagattttcataaccgacaaagaaccgattgaataaatttttgcttagaattcgattcatactaaagaaataatgacaacaaaaaaattgaattagtaataattggttaaacatggttaatgattgttaataattggacattataaaacgtttatttgtcggggcaaaaaattgatagaaaataataagtgcgtgtccaagtaatctccggttgaaccgttctcctaactcatataagaatgccgaaaattggctgggctcgtataagcctggccaaggacaggatacattgaggctgccaccccttgagacgaatactgagtttgagtggtcattccaagtgcagaaggagacgggtgctgcggttggtattggcattgttggcgaagcaattcggcaagcttttcggcctttagccttctgaaaatatttacctctttataatttgttttttttatttttctatagcttattttatttttaatcatatatttattaacttaattttataaaaataaaacatagatgagcagacctcacgggaaaagcaaactcctttcggaaaaatgtttacctcgtatggccaataacgcgtttttccgtgaatttctttatgaaatcatctatttccatagcccctttgtaaaaagttcggccgctgtctgacaaaataatatgtgctttggtaaagaatccatgtgaattaaaattcagggaaatggtgcaaaaa

SEQ ID NO: 13564 - DNA, 653 bp, Heterodera glycines
gggattcgaaattggtcaaaatgcgtgtcagatccgtgttcagcgactccgaaaacccttagaaacatattttcagtgacttttaaagttaattatttttttcaaaaaaggggtcctaccatcggtagtattaccccttcatccaccatcaaaaatttataagcctacttaaactccataaaaaccaattttcaaccaaataacaaagacactagccaaaccatatataatatcattaaacttctcatgttataaatggctgcgcccaaataaaggtttaaactctaccgaatccaatttcgccttcatctcattcacttcccccttcgttctcacggcattggcatgcgtttcgcgcaaatgactaagagccttattcagttgtggctcaatggacagattgtactcggccaaggatttgctctgggccaatttgatctctttgtcattaggaagagacgaaacctagaaattatgaacttaaatgaccgttgacttcataactaattcacctgcggcatactatccaccatcgcattcaatcttgactcatcctgtaacaaattctgcaattggtcctctgtgtaatttcgaagcttcgacattagggtagaaacacgagatgtccatcaacgctttcatagtcacgtgaa

SEQ ID NO: 13565 - DNA, 1141 bp, Heterodera glycines
gagggcatcttttgggtcatcaagtggctaacactgtcttcccctgggcacatgcgatagatattccccatcccagccagaaaatccaaatatgggagtatggtacccaattttactggtccgtaaataactcaactccctagaggggcatcctttgggtcatcaagtggctaacactgtcttcccttggcacatgcgatagatattccgcatcccagccagaaatccaaatatgggagtatggtacccaattttactggtccgtaataactcaacaccctagagggcatcctttgggtcatcaagtggctaacactttcttcccttggaacatgcgatagatattccgcatcccagccagaaattcaaatatgggagtatgctacccaattttactggtccgtaataactcaactccctagagggcatcctttgggtcatcaagtggctaacactgtcttcccttggcacatgcgatagatattccgcatcccagccagaaatccaaatatgggagtatggtacccaattttactggtccgtaataactcaactccctagagggcatcctttgggtcatcaagtggctaacactgtcttcccttggcacatgcgatagatattccgcatcccagccagaaatccaaatatgggagtatggtacccaattttactggtccgtaataactcaacaccctagagggcatcctttgggtcatcaagtggctaacactgtcttcccttggcacatgcgatagatattccgcatcccagccagaaatccaaatatgggagtatggtacccaattttactggtccgtaataactcaactccctagagggcatcctttgggtcatcaagtggctaacactgtcttcccttggcacatgcgatagatattccgcatcccagccagaaatccaaatatgggagtatggtacccaattttactggtccgtaataactcaactccctagagggcatcctttgggtcatcaagtggctaacactgtcttcccttggcacatgcgatagatattccgcatcccagccagaaatccaaatatggggagtatggtacccaattttactgggtccgtaataaactcacatcctagagggcatcctttgggtcatcaa

SEQ ID NO: 13566 - DNA, 902 bp, Heterodera glycines
cattttctgcaatttggtataacccaaaagaatatcattcgtttttcattaaagataatataatatcctttctctttctttagacgtaaataatttgaatattctttagccatcttaaaaaaattctccaaatttgtcgctaatcctttgacaaattccgaaaatagagcatcatcaatctaaattttgaatttatttaatttacattgaacgttaagtcttacccatttccattgatcatcaaattccgaatacgcaattatcagatgcttgtcatcatttatttcattggcaccccaaggaccgtattcttttgtccttttttccgcttttttgaacattttctctaactttttgtcaaatttatctccacaattttgtcgaattattccgtctaaactttcatttgtttgccattcattcgctgtgtcaattgccaattgcaaaatcatttcattaattgacaatttttgttcataatccaatctcttctcattattcaataattttggttcataattataattaaataatctgtttaatttatattcattaaactcactctcttccgaattaaaataaaattgaaaaattgtggccaaacaattcaccgcataaattattggtccttcaatttcaattttatttttaagcacaaattttggcttctttgtgtgaatcccaacgtattctctgcacaaatattcgtgcaaaatgtccaaatatttgcgatatttttggcattctgtccgttcatattcttcaaactccaccgcaattttgtcacattgccaattcattctcataaaatgcatgatgccaaggtgtgcttcatatttttgtcttgaatactcactgaattgaatttcttggtgacctttcataaatgcaattagcatatt

SEQ ID NO: 13567 - DNA, 3442 bp, Heterodera glycines
atgaagtatgtaaaaaatagggattgatcatcagtaggattgtccaaatccatattttacttaatataatttatttattatattaaataataatgaagtatgtaaaaaatagggattgattgtccaaatctatattttacttaatataatttatttattatattaaataataatgaagtatgtaaaaaatagggattgatcatcagtaggattgtccaaatctatattttacttaatataatttatttattatattaaataataatgaagtatgtaaaaaatagggattgattgtccaaatctatattttacttaatataatttatttattatattaaataataatgaagtatgtaaaaaatagggattgatcatcagtaggattgtccaaatccatattttacttattatattaaataataatgaagtatgtaaaaaatagggattgatcatcagtaggattgtccaaatctatattttacttaatataatttatttattatattaaataataatgaagtatgtaaaaaatagggattgatcatcagtaggattatccaaatctatattttacttaatataatttatttattatattaaataataatgaagtatgtaaaaaatagggattgatcatcagtaggattgtccaaatctatattttacttaatataatgtgtttttatattaaatgatgaagcaatatttaaaaaaattgggattaatcataagtgtgccaattttggcggatgtttttgttaagtaataaattttttattgaaaaacaaaaactatgacttacaataataaaaagcaatgtaaagattttatttgtcgaccaattcaattaaaaaattaatatgccgataacttatttaaaaattttaacaattatgaattaattaatacatcaaatagtaaaaaattaatgtagaatacgacccattattaatcagaatcccctattttcggttttaataataaataaaaatatattttaaataattttaaatttagaaaatttaaaaaataaaatgcaattgctcttcacattcccaattctgttggtcattctgtttgcaaacattgaccagaactaacattttgctgatgccagttgttgctgctgttggtaagaggaaattttttaaattctctgaaatttttttatattttttaattattacagtaagccttgctgttgtggctgtacctgtgtcgggccgtgccaatgttgtaacccaccactgctgatcaaattgccaaggtccaggcaatcgatgttttgaaaattttttcctaatttttcccgaattttcaggacttgcccctgctgttgcaaatgctgtggctgttgctgttgcaggccatgtaaaatccaaaaagtttttaattttttaaccaaaaaagttttaggctgttgctgctgcggttgcggcggcggtggcggacgtaagaagcgctcaattgtcctccgctcggccattgaagcggccaaaaccggaaaacgtgagaattttcaaaatatattaccgtattttccaaaaaatatacacggcatttcaaaaaacgcatacatgataccttaaaaattcgccggtgaatttagtaatttaaggcctttatttttgatctccctcaagtatgggaattaatgttaataaatatttttaaaaaaaattagggacttacggtgctttattttaggaacactaaatagggtaatcaggacgacatataggttgaagtaatacggtacttgtttttttttgtcacggtacaccaaccccaagcctaattccaattttgacggtaccaacctgctcttactcagaaaatttaaaaaaaatttaatttttagctgctccaccagccaccaaaatgccaatgtcatcacagccatgcccaccagcagaagatataaactgcaaacccacaacagcgcgcagcggcgccactgagtgccaaaagtgtggagctgcagcaattagtgccaataaaagtcgcgcaagacgaatggcatttggcgccacatttttattcgcttgatttttcaaaatttgtcattattatatttatttttgtgagctcttttttgggggtttattttatttatacaaatgctggcggtggtggtggaataaaattggattttgccattcaaaatttgtccgattttaagcaaaatttaaaattaatcaaaattatttgtcttttaatttcgcaaatttatttaaaatacctgcaaattattttaattttcagcaattaattttaaatttctttgttttttatttaaaaattactacgcactgcctcagaagtatctatgagaatgtttaattgtgtcaacaaattaattgtcttcagaaattaattttgtcatcattggccgtcgtaattgggcaattattactaattaaaatttgaagtggagccaagcggaatcgaaccagcaaaagaaagaagaaagcagaacacactacccacttgactttatgcacaaacactctcgccttgttaaaagtaaaaatgaaaacaaaaaatttaattaataaattaatttaataaaaataaacgaaaatttccaatgtctttttgcttggctttcttgagttttccttattaggttctatttttatttaaataaagtaaattactcctattatttaatgaaatacttactagattattttttattatatatttattttattaagaatttttataaaaaatgtctgaaaatttaataatcaatcaatagctaaagatgaatttaaaatgaagagaaaagtcaacattaaatataaatttcagtaaagggttcaaaaaaacgaaatttacccaaatccctaaaaaaatttatcttaattttttggggggcacagaatccaaattgtcagccatatcgaatcctgaatccgaatttaaacaaataaattttaaaaaccttaatatatttgcgataatttttggtattttttctttaaacttttttccaattttatcacaataatgccaattctttctcataaaatacaaagtgccaagagaagcatgcgcagtgaaaaatgttcatttaaatagcataggaaaattaattataaattgaattttatcaaaatcgaaaaaaataatctttgaattttaattaaatgtttgtcagcttaactcccaatgcgatttaaatgccaaaaataaacaaatgatcttttaaaaagcccgaatttgttgacaccgaaaaatttttatgaaaatggcgacgaattgaaagtgtcaaatttgtcattgtattcatttttcagatctcttttttcttcactatttgccgcattttccattgctttttccaattttgccttttcttccttggcattttgtttagtattttcatacattttttccattttttgctcaaattcttgccgaagattgtcttcaa

SEQ ID NO: 13568 - DNA, 2438 bp, Heterodera glycines
ggatttttatgtttttacatattttttctgcggcttaaattattacgagagaagcccaaaaatcgtattttctccgaacaattttcgatttagagcgtcttataaaaacacatattttgacgttttggcacataaaaaacatatcgtacatatttcggggtttgtacatattttggtatttttgagaaaaatttgtatgaaaaacagaaaaaaattgaaaaatacacccctaaaaatcaacttattttcaaaatttatttatttatttcaaatgccgtaaatcgaattcttaatttgtcattggattataatttataaaaaaaaatttatcggaaaaaagatcaattttactttcgaacaccttgaaatgtatgtgttttgcaattgtgcgggcgaaaatgataaagaatgagatttttggaatttttatgcaaaaatacccttggtttttccaatttttaacacatattttagcacatatttcagctttttttagaacatattttattacatatttcatgattttagcacataaaaatcctagctctagtaataacaatgtttaaatgatgctgaaagacaaataatttatttgataaaggaatttttaatgaaaattaattcttccacaaatgaattttgattttgtcattcccgtaaatccttcatcccgggtaaaaatcgtgatcccgatcaccctgacttttctattcccgatcattccgatctcacattctcgtgcaacttttattacaaaacaaggctgacacctgaaaaatacttttgattcgctttaaattagtcaacattaattcctattaatgatgcaacttttagtgacgaaaaatctcgaaatagttaactaaaatagtgagtaaaaatgccaaaatagtgaccaaatagtggcaaaaagtccgaaatagtgacaaatagtgacctaattttcagccaaaaattaagcaaaaataatttttattcactggttgcagttgcaaatgagctacatttcctttataaaattctcttagcaaataatgatattttttaaatcaaaaattttgtcaagaaaaaaaattttgggggagaatttttgaaaaaattttccaattcttagtggtgtatttaaaaaaaaattttggtcgattcttaggagtgtattttttgaaatttttttagatcgattcttaggggtgtattttttgattttattgcatttttgctaataaaatctctgaaaaatgtcgaaatagttaaaaaatagtgataaaacgccaaaatagtgaattttcactattttagtgacgaagcgtgaaaatagtgatttctagtgatcgatagtgagatccaaatcgaaaaatttcaacgcagaaatgcgttttttgagctcctttcttcaaaacaatcgagcaaaaaaaaaatagttaaatcactaaaagttgcatccctacctattaatataataattagctaattatttatttgttttttttaaatatttttagacaaaattaatcttcaacaaaattataaatgcatttggtaatttgtttttatttttagcatctcctcaacatcatttcgctgcattttccatgggcggtggaaatgggttaataattataccataaatttttttagttaaagatttaatcaactattttgtttaagcaatgttagtgcatcggccgatgacgagggctacgatgagcatacagtatacgccactactgtacacgggggagatgatcaagaacagcgccgaattgtgcgtacagtaaccacgagggtgcgcgatccggtgcacacgcgagtacgatttgtggacacacaggtgggcaaatttgaataaaatgcataaaaagcctatcaacactagagcccggaaatttcaaatttgcggatcccgctgcgggattggtactgaaaattctttgcgggacgggatcccgcgggattaatcccgcaaatcccgcaaatcccgcatttaaaatttgcgggatcccgcgcgggattgcgggattttggaaaattcgaaaaaatttcaattaaattcaaaaaatttccaaaaatcaaaaaatgctgaaaaataaatttttaggggctggcgggatgcattaaaaggggttgatgggtcgactaagatttttcgattggatccgacggtaaaaagttgatcggaaatcaaattattaacggttcataaattgactatttttttcttttcaaacccacttttttgcggtgcaatttttcaaaaaactaggaacagagggtccggcggtccctatcagggatggcattccgaggccccaaaaattttcggaagtcggaaatcggaattccgaccccaaaaacgtcggaaatcggaaatttttcaaaaaatatacaatataataaaaatttctaaatattttaataggctaaattttttaattctt

SEQ ID NO: 13569 - DNA, 998 bp, Heterodera glycines
  misc_feature (814)..(814): n is a, c, g, or t
  misc_feature (850)..(856): n is a, c, g, or t
  misc_feature (858)..(858): n is a, c, g, or t
  misc_feature (860)..(860): n is a, c, g, or t
  misc_feature (864)..(866): n is a, c, g, or t
  misc_feature (878)..(878): n is a, c, g, or t
  misc_feature (880)..(882): n is a, c, g, or t
  misc_feature (904)..(904): n is a, c, g, or t
  misc_feature (933)..(933): n is a, c, g, or t
  misc_feature (935)..(935): n is a, c, g, or t
  misc_feature (943)..(943): n is a, c, g, or t
ttgtccaaaaattacaaaaccaatcatttcgtcactggtcgtttcgtcactgagaaaagtttttaaaaaagtttggcacattgccctaaaaacaacaaaaaaaaaattctttaataaacaaaagtgttagcaaaaaagaaaagaaatttgataaaagtttaaagttgctcttattgtgagatttcttacttccaattgtgcttatttctaaaatttatttacgacgaactttgtgagagttttgcgaggcccctcgcactagtgctgtaagagaccgaaaatttcacgagactcgaaaccgagacttcaccccaatcgggaccgaaaaaacccgagatttttcttgagtcgagactcgagaccaagactctcgatcaactctatcccgcacatcgtctcttcgcggcgctgcttttctaaggaattttaacgattttatcacaaactttgtcaaaaataactttgtaagaatttttcgaatggccttacgatggattttgggtaaaaaaaacaactttgaagaagagaaaactttaaaattttttttgctacaataattgcaattattatgctttatccatttctttttgtactttttaatatcacagcttttgtttattaaaataaagtaatttattttttcagttttgacaatctgccaaacaaatttaaaaaaaattttctcggtgacggacttaacagtgacgaaacgatcagtaacgaaatgaatcagtgacgaaatgatagggagcctatcggcaccaccgtaccccattgtaccatattttttaaaatatccccctcgatcgccctntttgtcaaagtgtttggcccgcccgtgaaaaaaacnnnnnnntntnttcnnnttcccccctccncnnnccttttctccctccggccctgntgctctttagaggattccccgcccttttncnctcttttntttgccttttttaaggcttatccactttaatgcataatttaaacttttcacgcat

SEQ ID NO: 13570 - DNA, 2259 bp, Heterodera glycines
  misc_feature (2109)..(2109): n is a, c, g, or t
  misc_feature (2202)..(2202): n is a, c, g, or t
tgaacgcgcattgatcgccttggtggcgtcttaggtctgatgaaaattacatcatcagcctgcgcaattggctcttgcgggatgcaagactccgacaccaaaccaagcgtgtcagcttggttttcaccggccacttgggcctgggtgagaatggcatcaactgcctgtccacttgtatgtggttcgatgatcattatatcatcatattcatcaacttccattagctcagcggccttggatgtcgactgcgcttcatccgtatgccgatagacaattgggcaaggagttggcaccccttcccttggatgatatggcacattatcagagccatacagctcgttaatgtgccataaaatgcgctttttttcataattgatggataaatcaggcagaacaaatgtgcgattgttcataagccatgactcagcatacaggcacacgaagtacccacaactattaccatcgtgttggaccgtcagattttcgacatcaacaatccctgtcaacactgctgacggcaaaatatccgaaatgatatttttaattttatccgtcagttgcggatccaacctgccatatgtggtaggcaaagaatcggcaaaatgagtgccaaattgcacatcatggacaatgagagtccaatgtccagggaaatgtactggcaaaagtataacttctgccggaacattagggtcgtacccaaatgtcatatttttgtaaggcatgactctgtccaggccattgctccataccattgggtcaacaacgaccacttttcgttgtgatatggttgccaagtatgccaagtatgtggcagcaaagccgtcattgagaaactgggtcatatcattccaacaggtctcaatgtatcttgggccagatcttggggcaatcggtgtttcgccatcacgttcgtaaaggccgattgctgcccatttccaaattttacaggcaaaatttcgcgatgtggcgaaattaatttgcacagagctgaaatcaattttttcaaacacaatgtgcgagggtgccggacttagagcgttttccacagtttggtccatttcagagcatttgctcatacactcgttggttttgcctcttcctttaccggcatgccctcccagttgcttaactggtcgccctccacgactttgagtcgaaagaggcgtcaaagcaatagcttcattggcaaacatgggttggccacactcggcgacctttcccctttttttgcacggcgaaccctggtcactttgagtgaccgcagttcgaggtgtgtcaatgagagacaccctttcttgggtagccaagattggcttcgctccggctttctggggtctaccccttcttttacttccagtggaagaagccggcgtgctcaattgcagagcactaatgtttggggtgttgaagcccctgggcgatgccgctccattcccatctgcactcccgtcagggacgggtgagcgaaccgggctgacagattgctccgtccgccgtcgatagcgctccagttccttcttccttttattttgttgctttgaaggcattctgaaataataaatcagaaagtgttacaaatgtggcacaaagtatgaggaaaataaccatatgatgcacagaaaataaaaatatttatttaaaattgcgcaaaaaggttattctgtcatcattcttcgccgtggagtgtagtcttcctgtgctgaaatccatcagtcagggctcacacatcccattaagaatgcagatgcaaaaatgtccggtccataacccaaaagggcaggaccagccactatttttggtgcgaaccacaatcccccgaaggggtaggtccagcgaccatttttggtgcgacaaatgccccgaaggacctgtcagcgaatcatattggtgcgacacatgccccgagggccagtcagcgaaccgcattggtgcgacacatgccccgagggccagtcagcgaaccgcattggtgcgacacatgccccgaggggccagtcagcgaaccgtattggcgacacatgcccccagggccagtcagcgaacccgtattggtgcgacacgtgccccgaggggccagtcagcgaacccgtattggtgcgaccgtgngccccgaagggcctgtctgcgaaccacattggtgcgacattgccccgaagggcctgtctgcgacccaattttattggccctttgtttgcgccnattcctaaatgaccagggggcagggaactccgaaacacagacgcgttgctgatgaac

SEQ ID NO: 13571 - DNA, 1571 bp, Heterodera glycines
  misc_feature (19)..(19): n is a, c, g, or t
  misc_feature (34)..(35): n is a, c, g, or t
  misc_feature (42)..(42): n is a, c, g, or t
aggggcaggaaactcgaancaacagacgcgtgtnngatgacnagaggacaatcccaccgtagccacccttctgttggaaaaagggaacttcgaacaattagcactgctaattaatcaaaggacaatcctcttttacaaacagttagctgggatacaaggccagaaaatggcgttcccattaggcggcccagccacatgcatggcaaaggccagtgcaagtctgggcgttatttccatatcatggtcgcaaagcagaccgatatgggtgccctggtcgcaaagcagaccggcactgtgtcatggtcgcaaagcagaccgacacggttggctatggtcgcaaagcagaccagcctcgccatggtcgcaaagcagaccggcgtgtgcactacatatcatggtcgctaagctgaccgatatgttgccatggtcgcaaagcagaccggcacgtgcacaaatctcatcatggtcgcaaagcagaccgataagatttgaaaacaaataaaaatgtgagtctcaaaagggtcataaggacagaaatctttacaattgactgaataatatttttaaaaatttaagaacattttttttctgtcaagtgtaaagacttcttaattctattttggagcttatgcgtgacaaagtgtacgaaacttaattcctaactaacctcagatttgggttagtaaaactattggcttagtgtacaccttgccataatttttgtatatatgagcatctaaaaattttttcttattttattcatttcatggtcaaatcgatgaattttaaagatttaaaccggccaaacatagcaattgcttcagaacatttttttatttcacaacttatttacgggatggaattggtataagcccacaatgttgagcgattttggtttttcaaaaagttacaataattgattttcatatgctttaaaattacaatttttaagattttttcaacaaagaaaattgtttccgttttcaatttatgaattgccgaatgcaatcaaaaattttgagctcagaaacatttgaccggctatttcatatggttgaaaagtataaattttttaaaataagttttttcaacaaagaaaattttttccttttttcaatttttgaactgccgaatgcaatcacaattttagagcttattaaacatttgaccggttactttgagaaaaattgaaacttgccagcaatccgctttgccattgaaatgtttgtccaccagagcatttaaacggggcgaaagcaatgccaatttgggccgagttgaagatggtcagaaatgcccatccaaagtgttgcaaaaaatcagctgaaaaaaataaaaaataaagagagaattatctaaaatgtttgaaatatagattaaaattctatacaaaggaaaaaacttaataagcattggtagtttggtgttttttattatttaacaaaagggagggggggggggaatcaataacaaaatttatactgagaaatgaataataaaatataatcgatattcgtcgctgaaaaaagggtttttttttgcgctctaattatttaaaaaccggggaaaaa

SEQ ID NO: 13572 - DNA, 4477 bp, Heterodera glycines
aaaaaattaaaattttgaaaattacggattacgttttacggattacgggaaatcacgggattttttacccccgtcatgcggattacgtaatccgtaattgagaaaagcgccgtaattacggattatggatttacgtaattgaaaatccagttacgcccagccctagtatacatacaaacatgggacccatgttatgagctatttccatattatgagcaaaaatttctaacttttattcagcagttccataaaaatttgggctttttcaaaaattttttcataaatattcttttacttaattattttattattctttttaaaactcacaagattgggaatcatcgtactctgaacaatatctgagcatgtctgcccgtaaacttaggcaaaacacttttgcagaacgacgggaaaccgccaaaattacttcgatggtttgctttaatgttgttaaaaatatgaattttttcaatatataatattatattaaatttttcaatctgtttataggctatgctaaataagttattagattaatacttttcaaagaagttccattgttttcaaattgttaactttttaagcatgctatctttgaataattataattttacaaaagcataaaataaataatctatctataaaactcacatttgtttctgtgtacatggaaactaattcagtttggatcattgacatacactctttaattgcctaaattattatttgattgtgattgcttgaggcacatttttactgatttcgaaaaaaattcagcttcatcttgccgaaaagtgccatgtgcatttttcatgaactgtaaaaaaggatcacggttttataatctttaatcaacatatcaatgtcgggaccggtcataaaactctgccgaggtgatatagatatattattaacgtaatcagaaaacagcagtttagctaacaaaggaaggtctggaggtgtccgtggagtttcggaatgaaatttggtgggtgcatagagcacccatgggttcttaagaaaagtggttttattttctgcgaaatgagtacgagtgccgagatatgacgtgccaaacttttttctatcccaataaatcgaataaacatttgcatcgttttgtgttgttcggtggtgcggaggttgtgcgtttggcgtttgtttttgcccccacaggttcgaatccctcttatgcaaattaatttcccccatcttatttttgcttttatgcaattgaatggccaaaaaatcaatcccactcacacccaaaaatttatttttcgttccacaattttttattcgttttcgcacatatggtagtcattataaaaatgatggaaacagagatacatttcacaataggcgcaccgtaataaaataatattttcacaattaaataattgacacgtcatatctcggcactagtattcatttcgcagaaaataaaatcacttttcttaagaacccatgggtgctctatgcacccaccaaatttcattccgaaactccacggacacctcaagaccttcctttgtgtagcactttcgccttttgacttttcggcgtaaaccaccgcctattttcaaagcttgtcgtcgcttgagtcgtttagtggcccaattcaaagttttgttttctgcggtcggtgccattattattatggcaccaaatctgcccaaaataatctgttggtgatgctggagattttaatttagtgatgaaacaaaaatcatgaattattttcattgaatataaaacgcccgaagggaaatagaggcaaaagtgcgcaagtggctgcactggagaacattcactgggcggaaaaaggacgccaaaaaacggacggataaatcaatgagaaaatggcataggagaaacagacagagagaagagagacgaaaatgagagaacggcaaaatgttttgacaatttgtcaactgaaagcttgggccaaatttggcttccatttgatttgtttaaaaggcgctttatggatgagtaaaaagaagcaccaacgaatttagaaatgaacacattaaacggtcaaaatcaacaacggcaaaacattttctaatcactgacaaagaattttctgatcaccgtccctttcctctcacaattagcggtcactcaacaacttcaaaagctggttacgttctttcgaatcgcacaggtcatcggcaaatgcgagcgcggttctcccttaaattgttttttattggctaattaaatgccatcaaaaaactgaccttttgcatcagtctgacttttgtcggctccgttttgcaacaagaaacagacaacgtccaacttttcttcttgggttgcgaccataagcggagtaattccgtgctcgtcacagtgattcaaattcaaatggctcactgtgaaaggggaattagcaatataatttttaaaaaaatcacgcgaatggcaccgaaaaaagtgacaaattttcactaacaaaaaagatgaactcaaactgtgaaattcgttttgaaatgcaattttgccatatttcggaagtcactgacggatttccatgcggccttcctgacaggcgatgaccaacggcgagcgattgtcgttggcaaacaccaaacagttcgcgttttttccggttaacattttgacggattcaatctgattttcattgacagcatgtcccagggcggtcaaacctaaaatgatttatttatattatttaagcattgaaaaatatttttataaatttttaataattttataaggtacacacgaacaaaggaataaaaaactgaaaaaaatttgtaacctacttttggagaaaaatttaaaaaaaaatttttcaagctaaagccattttggttttctgggtctgcgaattcgatttttacacgcatttcgattcaattccgtaatgtgacgcgatttgaaacaaaaagtcgaaatttaaaattttcgagtttcgcattgaaatttttttcgaaaaaggggagctgccaccggtacaattaccgggtacttgaccattcttattttaaatggaatttggtcccaatttttctacataaaaatatgtccccaattaaaagcattgtctctccatctaaaaaagtgccggaggcctattgggcagataaatacggtaactgacccttgacatccttttgctcaattgtcgcgcccaactcgataagataggacacaatcctaatgtgaccgaagacacatgcccccatcaaaggggaaagaccgttttcatcggcaaagttcacattcgccccgcgctcaattagggatttgactaaaaaggaataaaaacaaaatgatttgtcactttaaagcatattaaaaatttattttgaattgccaattttaaccgaaatttcatgataaattcacaaacgaactgtgattcaaggccgcccctttttcgcatgcatccaacagttgtgcatttggattactggccattaataaggtatttgtcttgcttaaaaattgaagcttaatacaaaatgcctgggggtgatcgaacagagacaataaaacggctgaaccacgaaagaactttacgaaaatctttagaatttatggacgtacataaacactaaaagaaacagaacacaaatattttttaatgtttaagttccaaattttaatgtcacaaaaattagaataaaagatggttttaattagagatcggcatttttagaaaatacggatcaggattacggattaggcactcatacggattaaggataaaaatccgtagtccgtaaaaatccgtatacgactctggtccgtagacgatctctagagttaataggttttagattagccgaggaaatttttgtgttgcaagagtgtgaaaaataggatacgaatgcgaaaaaagaatacaactaaatttaaaaatgatttttatgtagctgtacacgagatggaaagaaaagtgttaatcggtggataattgccttttcaacgctcccattagtcacttctgtagcagattaaatcgggtgggaacaaaaaaaaaacagatcccataaatgagaatgtggaggggggggggggggagatggccaatctgatggaacatatactcattattataattttctagggtgatcgagatgtcttgatcgccccaacgtgagtgtatcattttttaatgacgtatttcctgcaattaaatcatgtaattagttgcgctaatattgattatgatgatttttaattaatgacataacacccaaatattaccataattctcaacaaaaagaagaataagcaacttactgatcctaaaaattcaaaggataaatttcagcatcaatttcctctgtcggagcactgatccagaaactacttcttttagttatgttgacgttgaaaaaaatattccaaggcccaaactgctcctggcagagcatgagtattgcaccaataaattctgtcgatcaaactcaaaagttgtcacaaaatatgaaaa

SEQ ID NO: 13573 - DNA, 1138 bp, Heterodera glycines
tggcaatacacctaataaaatttacaaatactgggccttttgttgatttgattaattgttacttatttcttataaatcctgttgggtctaataaacttaaaaaagcaaataagtagacgggcatttttagtgtcaaaaaatctcaaaataattaaataaaagtgcaaaaaatgccgaaatagagaagcaaatttaaagtgatttttgtttctttttttatcacattcaaaagagattcatagaatttatgcaactgaaacctataaaaatacaaatttctgggtatttagggatcaatttttgacatttcttcgaaggttcaactattcggggtgtattttatattttcattgcatcaaaaaaaaacccaaaataatggcaatattgttacaaaatgtcagaataatggcctaattttttagtggcaaaagtctaaaatagtgatccctagctacgaataagggcattaaaattagatttccgggacaaaaatgtataaacaaagccacagaaaaataatgaaaaaactagaaatagtcgctctatatatcaggaatcccgagaattgctttattttcgcctgttaaattgccgatcgaccgacccattcaaactcagcgtctccagcttgtccaggcgagggatgtcctccaaggcctgctcgtcaagctcgttctcgtccagaatcaaatgctcaatttcctcagagtgttcagtgagcaattcaatgggcaactgactgaaacattttggatcaaaaatcatacaaataaatttggcgctagttgagctaccgaataatttattaaaatttttgtttttcaaaaaggatactaaaactgggataaccccattcatagacaagtctaaaaaaaaaataataggcttggactaccatactaattagatattttagaatgtgtctgttaaatgcaaaactgttgtgaaaaatgttataactccattcagagaaaagatagaaaaaaaataaatataggtttagagagccctgtgaacagctgcatcggatgcaagtgccgccgttgctgtacgcctaacaagtggggagccatgaccgaaaattgcttaaaaaaaaaaccaaacaaactccttaattgttagttcccgttgacaaacc

SEQ ID NO: 13574 - DNA, 1423 bp, Heterodera glycines
cccgggtcggcttcttgggcggaaagccggaaattttaattcggaatttcaaaatctcaaccggttgcggccctggttataagtcatcttttatataaaaaaaaaacacaagagctcagaataaaagtcccctatagtttgggtcaatggcaattcgtacaaaaggcatttgtacaaaattttttttacaaagcctaagcataagcctaagctaggcccaagtaagcctaagcctagcctaaagattaggccttaagcctaagccattatatgagttgccttttgtatgtcatgaaagctatagttttaagatttaaagattaaatattttaaaaacacgcacccaaggctaaggttggagcagtcgagcacggtcaggtcgtccgtagatgaacgatggctggcggtggacgagtcggcgcctgcggacaccacagagccgtgaccattcagcgccgccagcaaggattccgtcgatgaacagcgacggcgactggtggcggtattgcagcgctgctggaagtcgcccagcccgcttagttgtgacagctttcggctcgctttgcgcaaaagcgcgtccgcgttgccgccacactcttccgctccgtccggcgcgttgctgtactgcttgcgtgagattttgcgcgcgcaatgggttgaagggtgtagcattcgatgggtaaagcggctttcaatcaaagggtatggctcttatagcagcttaattagcactcaagttaatggattaatagtttatgaaatgtatttattgttgaaatcaggatatatttgctaaaaaactatcaaatggcgagaaacccatcaaattttgccattttgtagccacaaaaatattgttgtaaaaattttctgttacatttttttgaatcttcataaaaatttacttcctgacgaaggtaatctccccgacattcttaaattctccagccatcactgacaaaatttatcttggaatttcctccccgttccccgacttttctctctccaagtttcggggcttaaccctagaagaaaacatataaaaatagggaaaaacatttcattcggaaaacaacattttctgttaccatgagttttgtcgggtttcataaatggcactgtttcaaaatattttttacagttttatttacgaaatttcattgatttaaaaaacatattttgtactttgcctcatgttttttcttgaaataatgaaaaattgattattatttttcctatgtgaacccaaactacatttgtatgtatcatattttttaaattaataacataaaacaatcacttaagtaaaacaaaatgaaatattttgaaatattaataataatatgtgtgcgaagacaatcactgcccacaaatatatgcccaacagcattagtggggagagaaattaaacagaaaatggaca

SEQ ID NO: 13575 - DNA, 1735 bp, Heterodera glycines
tattcgaattgggcataatttccataattcccccaatccacacacagtaaaataattagttgcattttcccatgacattctttcattcattccccccgttttcccccgtcatcatcttgtgctaatgccaaagtgggcctcccacggattcttccccccaatgttgcacatatttgtaaaatcatatagttccacgtcgaaattcagcctttatgtgtaattggatttcaaagatttcctccgttatgtgcttggcaatggcatgtctgtactttgaaagtttcttggcacgaaccaagcccagttctccaatatctacttaaggaatattagaaaccaaaaattctcatttcttaaaaatactcataaattttgaaacataatggctaggtttataaattatattcttttgcatattttttctattcatcgtctttttttttaatttcttggaaagaaagggaccagtggtgccgataggcgtcgtcgggaaaaattttcaaaattttggctgtgggttgttagcagatttttgtccaaaaagaccattttttgcgagtctggtctctttttttaaaatattttatgaaatctgttgcccagctgtccgacaggcgacgccggaaaaatttagcaaatgagtgcaatttatagaaagtcttaagtaaaaattttttctattagtataataaatgctcataaaatattaatctttttttaacttgaaaaacgaattaaacaattctattaaatgagaacaataaaaaggaagacgacaaaaattgcatgcataaaaaacattcgtggtgctaatcaatttatggcattttaaagctttttgataagctgtaacgatttatacctcttaattccaagctagcccatcttttaattttctaatcagtttgcgtctcaaattaaaaaattatgtttaaatttaattgcccacagaaatgcctttacaacttttatttgtggccgtgccgtttgtccttctgcttattcacccgcaacacataaatgccaacaatgactcgcctctaaaattgtactttgagccaagcaattttgaacacaccgtaaaaatcaaaacgaaagaggagaatccgcgcgatattttctacggggaaacacaatcagaagggtcggggtcattttggcgcagacaagtttaaagattcataacttttttttttaattcgaccatataaaataatgttgatattaatcaataggtctaaatgttctttattagcctgcaaaatttcaaaaaattatattaggttttaaaaaagatatggcgcgctgcgccaaaatggccaggaaaatgcaattttttgaggtttttggccataacttttttgtttctcatgtcagctaaattttttgaaacactatcaagccacttaaaatcataccaagattaaattttttttatattgtaagatttttaatttggcaagatttttagaaaagcgtatgggtgagttcagccgctttgttcgatcccgaaggggtaatccttaattactatgcgtattgacaaagacgagtttgatgattagagagtttgttgatttttttaattgttttcaagagcttttttgttgataaatttttttttcaattcgattatgaaattattatgcccagcagatcattgataatccaaattaggagtgtaacgggacccataacggattaagtattcaagtttttgattaaaattccggca

SEQ ID NO: 13576 - DNA, 2877 bp, Heterodera glycines
  misc_feature (4)..(4): n is a, c, g, or t
  misc_feature (17)..(17): n is a, c, g, or t
aaantctgaaataactntttgaaagaatttcttaaaccccactagctggcagaagtgatcagtggtgacaatttaacatattttttcgaattggacatttgaataaatatttttctttatacttttacaaatcagaaaaccagtttggaacaaagtttagaacagatcgggcgagggcactgatcagaacagatagggcgagtcgtttagaacagatcgggcgagggcactgatcagaacagatagggcgagtcgtgtagaccaatgccgatcccaacgccgccctcccgcgcctcggccgccttcgagcgcagcatatggccacgctgcacattgtcaatggtggccattgttttggcattgcccaaaaagtaaccgacgatgcccaattcgctggtctaaattgaaatggaaaagaaccattaattggtttgtcaccaattaattcaatgatttcacttaccatggcgtacattttcggcttttccctcgcgcgaattgaataattctgaagggaaaagcggatcaaatttgattttgatatttaaatttaacacttgaattgttttaccgtcacttggggcatctccaatttctccatcagaatgagtcccccgcgttccttccgcgtcatcgttcgcaatttgtccgcgagttgttcgtcccagaaattgttcccccctccgtctcggttcgtttttagcacaaatctctcgggcttttcgatggcttcctgtaaattgtatttgttttaaaatctttttagaaatccaccttaattatcgcacgggtttctttgtcgtctttgtccaggccccaaagaccggcgaaagttttgcggacggcggcgattgtttcagctttttggtcgggcaaaaagtgctccaacattcccggcagtgccaaagtctgaactaattgctaaacagctgtttctttttgtgccattcgacctgttggactttttttgttccagccaaatcgatgcggacatttgttgtcaactgaaagcaattttattcaattttgtccctatgaatattttattatttttattatatttgccaatggcatttattgaattattattaatttagtccatttaacactttttcttacaatggcatttgatcgctccaactttcgtcgaatgtcccattccttttccgtctgccaatccttctcaaacagaaaatttcgttgataaattatcgccacttttctccctttgtacgaaagtgatgaatcatttgggtccaaaatcagtcttaagaagaaaaaatcaaccaaattctgatcagtcaactgagtctattggatttgtttggcattttgtctattttgtatgtctgtctgtttacttttcgccacattcctgcaatgtaaggcgcacaatttcgattttatttcccgaaatccgttcaatttcgtattgtacgagccgttggtcaaaaatgctctgcacttttgtgtaactcataaacacaatgacggacaaagggtcgttgaattgtttcctgatttttaataactaatgaattaagtgtttaattactctattattattatgtccattttactgaccatgctttgaccagtgcttccgctgcgcctgcgcatgactcattcggcggcaaattggcggtggacagtcccaacttcgagaacacgcgcctgtgcactttgctgacgccctccgtccgcgcgtttccgccaattgcgcccatattcacttcgaccttaagacaacaattagttcgaacaaacaatttggttttgtgtgtttgcctgcttcagttcatattctccgctttccgcattcaaatggcacatataatcctaaaaattgagggaatttattatatcttagaggtaaaggtgcctttttaattaattaaatttatttttaattaataattattgaccgctcgttgcaaaatcagactgatcggctgtttgttgcccctctgctgaacgtcgtccaaaatgtccaaaaggtggccaatgtaagcgtcgcctttgcccgcctctccgagcgttctcttcaaaaattcgtagttctgagacacgcgaaagtaaagcaattggaacgtcttaaatgtttccgcttttttcaatttaattatatttattaaattgtgtaaatactttttgaacagcttttgcttcttcaaagagacggcgcggaaaaggcgaaggaaacaaagcgaagggaacaatctcaacgacatcgcttctgtaaaaaggaaaagcaaatggtcaaattgcaactcaaaagactgaatattcaaagccgagaaaaacataaaagccaaatcgaaagttaactaaaaaatgattaaattttaaaaattaaaaggtccctcctccctctcctccctctcttcccgtgctttgttttgctcaccgttccaattggtccttgactctgttcaccaaactgacagtgtgtgcccaatcgacggcctcttgcactatcgtttcaaagtcggcatcgctctctttgggtaattaattaattgctttgtatgtaattatccattccaaataccgtaattgggctcgacagactcttcggcacggattggcactgtcgtcgaagtggcaaaagacagggggaaaaggacgacaaacaatggcacaaggaaaaagacaaacgcagacgaaaaattagtcattttcagttaaaattttattttcaaataaataaaaaacaataacaatttaacaataataataaagtaattgatgaaaatatatctcaaattcttatttataattctgcaacaggaaacattaaacaaaatccaactgtttttcttcacgtgcatttcattgggaaaaaaacaaacggaaatccgtcaaaaaggccaaaaa

SEQ ID NO: 13577 - DNA, 2595 bp, Heterodera glycines
ttttgctttcttatggcctgttgctgtcgtttaagctcttccaactgcttttcctcctcttgctttttctaggtctcgttttccgctctctccgcttccgcctttgccgctctttcctcttctgcgtttgttaccattgccactctctccgcttccgcctttgccgctctttcctcttctgcctttgttaccattgccactctctcttcctctgcctttctttcttttgccactctctcatcctctgcctttctttcctttgctactctctcctcctcagcctttttatccttggtctctttctcgcctttcttttcctttgctattctttgctcttccttcttttcccgtgccagtttttcctcccttgccttcttttcacttgcctctttctcttcctttgccttcttttccttggctgctttctctgcagtcttccttctatcttcttctgtcttacgacgcctctcctcttcttctcgccgtctacgttcattttctcgctgctttctctgctcctcttcccttcgctttctctcttcttgtgcccatttttcatgccgcaacgtttcttgttgagccgctgattgcttggtcaaatatgaaagtgggtttaagggcgcttcgcccgtattgtcttcttcctcctcaacaaacgagacgtcaagaatctcgccctcctcctcatcgtcgtcgtcaatgttcccaaaacttgcatgcaccggtgcggacctttttcgtgtcaacagccgttccacttcggcaatcatgccatgatgaatgcccctctcaagctgctgtggcgagagaaaacttccctttggcacacggaaacggtattttcggccgtcgtgcaggtgaacaatcacatattgtcggtctgatgtacccagctttgcccaacttaagccaaaaatcggacccaatagccatgatttttgcccacctgtttgggtaaattatgcctgacagtccaaccatccacccggccccatcgaacaccaacttctttggcaagtgcactttgaatttgtttgttttatttccaacaaagcctggcgtattgctcggcaaaattacaaagaaagagtttgtcatttgatcaacaagtataaattcttcaaaatgagatcgtccttatatcgtggtgtgccatctcggttcactttcccccatctttgatccagcggaaactctttgccatcgtcgtcgtcgtcgttgccggttcatccttctttaggtgcttcatgatcagatcggtgcaatcaaagttcagctttgcacagtcttggcaaaacgattgggtgaactcaaggcgttgctgctcgccattctgattgatgagtttgaatcggctgttcccctgccggaaattgtcatcacgacactctttgcacatgaacgtgaacactccatacttaagaaattttcctattttttcaaattaaatattagccaaaacctttgggcgggccaatttccaaaatatggtcgggtactcaaacacattggtcggttgttttttgggcgattcatccactaaaatttggctaatttaaagaaatttgcagaaaaagccaaaccttcagcttccatggcttttgctttcttcattgcggaagcaatttcctcatggattttgtccaagcgaggcttgcgtcccctttttgagggccccggttgcaggtcaagcagtgtttgagtgttgttgttgtctccaattgtgatgacgtcatcatcattttgaggggaaaaattttcccgtttcgactcatccatttctttaaatttaaaaaaatttaaaattattataaaaaactcaaaaaatgattacttttgttctcaaacaccaattgatcattgatttttctcggggccattacgattaagaaatagtttatgattataattgttaaaagcataaaatgaacctgcgaaaaaaaaacacgtaattattgattgatagtgagaggggtgttagcgcgcagcgacctccagacgggctgtcccttcttaatcgataggccacgcccatccacaaacacatagacgagagagtagtggttagagaaagatacaaaagggcgccaattcaaacacacagtgaatccccaagccgatttattgattttttacagattatggtactccctctgactgctgccctatccaaactgctaagctgtaaacccgaaaatttagcagaatatttgaacaaccccgaggcagtgaacaaagcgaacgcttacttggccggcaaaaaactcaaaacaacctaccagggtcgtgattccaagaccaaagatgtcaagttcggcacattttcggtgaaacccgctgcggaaacctacgcctttgagggatttcttggcaagtttccaaaaattcagtttcggtctaacacatatgcgttcagaggttaaagtccaccagtatttctacataaagcaccggatccgcctactgtacccacagctgaagtgcattgttgagtaccacaacaagggccactgcaaatactacccattgggtatacaattttgtccggaaaaaaatcaataatcattttcagagttgttggccgtgaggaaggcg

SEQ ID NO: 13578 - DNA, 1916 bp, Heterodera glycines
  misc_feature (10)..(10): n is a, c, g, or t
cccccccccnccccccccggcgatgtccgtccgtccgtccgtcggctgtccttccgccagccgacggtgggcaattatgttagtgttcagtgcattttttgtttaaagtgtgagtagtgtgatgaaataattttctgagggtttcgaaatacataaatgcttaaaaatattttttttctatatttctatttttaaaattatttaaatatctgttttttattttaaattaattggttaaattaaaatgatttttcttatttgtagtaaaatttgattgaattaaaacattaaataatataaaatttttatatttagaatttttatttatttgaaatatttaaaaagaaatttttttgtttaacaattgaaattaaattttaataaaatcatgttgcttttaaaacggaaaacaaattaattcagatttaaaatttattcttcatgctttcagtttaattaaaattcatacatataaaatttatgctataaataattagtgtttttatattttttcatttaattgtttaatttaatagatcagcattataattaaaaaattgaatatctactgagaaaaaaatatttttttttcaataaataaaaagatcaaatgccaaaaatgtcattacttcgtcccattttggcatttttacccgttttattatgcctttactttatgtagtttttttacgcaattttacccaccaaatcgaccacaaattttcttttttgcgcttccgcgcggtgccgccgcgccgtttccttccgcctttctctctgacgcaatttcggcgagcggcaccggcccgatttttgtgcccttccgttcaccgacaattcaaaattgtatggatggatgccctcattatggtaccacagacagacattacggcaccccattaaataatatattacttaactaatagtaaaaatgataatggcacaaaatgccaaaaaaagtgtaccgttctcagacaatgaatgaatggatgaggtcacacattggcccgtcactgattatgcgcaagcaaatggcaaaatggcaccgacgaaatgccaacaatacaaaaaaaagaaaaaaggacggcaccggcaggcatttttcttttttggttttcgccctttcaattccattacagtacccagcctaaacacatgaccaatttttttagtgtggggtgcaattaacataatgccaataatgggtgccaaaattaaaataatggtaatgccaaattcctcctttagtttcagcagctcaaaattcaaatgcactgctttagttaattgaaattatgttttaaagttaatgcacatacatataatggtggccaattaggataagaaaaaaaattcaaatgctttttcatcgccgtggcatgaaaattaatttatgcgcgtgctaatcatgcaaaaccaaaaattatgcccatttttgaagccaaatccctgtttggaatgacaaattttttgtgtggcattttattttgacatttaaaacttccaaagttaaaatgccatcttcttgacggcaaaatgccaaatttcttcaagttaacacttaaatttttcactaaattgccaaaacccattcctgtcattttcgttttttgtctctgtgccaataattttcggtccggcacttttctgcccgccaaaaaatgccattccgggtgcctttgagcgcgtcatttccggcacattcccagcgagggggggggggggggggagcaggcggacgctgcgcttggccacaatcaccgccaaaaattcaaaaaaaaaacgacaaaatcaaattttgccctcatttttatgtcactgtgtcctccccgcactcctccaaaaattttcgattttcagcaaattcctccctctcacaatgcttctcccaccgacaatccatggcctaatttctt

SEQ ID NO: 13579 - DNA, 2181 bp, Heterodera glycines
tttttggccacatgcttttggccacaaaatcgccgcccatcggcccatcccccgcgggggccgaggcgttgggctgtcaatttgtgacccctctctctctccccaccccatgtgtcacacgtcaccaccgccacattgtgggtgcccctagaaaaaccgtttttttttttgcctgttttacaacgtcaagcaccgggggagcaaagaatttttgaatgcatttttagtttggccaaagttatggcattttgaccgcctttttgtgccaaaattaaaaaatctctttatctttctttctctgtcgctgctttatagcattctttatttttctattaaaacaaaaaagaataaaataaattctaagcatttagcaaataattttcccaagttaaaattcggcactaaaactgccaaatgttttttttaattaaattttatttctccaacatttatactttaaattaattcaccaaattgtgccaggtggtctcttaaaagtttaaaccattgaaaaaagtgcaaattggtaattttggcacttttcttcactttgcccagacttggcattttgagccagtgccgttgtcctcatttatctcttttcacaattacgtcattttggcgccccattatagcaccaaatttagcgcctctgaatgacattttattcccactacggccgatgggcagactcagcccgagaaaattcagtttcctggcactgacttggcacagcccaccaaacatttatgtacttatatgtagcaataccgtaaattcaaattaagtaattatgtataagaaatgttacaatatttgagggcacctgcgaattccggcaccggttggccacgtgttcctatttttggccccaaaattgctggccgatgggtggcacttggccaaccgttacatccgtccccctcaattcctatgtgtgccaatgccaaccaaaaaaggcacccaaattccaacatgacagctctgaaatttgagtaacttcaccatctgtcatcgctcttttgaatttgcgcgggtaaaagaaaagggagagagggcaaaatgccaaatttggcaacggaagtgccaaatgcccagaaatttaattgaattttctctcctttttactttttcggcaattaattggacaagaaggcactaatccgttgcctgccatcaaactttcttccgcccaacatgtttggtgccaaaaaagtagccattagcgcaatcccccgctaatttttaatcggattttaatgcaaaaatgatgcctttaatgtgtgagggtttcgcgtggaagaaatgtcaacaaaatgttgtaaattaaaaaaaagcgcaaaattttcgtaatttttaaaagtattttttgcattcagtgcattttttgattaaatattgaaataatttaaattattggacactaattacacaatttgttccgtttggcccatttttctaatgccgataagtgatgggagccggtttcttcactttctaaatcccggttccgcaaggtttttttttggggctcggcatgccgtttcccgaaattatttagggcctagaaattcccaatgccaattcttgaaattctttgatacatcggaatgccgatttcgtgatttctgaattttcttggcgcctcggctcccattcctaatgcacatttgtttttttggcattaaatatttcaaaaatttcaactaaaatttaattttatagatcccaaaccttggcattttcttttattccaatgccattgttgtccatacaaattgacagcctgatgacgacaaattcttatgggttatgcttgaaattccattcccccccccccctcgcccaagggcattcttttttgttccttaggggctaagcaaaaaaatttaacgccctccggcaaaattttttcacggtttacacattttgccatattttataggcaagggacaaaaaatacatatgtgtccaggccatttaaactaattttgcgcccaatttgttctgccgctactctcttgctaatttgtaaagcaatttgcggcaatttttcgcgcgcaaattttactttgctgtgtgttataatacccagcggcaatttgtgggtgcatattaattatgccaattcaattaggcacactcacaaattaaccttttgttgggcaccaaatgccgacg

SEQ ID NO: 13580 - DNA, 2008 bp, Heterodera glycines
tggccgtcaaaaaattttaaattttacaaaaattctctccctaaaattaattcagaaattacatggtttccttcaaatcttactttttcatttactaaccctatctaatgattgattgatttcttttaatggtttttccactaattttttcaatgtttttatttatccaaagattactcaacaccttttcaatagaagttttatttttaaataaatataaatttttatttttaattaaaaaaaaatttttttttcaagacttctttgtcatttcccgcaatacaatcggaagcccagcagatgcccaactccgtcgctgctactccttgcgcccccaacccgttcaacaacaatcacttcccacaatcagatgcagaaaagtacaacaacaaacagtgttgaagtgcttcagaaaaatgagcgatgacaaaattttgctgtggttttgatggtcgacaaaaattccgaatgctttttaattttttaatttatttatttgatcggaataaaaacaaggtattgcaggaaaaataattttttataatttaccagctaaatagagaataataatttgggctactccaaatgcttctttatattgaaaaaaaatacacaaattgattgacaaaacgtcaagtacaatgaattgcgttaataattttcaaaaaatttcgacatcacccaattgcgatggtcttttcaatatttattactacaaaatttttaaattttttcaattcctctcaacatacttaaaaatttatttgtaggagataaattatttattttaatttttatcaatgaactgtgaaagtgatagaaaccctcatggattttaggatgaccgaaaaataatttttgaccaaaacaaaaatcatttgtgctttttcatgaaacagaaagaaatgcttaatcgttaatattagaaacaaaatgaaaaagtgtaaacaattttattcataattttgctaaaaaaactaaattcttaattcataatattgtaagacataagctaattaacataaattgccgaagcatttaagcacatttcacattaattttaatctctcttttcattttcattttaatttatttattttcccgttagcgatcgatccgacactcctcccctttccatttatgtctatttaagctgcgatctctccattgatattcacttaatcatgattatgtagtttatttaatttatgtaatttttgtgattttatttaattgtatttaattgtaattgttatttaaatatttaaattcattgcgcatttatttatttatttgttttgattttatttgtaattgttttccatgcttttcctgaaataaagccattccagaatggaattggaattggaatgagttggggagggaagtgggattgatcaccccaggaccccctcataaaaatgattggatttctaagggttgggagtcccaaggcctaattcagcacgttccactggcatgtgtgttattggtagcaccggatggttaggcatttggcctgggcggctaagggacaacccataggaaaatgttagtgagggaaaagcatggaaatgatggccatcagtgagtgcttcggcaataaaaagaaagtcctccggaggcggtaaaaaggagaaaagaagagagtaaaaaaagaatgccccgataaagtcagtgaataccctttgggatgcccttttggatgaaaatgcccattaggatgaaattttgaaaatttgggatgccccttaagatgataaatagataaaaaaaatgactttcgggatgccctaggatgcccttcgggatgaaaaaaaagaaaaatgccccgggatggcctttttgatgattaaatgcccatttagaagaaaataatggaaaattttgaaaacccttccggaaacaaataccttgaaaaagaaaattcaaggatgccctttaagttgaaaatggtgaaaattttaaaaatgccccagtaggaaaaataaataagtagaaaaaaaaa

SEQ ID NO: 13581 - DNA, 1563 bp, Heterodera glycines
aaaatgagatagatacgagagaacaattagagtttgatgagatgaacaaaacccaagaggcccatggaactgcaccttttccttttagaagacctccagggtctcccagactgaatattccagcaactcctcctgctaatttagcacctattttccaaatccaagcaccaaataggggtaaggtgaatgcactcactgaagtaggcacttcgggaccacaaccagggctatttaatggtgaaattgcttcggcatttgatgaatgggaaatcaaatttagggattatattgatgtttttggtacaaattggaatgaatcagagaaattgaatcgtcttaagctacatttgggaacccaaacacggaacatttttgatggacagtcctcattttcgggaattagcctacagaaaattagcagcatgctaccaaaaggaaggagagtcagtaagtgacttcattaagcgcttagttcctcttgtcaacacaacttcagctcaacttccgcctgaagcaagagaagagatgatgtgtaggtgtctcatagaaaaagttagacccgaatttcagcgttcattacagcttgtaggaccacttattgggagaaaggactttcagaaactgacagcatacattcaagagttagaagtctcaattgaaagggatgtgagaaatgagagcttcggcattcaagcacttaatacaaatcctagtcatgttccacaaggcaaatttaacacatggggaccttcgaaccctaacaatattcaacttgggcacagaacatttagaaatgaaaatcgtgatcagtcagacaggagacccaataatttttcacagaacaatagatacaatcagcaaaggagggattggggcccacaaaatgatagaagatggaacaatcgacccgtctgtcattactgtaagaaaaccggacatgtacaatacaattgcagggagagacagaatgatttttctgggcaatttaacaatcggaatcaaacacgatggcaatctccgccacaaaattcaaatagggacaattggtacacaaatgagtcaaaacaattaaaaaatatggtagaagacttagcagttcaggtgcatgaaatgaaaatgaataaaaattacgcttcggcgagccaacagaacattaaagcattacaaatgattcatacaaacgaagaaattcaaaaaattgaaccaaagaaaaattcttttgaacccaaaagtatttcaagttgggagaataagcaagggaaatccaaaacattttcaaacattttaatgacaattacgcttttaaatgttttaacaactgctattggcaaacaacaaattttaactgtagataagcctatgatttgccaaacacaaaagcaagcaatgctttgggagctaccaattattcaggggtgtccgacaataaggttaagtgtagataattcacctattactcaaaatcgtcagctgtttatccctaacagcattgaattttcaacaaaagcttgggcttgtaggaaaattaagaaaattgttagaataatatacaaccactaacag

SEQ ID NO: 13582 - DNA, 1783 bp, Heterodera glycines
tgcttaatggctaggcttcctatttctatgcccttctcccgggttttagtgcctatttaagatgtttcggaaaaacttttcaaaaaggtcataaaattaaaaaaatactcttatgagtttaatctttttaaaaaggtaataaaaacgaaaatttaattgaatccctaaaatattttttctccttttcttgagaaaaatttttgatttttaaaattgtcctattcgagggtctttctatgcctgttaatgtctgttttgtggattttttttgttgcctttttaggtgcctattttgcgggcttttgttgcctaaatatcccacacctggtcattagtcagacaattatttaattttttaattaagcaaataattggttttgattaaaatccaattggcacaccgtccgtcccggacgtgctcaaaaaatgccaaatcacaatcactgtagccatattttgcggacaaaatcggtgaacaaaattgtgtcattgtccacaatgtccaaatcgtctgggaagcccaaagcgtttcttgtccacaacagttatacttggcaacagcacttcttttgtctctggaaaaaatgttggaaaataaaatttttttttaaattttttttcatgtgccttaaaagaaaggggggtttgcctatttttcagcattttgcttattttatgtttcttttttaagcagtattatcaaattttccaacaaaattcgcaaaaatttttctaaggtttcctggcggtgctttatcaaaattattagtgtgtctaattatcttcaaattttctaaattggcctgaaattgcccaatttttcatatttttttgtgtgtgcctaattaggaagtccttgttttttaccatttgaccataaataattaatttaataagcattaatgtctattaaattctaaacatagaattaattggtttttaattaacgacatttaccacttctcattttctttgttaacgaattaattgttattaatgattttttccctaattaattgcgttcaatattgtttgttaattaacaatttttaataataatttttttttaattgtttctcagaatttctagcaatgagcagcaccttcttcaaaattgatgagcagtaagccaagcacggcgtcagcaacaatgaattgttgtgaattgaatcgacgaatgccaagcggacgtccacaaattggaattgttttgcgttttccttaaaaatggaatttaaaaaaaaaaattaattatggtaaaaaaaatttgaaatacccatccgttcataaacattaaatttaaaatatacaaaaaaatgcattaaaacaaattctaatttctttttggtactagtgcattttgtatccgctgtttttttagaagcgtagccagatagtaacaacagtgcaccaattgctgtgtcaccgccgcactgtatagggatgaagagaaaatgaggtctctgtaatcccgcaaaaagtgacggcggcgatttttaaacttatgacatactttagaattgaaactgaagtccaagatggatatgttggtgcatgcaataattcataaccaaaatagatgaaatgataaactaatgtattgctatttaaaataaacttgctttcaatttctgaaatgttttgtttttaaaagtatagcgacaatatttcttaaaggaaaatctactaatgttatttacaccctttattattaaaaatcgttaatatttcaattttttatcttattaattatattctattgaataataaattcactttattg

SEQ ID NO: 13583 - DNA, 2520 bp, Heterodera glycines
  misc_feature (2492)..(2492): n is a, c, g, or t
  misc_feature (2511)..(2511): n is a, c, g, or t
aaggggtcgtcggcccggcgaggggggaaaggaggaaaagtgtccgaattcgaacatattttcttaaaatttatcacaaattttcacagttctgcctcccagaaattttaagaaaatcaaaaaaaaaaaaggtttatttacatatatacttgaacaaattttcgcaaaaccagggttgtcagatgaaaattttcaaaatcataactttgcaaacaaaaaaatcatcaattggggtaaaaaaatcaacattttcaataaatttattagttaaatgcaagaaaacatgaataagtgatctgttctgatgagtttttttcagatttttctggcaacttggaaataattttttggtgattaaacattttgttccattaatttgcatcgtcaaaatgggaggccaattagggcatggtcttctaagacaaaaatagtgggtcaatggcaactcgtacaaaggcagctcgtacaaaaaaaaaatttctaagaattttcaactaaaacttagaatttttagataaaaaaaatctaaatggattttttagcctagaaaaactttttaaaacacttaacttttcaaaaaatttaaaaaaatcagctgaaaattagtaaaaaactaaaaaaaattttttaaaagtttttctaggctaaaaaaattcatttagattttttttatctaaaaattctaagttatagttgttgtttttttgtacgagttgcctgtgtacgagttgccatgacacctaaatttggaactttttcgaccttaatttcgcccttattttgaacttacatcagggctgccatcgtccatgctccgttttcaaggacgggtatggcgatttgcaaggacaaagtggaaatccaaggacatttaaaattttattctatgcaatgaaaaattgttaatatttatttaaatggcttgtatttttcaccggaatggattttttcaaacatttttttgttttcactgatttttcctcatttcaccgcatatgctcttttacggcgcgctttttccaaaaaatttccggggaacagggggggggccggcggtgccgttttaccaaatgctcattttcaaggacgtccttgcatccaaggacattttttattttcaagaaagagggcgcgatttcaaggacgtccttgccattcaaggacggatgacagccctgacttacatacctatttcaatttatttctgacgaaacattaacgattaattcttgatgcttttagaatttcatgtgatgttttctgtaattccattgaatgatttgtgtcaattagcaaataattcatgcttattgagtaaacattttaataattcgccaattctcaatggaatcttaaaaaatgctgaaataattgaccacctatcgaagaaattacaattcgatgaatcagaaaaaggtagggatatccaattcatcgcagtttggagatcatcccttcttttagcacttctttccattgtcaagcgcaatgttgaccgtcttcatcaattatgcaatgaatggataaataccggacacttctcatctattcccgaccattaccggttattgtacgcattttgctgtgccgttcgtgccaaactcagttatttacttaaggattatttcgtaagtttttagaatgaattataaaataacagttcgatcagttgtctctccgacattgtgacgatgggttgctgaagggcaatgatttggaggatgaaagtctgtccaaattcgcttctttcttgtgccgcaaatttcttcctccgccctcagaagtgccggaacatcagaccgatgtgttttatccagaataacaattaaatcaacatttaaactaagatttagtcaaaaaaagcgcctaatttactgccaaattctgtccaaatttcgtcttcagaattgccttcgctcgaatatttcttcaacaatttttataagcttcaagtccccgtcatcattcgtggaatggtctttttttcatttataaagtttatatacatataattaaacatttatttaggtgaatgggtggccggcatttgaaaaatggagcttttcttatttgaactcgatttgtgggcatcgtttggtccctgttgaattgggtagtaaatacacggtccgtatggaatatttttggcctttttaacgaaaatttttgttcaaaaattaggatgacgactggcgccagcagatgatgagtttcaaccaatatttggacgattttgtttttcccactaccaatgtgagttataatcaaagcatttttttgcaaattctttttcctttttgtttgatttttcaagaaaaatgggtaaatttttttgaaaattatgcacagttttcttaacatattttaataaaagttacaaaaaaaattaagattctagtctaacaaaaaaaaatttttcaggaatgttttcggttacacctaggttcaaaaaaagctttgaaacattcttaaataatatattttgcgcagantgttatatcccggctgacnttttcggcg

SEQ ID NO: 13584 - DNA, 1234 bp, Heterodera glycines
gttttcatgactttaggaaccataaaaaatttttttgaaaaaatgggagggacaaggcacagccagtaacaccaaacaattgttccatctcgatttttcccggttacgagactgagaacacatttgcacgactggaatgaattagaattttcgccataaatataaattttagacctttgaaattaaaactggaaaagagcatgagttagataagaaaaaaccaaacaacaagattgttacaacaatttataaaacaaaaaaaaagacaaaatttacacaccccaaaaatgacgcgtctcaacatagatcgtgtcacgattctgcaagccagttgcatccagacgcctgtgcatgtgattttgcatgatctgaatatgctatacaaataaaattcaaattgctgacactaaacaccaccgtattgaagcctcgctcgtttacgaaacggagccgaacggtgtttgggtcatagccgtaatctctgacaaatgcgaaaagagcagtgaccctgtggtgcccattaaaagtacggtgaagaatttgaccgttcgccagtcggaatttgatgaaaaaaaaatcagagcgcattgaaatgctggggagatcaacttaatgttttgcattcggaaaaaaagaaaaaactgacggcgaatgtagcgattcgtacggccaatcaaagacattttcagttttgatgctcaataaaataattaaaaattgaattcaatggggataaaatattaaaagcagttaaacaacgacgtgcgaaatataagcagtgtttagaattttgtgtcaaacatgtttgtaaatgaataaaaatgccgaatgacatatggattatatagcgatcaatgattcagtcaggtcactcacccccttggcacaagtacaataaatgatcatttttcctcaatgttcaactgctcacgtttggtccagttcagctgtttaaacgacttggaagtttccaatgtggagacctgatgagggaggaaagtggcactttgttaatgaatcattaagggattgaaaaaggaacatcaaatttggcttccattacagagatgcactttttatttttatgcctcttgtccttgcgctcaagttcataaatgacaaaagggggggggggggtcaaccgaaatggcccggtcttgtaaattgacgtttttttttctttgcttttcaaaaccgcttctttcgcggcgcgctttttccaaaaaacttttgg

SEQ ID NO: 13585 - DNA, 2377 bp, Heterodera glycines
  misc_feature (21)..(21): n is a, c, g, or t
tagagtcaatttctaaaaaantcgctgaaaaatttctcaaaaatttttttccttaaaattttcgtactaagaaaggtcctatgaattttttatgaaaaatttctaggtttgaaattttttgggaaacgacgtggggggggggcgacctgctcctccatcaactcaccaggtaaaaaatcacagagattgagcagaaatgctgaattaaaaaactaacaaaaaaaacttagatgtccacctccattccaattcaaacaccaaacaactttttcgtatttaatctaccctgaatggcggaggcgcgcgagatcacggcacgctccttgatcagcacaataagcatcggaaatttggaacgcggcaccattttgatgtagttggacacttcggtcaggttggccaactccaaccaatcgaacaaatgctttttgttgtccgccaacgaaacgtcccaagcccacaaaatgaactgacacttgagcaggttgctcacattcacattggacatcacctgattaagcaaataaaaattaatcacagcaaaaaaatgggaaaaaacccgaaaaattttagttttcgtctcaatttttgcattacacccgaatcggatgtttccacgtgtttaatcagtgtaacccattcattttcgagaatatagcaagaatcaagcaaaaaaggtgtgaaaaccgtttgagcgaagatgtgcgccgcaactgattggtcgtcgtggaggtaaatggccaaaggccgtcgatgttcagcgccacccgcgggcgagtcgaacgcctcggcaatggcatcctgcagagatccatggaagaacggcgcatgctgggccccgtatctgtacaaatgatagtgaaattataaaattaatattcctcaatttcaggaccccaaacgagttaaatgacgattgaattccatttttgcaaatgtcttcaaaataaagccttcttctcatcggtgattgatgtgggcgctagtttaaaaatggcaacttttgaattttactaaataccaaaatggagggaggacccatttgtttttggggttttaggggtcgatgataacgaatctgacatccatttggatgaattcctaatccatagccaacaatcgaaagatagaccacaaattctttttcgaatcaacccagaactcgtcgaaatggaggtcaggttcgtaaccaacggcaattttgcaggactagacaatagtccataaagagtaaaagggtctcctatttggattttagtgaaattcaaaagttgtaactttaaactaggcaccatatctcacaatgacaaaccggctcaaaatgttgaagccacaactgacaaacctcgagtcaaaaacggcattaaaattctgcatggcctccggaatggaagtgaattcggtgggcaccaacggcagttggttgacattgttcgccgacgagctccgctccaactccaagtccgagtcgcaatagctttcgtcgccgtctccgtccattttttgcacggcaatcaaattttaatagagaattcagaagagaaggaagtaatatttattataaggggcttcaatatgctgaaaaagagcaacaaaaataaagaaaataggtaagcaatgaaggaaaaagtcaaaatttacgtattttgtaggaaaaaaattttaatttttgttcgaatttaggtcgggggttcggaagagattaatttcagtaatttttccctaatatttcattcaaaatgggggaaaactcaaagtttcgcttcggactttattaattgggaatgagaagaaaataactcattctcatcaaatttttgtttcccaaagaaacaaaatgccacactttttaaaaaattctcctaaaaatgcgcaagatatgcggtttttcatacgaaattttcctctaattaattgccttttgatgttacctaaatagaatgatatcgaccacaaaatttattgaagatgtaaaagaaatttgtttgcatagcaaaacgatttgcatggacgagccatggacactgcgggaaggggtaattaacgaaccgaaaaactaaaatttacacatttaaatgtataaatttcgtaaaaacaggccaaaactgttggtggtggaggcttctggatggaacagacgagtttcatcaacgatccgcttaatgggaggccagtgaaacggaattttgctgtgtgcttcaggtggcatgataaaaaaccaaaattgattaaaaaaataaataatttgcatcctctagcgagacgtatggcgtgcccgtcttctggttcaatttttacgatgaaagtaatgttttcttttcgcgaattcggaaaacatttaaaaacggtctttaaattggccctaaaatgatgaaaa

SEQ ID NO: 13586 - DNA, 1287 bp, Heterodera glycines
attttgacacattttaatcggattataaaaaaaaaaatttttcgaaaaaaagttcgaatttcgggttaggggttcggaaattcgtccaatagagttcatattcgtgatcagcagccccgaaaacccctagaaacacgtttttatcattagaaacaaaaatttttttttatgtgggtcaaacctgtatataagtaccgtaatcttttcctatctgtaagtgtcaaaattataccaataaaaaattagaaattttttctaatttttaacgatggataactgagtccctgttggaaacggacaccttaaaagcccgtttttttccttgaaaaatgccaagcgcaccataatttgcattttcctcgtcattttgggccattttaaatcgattaaaaccgtttttaaatggctttgagtttggaagctaagagacatatttaccgccgcgagtttaattcgttaataagggtgggtcgtcgtagggtcggggggggaggggtcgtaacggaggggcaaaaaatttttattgagaaatttccttagcgaaattcaattaaggtggccgtctccttttgttcgactatttccaacactttgcattttcttccgacgaaattcgatcgcaaatgggcgaatccatttctcagaatgagcacccttttctgggcattgccttctacaatttgcacccttgcaaagtcgagaatttaattcttttttatattttagtattaatgatttttaaagcctttaattttcggtaatttaagggcaatgtgcgagagagtctctgttttttgtgcccaaagcaaaaattgtcattttttgatgaaactctgttaacaaattgcattaaaaattccaaaatgttttaagtactctcgaaatttaatttcatattttttcaagtattcccgaattatttgtagattctcgaaatttttaaaaatgttttcaatttttgaagaattttttaaattggaggatggcaattttaaaaaacgagccaacacggttgaaaaacattgattcttttggttatattttgggaaatttcttttgaacagcaaatgcttttgatcaaaatgttttcttataaatttgccttttttcagacttccgaactgatgcgatcgcttaagccacgcaattttgtcctcaggtcgtcgtttatcgatcatttaaagcaattatcaaattatttatcctctccctttcagtttcctttcaacgatcggttcgctgttcaaaacgaattggccattagcactttttactaattaagtttaa

SEQ ID NO: 13587 - DNA, 2937 bp, Heterodera glycines
atttcatttgctttttgataaaatttattggatggaaaataaatttgcaaaaaataacattaaattaaaaatatattttagcattttccttttcacaaaagtatttgtgatcccgtggcctataaaataattcggtctgttctaactaattgaataatttttgtagttttttatagtttctttaatttcatttttcccattcgttgccaaatagttcatcaaaattcagtcttattttgtatgatttaattaaaattaataaatattaaatccccgatatttatttttgcgattctatgaagtctttgtctgacgaaagtgatgagtttttccgacgtcgaactttcatcatgattttttttttgttattttctttattaaataaaatttccagaacagatgaaacccctctggtgttaggctgttgtagtttttggttcagttattttatacgatttaaatttaatatatgatcttatttaaattaagttttataaaaaaggctaaaaaatatgagaaaaatatgtttataataatagaaattatgacataatttattatataaatatttattaatgtatgcgatttaatgacgagattaggaatattaaatgttttatattgaaaaatgtaaaatactgtaggaagccacaaacgcatgaaaaacatgtttttggcatggtttaaagtagagtgccacgggaccgggacctggtagcggacaactgagtacaactgagtaccaaggtcccggttttgaccgggactagtcccggttttcccagccaaaaattcccggtttttcacccgaaaaggtcccggtcccggttttgccccaaattcccgtcccgtggcactctagtttaaagcttcgtggatggatttctctaatccatattttccatatttcgcgatttatgtccatatttcaatatttgtccatattttggttataatacccatatttatgtccatattttggcatttttccaaaaaacctctattggtacggcctcaaatcagctaaattttccttattgatccctcgagacctaaaaattttctgaaaataattttgcataccatcatttttaaagttttactttatatttagagaatatgaagaaattttgaaaattataccattgaatatggttaccgtagttcctttcccaaagttgttctatgatctgttacgtccgcattaccattcccaaaattggaataatatcctttattccgaaggtgtgcacacaattacataatgagtaaatgagggaaaggagcggcccccgattcgtacgggacagatggggagggaaggatcggacggacacttggcccaatccccccgatcagaatgaatagaacaaaaagagaggggaacagattaatgagaagggggggggggcggggcgagtggggcgagaaaagtcaagagcataggcaataaaatacaatgtaatgacaatcagtatcaatttccacagcaaattttattaaaaatttcaatttttcatcaggcggccgaaaacttcaataatccataaaaatttctccaaaatttgaaaaaaatcaaaaattttaccattttggtgcaaaatcgttaaaaatagcgtgccataaaaaggctacgaaaatcaaaaaagttttcaaatatttaattttttttttaaattttacaataaattatttttaccagaatttgttgtgggtcaaaatctgaattttaatttttttttccagaatttttttaaccccttttgagccctgcttaaggaaggtactgtgagattggttatctattttttttgtgcccgtccatttttaagggaacatagaaaatgaggttaaaatgcccaattttaaacatcattggcacacaggacgaagtccaaagacaaaacgctggatgcccccggggggatttttcccgcgccgttcccccggggggtgccgtgcccggcgggggcggacgggcggggcggagactcaaaatgttcagcagctcgtcaaaaatgcggcacagaaaatgccctttttgtttcgagcagataatgggtaatttgcttcaacttttttccctttttttttgctttaaaaaatcatcatggacaaaacaaaatgccaaaaaatttgggtttttgaaaagaaaaatttggtaaatttttaatgagcctaaatatgtgaatgggttaaaaaggcaaacaaaaagtggtactttttggttcggttttgtgcaccaatcccaaaaatttcaaaaatatgtcaacaaaggaagtttttttgatggcacaaaatgaaatttgccccaagcgaaatttaaagtttttgccattttaggttccttttgtgccatcaaaaaaatccgtgcatcatttatataaatttgtttaaatgtataaaagcgaaaagtacccaaaaagctgatacaaataaatggaagccagtggcaaaatgtatgattatgttttactactaccgtatacttgaaaaaaggattataacaattttactatgttgtataatacaaaaagaaatttgagcaaaatttttactacggtataccgtatagaacaaattttcgtagaccggaccattgaaaaaaaaagtatatgaattgacaaaagacactgtttggaaataactaactgatgtactacaaccatttttgtgggaatctcgatctcgacaacctctcatggcaagacatacatgatttaaataatgaacaaatgaattaatcgctggtatacggtaatggagggttaaaacagatgaaggaggattaacagtgaattgtggttactttaaggcaaaatcccacggagggaatcgagcaattagccaaaaaaaataataattttaagcctatcggaggcgccaaccggtgggaatcgaatcgaatttgtcggcttaatcttcagccctaaaact

SEQ ID NO: 13588 - DNA, 1345 bp, Heterodera glycines
aaaatgaatcgagaggccagcggcggacggagcggctgtcagcaaaaggcatgccgtcgccgccgccaacaagctgtgctgctgccagccgcacatccccgcgtcgcccctacacccccgagggcacacaacgaacgaaacgacggcaatatgtgtcggatttccggatttcttgttggagcagcgagcggctggcgggcgcgcccgtctcaatttacagctgctctccacccgccccgtccgttgtcggcggggtcaaacgccgtcccgccggaggggcggcggcgttttctttttcaccccttcgcccctccggcaatggacaaaaaatgaattatacatcggaagggcctgtgctcaaattaatctcgttaagtgaattttccggggacaggcgtataatttgtgagaattttctttttttgtttgaaggggttttgttcgtatttaaatgcttagacacaattcattagcgtgaattgcttaaggatgagacaaaattggttggcattgtgccagcggaaaaaaagtgaatttcaattcatttaatatgcctaaataatcttaatttaaaaaacatatttaattgttattttaattcatttttttaaatgcggattaggatattgctccacgacatttattaatttctccagccattcccgacagaagttgaccgggggaatttactcccctatcctcgacttttctctccctaaggtcagggtttaacaccctaatttgctaatatttttaccttttaaatttaatttaattaattatttaaattttaattaagcatttacagttttaccttttaaattaaattaaattaattatttaaattttaattaagcacataaaatgtaatacctaaattaataaaataaaaatgtcataaaaacaattttcaagggttaagcaaattaccatacctaattatttgtgtaattaccattcctatttttaaccaatagacagactaatataaaagtacaaagcctaaccaaccattaaatgttaatgtagtgccgtatattggaagtaaaatgccctaacttttttttttgataattagcacttttaattgttattcaggtttttagctgtgacaactgtctgaaaaaagaatataatgtaaatctaataattaagtgataaggaaatgccgtaaaaagtgccttgagaaaaatttaaaatgaaatttaagaatttaatttaagagacaaattttagtaatataaataaacttaaaggaaatggcattaaaatcttcttctttttttttttgctttgaaaaaatattttaattgttatgtagaagggaacgtaataataagaaaat

SEQ ID NO: 13589 - DNA, 2422 bp, Heterodera glycines
ccgacaactcattgaaatggaatcgaggaattggcaatctcaagatggtgaagaacacccacacaaaacgcaccagtcagggtgtcgtgcaagcttggacatcgtgacaattacgtccggtgatgcaaacactgacagcgaatgggtcgaagagattgtcgttgaacggcctcccggattggcagcgcattgtccggaagagtcgttgaagcgcatctttcccaatgataagcaagctccacgctatggcatcgaagaaatgatacgcgatgcattccacaaaaaccttatcagcgatgcttacaacacgcggaggatgtcccaggccaggggagtcggccaacccattccaaaggcaccgattggacgtccgaacgcaaatggaccctcctgtttgatgcggcgacctgacgaacacgtcagcgtgtttggagtccaggagattgacagggcgtacaagaacaaagacatggacacagcgtttaaggtttgaaaattggaatctatggaaatgaaagtgccttttaagctatttatcgtcacccgatgcattgatgagtcgaatgagaagaacgttctgttggccgagcaacacattgccgccactcgacagaaacaggcacaaaaggacaaggagaagtcgaacaaaatggagcaaagacagcggaagctcggcccgacttcgtccgcgactgctcaatctgtcggccacttggactcaggcagtttaactctcgcagattctccccatggtaactgaactgcttagttcccttggagttgcttttctcctgtttcagcaagttgctcctcctcctcgtccatcgccgtttcgtcctgtgcttcgtcactttcttcccagtcgcagctgacggcgacggattcggcgtcgacttctctccacaatttgtgttttccgaattcgctggaactccgccgttccaacgaagacccgcggctgagtgacccgcacttgcggaagtttttcttcaggcaaaggctctcttctcagtctcgacatccgcatattcaccaccagtgcgtttgttcaatgacttaacaatttataacatcttccaagtttcagttgttcattacgttcacctgacccgcgcatttgtgccaaatttgcttgtgatggcaccactgatccaatcagaaatggccaatcatcgctgtttcaacaacgaagaaattatgagaatgtaaattcaacaacattttgtgcaccagcaacggaagaaattgaggaagatggaatttgcaaaacggacgatgactctttcaatgactacgaatttttccatccacgacaaacgacgtgcagcacaattcggggcgaagaagcggaggcgaaaagagagaagaaggggacggaggacaacaacaatttgtcatcgtcatcttcggtcagcacaatcaccgcaatgacacggacaaaaacattgccaaatggggcgaaacaacacgaagaagggcacaagaaacggtctctccaccaggaacccctttcccggaaaaaggtcggagactaatactgtataaggcacacggacgttttctttttaagagcagcaaccaagttttggaaaggagttcgctcatatcttcgccgtcctccgatcacacagagctcgaagtgttccacccctccgactgtagcttggcaccctcaagttcttcatgttcctcgtcagatgtaaagaaaatcccgaatatgtttgtattccaatcacacctttatttgtttagagccttgaaaaccaccggcagtcccggcattgtcccgagttggcgaacaatttgcagtcccagtcccaccatcagcaccaccggcacagtcataaacatagaaaccatagcagtcacaaaagtggggacagtgggagccgaagcagcagagaaaggaagtgacaggcaaactctcgcatttccacgtttatttgtcgccaataacctctccttacacttcacattcagtcagccatccacaaaaagttctccaaattgtcgtcgttgttttgtttataattatttgtatatttgcatttaattctctcttctctcacatatcgaaaatcacccactcatttcgatggcaaattgtttgtctcgtaaattcagttcgcaaactttttaggtataggtacactacaaaatattaatttgtgtacatatatttataaaataaagttttaaagttattgataaatgaaattgcttagtttttgcagtctaaaaatgaagaaccactaagttttgattagttcagcggcacttcgtacaagcatagtgaatgtggctcaaatgcactttatgatgaatgttttatagtgttttttttaaatagatttttataaagctaattctcgcagtagaatattttttgtaatttttgaaggcaggtaaaccaccataagta

SEQ ID NO: 13590 - DNA, 1388 bp, Heterodera glycines
tttgactgttttctgccaaatttcactttttggctcctcttcggacgctaatcgggcggcaaaacctgaaaatgtttctaataagcaccgcttcttgaaaaaacggcaattcaatttgccatatggtgaagcggcgggagtgtccatgcgaaagccaaaactcatattgaaaatccagccatcggcgacacttccgcctgctgaatgcgcgtgtatcggagattccttttgggaatgccaaagtgagtcggcccaatgagtggtgccacgcccctccccatcagagcttttgaattgccaatgattaagcgagagtagccaccaagtaagtgcctttctctgcttgggttggccacgaaagcactgactgttcggcctcgggcagtgagtgcctggctgtgatggacaaagtattggtgccgcagcggccgcacttcgtttggcactatttggaaaaacacggcgtccgcgtcgcgcagccgcccgtggtcgctcgtcacttcgcaattccaatcggcacagccacgcaaatttttctcaaaatttgcgtcccacataagcagcagcggaggagcggagctgttatctgtcattagccaaatgattgtcaaagtgaaaagcaccaccaatttgttcgggctgaagttgggcacggtcttccagcgaagcgctgccgcggggcaacaaaaggtcaacaatggttacggtaattccgtttcggtccttgatacggtatttgaacggaggacggcgaaaaacacgacgaatggcaaacaaagaagaagacttaagaaggggacttaagcaaaaaaggagcaaaagcaaagcggcaaattaaaaatgtaaaaatgtcaaatgcaaggagaactaaaaaacaactgccatttacgaatgccacggcatttcccccgccccccgccccccccccccccccgaaggacaacgcaccgcccaaaaatggtcaacgacgcttatcatcaaaatgacaaatacgcacacaacggccgacagcttaatgagcagacaaaaccaccggtgaaggaacatcgaaagtgccaagaggggagagggacaaagtgccgaattggagtcaaaagcgacagaatgaatatgcataaactagcgattcgtttttgtttttttccgaatggtttttttctttgccccccccccccccctcggcccatcacttttgtgaataatcattcgttctgatgggattcgcaaatcgatttccaatacataagtgaaaagctttggtaaacgaaatttttctttttttaaaagaaatattaatttaagaaactgaaataaataaagggtccaattttacgaatcagcgaaaattgccattggcgagaggcatttggaagacgccacttgctgct

SEQ ID NO: 13591 - DNA, 1547 bp, Heterodera glycines
gtagacaaacgaaggtgcaaaagggctctgatgacctataattcttgttgaatgtttttgatcgcaagcaactgaatgagagggctaactgatgtccagccgatcggaagagcatttagtcagtgatcactgatcactcccctccccccccccccctcattttatttctgtttgctttgtacttccccaccactttctcagcttaccaaaaggtttatcaaaacaagggataagaccccttaagcatttcatgcagtgataagcagaagggcgtttttgccatacaaaatctcattacactccaatttctatttaaattagagcgtgttcattatgccaatttaataattttgttttatttcgctgacccacaaaatgtccagcccacgaaatgtccaagtctcgaatttgagtttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggtgcctatttatttatttttcattgaatttaattaataaataattttttttaaataagttttaaatttgctcttagcttgttattatcttttgcttatctccaaagtgatgaacaacatcagcgacttttcctcctcttccaaaatggcttccaacagaccggcactgaaagagggcgagtgggcgtgtgtggactccaaatgtgcgcaaattaattcggaaaaacgtcggcactgccaaaagtgcggcaaaggttcgtcgcttcttttcaagagttcttacgctctttttagctatttttggttttatggcccggatttgaatttcaaaaattccatattttgcaattctgcgcacactttggtttggtttggtaatactacggatggtaccccctttttccgaaattattattttttcagggttgagaatccgattctaacatccattcaaagcctcctggggtgaactatagtgaacgcccgtgaaaaaaagggtcaaatgatataccaatcgattcgtctcaaggagctaagcatggaaaaatatgtctcaagttgtggaaatgccaaaaaaccggtttttgaaccggttcaaaactcgaaaaattgagagttttcgcactctaactttttttaacgatcaaataccgacaaatttggtaccatttgaaagctcttgacgagcttaatctgaaaatcaggaaatgaagtcgaacccatgccatctgagcacttggactactgagtccctgtgaaaagtgacatttcagtaccaaagatttaaaggatgaacaaaaagaattttacaagttaactttcgcaaaagggagcatgcgaagacggagcaagtagtggggcgagacggagggcggaggaagcagtctaacgagcgccacaggcggttgactgcgagggcccgaaggcaccccgccaatcagtcaac

SEQ ID NO: 13592 - DNA, 2133 bp, Heterodera glycines
  misc_feature (2042)..(2042): n is a, c, g, or t
  misc_feature (2084)..(2085): n is a, c, g, or t
  misc_feature (2093)..(2094): n is a, c, g, or t
  misc_feature (2107)..(2107): n is a, c, g, or t
gggtacggcggtgccgataggcgccgcaggggaattttaaaaaatttcagttcaatttattaacagaaattgtacaaaacttactagttttttgaaaaaaaaaatttaaaaaaattccgacttttcatcaaaaatttcggaagtcggaattccgaccccaaaaatgtcggaaaccggaagtctttccgtgccatacctggtgcctatcgacatctgcgagaaattttatgaaatttaatgcgatttattaacagattttgtctaaaattgaccaaatgacgcagtttttgactcaatttctacaggattattaagtaaaagcctatccgacggtgccgataggcgccgccgggaaaatttcacaaattttgaatgaaatttgcgatgaaaaatgagttaactttaattaaatttattatttaatttatttaaaaatatttggcattctgtcttagaaaaattttcaaaaaaatcaataaaatcccgcataatcccgcacaaaaaatcaaatttgcggtcaggacagatccgagccctggtctaaagtttaaaaaacaatgaaaaataatatttaatgttagaaaacctttgtttaattaaaattcaattaaagtgtttaaagaaaatatgaaaaaactctaatgtcacaatggtgaaaaacaacgaaagacagtaggcttaaccactaggctacatatatgtttctgattctttaacagaaatgatttatttatttaattttttctcaaaaaatttccgctgacccacaaaatgtccaagccacgaaatgtccaagccacgaaatgtccaagccacgaattgtccaagccacgaattgtccaagccacgaaatgtccaagccacgaaatgtccaaaagagtaaaaaacacgaaatgtccaaaactcgaaaaagctcataaaaacccggaaggagtctaatttagggttttcggggtcgctgaatacgaacacgacatttatattacccctttcctaaccctggacccaaatataaacataaaattgcaaaaaaaaattcaaagcacctaaaaagagtgctgatcaaaattcgaacaagttttagggttcctatgccatccgaattctctctatagacacaccctcagcttcacatattaaaaaaaataattttattaaacattcaataaaattctttacgacgtggacaattgaatcatcaaaattctcgaaatccttcaattttcctgcatatccctcaatttgtaaaccgagcgccgtcataagatcatggatgtcaccgttgttgttgtacgacgcgtccgccaaaattcgcaaaatgacagcatcctggaggatgtatcgtttgtgtcgcttgtgaatgaaatggcgagcagatcgggcagcgtccacctgtctgtcgatgctttcattaaccccacaaatgaagtccgagagggcggggtggtgacagaggcctttctaaatgtttcttttcaatttgcttttaaaaaattaaagaccataaaatgaagatgagttgcttccagtccgttgtttgtacgagcgagggcagacgtggcctgagagtgcatgttccaaaatgggattgggaagtggggcgcccgaaagatttcgtcctcccacgctggaactgaatttttttattaaattaaaacggatgaattgattaaagaatttgcctgaaggcgctatcgaagtcgatagcgggctcaacgaatattgaacaatctgctcccgtggacatcgacgtttcccaacaattttttcttctcacgccgcatcatttcagtcaacgcattgttggaactcatggcacaaatgcttgatccgttgctgatcgcctcacttttgacaaaattcgggtcggcttcagacatggctcggccaggacactttcttttattttctgccgctttgactctgcctttaatacaaaacatttcttttaatttaaacaaacttgttgtttctgaggtgctgggagatggttatgttctctttgacagacaatctcccccaaaattggtctttccgcgctncaggtcactgttgaaaagtcagcctcgttcaaagtttgttgnntcacattnngtcgaagtatcancgcatgcgattcgtcaccctccactc

SEQ ID NO: 13593 - DNA, 1067 bp, Heterodera glycines
  misc_feature (6)..(6): n is a, c, g, or t
  misc_feature (17)..(17): n is a, c, g, or t
  misc_feature (23)..(23): n is a, c, g, or t
  misc_feature (26)..(30): n is a, c, g, or t
  misc_feature (33)..(33): n is a, c, g, or t
  misc_feature (36)..(36): n is a, c, g, or t
  misc_feature (39)..(39): n is a, c, g, or t
  misc_feature (41)..(41): n is a, c, g, or t
  misc_feature (47)..(47): n is a, c, g, or t
  misc_feature (55)..(56): n is a, c, g, or t
  misc_feature (58)..(58): n is a, c, g, or t
  misc_feature (62)..(62): n is a, c, g, or t
  misc_feature (65)..(65): n is a, c, g, or t
  misc_feature (67)..(67): n is a, c, g, or t
  misc_feature (74)..(74): n is a, c, g, or t
  misc_feature (97)..(97): n is a, c, g, or t
  misc_feature (106)..(106): n is a, c, g, or t
  misc_feature (117)..(117): n is a, c, g, or t
  misc_feature (125)..(125): n is a, c, g, or t
  misc_feature (131)..(131): n is a, c, g, or t
  misc_feature (137)..(139): n is a, c, g, or t
  misc_feature (143)..(143): n is a, c, g, or t
cacagnacgccaccggncaaagnaannnnnagncanaangnccaacngcagccanngncacngangnggaaggngccggaagcaccgagcggaacgngaacaaccngaacaaaccanggacacgncaaaangagagnnnaagngacataggatcaaaggcacgaaaagccaaaaaaaaaaggaggaaaacgaaataaaaaacatcatatggtatgatacggtacggaacaaaaaatgaactgtagtggactaaaacaaaaaagttcaaaaaagtaaaaaataaaatgaagaaaacgaatggaaaagattgtcgtcactgccggacatttccaaaaattttcctccatcgacgagcaaaaaaaagcaactgcttttgctccgattttattttctgcttataggccccctaccaaatttcggtttatggcaaaatgttcatagcgacgtctgcccacggcacatttgagtccaggcaatgagggcaattcgcagcggaccgggcccgggcaattgatcggatgcttcgatcgtccatagaagatcctgagggcaacaaatagattctgatcagaaataggtaaacaaattgatcaatttgcctattatagcaatcggcgatcaacggatagtaaacaactcttgagggcaaacgcgcgaacagctcgccaagctcaggtgttgtggccaaaaagcggtgaaagttctgctccagctcgaccgcccgggccggctgaagcatgtccgacatttggaacttgaaaagttcaaaggtctgtaatcgaacaaattagggatagagtgatcagaactgaaaattggtggtgatcaaaatcattgtcgattgaccaatgtcggcttattggtagtcaaaatgccaatgcttctgtcatgatgccaatgatagagcttacccgttgtgtccgaggatatgctgaggagctgaagtcaatctgaaggtttaaatgcgttaatctatgaccaatgccaccgacaaaatcgaatgttgaattaggcaattccatttcgggcaaaatttttaaaattgttccgtgcacaccactatgatc

SEQ ID NO: 13594 - DNA, 2001 bp, Heterodera glycines
tgatcaaagagacaaggcttaatgaccatcggtgatcagtgataaacagcaagttaattaattggtcacaaaagtgattaaatcaccaaaacaaaacgaaaaaaatcattaaaaatgaccaatgccatcaaattgagacggggagattaatggagacgggcatatgattagagaaattacggtagtaccatgctccagttgcgaaagtggagcatgaaattctgctccgccggcacagtgtacattcggcctcggctgatgattccgggccaatgcagccaaacgctttgcacattgcccggcttcaccacatatttggggtcttcccattcggtagccactctaataagtgatcaattttttttgaaaattgaattctttttaccgcgcttcattgatcaatgccgcaagggaaaattcgcccggttcactgcctgaagaagagaaatgcaagagaaaaagatctaacaagaaggaggaggagtcgagaagacgaaagtgagagagagaacgagagagagagagagaaagataagagtgagaggaaagacggataggaaagagacagatagggcagaatgcggagagagagagagagagagagagagatggttctaatacagcttatacagcttaattcgtgcacagtaaagctagctcacttgtcaccaattcggtgttgtatcggttgtaggaaaagccggccgcgtaaggcactttggcacttagaaaacggaattcctccaaaaatgtttggccaagcttcgggatcagcacatcatccaaatcggacacgatcaggaactcagcggcatccaaaaaattaatgatttggcgcaaatttgtggggtccgcctctgatcaggcaacaacaaactttgtagaaaagcagacagtccgtgtgcgcagcagcctgatttctgaaaaaaattgtttggttttcaggcaaaatctataccttagatcaaatcagattatttcataaaattgatcagctattcaagggcatacctttgggtcttatcagattcgttcattgatcagcatattattaattaccaaacctcggcattttttggctttatattgatcaatcatttcagctattcattttcaatcattgagttgtgatctcatcaactaagaaaccatcgctattaatcagtactattcacagtgattagcttgatgatcactataattaagccttatttacctccattctagctcagtgtttgggtcatagccgagtcgatcagtgccgtccgggtcctggacactcagtcccatccacgtctccaacttgacaattttctgcctttcgtacaccttaaacacaggatgccataatgcgggtcatttttgggtttccggcccgtccctggttcagtccagagggcacaaaaaaattcccctctcccccaattttgccccgggcgaatcggtccccccttccccaatcgctaattttgtatggacccaccttcggaataaaggctattatcctactccaatttaacacattatggggatggcttcggttacgaatgccaaaagtgcatccgataaaatcaccttcatgaagtcgaggatttcgaccagcatgctttggatgtagtacacttgaagtgtgacgcccaattggcgataaatttccaactgaaaacagaacgccaaaaatttggatgaaaaaaagtttgatcagtcggacctaccgtcggaatgatcagttgccaccgttcgttatagaacaatgggctgaagcaggcaacgacggacaactgttggtccgagacgggtcggattggcacagtgacggaatgggacagcacttggacatcgcgcagttggaatttggtgggacggtccaccgtcggacaggaggccaagtagacggacctaattaattgtcagagtcatttccatattaattaatttggctggttataattaattgtcaaggccatttagttattattattgtcatatcaattgtcgggg

SEQ ID NO: 13595 - DNA, 3427 bp, Heterodera glycines
  misc_feature (3261)..(3262): n is a, c, g, or t
  misc_feature (3264)..(3264): n is a, c, g, or t
  misc_feature (3383)..(3383): n is a, c, g, or t
ggacagtttttaaccgtgggaatttgattcttttgggtttgaaaagtttatgaagaaacttctgtacatcgtgaagctttaggttggggatacgttttcgcgcttatgctagcaccttttgcattcctgcatagctggcggcgaattaaggttgtaataaacctgttcaagttgactttctatagttttgcccataatctggtttaaatggcggtttttctctatttaatccttgggtttttatagggttaacctggacaaggactagttttcttttagttcttctcttctttcctttaccctgttgtaaattaaataagtattttgcaatttccggttccctcttcaaacgttgaacaaaaaatgtatgacctctaggcagagaaatatcttcacctgataataatttcagtgattcagtataattcgatccggtgactggcttattaaaattagtcaaaacctgtcctgattgcatatcgattccaaatttgtccggattttttccaataatattcataatttttgaaaaatttttctgacttaattttacgtcttgggaacgtattggcgtactactgctacattctgtagccgaagaataatctgccgaggattcaaacacgttttcacttttctttttacgtgatgctcttattaatcgtaacggctgacgcttattctcttgttctacggctgtttctatttttggtattttatgaattcccatatatggagcaacgtttggtattgcagaactcgggtttccttctatgatcactttctgtggtttattttccatcagctctttgagttgacgtctccgtttgtacagccaagagtgtcgtttcattttaatatcagctccgattgttttatcattcaaatttttatgtatatttgagtctaatgatgttttttcatcttgtataggatcgcctcggctacccatactcttcactatgttcataagcgcaatgtattcggtttccggaaccatgaccattttctttgtgtgcttcattatgctgttattttttcaagcaaatgttgggctaagacactgagaacaggcacaagaatagcaccaagggcaattccgctcccttgttgaagtttttgccgagctgagttctcactgcgagcgcgtgctatggccctgtaatagtccgcgtattgtgacaaccgtcgcttctggcttgaatttaaacgaaaattaaattttaaaatatttgcgcaaatttccacaagggcaagtatttggtctgctgatgctccctgtagtagctcgttttttcgtttatcagacctagtggccgcaagctttttaaaaaaatctgtattttccctaacgtaaggactaaattgatacattttggattttttctacattcatgtctttatatagacaatgcggttagtgtaatacgttattcgctcggtaaatagatttctctgcgttcgtccgggaatattttgctagtaagacgttcattttcctgtgcattaggatgcatatttataaccaggtagctaaacggttgacttgttgcatcgttatatgactccataaaataatttaagcgctttggaaacaattgagatccgactgtccgtacctgaagttgcccggatgggttacgtgtcagcacaagatagtgactgttcgcccttgctgtccgaatatttcgcccatacaggctctgagttacgaaaattacgtttacgttccaattatgcgaaccgcgtgtaaacaaaagatccaaaaaatcattgtttatgttcagcataaggtcgtccagcacaagtaggagaggtttaggtttactattaatcaatgcctgatctggaatcccattatgggtttctattccacgtttcatcagatcaatgaccgaatcgttcatttcagaataacaatataaaactttttcgggaggtgggttaatcagttcattatggtgtttcaacaacctcatcagccaatgggttttaccacttccggtggcgcccgataatataagagtgaagggggcattaaacattttttaaagttcaatttttctaattgtaacttatttatatagtgtttgtcctcaattttgtatgggacatatgccgcacattttgggcacatccaacatttttctgcccaggggaagtgtacggtgccaaaatgcaatagactttgtgtcctacatcttttacaaatttcataatgacatggacagtaatgacaacattttacttgatgaatacaaattttgttcatttttaataatttgtaacaaattgaaaaaaacagaattgtttaaatagtgtaaatatgtaggggcagttattcgggtttcatgatgtattcgagccattgtgttaaatctgccgaactgccagataattctactgtttccttctgcgaccactctgttgtcaatttggctgttttaaaaagagtctgcgggtcggactcggatattttggcaagtggtggaaatttctcacatgacaaatcgttttcaaaagtttgaggggctgttggtataaacgatgacgatttttcttgtgggaaatcttcatcaggcggttcgatttttggttgtatgagtggttgttcgcgttccatttgttggtccggcggtggtaaaggttcacgctccaattctttatcaaccgataattgtatatttttctccatgaatgtttagaggtaatgggtacaataatctctattaactgtacatttcttaaaacgagctgcttatatagtgacgctaggggcgggggtctggatcctttaataggacatggggcaggggtctggacccttaatatgacaagggacatgggtctgagggtacttaatagaacaagtggtaggggtctgaacgaccctgtccgttgattatatgcagaaatgctttaagttacagggcaggggtccccagatcccttgcgataggttgtaggggcaggggtcccagaccgctgcccatgtgatagattacaggggcaggggtcccatgtgataggttgtaggggcaggggtcccagacccctgcctatgtgagaatacgttcacatgatatcatatactgtatgttgaaaataggatcagcatactgtataattttgttgcaataaaaaaaatgaaacaaaaaagggttacgaataattaagcatatgtgtttgtcagattgagtccaattattagaaaaaattggattaatattctctataattccatatactgtattttgaacnnangctcagtatactgtataattgcaattgcaacaaagaatttatggataattaagcatactgttttagtcagattgaaaatccagatccaccagcttcaatatgaaatcccgctccatatntcggtccagggctttttttttaattgagaaactctaaaatttaa

SEQ ID NO: 13596 - DNA, 1519 bp, Heterodera glycines
  misc_feature (1245)..(1245): n is a, c, g, or t
tgtcattttttacatttgcttttgaacaaattccgtcctccatttgcccttaagtggcgtaacaagtcagtccaatcatttatccaaacactcattcattacgttgtcaaatcggttctaacagcttcttgctctttgttgtccgatgctctctttttcatcggtgccaatcgcgacgaaattcgtcagagtgccgggcccttttggcgctcatcaggtgtggcacggcatttgccttttcggtgcctttttaatttgtgctgtgccccattttcagcaacatttgagctaccccttctttgtccatgtgttcgcttcttctttgctagtctttgcctccgtttgcagtgccattgcttattatttgccaatgactaaaatgaaacgaaggcaaaacgacaacggacaaaaagaagagacagtggcggaaggaaaacggtgagagaaggaaaacggtgagagaaggcggagggaaacgggggagtgggagacggggggggggaagccgatggacgggggaggtaacgaggaataccataccaatcagaagggatagtgccaagcgggatccatgggggagaaaaatccgaggggaggtatgccgatcagaaggggaggaatagacaaaagagatccatgggaggtgtggggggggggggagaaaaagccgagtgaagggaaaggggtaacgaggaatgccggggaaagcaaagggattagagagcactttggacgaatgatccctctgccccctccccgtcccttctttagccttaacaatggtgccgctgtgctcctcagaaatggcctttttctgagtgccgcttctctcccctgtcgctccgtttctccaaattcttcgctctctgattattttccgccgcctccgccaacgccaagactctttcagccggtaacagaaaagatttacaatagcagtatattattgcttttttctgcaaaggattggatgtcacagtatttaacgggacgaaagggtacggtaggagcggagagtacggtggcgaggagagaaagggacgggtgctggtcggccgtttgagtacggcaagagagaggcgagaagaagttacacgaaatgcttgtaaaaagattcaataaataaatgtttatattttgttgtgattttaaatgccattctccggcgaatggcagcgaacggaacgaaacaatttcaaatttgttttttttcacctaatgaggcacactttttaagatttaatnttattgcccccccccctccaacgcattttttaaattaaaatttacgatttttaaatccccccccccaattgtccgtttcattttataaaatattattaattagtaataatttaagtgccacattattcatccgtttctctttctttctttctttctttctttgttttttttgtgcttttcctcctcttttcatgcgctcgtttccctgaacattcgctgcgtccctttggcattggcattttgactttggccgttgtaagcgaattgttggcca

SEQ ID NO: 13597 - DNA, 2724 bp, Heterodera glycines
gataaacaatcaaaaaagaagaaaacgaagggagagtttttgtgtttgaagtgaaaatggcaaaatgaaagaacgaattggcggtggctgaatcggcgatcaaaaataatcaatggccatcgatcagttatcgattgatcggtcacacttgcgtattcgccccgatcagtcgcgtcgtccccccgcctctgcccgctgccttttgtggcatttcgccggagggatcgctggaccattcgaccacgggtcgtcggtagaccgaggcgaggttggccgagtggagccgtgggccgtcatcgaacagttttctgtgatgagaaaatggaaattcatacggtagaggggaagagtactgtaggtaatagcaaaagggatactgtagagaagaggaaaagagtgaaaaatggaaaggaaagggagtaaaatgattaatgttatcagaatgtccgcttgaacactttcccccccccccctccctcaaaattgatcaattcattttaatagcgtatggctaattaggcaattatgacagatgaaagggacaaataaaatttgaattgtttaaaatgacgggggaaaattaaacaaacgaaaaacaaaaccaaaaacgaatttcggtaataaataaaaacatatataataataataataatataaatatttaaaaagtgctttgttaaagtgcaatttgtgcacaattgcgaaacacaaaattaaggcaaagcaacagaaaactgaggagagaaaaagtgaaaagaaaggacagaaaaaagggaaaactcccactaccgtaccacggagaataccgtacctttgctgtccattggaagtgagaaatttgtaagtggttgcaatggcacagacaaaagcgaacgcccagcagagagtaccgcccaaatggaggtaaaaggcgtagccgatcacttgctcctaagggtggaagggtactgtagaaggagtcgaccgattcggcaaacaaatacggtaggacaagccacggtagaatgtgtgaaaaacttacataagtgccgaccattccttaagagcaaaaatatatttaattactcatcacccgatgttgaatggtcaccctccccccccccccctcaattaattaatgctttcgaatttggcatttattttgtgcctttttaccggtgacgaagcgaatgtcgacgcgattagcggagaagaagaaaatgccatcggcgagcaccgacaaaagcatggcgatgaacagagaaatggcgaaacagaaggtggacggggcaaaacaaggcgcacaaacgccggtgcaaacggcgacaaacgcagccaattgggagagaaggatcagcgaaaggacgaccttatgccatcccctggggacgaatgggatgatcagagacggcacaagcaaatgtcatccccggcaaagacatagcaaaagagctaacaaacaaagggtggaccacatagccccccccccccaggcaacgtcattgatcccctgggggcaaatggaaagaccagcagagatggccaatgcttttcctaccagaatcggtggtgctcagcttctccagctgccccgtcctcgtcgacatggttctgaaagtgaatgccatgccgttttttgctttgttttgccgtgccctctcccacccgaccagcgctctttcgatgactaatgccgcggactcgtcgaatttgtacatgcaatggagcggcgcttcctcgtaaaagtcgcccaccgccaccacatgctgaaaaagaatggcaaacgaacatcgaaaggcaatttgatcagctaaaacggagccaaccttttcggcacgaatgcaatcccaccaaaggccgtgctaaagcaaaaaatgggggaataaataaatgaggggaaaagtcggtggagggcggggaaatccccctcgggggatataatttcaacaatttattaccgaaaaaccctttcatgtttaagaaaaacgaattcttactaaatgtgcttattgtttacttcaatatttcgaataaatttaattatttcttaaaattaataggtaattcttttaaactgtgccttttttgttcaatgaaaaaaatcttcaaatggattaagcaataaatctcatcaagctttaaatagagtgcccttaatttaaaattatcttttaattaattagaattgcctgatgttcagctcggaattcgcgaatgtcaacaactaaagataaatgattaattagattaatttgaatcaatgggccaaatgtttttttggcattgccttgccaagcgggcgaaaaaacaccggcgactgtcaaaacgatgccggcgatgatcagaaaaatggaaacggccaacaaaagtttttgaatggctgtgctcggcattttattgccgagaaaataacgaagtgatcgattgatcgatcagtcggtgatcagaagcaaaagatcactgaaaaaagggaaaaacaaaaaattaacgaaatgccaaaaagggataattaaaaagggaatcaaagaaaacaaaatatgatgagtcattcattcgattggagattttgtcaggaaagtcacgagaagggaaattcattcacattgacacaccatcccagaaatgagctgctgtaccaaaaaagatttgcgtgtgtggctcacgtggttttagtaagatagtaaagggacaaagggtggtggttcgagtcaaaaagtgcaactatgaatattttcatttatttat

SEQ ID NO: 13598 - DNA, 1025 bp, Heterodera glycines
atatatttattatttattagataatcattcaattgttaattaactaattaattaaattattagaataactcttccgtactgaaatggcccgcctcttccgattagggggatctacgacaattcaaagaggggttttattttcgaaccctctcgggaagagagagggctgactttatttaataaggggcctcaaattcaataaataggctattccgccatcgtttaccttcatttccggccccattagttccttgtgcattaaatgggctaacaaatttttgcgctccatcagcaacattttcagcaaatcggcaatgttttcggcattgtggaatgaaaacggaattgatttttccaaaatgcattgcataacgcaatttttgacgcgttcttccgtcgtttttccctcagtgatttttcgttcatcacaaaatttttcaaaagtcctagctcttatgcttggttgagttttaagggcccatgaaaataaatcggcaattcgatcatcttttgactcttggacaatttgggtgagtgtgatgagttcgttttcaatttccaccggcaaattcgtctcatctgatcaaaaatattcacatattaattgataatgattagaaaaactatttttgaataaaatattctgttaaattacttttttgctttgtgcttttcgaagtttctcctgctccgctggctgttccaattaatgccagataaaagataattgaaaagtgaaatgagttgtttttagtcgcgcttctcttcattggtttttttttgtgtatgttaaggttctattatataattatgcataaaacagagtaaccatcggttagctcaatttaaaatgatataagagggaaaatttgcgaattcaaggatactttaaaaaattaaaaacacaaacaaaaggaataagcagtagtgactttttctagcatttcgtccctttttttgcggttcgtttaaaaaaaaaattctacgcaacagaaggagtcggcgaggggggggggggggggggg

SEQ ID NO: 13599 - DNA, 3153 bp, Heterodera glycines
  misc_feature (80)..(80): n is a, c, g, or t
  misc_feature (95)..(95): n is a, c, g, or t
tgattatatacccattttatatattatatttgttttattttttgaaatccctccctctggtgcccaaacttcccggtgcncaaatttctggtgcncaaacttcatgtcgccgtcggcgatgccgataggcgccgtgaaatttacttatgatttgttaaaagttatttccagcaaaaaatttttgaaaaaattggaaaaaagtgtcattcttaatttcttgagtccaaaaggtatccaaattgaacacttcgttgatttattgccacaaaatgcgattgtaaagcgacgcgtttctgtaataaattggcattttttattacattttgcactttatacatttatttatagagctaatatttttagcttctatggtctgaattgcacgaaaaaacattttgttgttttttttggtgggttcttaagctacctttcgtgttattagggcctatttactaagtttttatttttagagccgaaaaccccaaaaaaaaattttgaaaaaacctgttttgacctattttggcgttttcccaaatttttaacaaaaatgcaataaaaacgaaaaatacgcacctatgattagggaaccgacttttagtgacgaaaaatcccgaaatagttaactaaaatagtgacaaaaagtccgaaatagtgacaaatagtcacataattttcagccaaaaattgagcaaaaataatttttattcactgattgcagttgcaaatgaggtacattcctttcttacattttttagcaaatattgaaatttttaaaccaaaaattttgtaagaaaaaaatttgggggaaaaatttttatgaaaattttccaattctaactggtattttttgaaaaatttttaggtcgattcttaggggtgtattttttggttttttggcatttttgttaataaattttactaaaaacgtcgaaatagtgaaaaatagtgacgaaaagccaaaaaagtgaattttcactattaatagtgatttctagtgacgaaaaatgacgtccaaatgaaaaattttaacgcaaaaatgcgttttttgagctcctttcttcaaaacaatttagcaaaaaaaagttttttcactagaaatcggtccttacctatgatcgaccctaaaaattttcagaaaaatatgctataaatcaatcgtagaaatgaaaaatttctcaaaaaatcatctccaaaataatttatttattttcttgataagaatttctggttttaattagagtgcagcgggaccgggaccgggccgggaattcccggtcatccgaagtcccggtcccggattttgaaaagctcaggtcccggtcccggtcccggtagggcaacagggaaaaacaagcactggtaattcaaaatttcccccggcggcgcctatccgcaccgccccggatccccttcttccacaaaaattttttgaaaaagcgcgccgaaaaaatgtgatgtgaaaagcaaatattaatttataataatattcaatcatttaatccaaaaaatgattaattgtttgaaataattaaagaaatttgtttgaaaattttcattaatttaatttagctttaactttaatttttggattttattaaataaaaaacaaaataaaaatttaattttgtattattttcagttgaaaaaaggaaaaacactttcttttttgtgtttgcgaacaaaagttgggacttttatttacatatttttacaaattttgggatttttctacatattacatatgtacatatttttatacatattttggactgtttcatacatattccacaatttttcgtacatatttttcatttttttacatattttgaggatttttgagaatttatagaaattttttgtaaaaaattaaaaaatttttttttgaaaatatatccctaaaaaatcgatttttttcaaaaaatgatatatcaaaaattaatttgtaaaatattcaaatgtgattctaagcctattttggtcatttttatggcattttgtgcctatttcactttttacgaagaatttttttccaaaaaataaccattaaaaaaattttatttacatattttcctacatatttgaggacttttgtacatatttcatacatattttagcattttttatacatattttatttacataattcgcaaattttcttacataaaattagcagccctattaatgaatatttagctcaatactgatttggcataattttttttaattgaaattttcttatagtgaatgtgggttagtcacctagggtacagaaaaacacccggataaatttttgttagggatggcatttcttgcgaagagttggaataattcaatttttcatctttatcgggtgattttttttccttttcaaggctcgagtttaggtcggatttttgtgaatagcctgggcttactcgggatttttgtacattgaaaaaacagatagggagggatataggttggagaaggaagaaaaaagtgccttggaaaatcgagcaaattggcagagtgatttgtgtggagggcgaaattgatttaaatacacaatttttcgatgcaatgggaggggtggataaaatggaggagggatttgtggcaaaattcaacaatgtgcaatgtggggccacatgccatacattgcattgcgttgtgtaagcagtgggggataaatgcctgaataatgtccatgccatacaatgctatagatgcctttcattgtgtaagcggtgggggataattgaattatgtccatgccatttctctctttcgaaaattaaattctctctctctctctctctcccttctctctgttctctcttctccctctctctctctcccccctctgtctctctccctctctttctctctagctttccatcgttacttatcgccagagtgcgttgatcgattttgggcctcctacgcagttggttttagttatggatgatgtgaaaattgctgacttatatctcgcaaattttgtaaaacctgaattggcatattacaattcgaatttaagcctgggaggaagggagagacggggagggaaaagatccccgcctcgatcagcggggctctgatcagtagggaataaaattatatggacataaaatcacgaaatatggccataaaatatggaccaaaaatcgaaaa

SEQ ID NO: 13600 - DNA, 3538 bp, Heterodera glycines
atttttcaaaattccggacataaattttacttaattctttgataattcatttatgtgctattttaattatattcatttttaaaattattattttttaattattattttttttaatttcttcaaaaattttgttttcgtataatagctaaattagctatgaaataaaaataataaacattgaaattttttctgttcgccccattcaattttttttttcaaaaatattataagaaataaaaaaagattggcataaaagaaagaaatttttacagaaccaccacccacctaaaaaaaccaattttctatctggaagacaaatttttaaacgataatttaattaaaaactgttaaccattttaaaattgtttaatcatttttaaataattaacgaataaaaatgaatttatgacaaatttaaaaacatttttaatgtccctttattcggcttttcattgcccgttagataaatctgtttcaaagcaattaaataaaaccaattaattgaaaaacatttcattaatgatccgttgggtgaacaatgaatgggctgctgtcgcatttttcggagatgaattgacccgttaaccgagatccattcacaaaatacaaagaagcattcaaccgttttctgcagaagctgcagttttcctttataattacacctttttattaatataaattaataaaaattttgattaaaataaatttatcttttttttctttcattttggcggttcttccactaaaatagctaattttttaaattgatattttttaaaatttcgatcaaaaatttatgaaaaatgagtttttcccttttttcattcaattaaaaaaaatctggttttgagttctctgatcattctgcacaataactcacgatcacaaatacacatttttaggagatctctccctgtgttgatcagcttgatcattaatctcgccatgcaaaaaaagcacacaaaacgcgcacccaaacacagcacagcccctattgtgttgtgatgatttgatttgcgaataaaaacattaattatttattcataaaaaaggctttttccgcttcatttgccttgggcaacaaataaatcaccccccccccccccaattagccttatcaatgaaaaattattgcgcgatttttgggcgcatttaagggcctcccaatgttaaaaaacaatgcgcgcggaaagcttgatcagatgcttcttcctgttcccgaccaatgatttgatcaatgaataatgataataataatatttgtgttttgcttcagattcaagtcgtggaaatgatcagtttttattcaatggaataaaaaataattataaaatttatatttaattgttatgaacttatttttgtttttttttagaatttggcaattttatttcattcattttccagaaaattgcatatgtatttttgttttttatcgataaattcggggattttaaataaatgtttaacccggattttgctgttttatttttaaaccgtggcaatataaaagttttttttaaatacaagaattttaaaaatgaacctcccatggctttgatttatagcggcgctttagtcctagcgtccaaaaaaatttcggaaaatccgaagctttcatcaaaaataaaaaaactaaaataaagaattgattgcataaaacgacaattttttgatcattttttttcatgtctaatcgttaatcagcgaaaatcggtgattgaccgaattcacttttccgattcaagcagtacacccaacgaccgctttcttctgcgcacaaaaaatcctccaattgaacaattccatacacacacacacataatgattgacctggaattttaattgggtgctgcaaaaactttaaaccctattttaaataagaaaaaatgaatataattttttagaaaatgtatcatacagtaattttactgatcatttgccatctacttcatacagtaatctcgctggcttctgtgctcgtttcatcgccgtttgataatttccgaattgagtgcccacagtcatcgggcgcacaacggttgtcaattcgtatggtcgaatcgcaaggccagaagcgccaggacactgtattcgtgctcagttgtcagcacattgttgaggtaatgtgtagtacggtatacggtagtttacagtgagaatgggtggcagcttttccaaaataattaattattttaaatttcttaataattgcaaatctctgtgaaatgtgcaaatcaggagtgggtttgaggcttactgcaccactcttcttacaaattaacacaattttttaaaattaatcattttgctaaaaaatttagaaataaaagaggaaaagtgcaaataattttaattgctaatgattaagtcccgctttacatttgaaatcatttaattcttaatgtcatcattttcaaatctattaaaccaaaaagtaattagccgattatacaatattttaaattcatgaaaataaaatcagttatattttgcaaaatttgtcaagctttatccatggctttgtctatacaaatatttttaattaataatgaataagtcaattttttttattaaaatcatttaatagttaatgtttataactaagtaaataaaaaatagattttttttttgaaatgaggatttgaggatttttgagaaattttaaagtttctgaggcttttggggaaaatcgtcagaatctattaaatttgtgattaaaaattttaaatttaaattatatatttttgggagagtaaatgttttaatttaaaactaattatttattaattttaaattaaaaaattcatgtattttttaaatttgaatttttcaaaaaattatttcatttcaatttaaataaataatcaattattatacatttcaaagtttctttttaattaagaaaaggagtaatttattttaaaatttttcaaaaatttaatgcattcaatttttaatcttatttttaataaaatcattgccttatttattttattttaaaccgtggttgtacctcttccactcgtggctgtagctcttcaaacaattgttgtactattttcttaccagggttgtacctctgctaaaaatttttaccacttctaaccatggctgtatatggaatttgaataccctgattaattaaattaattaaatttaatatttattatttctattgtaaatttttcatttaaatgatgttttgtagaaaaaaaacactttgtttaaattatttcaaatatatatgatgaaaatgatgtgcagtgttcaactaactattcattaaaatttctttttcattcactgcattggcacaaccgcattagagttattaacgcaaattaatttcaacaaaaatgcaaattgtttttgaaatgccgtgcgatattcagaactaaaatagaaaaaataagaattataataattaatacaaaaattgaatttgccttgtcaaatacaaaattggggcacatgatgcggcactgaaatgcaacaaaatgccaataatttggttaaaatccccataaaaatatgg

SEQ ID NO: 13601 - DNA, 1264 bp, Heterodera glycines
  misc_feature (1090)..(1090): n is a, c, g, or t
attataattgcaatttctttttttgcagttatatatgctgttaaaaaaatacagaccaaccttactactctaatcgtaagtcaaatgcctgcttttatattaaaaacgaaagtcagaaatgtgccatctgtgcttcaaaatttgaagcattgggtgagaaaatcttttttgttttttcaaatatgaatccgaaatatttttcaaaaaattgggagtgaatgagaaggcgggcggtgatgtaccaaaaaaaggattttacgaccgttgattagttaacatggccatatattataagcggggggggggtcggctttttttcggcgcgttttttccgaaaaaaatttggggaccgtgagggggggggggcggcggtgccgataggcgccgctgggaatttgccataggcgccactcaaaggggtttctaatgatttttaaggaaatcggtcaaaatttattggaattttcatttttcttcgattgtcctcaatttttttatactttcagccccctttttgccgctgcaccaaatttgccgattgaattgaacgaagaaaatggaacaaagcagggaatctgaaggaaaatttttgcaaaatttcaccattgtttttgaacagaaaaatgtatttgttgtttaaaaacgaataaacggctctgaagcctgaaattaaattgtaaattatttgagtgtaatttataatttttgtcatgcctttatgttacggtatcatcactgtatcgtccggcgactcccacttgatgttgctgttctccgcaaattacaccttcaattttcacacaattgtcccgttttcctattccaccgatgggttggaaataaacgaataaaaatttgaattatttctgtttttaaaaatatgaatttcgtaaagcatcacttaaaccatttttagactaaaaatggaaaatttaaaaatttaatttttgattttttattcgaatccggatccgggatcgaaattgggcgaaatggatgtcagattcatgctcagcgacccttaaaactcaaaaaaggggggctaccatccgcactattacctcgttttgttttaggaaaaaatttctanaactgcaaaattaacaaaaaattttgagtttcttaagaatggagctcactgaaccataaaacccaacgaaaaattgatatacttatttaaaaaaattttaaacattgtataaattatacctagcacccagggaacggatttatatgtttttagcatgaaaagctcaaaaattgc

SEQ ID NO: 13602 - DNA, 2846 bp, Heterodera glycines
atattttctaaaaaattcgaattctggttagggattcgagatgagctaatagaatgacagatcgggcacttgtaatgttgtgatacccatattttggtaaattgatgaaaatatatatacctattttcgaaattttaaaggtaactcaatatatgaataactattttattgatacaataaagttaaataagtgccaaaattggctatcgtatgataaaaaacaaataaaatgaaaaaaacagttaattggggggaaggtggcaatgggcatgattgggccctacgaattatgcaagtatgctgaggcggcaaccgtccatcaggtttccttctcctgctcgtcctgatcatcatcatcaccgttctcgttgtccaccaacagaccccatcagcgagtcagaggcgacggagtcgagtctcgtcgtcctcctgctccaaactgtcctcgtcgggcctgtaggtaggagcatcttcggcggttttgagtgggaattgcactgaggccggcttaattaaagggattttcatgttggtaaaaaaccagcagactttcgtcacagacgacagacagcttaatctttgcgagtaatagctcacctaaatttacgtataagcaataaattaaaattacataccatccggtctggcgtggcaagaattacataataataattcgtattcacacagatttttttatttagattcgtttttgaacgatgttttatacatgattttgtatttaatttaaagagtaaaagagaggagttattagacaattaccaaaaaagatttgattatttaagtaattgttgatattttcgtttataactaggtttagctcgaatatgaacaaagttattgtaaagaaaaaggggattgtcattgattggactcataaaatatgtgcctttggactcataagtgcattagagcaggacaaaacaacactatttccaaaatttttgagatcgaatttttaagaaatttttcatttcatatgggtctatttttgaaagttttttggtcgattcttagaggtatattttcgaaattttttgggtcgattcttagtggtgtatttttttgctttcattgcatttttgtttataaattttgtacaaaatgccaaaataagggcaaaaacttattttaagggcgaacacccaaagaaaggatttcttaggttgaagattagtttttgcgaaatgaaatatatttttttctgctgtcattttctccattactttacatgtgcactattttgcggcgcgcttttttttcaaaaaacttggcaaagcgaggtgtccgggggaaaaaaattggatccttgccattcatggacgaatgcgagccttgaattagttgaattacctatattcgttatcagcgatcccaaaacgccaagtacatcgcagaaccgcttaagacgaacttttgcgggactttcaaaatttgaaaaatttaatctcaaaattctggcacagaaatctctcttcctatgtggctataagttgaagacccatggtcaaatcatatttgttaaggcctcccgttattatgaggaggcaaggaagtgattctaacagagaatagaatacttgaccgtaggactgatgtaggtggcatgctattctctaccacttgtctacttaaatttttgaatttaccatttgtatcatctaaacgtagaaatcgcttccaatttctgaagtcattctgaagcgatgcgtttccttttgagagagaacacaagaggaacgcagttgtacacatactgtagacccgacccccacattttgaggataattcctattaaatttgctgttatatttctcaataaagattatcacctttaatgctttatttcaaaaaataagtaatttacaataatatcttatcactcatttactttttatagcacgcaaatgaacaacgacttacttccggaacgagcccaagctggggcagttcaggacgacgacgcccggctgggccgcatctcaaaagtttgcttttaaattttgtaaaacaggatattggcgtttgcaatggtagattttgttccgaaatatacttttttgattatgtaaataaccaaatgataatcttagatgttgactggcatttgctcaatcttgaaattgaatattttttaagatttaacattttattgcaaatattgctgtggaatgattgagttgtagcagcaatatgaaaggattcagaagcagggtcgacattgtcctcccccaaaaaaaaaaattttaaagaaaaggacaaattttttaaattttgaatgtttttcttatcataaaatcccaaaaattttcccgtcgacacttatcgacaccgcggagcccaatataatatttttatcgaaaaattgatctcgcatggcaaaagattgtcattttttggtgcaaaacctaacaaattcctgttttcgcctctgcgatcagaattttattttctaaaaaattcgaattctggttagggattcgagatgagctaatagaatgacagatcgggcacttgtaatgttgagatacccatattttggtaaacaaaattggctatcgtatgataaaaacaaataaaatgaaaaaaacagttaattggggggaaggtggcaatgggcatgactgcgccctacgaattatgcaagtatgctgaggcggcaaccgcccatcaggtttccttctcctgctcgtcctgatcatcatcatcaccgttctcgttgtccaccaacagaccccatcagcgagtcagaggcgacggagtcgagtctcgtcgtcctcctgctccaaactgtcctcgtcgggcctgtaggtaggagcatcttcggc

SEQ ID NO: 13603 - DNA, 1987 bp, Heterodera glycines
gtgtcatggcagctagtacacagggcaactcgtacaaaaaaattcctaagaattttcaactaaaacttagaatttttatataaaaaaaaatcttaatggattttttagccaagaaaactttaaaaaaattttttttaaagtttttaaaaaatctaagtgttttaaaaagtttttctaggctaaaaaattcttagatttttttatctaaaaatctaagtttagttgaaaattcttagaaattttttttgtacgagttgccattgacccaaaaaaagtaacagcagaaaatgagtgattggatgggcttatccacttgccaatttccgcttttttgtcccttttttttcttccaccgtcaaatcaatggccagcgtcactttgtcctcatttttgtcgtaaaatcctttgctcggctccattaattccttaatgtcaatttatttcacgagaaatgagttttgccgaggttatgatatttgcatttatactctcactttatggttattttgacttgtcgattagctttttgatgaattaatgcgttttattgttttggtcttatcagggttcgagctccgtgggcagggggtgaattaatattttccgataaatttttgtttttcttcggtattttgtaaaatatttttaaaaatattcaattttcctgatttactcaagaaaattgaactttttaatttcaacgtttttatgggtgtttttgtctattatcgtaaaaaaataaatcaaaaaaacgttaaccggtatcgaacccataacaagaagtaatattggtgctgacaaagaggcactaaccactaaaccacaaataggtatattaataaaaacattttcataaaaattagccaagatagttttaaaaaataaaaattgtatgttttccgtcttttatcatacgaatatgccattcttagaggtgtattttcaccccgcgggggcgaaggtcgcggggctcgaaccccaggtcaataataccccttgaattttcaaatcttactccaaaaattttgactgtcactcaccgtaaaagtaatgaaatatttgaatccccggtcgttctcttccttgttaaaaacatggtcaatttttttcgttaaatcctccgttccgttcttttgtgcaacaattcgtagggttgccgaacattcgaagctccaatttccatctttggtaatcaaaattaattaatgcaattaaaattctcaattttcaccattcgttggagggacgcacaaaaggtaaatgcccaaatatttctcatttattgtttttgcaaatattttccactcaaagcccttcatttgcatggattcactgtaacggttgctcctcactttctctcgtgcaaattcagaaaatttctcaatttcaagtgtgagtaagtaatccaaattttaaatctcaaatttttttaatttataggcatttaaaatgaataaacaaaattctctattgttaacattgagaagggatttgcttgatcattggagaaacagataattttataaaaaattccaaaaataataatcgtgaaaaaatcactccatttattgtacaaatgttttattttgtaaatggtaatcaaagtaatcaacagaaaatgagcgattgggtgggcttaaccatcggccaatttccgcttttttgtccctttttcttcttccaccgtaaaatcaatggccagcgtcacattgtcctcatttttgtcgtaaaatccctcatccggatccatcaatttcttaattttcaatttattgtgattttttttcgatgagttttttaaataagttattgcgctttttatgggttttggtcgtatcatacggtgctaaatcaaaatacccttgcccaaatgatcattttttgacaaaacatttagcaaatttgaaaaaatttcttttctgccactcaccgtaaaagtaatgaaatatttgaatccccagtcgttctcttccttgttaaaagtatg

SEQ ID NO: 13604 - DNA, 2806 bp, Heterodera glycines
  misc_feature (218)..(218): n is a, c, g, or t
  misc_feature (241)..(241): n is a, c, g, or t
  misc_feature (248)..(248): n is a, c, g, or t
  misc_feature (254)..(254): n is a, c, g, or t
  misc_feature (259)..(259): n is a, c, g, or t
  misc_feature (276)..(276): n is a, c, g, or t
  misc_feature (2648)..(2648): n is a, c, g, or t
atttagtttaactattttgggattttcgtcactaaaagtcgcatccctagttataaacataagaaaattccttttatctgaaaatttataaaaatatttttattgttgaagagtatgcactttgaaaaaaaagaggagacagaaaatttggctctagtcaagtttatgcgttcaatcatcagtgactaccaggggtgtgacttgtctcagaaaagacngagagtttggcgagaggcgagangtccccnaaaaancacgngagcgagatcatgggancgcataaaaccgacccagaaccacaaaaaattcactccatttattgtaaaatgttttattttgtaaatggtaatcaaagtaatgaacagaaaatgagtgattgggtgggcttaaccatcggccaatttccgcttttttgtccctttttcttcttccaccgtaaaatcaatggccagcgtcactttgtcctcatttttgtcgtaaaatccctcatccggatccatcaatttcttaattttcaatttattgcatgattttttttcgttttgtcgatgggtttttttaaataaattattgcgttttttatggtttttggtcgtaccatacggtgctaaatcaaaatacccttgcccttgaattttattgaaaattgacataaaatgatcattttttgacaaaacatttagcaaatttgaaaaaaaattcttttctgccactcaccgtaaaagtaatgaaatatttgaatccccagtcgttctcttccttgttaaaagtatggtcatttttcgcgacaaatcctccgttccgctcttttgtgaaacaattcgataagtgatagaacatttgcaactccaatttccatctttggtaatcaaaattaattaatgcaattaaaaattctccatttttcaccattcgtcgaagggacgcactgaagataaaagcccaaacatttttgatttttttccgtttttgttcgtattgccaatattttccactcaaatcccttcatttgcacggccgcactgtaacggttgctcctcactttctctcgtgcaaattcagaaaatttctcaatttcaagtgtgagtgtgcctctatttcccacggaaatgttcaagtcaggaattcgggtttgagtgggaaatttcaacgggtaaagtcctggcacaccgcgaaaattcggatggcaatggaactgataaatgccgaacatttcttcaatgctcagaacactggatggcgcccggaaaatgcgtcagtggaaaatgcgtcagtagaaaatgcgtcagtggaaaatgcgtcagtgaatgttttattgtcataaaacaagttccttgcgttttcgggggcacttaccacgaatctggtatccatttcggccaattctgaaccccggacgcgaattcgaacaaaaactcgaaagtccaaattttcgaatttagcattttttgttcaaaaacggcataaatgatctcctattgcaggattgatgtatttcagtttgtttctgtgtatttaaaccgatttgaagaaaaacactaatttcgaaaattttgactttcgattttttgttcgagttcgggtccggcgttcggaatgcagaacgatgttcttatagaagtttatttctatattacaatacaaatgccatacaactttattttaaagtatttttatcactgacgcattttccactgaccgattttccggtcacgcactggatggaactgcaaaaaagaataattatttgctctcccttttcaaagatttcattcgaccgatgctttctgaaaaatcctccgttgagatgagagggaatcgaattttgagcagtgccgggccaagcactgatcgacgattctctgctgaacattcgatggcatcttgacggcacttttcgtcggcccaacggagtgcctaaacgaaaaaatattttaattaaatgagtatttatataaatattttgaattcaaattacagctttccaaatttcaaattccttgccgatcaccaactgatcattctcgaataattcacagagcaaattctgatcaatttgtaaaaattccttagattcgaacaattggccggcattttgacaaatgtaacgcaaactttggtgagcaaaatcctaagaatgtataatattgtaaatacacattaaagtacaataattgcttatattcagtttctcccaatttttctgattttttgaattttgagggctggaaattttttttaaaggaatcaaattgtaacaccaaatttcattaaaaatttaactttttcccatgtagcaactcaggctcagcttttgaaaatgaattccagttcttttttgctgaatttcaaaaaacttaggaactctgttaaattaagaagatggttcgtcgtatttcccacctcaaagtcgaaaagacgcgtctgaacaagggccaagaaaacattggacaaatttggaattggaatttgcatacatcgacggatcagcccccccaaaatgttgtattttctggctaaaaatattcggtgattaaaaaaggataaaaattaaaaatattttattaatttgttttcatgcatttaatcagttttgggtaattctgccgatgggttctgaaaaattttaattttcaaagtcaccgaanagggtgttcctaacaaaaggataggttacccaagtgactttggggcgttcaaacgaatatttcagggaaaggagtagggatgctcgaaaaccttggtctcaagtctcaactccagaaaagtctccgggtttttttggttctcggtttccagtttttta

SEQ ID NO: 13605 - DNA, 1697 bp, Heterodera glycines
  misc_feature (1621)..(1621): n is a, c, g, or t
aattttaattaataattaaaacctactcaaaatattctatagaaatcaatttaattttaaaagtgtttatttttaaaaaaattgagggttttcgtgccaattttgggtcttttagcattttatttttggagtctatttttgagagaacagcagacatttttgcattgtttttaatgctttcatttcaacgaattagcttaagttttctcattatgggaatatatttattattgttgttctttattatgaacaaaagtacaaacatttatgatttcttttattactaaaatgccattcgaagaaattaatttagtttgaaaaaaataagcgacaaaatttaaattatttatttgaaatatataataaataaacttaaatatggtcgaaataacctatcttttaatggacagggagggccacacaaaatattaaaaataataataatgatatgttattgtgtgaagaccagcgcatatgaataccgaaaacagaccattaaaacaagcataattataatttttaattaaccataattaatgcaattttttcatctttctcttttatcttttattttcaaacccgtgtattaataaactcctccattttgtgttcattaaaagttaaacagattattattttaattagagtcctcaagcaaaccattaatttgtagtaatattttttttgtaaacatttttccttttttgatgtaagaaaagaatggattacaattttaattttttgaaagaatcggatttaaataattgaatagaatccttaatttgaagataattcaaattccaaagtacatctgatcgctgctggcaaaaaaaataaaaaatagaaataatttgtattggctatttatcaataattatgacaagaattaaaaaatttcgacaccgtttgaatttagacactagcggcaaattggacccccgatttttgtttatatatatatatatatataaaagttaaaaaataatcgcttatatttaattaatttagcttacaataatgaagcattaatttaatactcagtcattttccagtttcgaaattagcaaattcctcggtaaaaagacgatttgtactgttttttttcctatcataagtttcaactggatttgtcatttttttaaattgactaaacatatatattggtattattggatagccgccatatttatcagcacgcaaaatttcaaaaaatttggtccaagtacaaaaaaagtgattgccagaaaattccaaaaccgacattttttattttctggccattacttttttgtaagtggggcaaatttactgagcttttaatttttatgatgatttttgtcgataatttttttttggaaaaatacagaattgtccttcgtccattctcctcacatattttttttgcattgcgccaccccaacctcattcatccatataacacataattccagcacagtcgagagaaaaaaaccctttttatgcccgaaattttccgggcctctcccccgcccccgcccctccagcgatgaaaagaatggggatttgggggatggatgaagaagccaagccgtgcctttgttaaatgcttcttcttcttatttttctgctttcattctgtgtngggacttaatccccccgccccctcccatggcgcgagccaactcagtcccacaattccgtcccccgccactccttcc

SEQ ID NO: 13606 - DNA, 3416 bp, Heterodera glycines
  misc_feature (126)..(126): n is a, c, g, or t
ggattgatcggcgtaggattattgctcacattaataaatgtgctggttgtggtacaaattatttgtacaaatattgtcctcgtcgtcgttcacccgtcgcgccacacttcgcaccatcgttcattntattgctttctgttttggcgttgttgtggtggtgtgctgggtggtagtggtgcaggttttaaccaataaattttgatttaaaaaaagttttaattccttatttttttttttaaatttattttgacaaaattttcaatttttttttcattttttaactttaaaaaatatttctaaaatgattctacgaaaaaaatataatattatttaatttattttgagtttaattttgtaaaatttaaatcgcttggattttttaaaaattaattttacagaattattcatgactttttatcttttttttttaaaattgacattttttgctcaacaaattccgtcccatattgcatatcaataaatggttccacaaataatcacttttccccattcaaatcaatcaaccggaaagtgagaagccccataaatttaaaccacaagcaatttagcagtcgcatttcaatgccaaattaatttttttttttttttaagatttctcgcatcataaatttagttttcaaaaaatatttattttagccctccttctgtccaatatttcaacaatcaattaatttaagtattacgaaaaatttttctcatatgaaatataattaatttaaattgcttttattaataacaattaatttttatgccaaattttgaattttgtcatttgcatttatatgccttcataattttcttttttgagcacctttctttctttgaaataataacagagacaaaaacaattatcaaaaaaatcacataattcaaaaaattaagcaaatttccttttccatctgtttaatgttgaaattccaagtcccaatttcttggcaattatttcgttgttgattttaggatttctttcttttatttccaaatattgtttgacctttctcaatttgtcctcattggaatatttattttgtgcttaaaatttaaaaacttataataaaacccagaaagttcacttacttttatggtactttggcgctaattcttttttccattttcgaaatgtcttttcaccaatgcccaattccttcacaaattctttctgtttgccttggccatataaacttttaaattcatcaaatcgttcaatgaattctttctttttttcctcataaaaattcattttcattttattaattttctttttatttaaatttaattcttttttccatttatatattttgtggcgatttgtgcctaataattttgcaattttccactcaattttatttcttttttcattttcatattttcctttttcttttaacttttctttaattgcatcaaatttctgaatggtttctcttttttgttgatcatttggacaatttccatttttccacccatttgatcaactgttgctgagttttcattttgctcgttttgatcattttgttccttttttataacattttcttcacttttatttttgtcccatctgtcgccaaatatttcgtcaaaattttgtcgaattttgccggatttaatttcgtaaaataagcaaaatataataaatattaaaagccacaaatttatttttgccattttgaattatatgtaaggaaaaataaatttacatgtgaattatttctttcattaatttgataattaaatagaatatattaaattgtaataaataatgttttttgtagttaatgcccaaaattttcatttttgaaaaattttccaaaaaacaattcttcgcaaatcttttttttttttgccttggattataattataaaaaattttgcaattttttttctcaattttggtgtgattttccattgatattataaggccgggaccggaaatggcctttcccccgcccatttatcactccgatagcgcttaaacggcagtgtgaggatcagtgtcgggagtcacttcagtggaacggccaatcgatccccgcctaggaggtacccccagagatccattcatcatcccttcccttccaagccctgaggggcctaattacggacgcgtaagagagtcccctggactaaattacctcattagcactggtagtagggcctaacggctttattatatttacccttttcattcaacttttctttaattattttgattagaattaaaaaattttagttgaaaaacaatatttgagaatttgttaaatcattgtccaacattaccgacaaacagtaaaggcctaataaaacaaaaccggttaaaaataaaaaaaatatggaaaatttgtaaaaagctttacttcctcaattaaatcaaaaaacaaacaaaattatatataaaaaaaacttttatcatcggcaatggattatgaaaaacgaaaaattgcaaaattcccaaaaatatgccagtttatcagtaacgatttggaggagttggaagaacgataacagcattttgctgaggatacacatgatttagatggaaaatctttttgatcgacacaaaaattcttccagcaattttcgtcggaccgaaaatatttttgataattttacggcaatcatttcgaattgttttgttcagcaaaaggaaaacgattgatggagccccttaaattttttaaaaatttatttaattaatttcatttaatgataaattaccgtgaacgctgagccttaattgaaaaaaagaaattactaattatatttaattaaaattattaaccaatcaaaatgggtaaaagtgatcatccattggttgagctccattacttgcataagcacatagatgaaactggccaatgaattcatagaagataaaatgaacacttggagaaatgcctaattgataaaatatatttaaaattaaatctttttcaaaaaaataaatttatataaatttttgaaccattttcttggcttgtgaaatgtgtgcttggtggtagcactgtttgtgccaaaatgcgaatgtaaacagcaaatagattgatggcaccgaaatcgcgatgatcacattgtgaatgaggtggagtaggacaaaatactgtaaaataaattttaaaaaaaacttggattgcgatttgaatatcctgattattcttgagatcagcattggtttcaattgcatttgtaaaaataggcaaaatctttatctttatgtcaattaatttatccctctgtagaaagtaagaagttttttaatttaggacaatgaagtcttttctggaattacagattatattttagatatgttttgtcattatgaaattttacagtttttgatatctaaggtatcccaaattggtatagctcggctttgtattttcttcagctttgattaatca

SEQ ID NO: 13607 - DNA, 3198 bp, Heterodera glycines
atgggtccgtatcgttatggcatcaacccaagtgtttgggttataactttttttgttgctagcctaatccagcaatcttggtatcaatcgaaagcttaacatgtttagaagatatttctaagctattgcttcgcgattagacaattaccaaaaaagttataacatgaaattccaaaaaagtcgaaatttttgagtttttttcttaataacttttttagaagctaaaatttttgtttgttttttgtaaggctaatagagcttgtgaagggctttcgaaagataccaagattgttagatttggtcaacaagaaaaaaagttataataaaaaaactgaggctggcgccaaaacgtcggcgccaaaacgacccagtcccaaataagtttgttttttttgttcagtaaaacagaatgccaaatttgtaaaatttaaaaaatcccatgggattttcccttgtaagaacacaaaagccgacctcgagttaaaaacataactttcaaaaaataaacagggattcgatagaggtggtctaaatatagaactgagcaaaattttaagaaatttcaaaagctaaatttatttgtcagccagattcaaacctctttcacgacctcaatattttttatttgcttcttttatttatttttatctccggaataccaaggcaaagaccaaatgccggtggtgaatgtgtactcgacttcggtgaccagcgacaacatttcgcgcaacgaccttttgtcatgggtcaacgactgtctccaagtgagaaacattggcatttgaaatgcgacggcaaattcgaattgagaggcctccgtttgccatttcagtccagcctgaccaaaatcgaagagatggcctcgggcgcggcctattgccaactgacggactttctcttcccgacccaagtgccgctcaaaaaagtgaaatggaccagccgatcggacgtggattgggtgcccaattggcgcgtgttgcagcaatcgtggaaacccatcggaattgccaaagtttgaatcaaaatgcaacaaatttggagttaatttgcaggggaggaccaattcatttgggaagttggaaaattggggtgaggggatgcctaaacgaataaaagaattcaaacggatgtcaaatcccattgcatttcagcctgtgcccgtgcagagtcttatccgggccaagtttcaggacaactttgagtttttgcaatggtcagtctcgttcccattcattcgatcgttccttttccctttaggttcaaaaagttcttcgacgcaaattacgatggtcataaatacgactctttggcggcacggaatttcgaagtccgttttgagggatttgggctcaaatgctttaaaatcacttttccattgtcacttcacacacaaagatgggtctcggaaatatattttttatccctaaaatccgtaccattttttcttcccatgtccatcccccctttttttcattcattcatttccaatttcttaggagtttcccgccgctttgcctggtggtagtaaacagcgtgcgcctccgcccattgcgtctgccgttgcggcgcgtcgcgctccgtcgatgtccgccacaaacactgcgcaaaaatacggcggctccgctttgccggcaccttctcagagccgtgcccaaactgccaccaaaggttttttaatttggagataggaaatgatgtcaaataactttttaccccacattacagcagccaaaccgcctgctgctcaacctctcgtcggaccgtcgcccgccgctccgcgccgtgccagcccccgctttatgggctcctcccagcgcccgccctccgccgtgggacgtcatccaccgcaacaaacaaacggcggtagaacgggtggaagcaccggcggaaggccaaaaacggcgagtgcatttgccagcaaagcgacaccgaaggcggcgtcgacggcgacggaagtgaacaatttgaaacagcaagtccaaacactggagacacaggtaagaaacgggggagtacaacgctttgtaaatcttaccatcgtttaatttgcttttagaattccgaagtcactgctaatctggcgattgagcgcgaacgtgcgcagctgatggaacgcgagcggaacttttatttcgacaaattgcgcagcattgaaatcctttgcggcgcctgcgcactgtccgacggcgaataatgtcgccaagatgcgttcaagaatcagaacatggggcacaaaattacgggcgtaaatgccgatgaaatacatttttaaaagtgccgggaaaaattgcatagattcggcaccaattgggtcccaaaggaagaatttgaaaagacaaatgacaaaacgacaggaaccacgcttaaatttagaataataatcatttcttgtttttatttaaatactttgatttaatggaatttaatttaccaagataataaagagactctggaagatgagaatggctttcatgttcgggtggatgaccgatgtgcgtgccaccaaaatcaaattggcaatggacaacggaatgccaacaaaatttatcaacagttcaatggcaccgccgaggaaaaaaagaaacagctcagtgtcagttggtgtcgttgtgttcatgtttttgtgttagcatacgttgattatttcaaaatttaaaaataaattaaaattacgtttttaatcaactgatatatagaaattataataagtcaaaccaaattatgggggaacagaaaaatcattcaaaatttacacaaatttccccattattaaatacaaatttacaggcatgcttatgtaaaaaatcacccgccaatgtcagttggtgccgttgtaaccgaagctcttcttaaaagtaaaagagaattaaaaaaaggtaaaccaaaagggttaatttttgttcattttctcatgttagcaataacttgatttagggatgcaatttttaggttttcgcctatttttttcctgagctgctaatggcctaaaacgcatgaaaaccatgtttttttggtgcttgttaagcgaattttcggattggcgagaatttttatcgcaccctgtatataaaccttagctaaaaaatattgcctacaaatatatgaaaagcattaaaaaagatacattattaattttagactaaaagaagggaagatggtagaattacaaaatttgcattatgactagggttttaataa

SEQ ID NO: 13608 - DNA, 4769 bp, Heterodera glycines
  misc_feature (2800)..(2800): n is a, c, g, or t
  misc_feature (4718)..(4718): n is a, c, g, or t
  misc_feature (4729)..(4729): n is a, c, g, or t
cctttcatttcatggtgacaaacgacagacaccactcccctccccttccccccctttccatcatcggcttttctgtctgtttaccattagcggtgccaagccaatattaattaacactcatgcaatattattaaaatgcccttcttttatatttttgcgaccgcactctgacaaagtgttcccgataccaataaataaacccaaatgttgatcagatgccttctgccgatgtcgccggcccaattccgttgcgccgcgtgtcgcatgcatttgaccagcagcacagccaccaccaaagtgtaaaaactttgagcgcacctcccggctaccaccaccaacagcaacaaatcactggtaaaataacattgaaattccagtgttgaaatttatttttattatttttttggtgcaggtgttttcaatcagtcgttgaatgctacggcgcccactgccgcagttgtgtcacacaacacggactcgtccgactgcgggtccagctccggactgggcggaatgggcacaccgatcaaaggggaagagggtcagttggtgctggtggcatgtttcctgggactgtttgtgagtgtctgtctcctcggatttagtgtctcgaatcttggaaaatggctcgagtagcaataaagtttcacaaacagtgtctgattgattatctaaatacaactgttttaataggtccttttaatttcgcctctctttgctcaggttgttccgcttcctgctcaacttcgtccaacaattcaatggccgccgattgtccgttggattcgcatgaccgcggcagcggtggccaaatcccagagaaattggttggtacagaaggcgtcggcagagagcacacatcggtggccaatggccatcgttcgttgttggccagcgcgacactgaccccggcgatggtttcgtcgtcgcaccattccgccacaaattcgccggtccgtcgtttagccgttctttgaccaaagacggagttagcaatttccaacagacatatgtacctattaacagttcaatcaaaatattttcctatgtaatttttcactgttttctaaaagaatttgcttttcttttaaggtgtccgccaatttgatgcccatttttcaccattcggccgccccacaacagcaaatgcttcaacaacatcagtcattcaacgcctttgtcccaccaattccgctgcttaacactcatcagccaaatgcttctcaaattagtaaaccatgattacctttcaacgatattaatcactggaatattaaactctcacttttcttggcatttaaaattttttctttttctaaccttggctattcaattccataaaatttggcatggcattggtcatttcatttggcaattcccaacagattcgttgcactgttctctttccgatggtccgtctccgctgatggcgccacctttgcaaccgccgaccgttggcgtccttccttacgcagcggtggctgctgcgtccaactccgtcaggcctttctccgctgcgtcgactgtcgccgcttccgttggcggcggtgcgctcccttcgcccgctgcgctggcgtcaaagaccggcctaaaacaactgcagcattcgcctccaccgctgtgcggacgtgcgctttacacaatgacatgttcgtcactattgctttttctttgccacccacacgttccaaaaattgaaaaaagagctttgacattttatgctgttaatatttatcagaatattttttggaatgccaattggagggggagggaggcgatgagcgagcgaagcggtggttccgttccccatttttacaattgcttttctactttttttgtttgtcattgaaaaaagaggaactttctgtaaatgacttttttagatttgtttttcttttcccattgttttttgttccccttttcaacaggtgaaaccaacgcactcgcctcggtcagtgcggctgctctcaccgccggttaccacgtcactttggatccctcggcttcggcgcccccaatcatcgcaacagtggcgacgaaagcttccgtcggtgccgaatttcagcaggtggcggtgccaacgagcagaaacgacggtcaaactgagcaacaacaggagaacaacgatggtaaggatggaaatgaaaatattttatcaaatttaattcgattgattggtaaatgggtctttttcctcttcgtatgtccaaactccaaaaccgagaaaggaaattattaaacaaaatatttcaaatcaatattgaaatgaatttgtttttcccagcgtcgtctcgtgaacaaaaagataaaaacgatggaggcggcacaacaacaaacaacaacggttcttccggaagcgatcaactgaccggaaatgacccagcaaatgccggggacgcaacagctaatttgcccccgggcgttcctcccgaaatcgctgcggcaataagtggtggcaacgatctctttgtaagtgagggaaaacagcggctaaagtgtttttcaggacagccaattcaccccatttcaatttactctttttgcaggttcacattcaccttggagatgccattgccctggcggtgggcaatgatgttcagcacatccacgggccggcaacgatcagaatggtctcccaatcgacgacgccgcaatcggcgattccgatgaatgttccggaaggacatattgtacagcagattttggatagacaggtgaatgacttcattttcaagtaaataatgactcttttgcatcaattttttccctgcagggcaatctgtcccacattatcatgtcncaagagccccccgccggcgttgggccaatgctcggccaacatgtcattaccgcaacgacagtaatgtcccaaattccgtccgctccatcgacgacggcggcacagcagcgacaaatgggttaccaagtgaggagggcgtcaatgaatttgccaatgacaatttccagtctgttcagctccatccttcggctgccaccgtaccactaaaacatttccgttccaacaattcgccaccgcgttcgacagatgtttcgccgctgaacgatgcggtgactttgtcacggcagaagcaacaccagggaatggccacggattcgggcgctgtttacccaagcggagttgttccattactcaaatggagtgatcttcaacagcaccaccaacagcaacgcgagcactaccaaagccaaagtggaccattcggaaggcagcatcaacagggtcgagggcaccataccgtgccttccccgttcaacgtatacaatttggctgattcggaaaccgtctcttcggccccgcggcattcgcccggtttttatgtgcatggctcgacaactatgggcgggatggacaatgtacgttttttaaaatttttttccctttatttaccatttgaattcattttcagcgtgttggtccttcggaaacccttccaactgttgcatatcaccaaaaccaccagcaacaacactcccaacatcaacattctgctcccggtggtgccgacactttcgattcggtcaatttcccaacacaaatttcgtcagtgattgatgatgatgagaaggaacggctcagagacactctttcctccattcagccaccgattctctcaaaaggtgtgaatattcagatgaattttcttaactaataattttgtacgaatttcagtgactgaccgtgatgccgaagtgatatggcaagtaatcgacacttctgaggctgctgcttccggtggtccgttcccgcaaattgacacctccgaattcgtctacaaattgactctgtttgaccctgtcaaacattcacaaacattccacaaaaccgaggcgggagtgaatgtgttgcatttgcagcaattgaatcccggcactgaatatatggtggggttggcttggctgcgcttcgcttcgtttttcaattttcttttctttttaggtcgctgttcgtgccgaattgcccgaacgcggcatcaacggacacccttcgacctttacttcctttcgcactttgtccacttctcccgaaacgccttcgctgccaaaattggtcggccgacaacagaattgtttttcaattcagtggaagtcacccaattgcaacggagcgccaattctcagttactgtcttcaaatggctaaggttgaaaaagcaatttccaagcagcacatggagtctgaacgattcagggaaagatggcctcatttgagacggtttacgacggtgcccacgagcaaacggtggtctccgggatggacagtggcgcgttgtatcgtttccgtgtgttcgcgcgcaacgaaatgggccaatctgagagttcgcccgttctgacggtgtaccccgagaggagtgacactggcggacgaatgccgccagcctatcaccaccaccatgttcagcaccattaccatgctcaacaacaacaacagcatggcggaatagtacaacgtggcggtaagcacaaagaacggcgaggggtgggagacggatgcaaaaacaaagcaattcagctgcgtctgttgtgggctcctcttccgttccgtcttcggctgctttgccctctcaccatcaccatggacacaatcaaccaattcgcccccctcactcgcccaatgtttattcaaccgcagcacgggccatcaaattgtcgtggaacccgttgagtggggcggacttcacatcccttgcagtgaatatntggaatctttngcattcatatttttaattaaatttgtttaaaaattttagc

SEQ ID NO: 13609 - DNA, 1986 bp, Heterodera glycines
taagcactattattcgattgtttggatagattctcttttaaaaattcttaaattcattgacaaaaaaagtgaaaaatttttaattttttttaagatttcaccaaattttttatgtcactttttaaaaaatgctttttttaaattttcattcaagatttaacccccaaaacattgttcaattaaaaaaaatgctcattatgttcaggcccatgtcgagaattggtccgcctttgcgcccgacttctccgagttggaggagaactccaaatacgtggagaaggagggcgaatttgatgcgcatgacgaggacgcaagtgagggggacgagaagatggaaattgcggcggtgtgttttgtcattttaatgaaattttagtttttttcttttttttactgtaatctaacgttttaatccaaaggttaacaccgtcttttttgctttttttaaaaatcattaagagagttttttggaaaattacaaaatttattagagaaagatggaagtcgaaactctcataaaaattaaaaaaaaaatttttttttgattatttgtaaattttcaaaaattttcgctcatgtttctaacaaaaaataatatagaaaattaaaaaaaaaaattttttttgttccaaaaatgtggtcatctacactaatatattattaatccacgagtttttcgtaaaaaaaatttaaaatttgtttaaaaaaatacaccaaaaattttccgaagcacctcaacaatcagttaaatgataagaaattttaaaaatacaaaaaaaaatttgccaaaaattatcccgcaggacgaggaggaggacgtgttggacgtggtgcacatcacggtgtccgtccaactttgctcgtccgacgaatcggagccggaagacttttgcaccgacttggaggtgggcaggtcgctgtggtttgtgccggtcggccctgagttggaagtcgctgacgaaggtgggcctttgtgtttgtttgttttttcgagtttttatagcatttagtgctctcgattataattagggggccgttgggcgaaaaaaccacaaattagatgggtcgaattgaggcaaaaaaaaaaaaatcaaattgactcacactggaacttttcgaattgtaaatgtcaaaatcaattttcgatttgctattgtaaaattttcggcttttttgtctctggcccacaaactgatcagaaaaattcgataaaatgaaaaatactaataaaaaatacgttaatttatttgcgatttttcctcttacattttaatgcccatttggtcatggggttcgagccagctcgacagatggtgaattatttttgaatttcttaaaatattatttcagttgactttttttttattcagatcacttttttattcaatttggtgtgtgagtcagggccaaacagccgaattttttgtttaaaagtgatttcaacactttctgttcgaaatgttcctttgtaaagtgaatgacatggcattttttggcatttcatcctccctcatataatggccgttaataaacagcaagcaccctagtaatttaggatttaattaattatccatatagaattgtgccaggagctcagcagaccaaactcccaagctgcgaaaggacggagtggcggtggcggtggttcatcacaaaaatcgcaccgaaatcgaagatccaaatgaatgatgacacttttttcttttgcttttttttatcattttattaatccactgacccttttttaaattttattattgtattgttttattacccaaatgacccttttttttatacattttatcatatttatttttattgtccacaaaatatgccaaaaaaatgcgttgaagattaactcttatatcgcttttgttgtcattagagcccggtaaaaaaatttttccgggaacgggaaaacgaaaaagaacggggcgggattcccgccttttttcccgttcccgtaaaaatcctgtcagcgaaaaa

SEQ ID NO: 13610 - DNA, 3248 bp, Heterodera glycines
  misc_feature (3204)..(3204): n is a, c, g, or t
tttttgattatttttctaaagaaattttttttctatttgtactatcttgacacagggtgtccttggaaagaaggactccaaaaaacaaactaaggacagacaattgtcaagcaaattaatttttttaaataaataatcaatttttgccgccgtcacttttattattatataaaactgagtaataatataattaaaataataataattataataataaatgaaacagaatgaagtgtaagaaatgaaggaaaatataggtaaaataaaaataagaaaatccgaattaaagttcaacaataaaaataattaaaaataaaacaatacggaagcacaaaaattgcaaatgaactgtaaatataaaaaaatcaaaatgataaaaataatataataactcaatcaaaattgatactaaaacaattttaaaaaaattaataagaaagcgcaaaagcatttcactatgaacttaaaaattaaaaaaaatcaaaatgattatgcacagattgacgacattttttgttgtcacatcttctgtttggcattcgtcttcaattattttttaattattttttcgttgttttgttgttatttttttgaattaataagcaatttcaaatataagaaaaaaaaggaatattaaggaatatttttacaaattttttaccccagtcgtccccctcccgggctttcgcacctagaaattttttttataagaaaatttaaaaaaaaaattgttaatttacagcagtttttttggaatcttttttgaaatacaataattcatcataaagtttttaaaaaaatcgctgaaaaaattttaaaaaattattttttttcttgtaattttcttaaaaaaatttgtttataaatattttacttatgtatgtaaaatgtagcaacagccttctcctttttaatcatggctattctgaagaaaggtatttttttaattttaattcaaaacacaaaaatacgttctgctgctgggcgcacttttactcatggtcactagttgaaacaaatccatctattttattcataaatatgattttaaattaagttttaaaatattttacgtttagccaacatttccattaatccatagcccaggctttacagcagttattgtctccaaaagtgccttcatataaatgccaaagcatgcgcatcccttctcccattcactttgcttttgctgacaacatttgaattcgtatggatgctaaattaaatatttaaaataaatatttttatttaaactggcttttcctttgtacgcttgaccttatccacaacacatcccacgcgtaggcaggcatttttcacagtattttgccgttgctcatgttgatgccagcagatgacggcgaccagttcccccatccgcatttgcatattttttccggcaaacatcgttcaatctaggcacattaaatagggaaatgatacaaacaaatatttatataatatttaactctccctaattccatatatatttttgtacctttttgacaacagacatatgaatatgtaattgtcaaaattaaattaataaaagctttttataaaggagtttttaaaattagcgaggttcgtggaattttaaatttgtatgcccaaatttattttttaattggtttatttggtcccaaattgtatcaattaatttaaaattgcaaattaataagttacgaaacggatcatttttactatttttctgcatcttttttcatcaatgagaaatgaacgatgaaaaacaatgtttagcccgaaaattcttaatttgaatgtcactctatttgtaatttgaaaatacaccatttcggactttttatcactaaaataattgtgccatctctaaaaatgccattctctgtcaataataagatcttaacatttgattggaataaattaaacggactttaattgaaatttgaattggattaccctccaagaatgcttgctcaagggagtttctccttttcggttgtgccaacaaaaagaatcagcaggatttgttgcctttcaaagacattggttatgtgtaataaataaataaataaaaaactttacactgaaactgttgaagtttttgacatctgccgatgatcaattcatcatttgtcagtgccattgttttttcctctttcaattgggcgaaaatgtcaaaaaattgtgatggaatgcattgtcagccaaaataattccgttttaaaagctccatgtgttcaacaaaccatcggctaaaaagacagacaaattttacaaaaatattattcattttatttctttaatctaaattacccgcttttatgagctaatttgtaatgcatcacggagccagcaaaaggcttgaggccaatacgagcaaacaaacacttaacaaaaaatacgatttttaattggattatctttaaatatttgtacaataaaatatttattttgccaaatgatccaattaaatgaataaatgaatgaattaatgaatgaaaattggtgagatggaattgtggatgtgatggaagtgttataattcagttggaccaatcacattgctaatcattgcttacgtggccattttatgggcggtagacggaaaataaatccggtggaaaattgatgacaaattgtatacaaaaagcagggggaaaagccaccaacagcagagaaagtcaaccaaaaagataatattttatagaagagatatcatcagacactgatttgatagccaacaaatatttgttggcaaatgcatcaaaaattgaaaaaaatagagaaattattgaaaacaatttataaatttaaatatgaatttccaaaaatggcgaaaattaaaaatatgatagtgaaaacggaattcgaaacccatgcctgcttaaatttcacgaaaaaatgcttttttttatttgaaatgaaattattattattattattattagattaaattatttattttatttagtaaaataaaattgctaaaaagcaattagctccaataaatgaaggaaatgaaaattagtcaatataaaatttcaattgatttttttaataaaataagaaattaaacggcaattagctgcaataaatgacgcaaatggcattataaattatgtggcattgattttcactgcgcgcttgaaaatattgctcatttaaaaactccccataaatttgcattatatcaaacaaaattttattttttacaanagataattgttaaaaccctataatttaagttgtattaattcata

SEQ ID NO: 13611 - DNA, 1926 bp, Heterodera glycines
gatcaaagatatttggccacaattcaacccagattccattagtgtggattttgagcacagcattcatttggcaatctgcaaatttgctgacaccaagattagatgctgttttttcacctcatacaaaacttacgcaaacatttgtcttcagcacatcttttaggtcgttacaataccgatgcaaattttgcacttcattctcgaatgattactgcgattgcattcattccggaagaggatataattcggtccttacaggaactcgaagatcatactcttgatcattatccggaacttgcgcctatttttgaatggtttactaacacttatgttggaagaggaacaagggcacccccaaaattttcctatgatatgtgaactgtttttcagcgtactttggaaggcagcgaccgtaccaacaactataccgaagcttgcaatcgaaattgaaaatcggatttggctatgctcacccacatatttggcgttttattgacgatttaagaaaaattcagaaaggtttagatcagattatgaagaatatgttagaggtcaggaaggtccatcaaaaaggccaaggtacaaggaaccgatgagcgaatactgagaaaagtgcaaaattatgaagtcggcaatgttttggagtagggttgcaaccccgaccccgccccgaccctgaaccccgacatttttggccattttcggggaaaaccccgaccccgaaccccgacgcttcataccccgacaaccccgaaccccgacccttaaccccgatcggggtcggggttaaatatatacccctaagaatggcattttcgtgggagaaaatgcaaaaaagttagacgaaatttgaattttttttaaccatttgccaaatttttattaaataaagaagatttgctcaatttcggacatttggaatgtggtgtagaggttagtgccattgacattactttctgtcgtgagttcgataccgtttgacgttttcttctttaattattttctttgtgacaaattgttttttttaaattaaatactcatagaaatcgaccaatcttggcatattttgacaaaatacatatcgaagaaaaacaaaaatttaccgaaattcataaatttttttggtgaaaaatcttagaaaatagagcttaattccaaaatttagcgctgcctatcggcatcatacttattaaaaaaattggctcaaaatcgcaaaaatttagcatattttggacaaaatctgttaacagatctaaccaaattttcaaaattttcccggcggcgcctatcggcaccgccggacgccgtaccctttctccttaagtctttagaaaagagcgatgtgaaaaaagatgttttggaaaacaaaaaagtaataaaaaattttaaaatttcaagaaaaaaaaattaattctataaaaaatttctgataaaaagaaataaaaaatatataaaaacaatacaaatattattatggaaattaataaatattatttccgaaaaaatattaaaaaaattttgactatttggcataaggcaaaaaattgaaaaaccccgaccccgaccccgaaccccgaacgatttggcaaccccgaccccgaaccccgacacttccaaccccgacaaccccgaaccccgaattttccaaccccgacgtcggggttgcaaccctattctggagtttaaccaggtctcattgatcagaattatagtggggtcatatttgtttgactatgtattctaagacagatattttatttgctattgatcgggcatgtattaaaaggcaagaaatccagggattattttctaccatttttccaatttttttgtttggtttgctcgcgtagtccctacagagatctgagtgtgcggtactctctcagagatctgatctccaagacaaacacaagatacttatactca

SEQ ID NO: 13612 - DNA, 1567 bp, Heterodera glycines
  misc_feature (1549)..(1550): n is a, c, g, or t
acaaaatacttatactcacctgcggcaatattggcctgatatgcttgttgccggagggagtataatattttagctcgctttgagtcatatctctgcgaactttgatgtgttggggcacattgggcaattttttcacagcattacggaaattataaatgaatttatcgcgcgaatatttgtccgtaaatggcacttttaaaattcggtccctttttacccctccatcagtccgcgtccttgggtggcgatgaatgtccgacgacagtttgtccttgaccccgcattcatcggcaatttgctccaccaatgcccgttcgtcgattgcctccggcaatttttcaatgactgcccggttcgccttctccttaagctgctcggagttgatgattgcgtcggttatcatacgcgaaacagcgccattcccagcgaagggcggcggttgaccccattggagttgagggccgttgttggaagtgtgtgccgatggtgaggatgagatatgctgggggtcagcaaatcgattcccataccgattctcacccgcaattagccgttccaccaacttttctaacttttctagtcgttcgatgactgggaccaatgtggggttccctgacccttctaacatcttttcaagtcggtcgagacgggcgagaatgtcctccccctcatttaaatttggggaattttgccgtcgttttttggtcatttagtttgggaatgaaatatttggaggatgaaatatttggagaatgaaatatttggagaatgaaatatttggagaatgaaatatttggagaatgaaatatttggagaatgaaatatttggagaatgaaatatttggagaatgaaatatttggagaatgaaatatttggagaatgaaacatttttgcctaattggcattgtgtaaattttttttgagaaaatggagaaggatccggcggtaccgatatgcgccgtcaaaaaagtttttttttaatgtgatttgttaattaaataaataagtagtttattctctgcaaaaattttatacaaaacgaaaaataaacgcttaataaagtttttttaaatttgcttagttatttttatggttttgaaaattgcaaaacaaaatatgattctgataaatgccactataaagaaaaaaaatttcaatattaataagacttcgtttttagacacaaaaagccaaaaaagtcctcttcgggtcggacaaaaaatctgggtcgagaaaaatgccgagtttcgtgtttcgggtggtccggtaacaaacctggtgtagatcactcttttgtaaccgacttttaatggaataatgtgtaagaaataaaatttgaaaaacaaatccaagagaaaaaatggcaattaaacttgtcacaaaggtacttagatcatacaaatggtaatgagaaaaatataaaaaattttaatctatttaaaaattgaaaagttttattgtatttaaatagcattagaaatgatagatttattgcatttactatgatttatgcagagaacagataagatgtgctaaaaagtgtcaaanntatgtacatatcagggg

SEQ ID NO: 13613 - DNA, 2603 bp, Heterodera glycines
tgcaggtctgattaaacattattaaaaatgacagagctcttaaaaaaattttaaaaaattccaaaaataaaaaatgataaattggtaaatttttgctgttcacatttttatgaaactcttgctatttgtcggcgaatagcagcagagcgcaagaatgtcaaaaacgggcagcgaagggcgactgacgtcatagataaaaaaaaataaataaaaatttacaaaaataaaacgggttaaaatgatgacgcaaaaaggaaaaataaattcaaatttagttaaaatgtcaaatacttatattttattttatttttgcatcaaaattcgtatttttgatttgatggacttttggccctaacacatagattaggccgacaattgtaagcttaattttacaatccgatttaaaaccgtttagcgatttcaataatgacgaaactaacatttccgagatttattggccaatgccaaatacaaaaaatgatgccttatccatgaatgtttggattttaaaataatttttatgtccataaatctattgggaataagccaaaaattcgaaatttgcgcaatccattgctattactttgttgcttaatgggattaatcagccgccgctgaattgaatgactgatgacgaacaaattagcgcttttgcttaggcgctttttggctttaagcacagcaccgccgcacccttttgcggtaatcatttgcgcatttggctgcagccacctgccgctgcccaccgtccgtaattacttctgctgctgtcactgtcgctgtcctcgacttaattaccctcaattttgctaggccggctaattactgtgtgtgagtgtgttgtgtatttgatgtttgtccccgtcaaggtttgttgcacacgccgccgcgcacatagtccacaaaacagttaccattgtgtgtccccgcgccatggcacaccgtcgcccccaaaatcggtcatcagccactgcggacggaatcgtcggcgggggacggaaactcgagaaatccaatttttggaatttcaaatgatctttgatctctcccactccgaaaatttttaccgtacacactcatactgaacaatttcgagaacgaggacccgagaatttgattttgcagagatttgagtcttacataatatgcttacactattgtgcataaaattcgtcgaaatttcgagttttcaactccgggacggggggaggggttggttctcttttgacacgtaaatgtggttcatacatataggctttcaaattatgccagatttgctaatgtgaattagcaaagaaaaaagttatggcaaatcaaagttggcggcgccgaaacggtaggcgccgaattgaccacgactcataaacctagcttatggcgatgttagcctctttagccaagcgattaaaaatgttccaattgcgtaccatttaagttctgtccctgatggtaccgttaaattaaaggtcagtcggtgccagcagcgcaatttgaaattcacggttctccgcggacggcgggtgatttacgcaattttaggaaattgcccagcgcaattgggcagtatcgcgcgcaacaatgggatacataaaaactgagtgactgagtgaccactcagttttggaagtaaattgtggggcaataaaatttgaaattaaaattaagttgatcgctacggccaagtgagagagtcccgccggaaacgcggggggaattaaaagccagtttataaaattaatttaaatcctgtattgatcgggatagactcattcattaatcttccataagttcaaatgagtttttaaaggaatggtttggattttgtttgcctcacaacagatctgcgattaatgatcattttagaaaataacaaaggctctggtcgcagatttttccgatactctgatcagcagaagccattcgattatcgtaatcagatcaactcattagaataatgatcatacatgaattaagttttcgatgtcctaatcgcttactaacaaattctacattttagatacgctaaatgttacaatttgattgggactttttggccacgacatcgcttttaaaattggtaaaatatttataataaagtggggtcgattttagggtgatggtggaggagggaggcacaaaagagaagagcggggtggaaacaacaaataaacagaataaatgggattttgcggggtccccgcctccccccggggggatgatggggccgtgaagagggcgaggaaatgggcgagaactgcgaccgacgaaggaatgaataataatgggggaatgttgggggggggggggaataatatgcataaaaatgtcggaaattttgctggtgaggtgctctgcctgtcctccaaacaacagtgaaatgtggagcgcaaaatgggggaaaacggtcaaatgatctttgcgggttggggcggaagactcattttggagagtgatcagaagagggaagggagacgggggaggaaaagcacattgtttccggcaagtttgatcgaacgagtcgagttggccaaaaaaggagtttagctcgtctggatatcggatttcgggaataacattctttattcatcagtcagtgatcacag

SEQ ID NO: 13614 - DNA, 1003 bp, Heterodera glycines
  misc_feature (934)..(934): n is a, c, g, or t
cagtcagtgatcacagaaaaaaaatggggactgatacgctgttttactaaaatcagacatattctgatcagcgatttaatggaagaaagagcaaagaaagtctaattaaggtttttgaagctgaactttaaccagcacaatcttaaagtgctcagcttcattagttgcttctcagatcagaaaggaaggcaaatttgaataaacttattatcttggatatcggatttcgggaatcacatcttttattcctcagtcagtgatcagtgaaaaaaatggggactgatacgctgttttactaatatcagcataatcatcaagtgttcactcagcttcattagttaagagaaaattgaataaagaattggaattggacaatcaaggcttgcttaaaagaaaattaggataaataaaaaaaaaattttttttcggaattgatgcaattaattttttgctaaaaattgatcagtctttcaaagtgaacaacagttcacattccaatcagtgtgttaagctgtgttgtttctctctcagcttttgcataataaaatctttagcaattttttttttgaaaatttattttttcgctgatgcaacccagacaatctttctcttttttttgcttgcaaatcccctactgacacagattttgggggcggattagaagctgcttgaccccccccccccctccccgcttaaacttcttcaacaagaatccaaagcgtttgagaagcgcactgcacacacatttatcggacaaaatctctacgggacgcacggcgaaaagcatttggggaaagtgaagaaaaaggttcacaagaaaatatattttatatttaaagagatcgaaaataaatggttaaatagtaaaataaagtaaacgtaataaaaaagatattttaaaacttgggtttgatttattgaatatttttcatantttaaattaaattattaaaaaataataataaataataaaattaaaaaatattttgaattttattaaaaa

SEQ ID NO: 13615 - DNA, 3592 bp, Heterodera glycines
  misc_feature (3478)..(3478): n is a, c, g, or t
  misc_feature (3491)..(3491): n is a, c, g, or t
  misc_feature (3525)..(3525): n is a, c, g, or t
  misc_feature (3559)..(3559): n is a, c, g, or t
aatttatttatattaaaatgtaaatttatttagcatacctttaaaattaataaattgtggaaattcaatatttttgaaattttctaaaaaacgctctttaaactaagttttggagtttttaaagtcaattctgaatttatacacaatttttggcattttttgagggttaaaaaccatttttggcagttttttaaggcatattttagtgcatatttgagcatttttcgggtttttagggcatatttgggggatttttagtgcatattttatgcgcatatttggagttttttagtgcatacaacttataaccctagttatgaattttgagaaaacaaaaaatatgattgaatgaatcgataatttaaattccaacaaattttattaagggaaattttttttcaaattttttttgcatttagttcattttatcgcgaaatatgaaaacccaaaacagtgaattcaaatggcagccgatttgcacattatcaatcagactttttcaatcaaaaagtcaaatttgaaagttgggccaaaattggcctcaatttcgtcgccagggttgagaaaagaaaccgctggttggaggccgtcaattgagtcgacaaagaaagtgggagagcctaaattcattcattaattaacccaaatgattttataattaattaattaaagtttaatgattggcaatttcccactggtcaatctgacgccgttcttcgtgaaaatgatttgtttgctggccaaatcgatgccgcagccgacgatgtcgccaatttggaatttggcatccgaattgaacgatactttgaaaacattttcttttgccaattggccataaaaatggccatcgttgaaataggcaaaagtgccagggaattttccgggcatttgatggcacaacggagtgttttttgtcacaaagccaatgccaatgccaaagtcacaatgggaatcactgtaaaaacatgggcataaaacataaatgaaactacaaaaatatgcataaaatattctccacaaattcaacccaaattttcaaatggtttaaactaagttttcaaaagtgtttctcgcccttttgggcgttttgtaaattcaggaaaggttaagaaaaatgagataaataaaaaatcatatcattgctcaataacacattaatggaataatcttttttatttttagatctaacaattctctataagcctgaaattttcaaagagttagtgaaaaatttacctttttagctttatagaaagaaaatttgtattttggcaccaaaaaaggaataaaatctggagaccggacgggaccgggatcccgccgggattttgtcgggagtcccagtgaaaggggtactttcccaaacattatgagacgacaagtcaaaatttaaaaaaaaacaaagggacgcgcaaattttggcttgtggtctcataatgtttgggaaagttccatatggaaacccgtaaaaaatcctgtgctttagttatgaagcattaaacttcgaatgcattctcagacaaatcttttttgccggggatttcgtcaaaccgtaatttatttacttttacctcatttccctttgtaattttacaattttcacttcaaaataaactgctccaatattttgagggggaaacacaaaggcaaaacgaacaatgcgaagacctggggaaaaaaggttgacagttttagattcaaaataataaattttatgtttttaaatttttaattaaaaaaatgtttaatattaaaaaaatatttccgatatttccatccggatttacctttcttttttccataatgtttgactttaataattgttggaatcaaaatcatacgatcactttgacagtccgaagtgttccattggtagtcaattgttattgtatctctaatctaaataaaaatgaaaatgataaaaagaaattaattttttttaaatttcgatttgtcaataagttaaacgtcgtattcattgacttacaatttgcagcggttcttcttcagaaagcatttgctcctttcttttttctttctcttttttctgtccaatgaaaaagatataacaaaaaacattttaaattaccaaatccgcaaaaatttgatcaattttgtcacgatttttctcaatcagttgccttataattgaatccatatttgattctgaaaaatggtgagtttatataatagtaagttactaaaggaattaacattttaaattctatttcaatttttagcgttaaaaataaagcgcctcttgtccacaaaactaactttattttttaaaattcatcctgacaatccaaaaaatgataatttggacaaagaatctaataaattgagaccagacttttaggcacgaaatttttaaaataggcacataaaataagcacgaaaaataagcacaaaaaaggtaaaagacataaaaaaatgaacaaaaactacaaaaaaggcacaaaaaattggaaaaacgcagtaaaatttacacttttggacaaaaatttttcatattaaaaattatcaaattttcttttggcactgataaatcaaatactattagttttttagcaatataaatccatattttaggggttttcaggaataaatccatatttgcaatttttgctttttgggtccatgttttggtccttttttggaatttacacaagaaaattgggtatggatgagttgggtttattctgtttttagtccatataaatccatattttgggggtttttcgtgaaaagactgagaacgacactaaaagctgaaaaatttaaaacataccattcgcctgaatatcagctgcagcaattgatattgctttttgtaaccacaaaaataaaaaaataaaagaacgccaaattttcattttaaaagttcgctgcgagtaaaaataatagtcaaaatttataagaaattaaaatacgaaccaaataactgaataaaagtcacaatcagaggattaacaacgaatcgaacgaatgcgataaatgaatggcaattaatgggagcgaaaatggaatggcattcattctcgagagtctcgcaggtccgaaaataacgacctcgaaacaaccttcaaaccttctaagagatatccatcaaccatcaatcactcttggtcaagctgatatttgatttccttacgcatgattaagcgaaccccaaaattggtatatattttttgcacattcatgcgcactttagtcattgaactgatcagtatataaaaatgggccattttagccctattttagaaatttagggaaaggttgccacgaaattgtacagtagtaatatcttagaggagccatttaacacttacataaattctttgatttaagtatcataagatcgggatttcatctattggcacaatcggatcacaaaaaactcttcaattaaaaaaaaaagtcattcacaaacctaaaaatcgctgtcgcagatataacatttaatatttcaatattnttttaaaaagaanagacgaatggcatttgccgaaatgaatttatccnatgtttggattgtattgaaaatttacattgtgtnaatttatttccatcttcgtatgatttgctcagg

SEQ ID NO: 13616 - DNA, 2159 bp, Heterodera glycines
ttctgaggattttccccaaaagcttcaaaaatcctcaaaatttctcaaaaagccacaaaaatcctcaaatcctcattgacctatcaaaaagccacaaaatgaggataaatcctcagatctggcaaccctgcacttagggctatcaaatgatattatgaatataaaatttggttgcttttaagcaaagttatagcaaaaaaaaaaaaaaaatttattttatggtttctgagtatcgtcatagcacctttgaaacctatttctgccattcaaatccggactagcaagcgaccgacagaaggccgaacctttaagccatataccaaaattttaatttttaaaattctggccccggattcgaatttggctaaaaagagaagcatctcttcgaacaacaatttgtcatacatacgaaaagtttgtgtctagctgctccaaattaaattttacaaaatttatgtctgctatggatgtgtcggcatgccgatttccgcaatttttgggccgtcgagatcccgatttcgaaatttttttggacagtctgatttgcacgtgtcgaaattttttgagtgcgttcgcacacatccctgatgtgtacggcaattcgacaatcaataaacacaacaaaacataatcgatgtgtcagcctttattacgaacaatcaaatttttttggcgcttcgtgcaacaaaaataattgacaaaaaaaatatgggagacgatagaaacagtagaaaatcagcagaaaggagaaatgaatggatgaatgaatgtgtgatttgtcaagaaagggaaaataagaaacaattagttaataatgattgataatgatcatttcaaaacatcattcatcaattataaaatcgtcgatcaatcaagcaattaaacacccgccaattttcgcaccattccgtcccatccgccgccgccgctccaacaatcaattaacgggggcccaatgtccaattagtacatcatgtgctccgcgtgggacgagcgcggcttcttgatcttgtcaatgttcttcatcagcatgtcgtacagcgtggcaaagtggttgcgcatttcgataatgaccaatctgtggggggcgagagaaatttaatgtccaaaaaaaagtgcgagtgttttttgcagcattttgtcaattgaaatccttgaaatgcataatctcaaattcaaacattccataatggattagtaagaccataaatcattaaacattttttatataaattttcaaatttgctgaaaaattttaaaaaattggaaaagaaattgattttatttttcccagaaaaccgttcaggatagttaaaaatctaataaatttttgacttttttttaaatttcagtgggaaaaacgatgttgggttaaattgctcccttttgggtggcggaactcgaaattgctggcgaaagtttaaaaacgcttgactaagtgtttttcagaattttgaaaaaataaataaattatcattaattaaatttcattcattttaaattttccatttaatttaagaaatttttggctggcacactcacctgatgttgatgaactgcttctgaaaatggtgacaaattagctttcaaaaaaatggaatataattttactaaacacgtacctcgtccatgttgagaattgcacggctagaaaatgtgccaaaaatttggtataaagccaaaaaaatttggaggcccaccggtagtcctccacgtacggatatttggcaattttggtcacaatctgtgccctcgacgccaaatattcgctgctcatctacagacaaaaatcgaaatttattgtacaaaatccttttttaaactataggctgacctggtccagataggtagacaactccgattgcactttgtaagtttcgttaaggcagtcctggaattttttttaatttaattcaatgaattttccgattccaaaacccacctgcatagacacaccgaaaacgttgccgtcctgaaatgaatataatcgaatttttaaatttgaagagggtgacatgacaccaaaaaacttggcaaactgacctcaattttggggatcaggaactgaatccacactttgacccttaaaaatagccaattttcgcataaaaatttaatccaaaatccaacttgttgacatcttcgatggcatcgcctgc

SEQ ID NO: 13617 - DNA, 3826 bp, Heterodera glycines
  misc_feature (2685)..(2685): n is a, c, g, or t
caattttaaggcattggaggtaagcaacaaaaaaaactctcccaggcgaatggggagctcgtttcacccttaaattcttcataaaaattttaaacaaaattttccaaaaaacttttttttaaagtttttctagcgatttttttttaaatttaagaattaattcccaaattcgctaaaaacattttaaattttattaaaaaattttctaaatttccaatattaaaaaaaatccaggtggagggatgcaaagttcaaaccctgcccgcaacatgaacaatttttattggaaaaagttttcaaaaaattttaaacatgaataaaaacatatgctggaggcatgggaaaaattaatttgagtcccaactcatttccccattttttcacttgatgctggggctgacctggtcaaggaaaccggccacttccgactccacgttgcgcgtttcgttcagacattcctcctggaaaaagcggttttttaaaatttattttcaatgaattttccgttttttccaaacccacctgaatggacacgccgaaattgttgccgtcctgaaatggatataatcgaatttttaaatttgaagagggtgacatgacacaaaaaacttggcaaactgacctcaattttggggatcaggaactgaatccacactttgacccttaaaaatagccaattttcgcataaaaatttaatccaaaatccaacttgttgacatcttcgatggcatcgcctgcaaattttaacaaaatgaatttgtgaaaaatgttccatttgggaatttaaaattaagacgaagcccaaggaaaagcggaaaaaagcaacgggaaaaagggaaaaattcatctgggaaccaaattaaaaagcgacttttaaaaaaattttctggacggaaaatctaagcaaaccgcaaaaaacaaaatcccgaaaatgtttccatatgaaaaacatcattgttgggacagaaaccatgggcataattttcaaaaattcaacatcgaaaacttacgcaacagtgggcgcagttcgtcaatgagttcggccaatttctcattgcaattcacagacccttttgcaaatccgtaaactggcgttccgttcagcagtgcggctgtgtcacgttggcagtccaatttttgcaactttttggccacctacaaatggggtaaagggtagaaatttaagagaaaaattctcaatttgagtgggaggaatttggaaaaaatacccaaaatttcaaaagttttaaaaaattttccgagtttttcgacctttatgttgaaattttcgaaattttaatgaaccaactgaatctcagtatagtttaaccaaaaatcaacttacctcatcgccgctcgtttgctcacctccacatggcactggcaaactgaaaaaatggggaatttttcaaatgtaatcttttcattaaaatttgtacaattttgtaagtggttaccccacatttgggcctagggttcaccaaattttagtcctaatgaaccaaaatgacaatgttttcttaagtttaatgctgtttaggctatcagggattgaaaaaactcaaatttaaacccgattttggacatgcaaatgtctggacacgattatatatagcataagtccgtataaaatggcaaatgaaaattgaatttttgaaaaaaatggaatccctagagggttaatccgtgaattcggcataatttggaaggcctaatttagtcaaaaaacaattttatttacattgaattgacatcggtcaacgcggtgatttcggccagacgcgcgtactggtatttggggttcttgagcagttcgttgaactcgaccactttggaggggaatctgtggggcagagaaaaattggaaaaatgggccaaaaattccaaaattggtttacttttgctcaacgatgatctccgcttcctgaaaaggtgggaaaacaaattgtattttaaacaattcatttttgttaaagtttcaaatttaaaatccgaattgccgaaaaaggtatccggatccatgaaaaaccgagattcaggtcgaattttaatttcattgaatatataaaatttaaaaaaattcaagagatctgttggaaaagcagagccatcaaaaccccagttaaaatatcttgaaatgtctcgaattcaataatcggaaaatttttgtagttttcaaaaattttgtaatgtttttttttgtaacttgaccattcaaaataatgtaccttcagtagctcctgtttgtagtcctcaatcttctgaaaaacaaaaactcaatttacactaattatggtaaatggtggtggcataatttctatggcacctttttgtgtgtcgatgatgatgccgatttattgttgttggggacactcattttgtgctgttgtcgcggttaattggagggcacacacaatcttttaaataatatttctgtgtttaaaaaatcattgaattataaaaaaaataaataaataaaataatgtagaaaatgcaacataaaaacatcagcggatttaacaaaattaaaaactttatttttatttataaaaatttttatgttaagctttttttttcaaagttaaaatattacacataaaaaatggtgggaaaaaatgaaaaaattatgaagatggaggagcatttgtggtgaccatcttgaagatttcgatcagtgttgcttgncacggcctcagatggtagtccttgaaaaaacgagagttttagggtttgagagtttcgaggcttggaggtacccctctagaaaaaaaagaaaattatttcaacaaatttttcggatttttttgcccttttcctaaaaattgtacccttttaaatggaccggttaaaaaattttttatggtaaggcaaaattcgaattcaaatccgaattctaacaatgagtcatttttgagtcgaacaaaaaataaccatttgcaggcacgcggactcgtacccctagcaggccacacacggcccacaaagcagggaccaccacacaacgaaatcaaccggtggttcgagtccgtgtgtacgcaaatgatttttttgtttgacattcaggatccaagcataaaaaaaaaaattcaggtcagatagctgggactgaaaaacatgctattcgtatcagcgcggctttggttcctttccccaaaaaggtttaaaaaaccggttttttcgaaaataaattcaagagtcaaaaaccagtcacatgggatccgatcgagaacttgtccacatttttgtagatgtccaaccctgacaatgtgtgccaacggcaataaattggactttggcagatgctaaaaaatgccaacctcggcccattttgaccaaccagccattgttgaacctaaaaattaatttcaaaaaagcatcggaaccaacgcattgccctgaataatttataggcgggtactcacaatcagagaaaaattcggatacgtgtttaaattttagtcaattttcttgaaaaaattgactctaaattttccccggcggcacctaacggcaccggcggcgggtccaaattttcccatattttatatttttccaaaataggtctcaaatggccataattttccgttttttttctatggcgctgaaatctaaacaattctggcctgaaaaaactcttcggttgcccctcccaaaattttcgtgtctcgacatttgcggtccgacttttgcggcccatttcttaagggctattttcggacatttgcggtcacagccaaaatatggataattaccaaaaacacttttttttctcttcaaatttacgccgagctttcaatctagcaattctttttcaaaaactgggctt

SEQ ID NO: 13618 - DNA, 3715 bp, Heterodera glycines
ttcatcagttggagcggaatattgcgcaaagacccgctaattatactgaggaagcagctaatggacgaattaaaggcacgcaaaaagctgagggaaagcggagaacaacagcagcagcagagagcgaaagtcgacttcattgacctgtttttggagacggaacagaacgaacagcagcagctgacggagcaatgccaaaacgagggcgaagcaatgctaagcaaaacggcacttcaggtggggagagagaggaagggggaaggggttggtggcggtagtgaagtcgagagtcttagtctcgaacctctttgactcgagcaaaatacttttcgggatgagcgtttcaattctaaattcgatacagaaaagttcggctctattgcactttatgagtccaatcgaccaaacaacaattaattaattaatcaaatctttttggcaattgcctaaacgctgagattttatatatttttgcttctttcctttgtgctttcgaatgataccaaaaacatagggtttgttcgaacatcaacaaagttattgtataaaaagaaggtattaatgccaaaacgagggtgaagcaatgctaagcaaaacggcacttcaggtggggagagagaggaagggggaaggggttggtggcggtagtgaagtcgagagtcttagtctcgaacctctttgactcgagcaaaatactggggcttccaaggatccgggtttcaattctctaatttgatatagaaaggcgctaacagaaaagtacaattgaatcgtttggtatttaatagtaatgctcgagacgaaaatttctcccgagacagagacttgacttcgagaccgagacccacaaaacccgagacttttctcgagtcgagaccgagatttttaaaaaatcttcttgttaaattaaaagtggattaaaactttttacaaaatttaatcgatttttgaggcttttctaataaacttcttttttgaattttgatgattcaattacatttttatcaattcaccgttaaactaaaagccttttttaaattcataattgaattttcactattgcttatttaaaaaaatgaagaaaggcgccgccggagaaaaaatgaaaaaaagtgcaatggaataattgggtatttaccacgaaaacatttgaaaatagagagtctcgagggtaatttggtgcagaatatcactaattggtgttaatcaaagcagtctatgagaaatgcaacaagcattttcagagagtagcaaagcggtgcactttggaagagattacgtcgcagcttttgatgtttctgcttgccgggtttgtggtattacgaaggcccaaaaaattcccaaattcacggcctcttaaatttcttgaaccaaaaattggttaccgccgtattttctctaattgtctcccaatctccattaatccaccaattacgctaaacgtgaactgtacagcttcgacacaagcgcaaatacgctgagtttggtttgccacgcgttggcccttcacgcggaagtgcaagcgaaagtccaagaggaaattgactcggtgtgcttcgacgaggtgtcgtccttgagaagagaggaatttgaagaaataaattcccgttttcaaggacccaacttatgagcagctgagccaattgaaatacaccgaagcggtggtcaaagaaacgctgcgccttttgcccattgcgacgaagtgaaaccaattagcataatgaggcttaacatatgaagaccttgagaagcctttgagggaaaactatggggcgggccggctttgaaccggcgtctctggctttccgggccagtgggtaaaattgaagaatactagtgcctcaccaaattatcgatcattcgatgcctatcggtctgtaatgcacgaatccgaaagaattttttggcggaaaccactttgggccgagttatggacccgggaccgaagtggccaaatggctgtaggactgaaccatccaaagccttaaaacgcacaaaaatgcaataaaattcgtggaatttgatgaggtactaagtaagtattcttcagtttccgaccagtgttctaccagccgaacgaccgaccctaccctctacagtaccctattgtacttgatagttagtatattgtcaccttaatggtccattaatcttctctcgggtaaacttcattctctatctcgagcttaatgagtcagttcccctgaaaattgggtgcaagcgaaaatggcaccaaaagaagcggattaggataaattaaatagttaagaaaaaaatgtgaaatgttccactttatattagtgattgaaaggttttctcaggcttaaaaattcgagttcaaactttagattttcattgatcgatcaaatttttgaaaatccgatgatcgatcgatcgatcagtttgtatttaaatgaccaattgttaagtgttctgaatcggacgtgctgccacacgacgacattgggcgacataaccgtggagaagggcaccgccgtggtgtgcgatttgctttcgctgcaccacgacaaaaccgtgtggggagaggacgcggacgaatttcgaccagaaaggcacaaaaaaacccaacaaaataatcataataatgggccaaatggaattgaaatggcaaatttgtgcacctttgttcaaacagggggacacattaggcattttggttttggagaataaatttttgcaatttcttaatcaaattcactgagactgaagccaggcaaaagccattaaaattggaagtcgtttaaatccaaaaattgtaatccaattgaaactgttttcaggtggctcgaagcagggcatcaattgccgccgttttacgcgttcggcggcggtccgcgcatttgcattggcatgcgattcgcaatgattgaggagaaattggcattggtccgaattttgcgcaaatattccattgtccaaactgcggacactgaggtgatcaaatggacaatcaaagcggtggtacaatcatttcaaatcgcttacagaaagagttggcattctccggacaattggtgatagcgccaaaatcggtcactgttgggcttaaactgagggacgaagaacggcacggcacatttgagtaacctctgaatttaggcttagtaaggtacataaatattttttagtatttaaaaatattaattggagagtggcgttatacagggaaaatatgaattataaaatggaaaaaggctaatttgaggaaatatgatcaaaaacgatgaaaactgataacaaattaaaatatttcaatcggatttttaattaatattaaatttgaagaaatatttttattaaatttttttgttgtaattgccatgggaatatgaacaaagccaatggaaattcagaaactcacgcaattgtttgtcttttaatttaaaatttaaaaggcaaaaaaccgaaacaaaaaatccatctcaaatttaaaacaaatttaaaaatattcaaaatcaatttattcaattttttatgatagaaatttaaatttactttagattttaaaattattttctaaaatcccttaattttaaacggtctgcgaataaactctcataaaaaatttttgtcgcatttcaaatttaaattttaaaatgggacattattaactgtattttatcggttcgtgtaggaaaaaagaaaattaagtacagcataaatagtgatcatctgtttttgaaaccttcatttt

SEQ ID NO: 13619 - DNA, 2472 bp, Heterodera glycines
ttggtgctatgtcgttatttaaaaaaccatcattatgattttatgtaaaattatttataacaatcaaatttttatttattcatatcattcgatagccctaagcgatctctgtcaacgatcaaacctaaaacacctattgttccacttacctcaaaaagtcaatttcttcaaatatctcttatctagatcattttattatgtatgtactaatatatttatttaataattctcatgcttttttcctttgttcttctatcattattattttgtttgtttgttagtgtctgttttcttaaaatctttattttcgtataaagatgagtatttgtcttaatttaattttattatttattgatttgtactatttttctactatgttaatttatttgtgaaccaaaaaaaaatcaaaataatttaaagtcgctaaattttgaattaattttttataaatatttgcttgatggaaataatacatattaaatctttttcttagtattatgatgtatttctcatatttttattagataagtttttttataaattatacttggtcagaaattcgaattccgagttaaattgcattattagataatttattcatttaattttttgaattttacacatttacctcttttattttttaaattttcattaatttttatttttaataactatcttctttttttttgagtagcgtaagtgctcaaatttgtttttattatttttgtatgtttttatacaatacacttagaaaaaacagaaaaatttgataaaatttgtttattttaataatttattatttgaaattatttttaatatcatagcataattaatttatttttgtcaaatcatttatttatttattcaaaagatcaatgagatcgtatttttcatttgagttggcatccattttaatttattacaatcttcaaagatattattaataatatttttctatatcaattattatattgtatcaaacagaattgatttctgttttacacttccaaccatttgtgatattgataaatttttggaaatccggtgaaaacataaatcaagttattttaatattaaaaacaatttgattaaaggactttaagaaattgattaaataaaatttttaaaatggtggaaatatttaaattttagttcttatttttaattttctatatttatgcattttcactattttactttgaatattatttttttttaatattaagtgttaaatatttatttatattaatattttaagtttttaaatttttattttatataatacgttaattatttgttattaattactacttaatataattttctttttattaatttcaattttataaatgcggccagagaattgaatgtaaagatcaagtgaagctctgcggaattggaaggcaacgtccatcgtgactatattgattgttgcttatattaatttattttagattgtgtaatgtaataattataattgtatttttttttatcatttttacatatttttacttcatgatctatttctcatgatattttatattgaacttattttttgtatttcacatcaaatgtctttaatttaaactgaagttttatgatttctattaatttataatttttactcggcattgttcaatatttatatttttttagtcaaaaattctaaggaattaaatccttaatttttttaaagaataattttgatatgagtaaaaatgagattattggagcaattatttgtttagttaacgaagtgtgtaattcgtttttttcaattattttatgttgtttaaaattattttgattaaaaaattttgataaatttcttgatttttcatttttattattaagtttttcatattcccatatttgtttttatgaagtgtctaatttatattaaattttaaaaaattttagtttttacatcaaaattaaattagttttggttttttaataagtgctcattttttgttattatttattttttatctaagtttagcgtctttttaaaggatttctttagtcgtaataattaaatttgtaaaaattttgtaatattctcaggaagaccatttttaagaaaattaaattacattttgatggtaaatttttagctactttttttattattaatgatagattcattttattttacataaaaagttgattagttcaataatgaattttattttacataaaaagttgattaattgaataatgaattttattttacataaaaaggttgatgttaatgaaaagtaattatatttctaattgtttgaggcttctaaatccaactttttcgtgttgatttttgctgatttcttgttttaatggccaaaatatgcgcataaatatgcaaaaaaaaaagtcgtgaaatatgaaggaaatagcacaaaaaaaaacttgaaaattagggggtgcaaattaattttttttttaaattttctcgtaaagttttatcggttg

SEQ ID NO: 13620 - DNA, 2566 bp, Heterodera glycines
gctgacgaagatcgaagcagagaatagtcaaatgaaaacgaaaattgagaaaatgcagacaaaattggagaagaaggaggagcagcacatgaacaagtttgagcaactgcagaaagacgtaattttcaaaatagaaaactcaaaatttatggactcaaatccgaaatttcacactctaaaaactaataaggagcggataacggatagaatactgaattcttagaattttaagcgtcctttatcttaaaggacatccattgaaattggcattaattttggagtcaaagtctgtaacagagctatcgaattaaaaattttaacccaaaaataataaataaaaaattgattatttttataaaccctatcaacgaaaatttcagattttcatagcacatcaacagcaaaatggtaagggaaaatgaataaagaatattgttcctaccgcaacattattattgttattatggcgatttgtaaaaaataaaaaacggctaaaaagacattttttatagaaattattgggcagcgatttatgtaattttaatattaccgtttttatagtttatttgttcgtttggtaatatattcaaattaaagagtttttcatgttttagaattggttggccaaatcaaacaattgaaagacgaacaaaagaattatttggcgagggtcgacgaattggaggaggaacagaaacatctgcagcaggaaaagaacggtaataatatcgaaccatttaatttattctcttggctctaattttatttcttttttttctctaattttgctatttgaacaaaaagaactgaaaaatgctcacaaagaaatgcaagaaaatatgaacaaattggaggaggagatattgtgcacaaaattggacgcggtgggctcaaattatgaagcacttacaaaaatttggccctaataatttaaagctttattaacatatttcaaaaaaatagtaaaatttcaacagaaagcattccaagaagggcttgagaaaaagcaactccttgaacaaattgtgacggttcaggcgaaggttggcaaaatcgaaatggaaaaccaacagcaaaagggtaagggaaaatgaatcaaagtctttaaaaatatgaattaataatttatgttatttaaatacaaattatgaaataatcttttttaaaggcattagataatttctcgagatggtcaaataattaaactattaagtaactagaaatgttaagaatctataaaaacaatcatttttgcaatatttttgatcattgttcaaaaaacatttgctgacgaattgtccactgacgaattatccactaacggattgtccataactgacggattttacttcactgacggattgtccggactccttttattattactgtcaaatattatttttgcttaacaaaatgcaaagaaatatattacataatcctatataataaattaattacaataaataattaatatttttagtttctatcgaccaaatcgaaaagttgcaaaatgaacagaatagaaaaatcaatgcattggaaaaggaacggaaagagaagcatatggaaatggtgaatgaatataatggaaataaatattaaaaattaataaatgattttaatgtttaaaatgtgaaatttataattttaagaatgaatatgaatttcaattttaagacacttttaaacttccaacagaattgttgggatgccaacgcttgtcacaacggactcaaaatcactgatgggaaaagtttgacggttgttcatatgggaagaagagaaagtatttttaaaatttactttttaaattattttttcatttagtcgaacttcgcgttgtcttcgctacccatccaatttggcttgacaaggattcctccggcttttcttactttgaaatttcgatcaaaaatatgaaatagtaagtacagcaattttaaatggcaaatttatcacaaaaaataataatgataaatttgaatattccgaattctattttagttactatttcggtcagatcttcttcggattcgcagtcaaacagcagataaaattggaagaaacaattgttccttccgactttggcacttattcatacataagccaaggcaattttaacatcaatggcgaatggatggaagttgattcattcgacgaaaacgatactgttggatgtggcattaattgggccacccgacaggttttttacaccaaaaatggacgacttcacggtttgtaaaaaataataacaacaaattttgttgcataaaagaacactatttttaaagacaatttctcaacatcatcaaaatacattatgccaaatattttttttatccaaatacaataaaatccattggactatttaaaaaaatcagaaatgatttctcatttatatggtcataggttgcttccatttggtcgacaattcatcaaatgatgttcctgaccaattgttcccattcgtttctttgtactcatttggtgacgaaattgaggcgaactttgggcccaatttcaaattcaatttggccactctttgaggaaagcagaaacaaatgga

SEQ ID NO: 13621 - DNA, 966 bp, Heterodera glycines
attatgacaattaaatttgttagcgattaattgaataaatggacgacaacggcacaatcaatttcctaagaattaattaaaacattctatcaccctccttatttaagggcactcccactcattaaagaaatccccgaaatgttgtgaaaaacaattttctggggcactcaattacgaaaaaaaggctgaaccaaaaaaggtgtgccaaaactggagtgaaagtgccatcaaaagagtgccgcccataaaatgaataaaataatgatgatgataatggatggcttgattggttggttgattaaatgaaatatgtgttggaaaatgaaaatgatatggcatttgccaaaagtgaatgtgataatagcgaagctgctgcataaatgatgaattttgaaataaaaatgccaaaatggtgatcagtcaataatcgatcatattcctatgccaaaaatgctgatcagtctcgtcagtgggtgatcgatcatttccaacttcctcctcccatccgtggcacctaaatgccaacaccattcttgttgttggcatccgcttctggcacaattgccgccgctgtttcggcatcatcaccaccagcgccgtcatgctttttctgttgcagctgcacaattcggcgctccgccgatgaacttttgtgctggttgtacgcctcggccggtggctcgcgctcgcccaattgttgcgcaaaaatgcgcattttctcgcggaagcccaacgagctggagtccgccacgggcctgatcatctgctgctgcaccttgcgctgctggttggcctgcagctcctggaggcgtctctgtgaaagaaagaaataagaattttttttaatatttgaaaattttattttttatttaaaaaggtggattaaaaatatggcggagggcgttcgctcagagacggcttagatccccaagctaaaaagagcaaaaatctgaaaaatgtttcatg

SEQ ID NO: 13622 - DNA, 1173 bp, Heterodera glycines
tcctcctcttcatcagttgcggtttttgtgccgtaatcattcgtgccattgttgtcctcgttggccggcacttcctccacctaaatgttctcgttgttttggatggagaattggacacgctttttggtcggcacgggatggagcagttcactgcaaaattgttatcattattattttaagttatcataaattccttctaataaagcctcctcccctgtattttttatttatgagatatggagtaaaatccctccgaaatttttttcgttaaactgaaattttcaaaaaattttaaaagaaaattcaagagaaaaattttttcgaaaaatcgaatttttcaaaagattcatgacaaatcactaagtatttttcaagtttcattgaaaaatttttcttgaaattttctcatgagaaaacgagctagtcctgctaaaaaatgactgtcccccggttcgtaccgaatggccggcttggccggcaccgccggagggggctgcctttggtgccgtcgttgttcattttgttgttgcccttctgccgaccgcacaccaccatcgccgccttcaggcagttgttgttgttgttgtggtaaatgcctgtttctgtgctgcaattcggccaccaccgaagtgccatcgcatcgtggcggctgcggcagtgacgtcatcgaagcggttgccgacgaaaggggcggtggcggcgctttgcctttgatgtttggcactttgggcaagccggtggcggcgacggcaccacgcttgatttgcaacaaattgttgttattgttgctgcagttggtcgtcggcgtcgtcgaccaattgttgttggcggtgtcatgagagggatgacgaccgtcatcataaatggcaacaacatccgtgtccaacaagctgagcgcggccaacgatttgctctgcctgcaaaatcaacatttcactacggtatattttgcaattatacagtaagacgcgtgttttttcccaatctctctgagacaaaaattgcattttcctattccctccatttaaatgtgccggcatgccaaatgccaaaatgccacacctttccaattgttgcgcagctgccaccattgaagcgggcaatttgttgcggtaagaggcggaggaggcgttgtccacagaaagtcggcgatcaatcgcagaaccggacgcg

SEQ ID NO: 13623 - DNA, 2565 bp, Heterodera glycines
  misc_feature (2550)..(2550): n is a, c, g, or t
gatgatgacaaattcatgccgttattgttggtgccgtaaaacgtgcccgacggcgatgtggcggcggcagcggaggaacggcgtgccggctgcatgaccaccacctgaggacggttgacggacggacggtagtgggcgggcaaccgcgaggcggacgatgatgccagcgaagcagcagaggacaacgcggaggaggacgactgttgctgggagtggcggacaagcggaaacggagtgccgccggaaaaggaaggcgaggacgcagcaacgggggcaccggttggcgacgacgatggtggtggcacaacaacggctccagcgatggcacaattgctgctactactgctgcccccggccgtgttgagcaactcagacgctgacatggaacgcttttgctgtttcggcacaaccaccggatggacggacaatggcaccggcacgacgccacctttgctgttgttggtgtagttgccgttcatggactgtctggaaaccgaagaagcgattcgtggttgtggttgtactccagctgctgctgctccattcccgttgagccgttgttggctttgaagtggttgtgtcatcatggcggcaccatcaacagcagaactgtggttgttttgttgttgttgttgttgttgcttcggatgaggctgatgaaagtaggggcccaacccgttggcttgcgccgcatgcttggcaacctcaaaatgcacaacggggccggccgaaactatcttttgtgctgccctgaaaaaataggaaattaattttctaaatatttaaatacaggccaataacaagaaaaaattttggatgcagaatccgaagcattttgagttcaaattttgtaaaaaaaatttttgtttgctaaaatgggtccggctgtgccgaagcgccgccggggaatttttttttcagaaattttaatgaaatttgttaagaaaacaataattcccaaaatttgcccttttttcttgaatccccttggcctgatttgtgattagagagatagaacaaaaactcacaaatcctgcccaacaccgatcaaactgttgccgttcacgctcaacaactgatcaccgggtgccagacgtccgtcaacatccgccggagagccctcaatgatattcttcacgtaaatgccactgccgtgctcgggagtgccctgaggagaaaacataaacatttattaaattaattattcgggccaattcaactagatttgtttatttaaaaattaaatgggtgtcccctgaagaaatttaaaaaattgtctaaattttctaattctaaaaattactctccccaatcacaatgaaaaaaaacaatttgttaataaaaaattattatttttttttaattaaaaagtatataaagaaattttatttgtatacactttcagtgccaacattttgcggccaatttcgctactcaattgttttatttaaaaaaatatataaatttttaattaggtatttctccgttaattgccgaattaaaggtatttgtgcacacaaaaaatacttaacaaatacaaacaaacaacagcaacaacaacaccttctctgtcccatgccgtcccccttcacaaatttgtccaccacaatttgaggacggaatggcactttttgttgaagtgccattcgcctccgctccaattggctgcttcttcccatcaattttcacgtcgtcaactgttggtgacgatgccaaaaatttttctcgcccaacagctgcgggagatgcggaagaagaagaaagcattgcgcgcagcagttggccaaatttgctgcgcgacttttccacacccggggatttgtttcctttgatgttgccgccgccaccatttttggcactaccattagtagcattgcttttcgattgtggcagcttgtccttcactttcttcttcgccttcttagtgcttgttatcattgcaattgcatcgtcattgtcaaattttgtgccgtcgctgttagcatcggcggcattctgattgatgttgtgccgccgatccgtgccgcccaatttatgttgctgctgatcatggccaacagcagaggacagtggcgacaacaatgccgatgccgaattgttttgccctcctactccaccttctccagcaacaatttgttcatccggagcagcacaatcattcttcccattcgccatcatcatcatctgctgctgttgttcaaatgatgaagccgcttcaagtggcggtggtggtagtggcaatacaaatccgtcgaaaaacaaatcgctgccgccggcgtttttgttgttgtagcggcgatggttgaaataatcttgctgtccctcttccccctcttcctgctgctgctgctgatggtgattgtcggtgttgttgaagcgacaataattatgatgatgaagatgatgatgatcaccacccccaccagccgaagccaaacaacggcggcaattgacccgttgtttcttttgatctttttgatgatgatcacaatgatgatgatgatgatgatgatgaggatgtgcttttgcttcttcccgccggtcctcgtncatgaattggcgacg

SEQ ID NO: 13624 - DNA, 1393 bp, Heterodera glycines
ttctccataaatattaagaatcacatagaaaatcagaaactattgaagaaacatttttttaattaatttttttccgtaaaatctcaaatttgctgttaataaaattataaactcaaaattttgaagacaggcgactttttttgtagagcacgaaaaaaactgcaaaaattcaagctcgtataactttctgatgttgatcaaaaaagtctgttgcaccctgatcagaacactacttcagagtgatcgtgagtgactatattttaacaacccttggggacttgatttgaaccataaatttggccataaaaaatgccgagtaatgctgaaaaaaaataatgcaatttttttcattttaaatttaaacaaataaaaaatagatttttttcaatttttgagaaattaaaatataacatcagataatttattaatttaaatttattaaataggatttgtaataattaaaataaacttctgttgtaactctttgccacaaatgaccgtagcccaatcccatgtaaaggtaccgtatgagtttgcgtaaaagtggtgttgcctcaacactttcccaatcgtcgtcccttacgaagaaatatttttcacaaatttttgtgtcaaatgaagatcgaacggcatggagcagagaaggttttcgtctgaagctgaaccaaaatggcattcgctacgtgcgcagaaccaaaaagccatcaatgatcttacaaattgacaaggttgggtaatgaaaattttaaaatttaaaaaaaaacaaaaatttaaggataatgtaatcaattttttaggaaattttcacgccaaatttttttttattaattattcaaaatttattcgcagttaatggtggaagaatgttctgtttgttgtgaattgatcataaatgatcaattaccaatgcaattaaaagaatgcgaggtaggaatttaaagttaaattattttttattttcatttttttaatatttagcattttttccaccctagctgcatttcacagtggttagtttcttaataaaaaaaatattaaatttctaaaataaattttaaaataaattcattataatttcaatttaataaaaatcgaacatatttattataaattgtaaacataattaaaactataaatttatttattaatttaatttaaaaaatttccagctgcaatgttcttgttttaatttaatgaattttaatttaattttgtgaatttgaaaaaagaattaatccagcgatatttaaagttaattaaatcaaaatattataaagaataagtttttcaataaaaataatattaaaaatttatattcaaaattgaataattatttttttgcaggttaacaacaaataaaacatgtccaaattgtcgaaaggaacttaacaca

SEQ ID NO: 13625 - DNA, 2728 bp, Heterodera glycines
aaatttatttcaaaagccaaaaatggccaaatttcgtcgttttgtcatcagacaacccgtcctccaaaatggccaaggcggtctccgtttttcatacgaattttggctgccccggaggggcaaaatgaagacaaagcatatccatgctcagtcactgaaagtggtggaccaaggaagggtaaaatttgctttaaaaaacaggggttccgatgtgaaaattttaacctcaaaagagacactaaaaaaagcaattcttgatgaaatatgctgaatttatttgaattgtttggcaaaaacccacacaaacttctaaattaaccaaaaatgacagaataaaattcattatattcctaaaaggcacaaaaaaataaatgagtattttctgagaaaaggcttttaacaacagcattcataatcgtaatcagaaattggaacaatgtgatttaaaaaattgttttgaaaaatcatgataattcaaattcatctttgttttattgaacaatttatcagttaagcattacaatgttaccacttatgacggattattaattttaaaaggttccattaatatttaaatcaatgaattgctagcgatgacgacaggtaaaaaaaaacaaggttaaagcattcatttggaaatttacaaattttaaaactaattaaaaattctaataattctattaaaatgtttgaacagctgtgcatcatcatgtatgtgcctcggtttacggcatacttttcaacatatgaaaaactaattaaacaaacccaatgaatgtgaatggacagaagatatatctttgataaacaatgattataataagatttgaaattaaattttttgaataaaaaataattttaaaaaaaacaaggattttaagattaagaaaagaattcgagaatccaaatttttattttatgaatgctaacggttctgtttggtgtcgaatttcttcttccattttcttaggttcattgtttcgattcccaatttttcagttttgtcgcgatttttatttcaatttcccaatttggtttcaaattgaattttttggtaaattcttgtttgattttttcaaattgctctattttttcaatattttgtggcgttgaaaattttttagataaatcttaaaatgagacaattattaaaattcgcttattccatttgttcttaccaattttcttcttccattgataaattttttgccgagtaattcccaattccttcgcaatttcacattcaattttgcatattttgttcttatcatatttaaatccataaattttttcctttttcatttcatcaaattttctgatcattcgaatcattgtgtccttatttatgtccttatttactctgtacttccgtgtttgtcctaattttttctttaatttataaattttggcacgatttgtgcccaacattttggcaatttcactttcaaattgaacaattggcattgttttataattgcaccgcaattcctttttcatcaaattaaaccagagttcccaagtgtgcttatttctaagatttgtgcttattttgaggggtcggatcttagaaagtaaaaatgtgcttatttctaagatttgtgcttatttcagcgttacgtgcttattttgtgcttatttttggatttgaaaataaaaaatgaaaaatttgaatgactattttgatttttcatttttttctgaagcgaatatttgaattaatttgattttaaaaaaaaattacattttatttcattttttgagtgaaattcacaaaatgccaccaaaacgtaaacatgattattgttttaagtcaatttttcatgtttttattgcgtttccttcacgcaaatattagttttagaaaaaatcttatttttggggtcagaatcttagtttttaggccattttgtcttattttgaaaaaaaaaacttgggaactctgatataatataaagaatcgataaattactaagcaaaattgtaaaattttgatttctacataaaatataaaaatcaaaattatttaatagataatgagtacaaataagaattgttgatctaattgaaaattgataaaatgcaaacagaaaaaatgaaatgaattcaactacataatattaaaattaaaaaattcatttaaaaaatatttttgttgaaattttgccaattttagttttcttccaaaattttcaattttcttcccaatcaaaactccatccacagaatatgtgcaattatttatttatttatttgtgttgtgtgttgtttgtccccctcttcacatttattcgccaattttggggctgattttcaaggtgaaatttgggcggggaatggaaattgcaaattgcaaattgtgcgccaaccgacggacggacgaaattggcgcaaaagaaatttgtacaaaaatggacggatatgggatggggatgtattgttatggatgaattgttggaccatatttggggatggtgtcaattattcattcattcagtcagtcaatccatttccgtcgctctctctaattacattttcaaatttttttaatttggcattgtgtctctatagaattggcacttacttttttttattcgtaaaactagagttgagcgggaccgggaaatttgacaaaaaccgggaccgggacttgccgggacttttcccaagtgaaaattttttttgaaaaaaattgaaaatttaagtgcactttgttacgaaaattgccaat

SEQ ID NO: 13626 - DNA, 2184 bp, Heterodera glycines
  misc_feature (6)..(7): n is a, c, g, or t
agagtnncggaggaagaaaaaatatggtggtagcggaacaaacaaacaaagatagaaagaaacagacagccattccaaattccaatgccatcccatcatcgagcaaaacccattgattgggaaatcaaaagtggccatttggcattggcccactttttcaaaatttaaataaaagaaagcgaaagggaaaatattagtgaaaggaacgaagaaaaaattaataaataaaatggccatagaaaggaaaatattttctgtctgatgagaaagttcaccaaatttcaactaatgaattaaaaatgatcaatcattcttgttcagactcaatacgaagttttgtttaccaatcaaacatttttgtcttttaataaaatgaggaattgagaaaagtaattacgaattcataaagatggaaatgccaaagaaattcgcagaaatgtctgaaggaatggaatggacaaggtcactctcattctttgaccattgtggaggaagcgagaaagcgccaagcttcgagaaataaacaaatgggataaattatgaaagattggtgtgggatatggatggatctttgtttgtgtcttatctgattctgatcgtaagaaacattaatcggatttaagaaattgaaggaaaaaccccgcgggtgtcatcccatcccatccgtatctttcccatgtgtctgatgaggggaagtgactgacagggcatccagcaacagcccttcttctcctcttgctcttaaactatgcccccacccattcccacaaaatgaaattgaccattcggtagcctttgctcaggcaatagcgtcctctcttctgctgccgcccctttttcgcctcgcccaagggcactgttgacaccagcagaagaagcactagcagcagctgggttcaggagagggggggagggggctaaaccgcctgatgagagcgatgagagcatgtggagacacacacagagagagagatggtcagcagcagaaaggaggaagaaagagataggagataaaggaaaaaagagacaaagagaaatgggagaggcatatggaaacagaaaaggaggaagggacggaggggcgggggagggcaaagaatgcgcggacaaagcgaattcatcgtctataacgggaaaatttggagacatcaaggggacactagcgcccaaaacggggaggggcatgttggacgaaattgacacatttgttgatggaatttgggactggtaaaaagaaagggaagaagtgcccccccccccccgctgcttccaaccccaaaaacggatgcatttggtgaccaacgacgaaaaagaaaggttgtggtgcacccacaattgagttgagtgaaatgcaaatttgaggggcggagggaaaggggggaaatatatgttttaggccggagaaaatgggggaaatgaaataaaaaaaatttggcagtgaataaaccgttgccaatgagtgccaatttgtcatttagcaaaaaagactgaattgttaggttccaaaaaccaataacatatgtacctaagtgtatacatgccttaaaacaggcaaaaaaatggcaaaatataaaagatgccataaaaatgattagtaataaaaagtttaatggcttaatttgcacttttataaatagtaaaatcaccaataagagaaagacccccccctccccactcattggactgacagcgaaactggaaaaattgttaaaggctcgcacccgtttcttttgttttgaccttttaaatttgttttgagatgggagaaaacggggaaagagatgtaaatgggagagagaagggtgctcacatttgtggggggggggaaatggtcgggtaaacacagagaaaggaaaagagaggaataattggagggcaaacagaacagaaaaggcggagaggacgagagatttacagaatcagaacacaatttacatattcattcattaagagttaccagagaaaatttgccaacgatacgctaattggagtgggacagagcaaaagtgatttgagtgttttgtaaaacggttgggattaaagggaaaaatgtgtggttaaatatttgacaaattaactaatttatcaattacgagaagacgaggtcccctgacccagcaagtgaaataaaaaagagaaacatcaaatgtgaacttatcaaaatattgggtgtttagggggaga

SEQ ID NO: 13627 - DNA, 2321 bp, Heterodera glycines
tgctgctgcttttgaagtgagtgaacaacctttgaatgattgcggtggaaatggaccgtgccgtattaactgacagcagccttttttatttggggtgggcatttgtgtgcttttggcttttgcttgctttgacttcgttctgtccgaccgcccgtccgttctcttcccccctcccccattctcccaatgattttatgctcgacgctcttcaaaatgttccaaaaaatcattcgtcgtaaagtgaatgaatgcgatcaaacgaagcgccacattccctaaattgcttttccctcttattgttagacgatcaaatgaaaacgggcgaagcatttcgatgatgaatttgagatgatatttgatcagcccccgagggggggggggagggacggcagcaaaagcaatcactcagaaacatcaaaggcacgcgaattcttcacactttcgccgcaataataaacaattcccccaatcactcgccatcagtttcaaatttctctttactgatcatcaaaaagaaaaaagaaacaaaattgttttgttggaaaagtaaaacaataatttggaaaaccgacagtttttacacatttttaatcgcgccgcgagttttgcgaattatttaggctcccaattaaatatatgctgttcgtaattaaatgaaaaattgcccacctgaagggactggagaacctgttggattttccgagaaacgcgcgtcggttgaactgctgaaattgtctctattttaatgcaattaaatgcgttttgtaagacaaaaacttcgaggggtccccccgcgcctcttttgtcttacgaatgttcgtattcgcgtagtcctgcggcgcttttgatgaaccgccaattccggagtcgcctgtcgagttcacatacactgccgttgttccgtccccaatttcgtcctcctcctcgtcgtcggtcacggggggcaacggagggagtggccgatcctcgaggacgagcacctgaaaaaagatgcaaaggaacggataaaaacaaattggaaaaattgttgattttattaatcgcccctctctgcccgtaaaaggaacaaaacaaataaaaaagggcttttgtcagaccgaagttcgattggccatcggatggggaggacagcactcatttgaggatgaagcggcattgttgttgttcggaacaacttttgacggctggcgatgcttttgtcgcatttttgcacaattttcccctccgttgccattggtcggtcgtccgctgtccgtccgttccgctgccaaagtttgttgtttctgttgtccgtcccttttgtcaggcccatctttgccacccgccgcggccgagccgacggaaagcgacgcattcgctgctgcgggtgagtcgtgccgattctgttgctctgtttctgatcgctgaaacggggactggatcatttgaccaaacaaaggaatggatgagagaaattggaagtcacggaaaggatttccccgcattatcccacacaattagcagccaattcttcctccgtttatccttttatcatcccccccccccagctgggcaaagacccgcggagattttttagataataacagtaattgttgacattaaaggaactgtactaactaataaatatagtcagcgggagcatttaaaatgttttgtttgtccttacaattggatcgtttactgtactgggttttaacagtaaatatgcattaagctcctatttagtcaaatcaaagaatggggggattctctgacagttaaagtctttctccccattagctaattacccccacccccgccaattcatcgtcccctaatcacttttttaattgcctcttccgccatccttcctctcctcccatcaacacaatttgcgtttgcttcgtccccattgcccattttctgtcctttttccccttctctgccacttccatcgttttcttcggccgttccgctgtccatcgttttcttttcttcttcttcgtcatcggaactgctgtctgaaaagaaaaacagtgatcagaagctgagattagacaagagatgggtatatgtagtagtaccttttttgtcatttaaatttattttaaatcaaacccaaaagaattccttcgtttttttaatttcccagtaaatttccttacaaattgatacataagcaatttgtcgagatgtttccgcaacaataagttgcttttccattacaaaatatgtgttgtttattaaattgaattacaaagtaagcatttgcatagaatttgccttgaacgaatatttagtggggaattgcgagaaatttgagcaatttaggcgaatttgtt

SEQ ID NO: 13628 - DNA, 703 bp, Heterodera glycines
gaatgaaagacggcgagtgtccattcatccgccattgatgaattccgaccccccccccccccgccagcagcagaaatagtgttggccattgcccagcagtgcgggaaggaatggaaaaagcaacggcagaaggaaaaaaagaaagcgacggagagggagaggaaagggaggtggccgtgaaaaaaacaagggccaacagatgctcatttggaatgcacaacgatggaggtgagggagggacactttaaggtgtgagggggagagggggcaaaaggaagaggatcagacaaaaagaaagtgtaaaaaatcagatagagaaaacaaaaaaacgagggaagggagggaggtcgaatggaaaagagacatttttcaaatttataggttacaattttggtgattgattggtactggaagagtgggttttgaattgggaataactaaaaacgcaatgtattcccagctagctcattttgttgaaatcaaagttggatggtgagggatttatctgccccctcccccttctcttttctctctctcacgcgctgccctcccatttcgctgttgtgcctcacccgctccattcgccccttccattcatgctcaatgtttaatccccaattcgcaatcttccgattgttcaagcaagttgttccaccctcccactttcaccaaaactcggaccgtcgtcatcaacaacgagacc

SEQ ID NO: 13629 - DNA, 1157 bp, Heterodera glycines
ttttcataatcagagcatgattctaggggatgagcattttataattgattttttgcttttttctgcatagatttttgaacagttacaattgcccataattatggcaaaccttcacttttgtaattgatattctcatactgtttataaaaaatgccagaattttaaataagcagttttaagaatgacttttcaaaacatgactcttattactccacgttggtcattcaggtgcaacgtcgttcatcatagctcataggctaatcatatgcttgcttaaatagcccaaacttttcaaagtttctcgattagacctttgggcgtacatttaattttttgcttttatcatggaaaatcttttatgctcctcttttttgcaaagctgccaaaatttccatgtcatacaaaaggcggctccaactattgagttgttataagcacattttttcataatcagagcattgatttctaggatgagcattttataattgaatattttgcttttttctgcatagaatttttgaacagttacaattgcccataattatggcaaaccttcacttttgtaattgatattctcatactgtttataaaaaatgccagaattttaaataagcagttttaagaatgacttttcaaaacatgactcttattactccacgttggtcattcaggtgcaacgtcgttcatcatagctcataggctaatcatatgcttgcttaaatagcccaaacttttcaaagtttctcgattagacctttgggcgtacatttaattttttgcttttatcatggaaaatcttttatgctcctcttttttgcaaagctgccaaaatttccatgtcatacaaaaggcggctccaactattgagttgttataagcacattttttcataatcagagcattgatttctaggatgagcattttataattgaatattttgctttttttatgcatagaatttttgaactgttacaattgcccataattatggcaaaccttcacttttgtaattgatattctcatactgtttataaaaaatgccagaattttaaataagcagttttaagaatgacttttcaaaacatgactcttattactccactttggtcatcaaggtgcacgtcgttcatcatagctcataggctaatcatatgctt

SEQ ID NO: 13630 - DNA, 1028 bp, Heterodera glycines
gcatagaatttttgaacagttacaattgcccataattatggcaaaccttcacttttgtaattgatattctcatactgtttataaaaaatgccagaattttaaataagcagttttaagaatgacttttcaaaacatgactcttattactccacgttggtcattcaggtgcaacgtcgttcatcatagctcataggctaatcatatgcttgcttaaatagcccaaacttttcaaagtttctcgattagacctatggcatacatttaattttttgctttttatcatggaaaatcttttatgctcctcttttttgcaaagctgccaaaatttccatgtcatacaaaaggcggctccaactattgagttgttataagcacattttttcataatcagagcattgatttctaggatgagcattttataattgaatattttgctttttttatgcatagaatttttgaacagttacaattgcccataattatggcaaaccttcacttttgtaattgatattctcatactgtttataaaaaatgccagaattttaaataagcagttttaagaatgacttttcaaaacatgactcttattactccacgttggtcattcaggtgcaacgtcgttcatcatagctcataggctaatcatatgcttgcttaaatagcccaaacttttcaaagtttctcgattagacctttgggcgtacatttaattttttgctttttatcatggaaaatcttttatgctcctcttttttgcaaagctgccaaaatttccatgtcatacaaaaggcggccccaactattgagttgttataagcacattttttcataatcagagcattgatttctaggatgagcattttataattgaatattttgctttttttctgcatagaatttttgaacagttacaattgcccataattatggcaaaccttcacatttgtaattgatattctcatactgtttataaaaaatgccagaatatagataagcagttttaagaatgacttttcaaaaccatgact

SEQ ID NO: 13631 - DNA, 3540 bp, Heterodera glycines
  misc_feature (1142)..(1142): n is a, c, g, or t
  misc_feature (1157)..(1157): n is a, c, g, or t
  misc_feature (3393)..(3393): n is a, c, g, or t
aatattcaattgaatttttaaatactcctacatagctaaaatttgtttttactttttcgagtggcggcatcacatcaaatttggcattgatcaggcgaatagtgctttttagtcgtctgtaagccttctgtgtaccgacaagcccgaggatcagaagagcatcctctggatcaactgactttttttgtcttgacagttgttgtttcttcttctgtggcgtgtaatgagcaaatttgtgccgaacttcccgactgattccttcgagggacgcccggctggcggaacgtgatctgtcgcggtttattacatccgcaatttgatctgccaatttgcgacgtgaggtgcgctgcaaatgatcgacattcatctttggtcgtcctgttggagttgctaaaattaaaaaagagaaaattatttgaaaaagataaaaaggggattttagtttcactcacttttgctggtggtcggtgtctccatcggtggtgccatcttttcctccaactgccgccgaagcgcagtgatcattgcgtctctgttgcggacctgctgtcgaagaaagctgatcacttgttcctgctccttcaactgtttgtccaattggtcggtttgtgtcgcggcgtcctcataagccaaatccacgtccgttgccttgtccaccgttgtcaaatccacttctgttgcactgtcggtagttgtgaagtccatgttcgttgctttgtcggcagttttttgatggacacgcacatggcgcctgatcggagttgctgacaatggccttgggcttgaacgcgggccttagtttaatttttgcttctaaaatagtgacttttttgacttacaaaggtccaaagttgacgttgatggtccactttcggcggcttgggtcgatgtcccctctccatctgctgttgtgtcggcttcggtctgctttagacctaaaaaatgcagtgtttttaaaataaaattaattttggtcaattttcatcactttttggggttgaaccaaccctgcgaccgtgctcctggcgccattccttgcgctttcgctttgcttcattcccacaatcactcattctttttaatttatcaatttttttacgtgtaagtaccattttttgccttaaaaagtaggtgattttgtnaatttgttgccatgngaaaaaattttttcctgtgggtaacttttcttgaaattttacctaggctagttttttggccctctctatcgaattctcttttgttttctgaaagtttcttttctatctcgagatcggctcttctatttttacaagggaaaatccccggaaatttttaagcattgcaaagttttggcgttctgattactaaataaaaaataagcataattgtactgggagcccaaaattgggccgctgtgtacagtattgatgatgttcatttgttcaccatcccccccttccttcacacataattttcccccgctgtcctgtaacattcattatttttttgtgtgctcaaagtgaatctcaagcctccattcaataattgttttattgataattagtagagaccggattttccaaaagtgccggaccggaccggtctgatattttcagaagcaaccggtttccgggcccggcctctcaaaaaccggtcaaaccggaaaaccggtgaaacaggattttcaaattgccgggcccggaaccggtttctggtttggtaaaaattttaattttcacatgtatttcacccaaaattgaccataaatcgtcccagatgtaaaatttcggctctacttcacttcaggcgtcaataatgacctcttcaataatttctgtttggaaataaaaaaaaatttgcgattttgagcaaatttttaaagaaaattaaggatttttagggtccggcgatgccgataggcgccgccgagaaattttttgaaaatttcgatgcaatttattaacagaaattgtataaaaatgaagaatttttggctatatcataaaccggtaaaaaccggtccaaaagtgccggaccggaccggtttggcattttcaaaatgaccggtttccgggcccggcctctcaaaaaccggtcaaaccggaattttccctaaaatcgccggaccgatttccgggcccggtccggtccgttctctaataattagtacttggctagtgtaaatgattctttaaataaacatttactgattataaatatatattagtaactagcgggtgcgtgaaccgtcggatctgggcttgggataaagcgcttcgcgcttcttgagcttcgctacctaggctgtaaagcgattcaaattgatagaattggttggagagatttttttgaatttttaaaaaattattatgggtttttagtccacatcgaggctcaagacgggcgcttcgcgcccgtttttcaaattttgttggccttacagagattagaagaggtacaacagtgattagaagaggtacaacagtgaaaaagtgatacaaaagtgattagaagaggtacaacagtgattagaagaggtagaatcatggtttaaaatgaaataaataagaaaattgtattattggatgtattataaatttatcaaattaaaaaaatccttttacttattaaaaataaagttagaaatttataatatagaatatttattgaaattgaaaggaattaatttctcgaaaattcaaattaaataaaacagttattcatcagaaaataatttaaaataaattaataaaacaatattaaattaaataaaaaaataaataatttaaaataccgtttgtgatttttcaaatattcgcccaaattctcgagggccaaaaaatttgaaaatattttcgaatttttaaaaaattctaaaatgtacaatgattgattatttattgtatattaatttttggacaaattctaaataaaaaaacaaataaattcttttattaatagttcaacaatgtttctaattataaatttccttttattaattaaaaagagagtttgaaatgtacaaggattgaatatttatttaaattgaaattaattttacaaattctaatttaaaaaatacaggagttctttaataaaagtaaataaattattattttaatttaaaacatcacaaaaaaataatttaatttaaattgaaaaattttattttttatggattaaacaaaactattaatatttattaaaatgaaaattaataatataatatttatttaatttgaaatgaaattaaacatgtaaaagtaatcaaaaaatgcacataaaaataatgtacaccggccggattcgaacctgccgccccccccccagaagatgactcagaatccccaatcacacagggattctgagggcttaacgatgtcaaaagtaaaatctgatcacgtattcgtgatncacggctcaaataacccctaaagacatgtttttgggagatttttgtgagaaaaattttttccactcaaaaaccatgtgcacccccctttggtccccgaatccaaaatcacttttatttttgtatccttttttaaaaatgtgataaaa

SEQ ID NO: 13632 - DNA, 1307 bp, Heterodera glycines
aagaggtacaaaagtgattagaagagggacaacagtgattagatgaggtacaaaagtgataaaagaggtacaaaagtgattagaagaggtacaaaagtgattagaagaggtacaaaagtgattagaagagggacaacagtgattagatgaggtacaaaagtgataaaagaggtacaacagcgattagaagacgtacaaaagtgattagaagaggtacaacagtgattagaagaggtacaacagtgaaaaagtgatacaaaagtgattagaagaggtacaacagtgattagaagaggtacaacagtgaaaaagtgatacaaaagtgattagaagaggtacaacagtgattagaagaggtagaatcatggtttaaaatgaaataaataagaaaattgtattattggatgtattataaatttatcaaattaaaaaaatccttttacttattaaaaataaagttagaaatttataatatagaatatttattgaaattgaaaggaattaatttctcgaaaattcaaattaaataaaacatttattcatcagaaaataatttaaaataattaataaaacaatattaaattaaataaaaaattaaataatttaaattaaaacatttgttcaccaaaataatttaatttaaattaaaattttttatttattattaataatacaaaacaaattaattaaaaaatgtaaaagtaagcaaaaaatgcatagaaaataatgtacaccggccggattcgaacctgcccccccccccagaagatgactcagaatccccaatcacacagggattctgagggcttaacgatgtcaaaagtaaaatctgatcacgtattcgtgatcagcggcccaaataacccctaaagacatgtttttggaagatttttggtgaaaaaatttctcaactcaaaaatcatgtgctcccccctttggtcccgaaccccaaaatcacttttatttttatatctttttttaaaaatgtgataaaaatgtaaaataaaatttatattatagagaaaaaaattgcggatttttctagtattttacttttcccgaatagcttttcataaggcagctacgaatttttttctgaaaattcgaatttttccagaaattctggaataacttttttcttttttgtgataaaaaactcaaataaatcccataaaattctccttatttttctctatttttaaagctttattatagttaaattgatgaaagcatcaccgagttatgaattttccgaatattagcccaaatttccaagggccaaaaaattccaaaaaataaagaatttt

SEQ ID NO: 13633 - DNA, 2904 bp, Heterodera glycines
  misc_feature (32)..(32): n is a, c, g, or t
tttttaaatcctttctacccgtcgattcattntgtggctcatttgccgttttccaatgatttggtgtgtcaaaaaaggcaatgcaaaactctgttgttatgtacttaaaaagagagagttgggaaaaatgagagagcaaaaagaacgcaaaaacagaaattcatccaaaattcgcatttatataataaataaaatactgggactgggcagtggtgtaaaaaacaatggtcttttcttttttagacaccttcgtccttttcgtttttactccgaataaaaatgcgtcttagcaggaattatttcagatttttaagagccttttgaaatagttttttaaatgtgttcaaagacttttttccgccatgatttttcatttatttcaatttataaaccaatttacaaaaattgcatttttgttcaaagacttttttccacctgtgtataatatttatacacaattattttattggttatttttgttgaacaatttattatttcaatggaacgattgtctagtgaatttggaaataaagtagttaaggtgtttccccccagtaggggtcagttgcgtctgacccaagcataaaatatcacaaattttttctttgttggtcaaatttggcatcattcaaaagttctacatgtttagaagcttttggtaaggtatttctaagcgattgaacaacttatgtataaaaaagttgcaacaataaaaccaaaaaaagtcagaatttgcatattttaatttataacttttttacatgtcggtaaatctttatgttttttgggaagccgatagagcttgttaagagctttcgaatgataccaactttattggatttggtcaacaaagaaaaaaaagttataattgcgatattagagacgaaaaatttcgaaaaatatgtagttaatcttgaaaatcggcaaattttaaattttcttgcatgagggtcgatttcgagtacataggtaggtgccaataagtactaatccaagctaaacgagtaacattcaatgatttcgttcatttgaacgtgcatcggtgagtacatattactaaatccggaaaaattcggatcagagagtccaactcaatttcatagcactttttgcatgtttttgatttttttctaccacaattttttgggtcggggtcactttggcgcgggacattttggcgccgcaaaataggtctaagtgttctctaatagcctgcaagatgctagaaaaatatattcgttttaacaaaagatatggcgtgctgcgcgaaaatggccagaaaaagtcagttttttaggtttttggccaaacttttttgtatctcaactagattttttgaaattttgcaggctattagcgactatcaagcgcttaaaatcacatcaagattttttaatttgaatgataaataaaaatgttatagcgtttggcgccaaaatggagagtcttgcgccaaaatgaccggttcccaatttttcaatcattctatgttagttgacaataaaataatatagaaaatttgcttattgtttagaaaaggattttgcaggacaattattttgttcatcattttgtgccactaattaattgaaaaagggaaaagtgtgctaattgaaccacaaaaatgaaccgacggtaagaaaggatttaaaaaattgcaagttttcatttacccaattttcttatgtttcagttggatttgtggcgacgtttggatggacattctgccatcgtttgaccatgctcaactcggcctcaaaatggcattgctttccgaccggttcgacatcttagtggacagacatttggatggaaaaagcgaattcacaatttggagagcaatcgaaattcgcaagaaagaaggaccaaaaacgaaactgtctgaatggatcgatggcaaaagtgtggcatttccgttccccgaccgtccgctgcccaacaaaattcgttttaagaaccttcggatttagtaatttcaaacttttgggcgctagtttaaagaagccctcttttgaaaatttgttcactttttttgcataattttttttatgcaaaatttgtttttttaacatggaacgtattgcatactatttaataaattgaaaaaaacattttaaaagataatttagcgctagttaaaaattttctgtataaaaatacaaaaaaaaaattttctaaaaaagtgaaaaaattttcaaaagagggcttctttaaactagcaccaacttttgtgtttattaaagcattttttatatttcttcagctacattgaccattccgtcattgaatttctccgttcaaacaagcacatttgggacagaagaggcaccaatttggaagtgtttgtggatgcaattgatatgggtgttcaaccgatttgggatgtttttatccgtcaaatttggcctatttttgcgacaaacattcaccatttgggctttcgcaatgccgatgctttgaacaacttgcgcagtcgcacttcaccaacgattctcactgatcttgatcaattggtttcaatcgattccggttttctgttccccgatggaattgctgatgatgggccaaatgcaactgctggccaagcgttgaccaaatggctgcacactccgacaaaaaatgggcaaccgaagcaattacgtttccgtgcttatgtggttccaccaaatctcgaatggctcaacagcttcaaagaggtcgtctcgccagaattttcgtcaatttgtttttgttttaccaatttttgtgtttaggcattccgtcgtgccaccacttctgtcagtaccatattcaactttattttcgtgtggacccaatgccaactgaacaatttgaattgatgaacgaacggaccaaaaaaaaagctgacactgaaacaggagatcgacgaattccacctaaatg

SEQ ID NO: 13634 - DNA, 1281 bp, Heterodera glycines
  misc_feature (50)..(50): n is a, c, g, or t
  misc_feature (53)..(53): n is a, c, g, or t
  misc_feature (68)..(68): n is a, c, g, or t
  misc_feature (75)..(75): n is a, c, g, or t
  misc_feature (91)..(91): n is a, c, g, or t
  misc_feature (93)..(95): n is a, c, g, or t
  misc_feature (98)..(98): n is a, c, g, or t
  misc_feature (103)..(103): n is a, c, g, or t
  misc_feature (109)..(109): n is a, c, g, or t
  misc_feature (115)..(115): n is a, c, g, or t
  misc_feature (132)..(132): n is a, c, g, or t
  misc_feature (137)..(137): n is a, c, g, or t
  misc_feature (139)..(140): n is a, c, g, or t
  misc_feature (144)..(144): n is a, c, g, or t
  misc_feature (147)..(147): n is a, c, g, or t
  misc_feature (153)..(153): n is a, c, g, or t
  misc_feature (161)..(162): n is a, c, g, or t
  misc_feature (171)..(171): n is a, c, g, or t
  misc_feature (179)..(179): n is a, c, g, or t
  misc_feature (182)..(182): n is a, c, g, or t
  misc_feature (185)..(185): n is a, c, g, or t
  misc_feature (194)..(194): n is a, c, g, or t
  misc_feature (202)..(203): n is a, c, g, or t
  misc_feature (205)..(205): n is a, c, g, or t
  misc_feature (216)..(216): n is a, c, g, or t
  misc_feature (220)..(220): n is a, c, g, or t
  misc_feature (228)..(229): n is a, c, g, or t
  misc_feature (231)..(231): n is a, c, g, or t
  misc_feature (238)..(238): n is a, c, g, or t
  misc_feature (244)..(244): n is a, c, g, or t
  misc_feature (247)..(247): n is a, c, g, or t
  misc_feature (294)..(295): n is a, c, g, or t
  misc_feature (309)..(309): n is a, c, g, or t
  misc_feature (318)..(318): n is a, c, g, or t
  misc_feature (327)..(328): n is a, c, g, or t
  misc_feature (330)..(330): n is a, c, g, or t
  misc_feature (332)..(333): n is a, c, g, or t
  misc_feature (347)..(347): n is a, c, g, or t
  misc_feature (352)..(352): n is a, c, g, or t
  misc_feature (360)..(362): n is a, c, g, or t
  misc_feature (374)..(374): n is a, c, g, or t
  misc_feature (1230)..(1230): n is a, c, g, or t
  misc_feature (1235)..(1235): n is a, c, g, or t
tgaattcgttcccttccaaaaacacctttgctcacgatcaatagggaagnganggaattggaaagggntaaaggnaaacattaaaggaaangnnnagnaaatngagggngagggnggaggaaagggaaaganaaagngnngganaantggtgnaaaagagnnaaagagagnaaaggggntgngantatttgggnagaggagnnanggggaatgganagangattgagnngnattgatnattaanatnaaatggggtaattaaaaagaatataaaatattataaaattgtttatnnaattaggaaaaagntattttggnaatattttnngntnnaagaatttgttggnatttntgggtgannnaattaaatggtntgagagagagagagagagagggaggggagaagaaaaagagagaaagaaggagaagagagagaggagagaaagagagagagaaggagaagagtgagaggagagaaagagagagagaaggagaagagagagagggaggggagaaaaaaagagagagaaagagaaggagaagagagagagagagggaggggagaagaaaaagagaaggagaagagagagaggagagaaagagagagagaaggagaagagagagagggaggggagaaaaaaagagagagaaagagaaggagaagagaaagagagagggaggggagaagaaaaagagagagagagagaaagagaaggagaagagagagagagagggaggggagaagaaaagagagagagaaggagaagagagagagaaagagaaggagaacagagagagagagggaggggagaagaaaagagagagagaaggagaagagagagagaaagagaaggagaacagagagagaatttgtgggatgaaattacaccaaacaaaaagaggtaaaattcggagcaaaaggcttcaaatgctaatttgaatttctttttgtgtgtgacactttcttcatgattaattggccgaatgtgaaggaataagaggacagaaaggacaaaagattgaaaggctcagataagccatcctccggaagttcggaagcagcagagaatgagggaaagggaaagaagggaaggaaaaagagacagatgaaagttggggaggggatgagaaagatttacatttttaagaggccaaaagagggggggggggggaagaagcaatgagatggccaaatttcgtccaaaagtcggacaaatgagggagaaatancaaancgacctttgaggacgcgcgagaggaaattgcgaaacagcaaaagga

SEQ ID NO: 13635 - DNA, 2331 bp, Heterodera glycines
  misc_feature (2261)..(2261): n is a, c, g, or t
gaggggcggaggatggcccggcgggtcactctcccgcgacacttccgtctcctcccccacgtcccccgttttattccattctttggacagttggccaaatattatttgcttcgcttgcccaatttgcctttgctaaattttttgtattctattttttacccattttcttccttcctttccgtgtcagtgcttttcctctccatcggcggttggtcatttcgtgccaaattcggccgaagggagaagaagcggttttgaccaacagcagcagcggcacgaccaaagtcagctgtgccaacaacagcagaagcagccgttggcgtgccaaaggcacccaaatgagcaattgtttgccctgcggcaacagcaaagccaacagcagcaaaatcagcagcaacaacaacaacagctcgacctcttccgcccttaccacacaatcgccgccgccgattggctcccgcttcagtaccaacagcagctgaacagagcacaacgcccaactgacgcggttggttgcgcgaagaagcgcggcatttgtgccccttaaaattggatgaccgccccgaacatttcagcgccgcgttttgtcgccaccgcacaatttgatggtattaagcgatgacggggacacattgagtgttgccgcgggggaagtcggtggaacgacgcggggaacacccggcgcaacggcactccacggggcacaagcgatgactgcaaatcactttcacaatggtcagctggagggttcttcgtttccctgtccatcgggtcactttcgatcaattatcatttttctatcattgctccgatcacttcactctgattatccaatttctgtctgtcttcctcagattcgttgccccgtcggcaccccgcctaccacactcactcgcttgaccgtcacgcccatcttcgggtcctttccgccggcgcgcgacctccgccgcctaccgctgcggacgatccctccgcccaccagcagcatttcaccgccagcgcaacagccgcaagtgtttcgcgcaatttgccccaccagcgacttcagctcaactcgctgctgatcagtccgcggcaccattactcagtcaacggatattcgtcttttgcccatccgcagaatggaaatgcagcaatttccacgaattgtcagtgatcagagagggagagtgaagtgactgactgacaaatgagagaaggcagtttaatgacggaattcaattttcgaaaacaaaaaaaatcttacaaaaagttttcgctcgaaaaaagccaaaaattaaattgtcaaaagcctccatctgccgctgatctgcttaatattttattaatctctttgtttttcgctactaattacctgtctaattcgcttaagtcccttcccttatgctaacctttcgtttggccatttgcccttacgcttttcctccgtttccacgcgctttacctttcagttcatcgccgcagccgtggcggggacatttacagcaattgcttttcctccgtcgatgggcctttgctgccgcccctcgggcattatgcccctccgccgccccctccgggctcttccgctcgttcgtcctttgtctccggcactgccacccatcagcgttccgcttcgctgtccgccatgtcgcggtcgatggtcactgtgttggagcagcacgaggagagacaacgccgcagggggagggtggaggggcacgaagcgcagcagagagtgctggaatatgtgagggcattggcagcactgaacggcaccaacgcaaacaacaacatcaacaatatcaacaacaacgccatggacatagctcggagtgattgtgccatcgacccattttcagtggcacatcataaaagtgccaaacgtttgcacactcagccgccgttgcccattccgccgcggtcgccgcatttaatccgtcgtacgcccctttcactgccacgacagttggaactgaacaataatcacgcaacggctggtaaaatcagacaaatgcttattaacttggttaacctatagcttgccttttgctttgctgccttcgcttttcctctgtttttccatttaaattttaattgttttttttcaaattttaaattttcttccgtcccttttaggcggcactctctctgctaggggtcatgccgacccgcgcatttactcgaatttgaagtgcgctagcagaagcaatggcgttggttctcccattcgtccttccgttgcgcagccgggctcacaactctcgttggcttcttcccgntggttcggcttatttcgacggttggccaattaatcaaatttcttttgaatcaaaacgaattttcgtacag

SEQ ID NO: 13636 - DNA, 1786 bp, Heterodera glycines
tggcaaaactgcagcagaaacagaacgtaaaggtagtcagtcaaaacagcggcggaatggggtggcacaattgcacaacaaaaagcgaaatttgcacaaaaaaagaatggaatggaatgatgaaaatggcacattcggtcaaaatggcacagccaaaacaatgaatggtactgcacacattttgatcatcattttagcgagacgaggtggaaaaactgtgcaacgaaattgaacaattgcgagcgatgagtgtgaaggccggcgtaacaccgtattggaacacggaaggagcccagggtacggtagcgaaggggggcaaagaggaggagcaaccgcaacagaacggacggggcagcaaaaagagttgggtgagtaacaaagggcaaaaggcttaggggtgcaatttaaatttgaaatttaattctaaaatattgaaaataaaatttgcaactttaatgagaattaactcttaattaaattgcaacaaattaagaaaaacaatgtggacactcaggttagcaaaagaaaaagcaaaagttagtgtggtaaataaagtggaaatgtgccgtgtttggtgctaattggtgtacataattgagcagttaattttgataattagaccataaaaaacaacacaacaattagaagtttttattttaaactgcatccaatttattattaatttttttgttgtcactttggtgtttagtccgataaataaatgaatacttaattaattaattgttaataataaattctgttctgctaccgttcagattcgaagttcattcagccgcgcctttcacaaaggcaacaaaaagagcaagcagcaacagcagaaggagaacaacgacgccgcggacaacaactcgctcaattcgttctcctccttcgcccattccaatcccagcaaaagtgccaatgccatcagttcgtcttcgtccgtttcggtgacctccaaaaaatggacaccggccaacacagacggcaattgggcgagctgagtcaggtggaaatggcacttttgcagcgcgagttggacaacagagaagttggcattgaccgatgtgcaattggacgcactggacaaggccaaagagattgacattctgcgggagactgtcaacagactccaggtgggttacggtgtctcaatgtacgataattttatttttacagtaacccaaacggcacataagttaattcttggttttatgccttttctgtttagcatgaaaacaaactgctcaagtacaactactccctcttggagcgcaaagtccgctcggagtcgcggacgagttcgcacctgtcattgaacaccaccggcatcgccgggggcggcgcgttggagtttgacgcggtcgtgcaggacgaggtgccttgctattattgttgctctaaaaggtgcctttttgttgaaggtgctcgctgaggctagcgaacagcttgcgcccccctacgaattcgccgcctcgtcgccctccagcggcgatatttctgtcaacacgacgaccaccggcagcaacaactccgccggcggtaccacaccgttcattcccccacccgccgatctcgcggccacaaaatcggtgaaccgttgcagcttcgcctcctccacgacgacttcgtccaaacgtatgccatttggccattttcctattttctgaccctttcccatctcggcgttttcaggctcttcccacggcgctttgtccacggcactgccctcagccaaggtcgtcctctgcgttgacttgagcgggcgtgtcgactcgctcagtca

SEQ ID NO: 13637 - DNA, 1671 bp, Heterodera glycines
aaaattggctaatatgtaaaattgcgtccagaaatttttagactatccgaagcaaagcacgaatgaattaaataggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtagaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaatttgcggtcacaaataaaataaaaattggctaatatgtaaaattggcgtccagaaatttttagactaatccgaaaagcacgatgtaaagagtcgaaagaattcacagtatcgtttctaatagagaaatatgcttacatgatactcataaaaactacaatgatcatttttcccacctttttatgaccacatttgaaaaaattcggaaggacgaggaaagatatgcttgatgcctcattaaaataaaaaatggttagtatgtcgaaaatttgcgttacataataataataaaaaatactaataattcaaactacctattctatgaccacatttagactaatccgaagcaaagcacgaatgaatattaaagaggcgaaagaattcacagtatcgtttctaatagggaaatattgacaggatattcggctaaaaacgggtttgatcatttttagcgc

SEQ ID NO: 13638 - DNA, 1466 bp, Heterodera glycines
aaaaaaggagacaattataatgggaaatgaatagtaaagaaattaaagtaagaataatatacaagaatccgatttctcgtggggacccggcaggaccatggtcgaagcggatgatattgtaagaaaaaatttttagaacaaaatttcccaaaaaatcaatttagaaacaaaaagaaattttggcccactatgtgggccaaaaatgaaggctcttcggaaccaagtagactactatgagaacagagagggtcctcagatcaatgtgaccccaatggggggaatgctataattgtgactggggccgatggggtgccgccgattggtgcagaggtacaatgaaaataaaaattcaaaaaaacaagaagcgaagaaaaaacaggaaagagttagaggggaagaagaatacttcctcttctttgcgagaattgggggacagcaacgacgggacgaggacatgcaaagcgtggtagggaaaatgaaatatacattcaaaaaaaaattaaaattaattaaacaaaggagggatcagttgcaagcaccaccacaagcaagagaacgaataggagcagtggaaaaagaaagagagagaaggtgagagcggcgaagaagcttagaggggttgaggacgaggaggaaggggaagaaacacttgcatttttttgaaaagggggaatttaaaaaaatgtttttttttgatatcgatcaaaaatcatctgttaactttttttattaatgttgaataaaaatttaaaaaaataaagtgcaaaaaaaatattaaaaaataagctgtgaatggattacataaaaatataaatcggctgggaattgaaaagaattaaaatcaaaaaaagggggtgttggaaaaatacgttagtaaaattttaattacaaaaaaagaaaaaaagaaatcaatttgagacgctaaaaagttgttgagttttgggctgtatgagtccactcttcagcagattgcgctgtgtgcgatagagaacgaaaaggaagagagaaaaaagagagagaaagagagagagagaagaaaagaaaacaacataagtgtgggggagagaaaaagagaaaaaatgacacacacacacacaccgtccactcaataattgagcaaagaatgctcactctcccttcactaatcccaccgcccgccaacgttcgctgaccagcagcagccaacgacgccaaactttatcgaattaaattttatgtaaaatatccaatgccgtcgaaatgtagaaattttattaataaaaattacagtttaattaggaaaaaatttatttaaaaaaattacagtataatgaggaaaaagtgcggaaaataaacaccccacacccaccggtttaaaaaaattttttttaaatacagtaccccgaaaaagatgcgcgaaaaattttgcgcgaaaatgggccccggatacctgccggtaacagctgttttcacacctgtcaacgcac

SEQ ID NO: 13639 - DNA, 2976 bp, Heterodera glycines
aaaaaaagtaaaattttgcttttctagtatttttcgaaaatatcccatgcctaaaataaatatattttaaagtaaaataaataaacaaaaagacctaaaacatataaaatgaatggtaacaaaataataaatcattgtaattatacatcaataattttgcctctaaaaatcatagacttatgaaaatcatttgtagaaggagttttgggtcactttataagtgattttctcgacaaaattcattgaaataaaacacttaaaatagctaaaagataagagattggctaattaaaccaaaaaaaaaaaatcaaacataaaaacgtcattttattcaagttctaaggaactactatttaacgaataaaatgaaataaattattatagatttaacttaaccaatatataaaaaatcgatcgattacaaattttaaattgatacatgcaccagcaagaataattaagaattgcttgagcattgattttcatttttaaaaaacaatattaaataaataataaaaaataaagacataaaaatgtattcgtttaaggagtaaatccaccgattgaatcagttcgacttattggcacctacagcagggctgcaaattacaatagaaattaattaaatatttgcctattaaaagagagtattttaataaaaaaaagaaaaaaaatttaccatatagaaaatgagaaaagctaataaaatgcttttcaactaaatgtaattacttgcaaaacgtgtaaataataaaacaataatgaacaaaataataaattttatgttcaacaagttttattatttaaataagtgcttaaaaaaggcgaaataagtgcgaaaataagcatgaaaaaattcaaaatgtagaggtgaaatttgttaaaattgctgttttctttatgttaattagttaaaattaagtcaaacaattttatttactggttgcagttagaaatgaagtacatttagaaattttcaggatttaagggtcgattctcaggggtgtatttttccgaatttttttttgtcgattcttatgggtgtatttttcgtttttattgcatttttgttaataaatttccaaaaaatcgcgaaataagaacgaaatcgaataagtgcgttaaaacgcaaaattttcgaaccgaacaaaaaatgtgtttttcgtacatttctcgttgagttaatggcgcagaaaaaataagcaaaaacttataaatcccagccccaataatcaaataattaattatatgttttaaatgtatattataaaaattaaattaaaagatacttttattgataatataaatttataatagtaataaatgttaatttctcatttatattggttacacaaagtgaaccgaagtcgtctagactagggtaagccccgaaccctcggggggcaaaaagtcggaggccgtggacctcgggggggggcgacatgtcgggggtcggggcggggaaaaagactacaaaaatactttaaaaaaaagttcatgggtcaagggaatcgattaatgtgctaagtgtgaatgatatttatgagagtcgggaggttgtcaaagaaattgaagcgaaggagatgaggaaggagcgaaagatattaaagagaatttttgattcaatttcataaaacttatgcttttcttttctctaattccaaaaaggaaaattagagcaatttaaagtatataaaaaaatagtttgtttttttaattaaatttttatttaaatttgaaaattgaaataaaatctatattcatacaatatttaagacatgtttgagataatatgatattttaaaaataaaactattccttaaaagataacaagaaattttaggaaactgaataaaccagttaacattttttgaaacaaaaagtaattaacggtaaaatttacatttattgtgaacaaaaaataataattattaaaacttattttcagacttttgttttattgtagtctatttcaaattttacattttggtaccattcgatagccaagctttttcaaatatatattccaatttgcaaaatgaattaaagggggggggggggtaaattttaaatgatcaacgtttgatatttatttattacaattgtatattaactatgtattattcattcttctttatattgtcgttttggttatagttccaattattctttttaaattagaaattttattacattattgatttaaaaattattatttttcctccttctcattaattagatgttaaataattatgtctatttaaatattagttgttttctataaatttgatagtttcatttttttttattgaaattaaaaaaatattacttaaagcgattttattttaacaatttaaaaataatcattattgcattaaacattaccaagctcaacaatcctttttgcataggctaaattttaattttttaaaaactaaaataattcaatttataaaatttattatcattatcattctgaagttttactataataagaattaacataaaacatttaattttctttaacaaaatgaaaattaattttacattgaattaatttatttgctttctgctatttgataaaaaaactaaaaaaaaaatgatgcagacattaccatagattaaaaatttctcgctaaattgattttttgttttaaatattatgacaaacatttcttgtaatataattttttttaaatttccaaatatcaacattacttattttcaatttttctatgtttatttctttttcattgataaacaatctttttcggaaaaattcaataaataggtttttagttttattaaaattatttatttattaactaaaacaattttaaaatagcatattaaaattttattttcggtaaatatttttgtttttaacaattatttattcaaaatgatcagtttcgaaagtcggcttctgcaagtatgaggaaataagttttttctaaattatactttaaaagtaaa

SEQ ID NO: 13640 - DNA, 4421 bp, Heterodera glycines
aaatttctaaaaattcacgcagctttccattaaaaaaatcctcccccggggttgtgtttaccgattatctgaagaaaatggtcctctgtgcttttgtcacggacggtacagcaaataagcgcgacaacgccgccggggacactttccacacagagcaaaagtcggagaagttgagcaaaaggagggaaaagagacgggtcgaaagtcacatctgaaaatgggggagaaatgggcaaataaatttaaaaaaacatggtaataaaatgcagtgaaaacataaaatttatgtgttggtcttcaataaatcccatcccttctccgtttgtttacccgcagcgattattaattcggcgtccctcggcagtgtccgccgttcgaagtccgtccaatccaatcgctcaacggaaaccgctgatcgtgagctccgggaacagtcgaaattcagtgccacattctctcgcaattgtcggagaacggccggatgtgcgtcggagagagtgacttttgccgaggcattcgaagcagcgaaggaaatgccagcgaggccacagccggcgcccaattccaaggcatgagaaacatttgaaaaggcgacagaatggggcgaattcgcgaaaaaattggcaaaagcgaacgatgccttaagggaaaagccaaaagtgtgttaaagacattttgccaattggctactgaccccccaacaactgagtcccgtcgtcccatgcgaaatgtgttgcactctctgtttgagcaaaatgtaaggagctttggacaaatccgagtcgaagagattggggaaaatgcggaagaaacattcgtcttggccatcttctgagtcggaagccatcgaagcacaaagcgactcataaagaacatcactcggatcaaattggaactcattcatctgaaaaatgcgtcaatttgttggttattcaacggatggatcatgccctggcaattagtcgcttcagaagtgccctgaaccattcactctttggcgggaagcgaacactcgccggagaacggaagaccaacgcgtccaaattcgggaattgttgcatttgtttcaaaaatttgtccagtttttccacggtgatcggcgaagaagcaaaaaaggaggaaagaaacgcacggaaagtgacattttcagtgagttcagtcggaagagtttccgcgagaagcggcggacggaaggaatttggaagagatcggagagcggtgaagagtccgctgtttggccgacttggaagatgagtcgacatctgacgggcaaaaagcgatgctcaattccaaaaacggactaaaaccgaccgaaggaagaacgaggaggcaaataaaagggacggtcgtagggaatttggtaatgacaggcgatttccagacgcttttcggcttccttcagcaattcactaatcttttcagggtccttctccttaagatgatacgattgggttttttagtctttatttctctttaattacgtttttgtacgctttgaaccctttttgggcctcttctctgatgtatttttgttcttcgtttgtgttcgtcggttcttgggccacccaatcctttgaaaggcgaattatgcgtcggtataatcgtaaaacttcacttcttttgttcatagaaaatcttaaaagataaaaactctattagcatatccagattcacaaagatttgactacctgcaaaaaaaaagttataaaaaatgaaaatattttgactttttttcggcgctacttgcccgcctgtttttaatgttttttctctttggcgtaaaaaacaaattcccactttttttatattcgaatttttttttactaaaaaattgataatttaataattttaataatacataatccttctttcatttccaagcctaacaaaattatttgatattttatgggctttcatttgctttagcatcgtttgctcttcgattgttggccatattttgtttgatgagattcgatttctcgagtgttttcacccattttaacccatagtttcactgtcatgaaaattggacatcggaccccgccgaggcagaaaagagccactgaccctcccccacagttcgattcttccgatttgggctctccgcaaaaggttcttaacttgaataatttgaatgcatataacaaaataataataattgcatcaacaaattaaggtttggtcactgttatgcgagaaggacgagaaattgcgccgagatccgcacgtattttcgcgccagaagaaaataaacgccaaaatgcgtgccatgctgctcgactggctgatggacgtgagcggaattgtcattaattagcagtcaattaacgcgagaccaaattgaaaaggtctgtgccgacaaacagctccaccgcgaaactttccatctttgcatcgattacatcgaccgtttcatcgcattgagtgaccaccaaatgcagccccagcgattgcaactgttcggctccaccgccctggtaattgcgagcaaagtcgaggtccgtttgtcttttccgaagctttttcccaacgacgaaatttccaggaaatttatcctccgaaaattgcggagattgccgaatacacggacgggtcagtccctcattttgttgggattgaattccgaattgtattcagctgttgttctgaggctgacattcgaggcatcgaagagattatgctggagaagttggattggacgtgttatccggtgaccgctgtccattggctcgcacttttcatgcagctgatgaacacggacgaagtgatccccgcccagcgagtggtcatttcagccggttggtcgtcttctaacagacaaaaatgattaacacattggaaataattgggcctaatggccgtttgcctttgtgtcgctcgtattttccttttattggcactttctctcattgtcaggcaaacggccgctagacactccgtcactcaacggcgactcttcgttcgtcatcggtaaaccgtcgctggaggtgagcattgagtcggcactgcccaacgacgagaacaatcagccggacgatgcccagcgggcggagtcgcgtccttccgtgccgtccgtttcgtccccgtgcccttcgccctcttcttgcgcagttggcgaagatgttcagctcgaggttggagtgttcgtccatttattgtttgttcctctacaaatgtgcccatttccaggtttcgtccgtcgttttcgccggtgcgtcgcgcgtccgtcgcatttccttcagttgcgcctatccgcggatgcaactttgccacattggctcctccccacgcgtgctgctgcacaccacgctagcggacattagttacgtcggccataattcgtacagcagtggccacatttacccggaccagcgctgcaccgtgccgaaacttatgcggggcgaattcgtccgaatggccgcggtaaaatcttgcaattttttccgcttttccatggcgaaatcatagtttaagtaacaaaaagggggagtttgtacagtttcgtggtgatgtttcagattttggacttggccatgctcgactcgggctgtcttcgcttccgttacagtgaattggccactgctgtggtcctttgctgctatgagcccgaacatttgatttgccaactcaccggtgccgccccgaccgattgattgcccttcataaatatttctttcctttaggtttttcgcctgaaaaggtgcgcgatgcccgcgcttacattgagccgttcgtccgcgtgttcgacctcagcgagcccaccggcacagccattccttgcctggcggacgtgccccacggcgaccgacacaacattcaaacgtacacatcgaagtgtctcgaacatttggtgagcgaaaaccccttatggagatgggaccttccgaaaaacttttttgtaaccaaaaagaggcctggtccgttactattagcctggtctactctttggcaatctttttttcgttgctccgttttttacctataatttatcatttttaggagactgtgcagcaaattcgaaaagagactgagtcgcgtcgcaaggcggtggaattacgggtcgcggctcgggtgcgcaaacgcaaattcggctcggcaatgaatctctaatgatattcatcaataaatatctaatttattctcttatttcatctctttctcacacggaaaaatttgccatgtgtaaattgtttgtctgcgattgttttggatcgaactttcgctactggcttttgattccaatcccacagctacggaaattgtcaggctcacaaccagcagttttttattagtaaaatgcggtgattacaaaataaaatttacacaagaaaaaatggtaatttcgtgacttatacgttttgagcaaggatgactgagaaaaaaaatgagtgggtgtaaacggacataaaatcagcacaaat

SEQ ID NO: 13641 - DNA, 2112 bp, Heterodera glycines
cataaaacaactggggaaaatggacacggaattggatgggttaatctggcaaattgatgcaaggttatagtcaactattaatagaatgaggaaatccttgctaatcgttttcataaatttaaaattcttttattaaaattggataaaagaaaaagcaccccacccctccataaatttaccttattagaatctcagaaaatgcacgtttgaataaatgaatttatgtaataatgggataaatttttaatatttcatttttgtaggtgtttctcgttaattgaatattctcaataactaacattttttaagttaattaatttttcaaaattttgtacaaatattttatattttttgtcaatttatttgaatgaattgaattgaatttattttatttattttaaaatttaatttttttgaagaaatcctctgcaaaattcgcgtccgtttgggcttatcattgtaaatttacagatttgcgagaaaataaaaataatagccgagaaaacattttggaccttttactaatcgaagaccgaaacgaatttttgcgacaaatatttggtgaaaaggaaaaatttgatacaaaaaataatgaaacaaaaattgaggaaacattggaagaattgttaaatgaagaaaagaaaaagaagaaaaacaaaagaaacaaaaagaaaaatggaaaagaaaaaatcgataaatcaataaaaaacacaacaaacacagagacgaaaaacagtggggagggcagagaaggagaagagggcagagaccgagaggaagaaaaaaatgttattgaaaagagaaaaggggaagaaattggaaattgtgaaagtgataattattcaaaattggatggaaacaaaaatggaaatacaacggacgaacaaatgacggcgaaaatgccaacaaatgatgcaattcaggctaaagaattggacaaatttggcacatttagaggttgttaaaaagtttaataaattaaagagattttcaaattacagtgaataagtcagtgatgacattttttgatcaaatttttacatacatcaaaaattaggacaaatgcagctttcaacatgtttaatttctaaaattctcagacaagaaacctgctgctatgaaccttattaatctaaatttttgttttaacattttttttacaaaatacttaaaacctaaggttattttttgatttctaaataaaagttaaacattaatcaaaattcaattatagtagtgtaaggaagaagctggctgggcggttaaaacgcggaaagcggggttgataagatcaataaaagaaagggcggatgtgcctcggtagcttaatggttgagctgcccacgaaagggtccatgagtgggttcgattcccacccgaggtttaacattttgcccatttcttattgtagattataaaaataggggctttcaggtgtgaggatttggccttgcgaggtcgatgtggctaaatttcaaatgaggaattcaggcttttgtggagtttcaagattttatgaatctttttaacacctcataaactattcatttttgtgcaaaattttgttaaaaatccgtctaaaactcaaaaaactttcccctgcggcgcccgtgctgggtcgtttcttaaaaactgccaagttgtaggaaaataaaaaatgtaagacatgtaaattcataaattggccaatttcaacctaattaatatttcatgtgtcattcaatagctttatgtgttatttatcagaatattaattttcaaaatttttaaattagtataaaaaaacttatggttattaaattccacaaaatcataagtcagaattttttgttgataacttttttgaaactcaatgaaattttttgaaattttaaagataaatagagaattcttagagctaccgaatgatattaataagtttggctaaattgcattttatgactagaaaatttaaatgtttataattatattcgcatggccatggtaaaaaacatagtatgttcaatgctttataactttttttcagaagcaatgagattaaattttctttttaggatttaatgtcctcttttaatcaatatttttaaatttcaaaaaatttaactgggtttt

SEQ ID NO: 13642 - DNA, 2095 bp, Heterodera glycines
gggctggccgctgatttgaatttcccgatcacgggaaaatcccgtgagccgtgatcacaggggctttttaaaaaaaaatcccgtgacccgtgaaacccgtgatcacgggcttcccccaaaatatcctcgtgatttccgtgatccgtgatccgtgattataaaaaaaaaatttctaatgattttttatttaaatttatttaaaaaacggaatttaatcgcgggaaaaattcccaaaaaatgttttaaagaaaccaaaaccatataaaccgctttttttgcggcgaccttttccaaaaaatgactaagtttacgatttttggcaattttttgaggaaaattagagctttttgtagaaatctccaaggaaaatttgttatttttaactaatttattaagaaaatttttcttaaatttaaccaaaaatctatttatgtagagaaaaaaatttctctaagctaacttttgatgctgaaaaaatcttttggaccaacatgctcagtccttcatgacgatctgaacaccccaaaagatactgaaagtcgggaaaattttagaaaaaattcttagagggttgggaaaattttctgaaaattttgattaggcctgtcgttttaaatttaagcgacggagagaaaaatagggtttttagcagtttatatgccaaaaatggtaatttttctgccattttggtgtcaaaatttcaaaaatacggtaaaatgggggtccgtctgccggtggtgccgacaggcgccgccgggaaaaattttgaaattttgagtgaatttgttaacagtttttttccaaaatatgtccaatcattggttaatttattggtctatggacgttttaaaaaataaagaaaaataattttcaatgttatgaaatttcttgttaattaaatttcaattaaaattatcaaaacaaattatataaattgtcctatcccaatggggaattgaacccaagggacagacaacgaaagacagaaggcttaaccaccagactacatatatatgtttattttctaatttgtaagcagaaaagagtttatttatttttctcaaaaaattcttcacaccactttcctattttcgtctcaataaaaattccctatataaaatgccaatcacggatcaaaatcacggaaaatttgaaaaaatccgtgacccgtgatccgagatcacggcaccccaaaaaccccgtgatttccgtgatccgtgagccgtgatccgtgatcacggccagccctggtactgacgaggccaactctttcactcattttttcaatttttttttttttttgcaattttctgtaaactttttctattaccccggtataacttcttcactaatttaaacacttgttcataattattgattaattcttttgttttttttaaatttattattatcttttctcgtaattcaattttttcattaattatttgttcagtgggaaatgcaaaccctaaaaagctcgtgaattcaattgatttgccaatttatcatttcaattctgtgtaatccacccaaaaccctcaatggcccattgattattgaattattgaagaatcttttatttgaaattattttattaatatttatgtcatcacaacagttaggtttttattaatccagctaaactaataataataataaaaaaagattttctataatttatgcaaatatcacgatcatttttcaatcacagagcattaaaataagtttgctttaaacatttcaaaagcataaattaacaatttctaaaatgtttctctatttttcattctttttatgccattaaaacagggagcgtatttgtccttggatgccaaggatgtccttggaaatgagcattagaaaaaaacattcgaaatactacaattttttgaaattttctacctattttttaaaattaacttatggcatgaaatgatgaaaaaaattagcggaaaaaaatctttgaaaaaatctattctggtgaaaatataaaccatttgaataaattttaaccaattttttaatgtccttgggtttcttaaaatttgttcgttatgtccttgtaaatcagtatacctgtccttggaaagagagt

SEQ ID NO: 13643 - DNA, 4530 bp, Heterodera glycines
cttatgacatttttattctatagagaaataaatcttcctctagatataaaaaaataataataaattcaaaaataatttttaatttgttacttgattttctaataatttataaatcttagccttttttgtgtttttgtttataagtgaatcagtataccaaaaataatttaataattttttaaaaggaattaacaaaaaaaaatttgagaatttttgtattttttttatattttggttcttagaacacatcttactaaaaaactcagggaaatattaaaaagaattagttagagtaaaataaataaaatcatagtcattcaattaaatttcttttagttttttcttcgaatttaacacaataatatctacaattaaaaatgcttttaaatattgcgttaaaaagaattgaataaagcttttaaaattcactcactaatttattgaatttctccaaaaaactgaagatttttttaaaaataatttcttaaataaatatcatttaaataaacacaaaaataatttaacattatttcatttactgaaaattaaattaacaaaaaaagatttatttgagtcgcaaattttatatcaatttaaaatctgggaaattgttttaaaatttgaaagggatttttttggtacaaaatatttgattctccatgattaattaacaaatacaaatttttataattatcattaataaaaatttgcgtattaaataaatcctttaaaaggaatatatcgatttatttattcatataaatgcattttatatagatttttacgatacaaatttcaaacaaacaaaaacacgtataaagctacttaaaatatttgctagaagaataaataaattcttaagaaaattagccgaaacttatttaatctaattcattcaaataaataattaaagaattatttgacaatgaaaaatggaaatttatatttgacacaaaagataataaacgaattataaagaaataaagtaatcaaaaaagaagaattgactaattataacttatttgctccaccttaccatattaatgaaatagtgataaggaatacaaagaaaatattaaatgaattaaaaaaaatggaattatcaagaaaaaacagataatattcttataataatacaattaatttggtttttaattaaactcaaaaatttgtttattttaagttagtaattgaaaaaatgaaatgaaaagcttaaattaagacataataatgttttatgaatttgtaaaataaaaaaaaaaacaaatataataaaatttttattaatatgaatttcaaagaaaaaatctttagcaaataataacaacatttacagaattttataccacacacaaaatatgttaacatagttttttggaataaatgaattaaataataatttagaaaaattctcatcatgtttaataaaataaccctttattaattgtgaagtaaatgaaaataaataaaaaataaaacagaataaactataaaaatagaaatctttattcttaatcatttattgttattcataatattaacttcataaaatttaaagagagaaagcgccaagagccattatgattccgaggaaccatgaagaaacaaacatgaaaatagatttaaataaaaacagattaaaattaattaacaattataaacaatattatatatttaattatattattaaaagaaataacatattttgaaatgctcattaaaagttacatccgaatataataaacaaaacaaaaataatttcatttgataatataattaatttaataatgcattaaataattaaatttattttatttattcggttctattttcatattaaacttgtcaaatgtttataaggaaaatataaataaaaaacaaaattataaattaaaaaattctcaaaaaagaaaattaagataatactttgtaattttacatgtgaattaaaatatgtaccgaatttatttctttacaaacaaaattttgtcattatttttggatatgaaagaaattggattttaagaattaaaaaagggagtattaacttgaaaagaatcatattcataactttgtttttattaataattaagaagaaaaaatgaatttgatttaaataaagaaaagcataaaagataacaaaacaaatgtttatgtgctttttatatatttaccaaaattattaattaacaatttattagaaataaacaaaggttaaattattgttaaaaatgaataatgatccgcccccaaatatgagaatctgaacatgatgataaatagatttaataaagcaaattttttaagagaaatcacaataaagattaataaaaatatatatatataaaattaacataactaattgttactcagtaagaattgtttgctaaatttaacttacaatttactaatattattcttattttttttttggagaaaaggaattataaatctaatggaaataataactacctttttaaaaaatttaattcaacgatcgtaaattcttgaatgtaaacatgatttgattaaaatactaatgttcaataacaactttagaaattttcataaaaaattactggtggatgagacaaaaaatcacaaaaattttccctgataattagggttataattgtatgatttttttctggaaacgggttatttttctcaaaaaactcctttcaaaattccaatttcccattcgacgctgccctaaaccttaaattttctttaaaaaaagattggctcaaaatcaccaatggattaatttttagacagaatcttttggcaagttgcacataaattttcgattatcaggaggcacctatcgaccaccggcccacctcctgttcttcaatttggacacccccccccccagtcccatcgcaaattttgtgtgcaccgggacgcaccggaatttttattaatttttatttgaaaatttaaagttttttaaaaatatggaaattttaaaaattggaaaaagcagagaattccaaatccttttataaatacctttctactaagcattttatcttggtttgatgatcctagatctttgcttattcaacattttcgtacctaatgaataggcttgtaaattatatggattaacatattttttctgcgcatatgctatgaagaaaggggctcaaaaatagtattaaagagaaaaattttgaattttttgtaagaacttttggaaaaaaattgttgatataagaaaaatgtaattttgttttagcatatgataaaaattaaaaaaattcgaaattgcatatataaatttagaaaatcaaaatttttgcaattctctaaaaacgcgccttagctatttattgtttttgatgtttttaagtcaattctgtatttttgcaaaagttttttgcgtagatttttagggctgtattttttcaaaaatttttgcgttgatttttagcggtgtatttttgaaaaattttttggccgattcttaggggtgtatttttccttttcattgcatttgcaaaacgtcaaaataggtgaaaataagtttttacaaaatattttatgtttttaggtgctaaaaataaaaaccctaaaaataggtgctaataactcgaaaagtagcttaacaaccccccaaaaaacaaaattgacgacttttttttgtttagtttttcaaagagctttttttttctctgcgcgtttttttcaaaaaaattctgggttacagggagggtcaggcggtgccaataggcgccgccgcgaaaatttgaaatcttgggtgaaatttgttaacaaattttctaaaaaaatgaccaatcattgattaattggattttttggctattttaaaaataaagaaaaaataatttttaaattttacaattaattaaatttcaattaaaaaaatttcgagaatgggaaaacgaatttgtgcgggacgatattcccgaatgggactaccgtatttttttcccgttccagtaaaaatcccgccagggaaaaagacggaaaacgggaccgggattcccaggttttcatgcgggatatttaaaaaacaataattaaagcagcaaattaagtaaaaattctataaaataaaattcgggcttatgtgttagaaccttaatgaacatcacaacagcaaactacagtttgcaacacttgaccacaatacttctagtgagatgttgcattttttttaccaaaaaagtcattcttaaaattggccagatattattaataaaaagaaaaaatctaagcatttgttatttaatgagaaataattttttattatctcacaattaacatttaaacataatgtatgaagtttattaaaaaaattttgtgaattcaaaataatttgtcgcttttttttgtctcaaaaatttatggattaagattagggttcctccccgagcctcggggagcaaaatgtcggggaacggggaggaaattcaccgaaagaatttgtcggggatggctggagaaatttaaaaaatgtcggggagcaacaccttcgtcggggaggaaattttcataaaa

SEQ ID NO: 13644 - DNA, 1629 bp, Heterodera glycines
gtcgcattgtacgaaatgtgccatttcccaccccgggcaccaaaaatggcgacggtgcgcgttggctccctttggatagaacggtggtagacaatcgctgtttgcccaggaggcaagcgccggcggacaaagcgccggagggactgccgccctcgaggggtgccgtacttttgccataagcccaacggaacagaaggtccaggcaacggcaccgccgcagcaaataaaccaattgggcacggtaccttaaaatgtgcggtaaaggtggggatactgtggggaatgggagacgtaaagggtatacggtggaagggtaaaataccacaattgaaagttgggatgtatgtttgctataaatggctctgacaaagtcatgccgttttccattttagggggtgcgaatttaaaaagattggcattttcgttgggtttggcattggcatttttaaaaaaccttgaagagaattgggcataaaatacgaaggaggaggaggcgttgagaacgattaaaatgttgttgacatcgttgagcaaataaccaatttgagaacggaaaagggcgggcagaacgatttccaacacgttaaggcaaaaggacagcgaatagcagaagagaaacactgaaagggaggcgaaacattacgagtgattagtgagtggcagggaaagcctttgatcattccgcctaattagtcacgataattgtcaaggtcattcattaggcatttgattaagcggcacaaatgcgagcaattaacaaaataatgccccaataattgctcttattttgaagaaaaaaactaagaaatcctgcccaattagacacaaacaaataattgccagctcacccaacacaaccattagcatcattttggccgttttgtgctctctccgttccgccgcgctcagttcggcccacatttctcgcctttgctccaccgccaccaaaattgttctcgccaccttaaagaaacaatttaaaaaaaattggcatttttaattcgaaattttagttttttaattttctcattcatttcgccgccttttgccattgccttctttcccacctgaaaattcaatgcacaaagcacacaaagcggcaccagaaactgtgacagcattgtggccacgttttggtagagcaacatgtacaggtaattctcgcgcaacagtccgaccaccggcggcatttgctcatttttggcgtcggtgccgtcgccatcggacgaattgttgatacggtactcccaaaaacggatcaaattgtagcacacggaaaagaccaaaatggcaacgatggtcagctgggcacggcgcctgaacggcgaacggggaaaataataatcgaatttgccaattcgatgacagagagaagcagggaaattcacagttaaaaaattacatgactaatgagcctaattgcctcttaattagctttattttgtgccacttacacagtgcaatggatgcgcacagtgaacggataacaaatggcgatgaagcggtccaccgtaatgccgaccaaaatccacacggacatcgtctgggccatcagagtgaccgggtacagaacacaacaggtggctggtaacgcgggcggagtgctggcaacgaagggcaatcattaat

SEQ ID NO: 13645 - DNA, 1168 bp, Heterodera glycines
aaatttacatttgaaaggtatttttaattaaaaagaactcaaaatgactaaaggtacggaaagccaaagaatgacgggtcgggacggcactccccgaaatacacacaatgtattcatttttctcctcacttccgccgttggcagcatctcgtgatgggggagcgaatctccgcactgattaatgagggacttctttagtggggtaattaaagaagggaaattagggaggcgtgggggataagtgggccatcaaattgccaaattggctaagggatgcgctggaattgttaattcgccaatttgccagtgaaatgtccaagccgaacttaagctcgtaattcactgctgatcagacaaatggaagcaacagaaaatggaaaagcgaaaatttatggacggaatgacaaaaattcttgtttttatttgtgatttttggcaatttcaaaaattcttttgcctttgattttttcattgactgtcaagaaaataatgccaatttccaattgtcttccattttttccatctgttcggctgacctttcgcttttgcctcgaaatttgacgcctttggcaattcattggtactcatttgagaatttaattaactatttcttaactttttgttcgttttattaacgaatgagtgaaaagtgcccgggggaaaatgcgatggcattggcacggaggaaaagggggagggacaacgacgacagagcgggaccgcacaaagacggcattcatatggcagtaaagagagagcgcatgggcgggataatccgggaaagtgacacccctgcggggctataattattccgggagtgaatctcgtgcaacaaaattgttgtgaccaaaaattgccggggcatttttgcgccatttccatttgacaccattcgcattgcaattagtacactttccatttcaatgcaactttattttccaaatttggcaactttttaagatattaggagaattgaaaaaaattcaatatgacggacatttttggaactaaattaaaattttccctcgggaatttcctcaaatttattaaaaaatactccaacattttatttatttggttgaatgtatatttaattattataaggccaaggtataaaagtaaagaaacatttacgtcaaaggaaagggaaaagcgcgggaaaatgaaa

SEQ ID NO: 13646 - DNA, 2483 bp, Heterodera glycines
aaatctgaattttaatgttttttgtcctgaatttgaaaaaaaaaaatttgggagccctgttttacaacattaaaaatgaagagatagtacgccaaagtgagagagaaattgaaagaaaaagagaaacgacgagatagtatgtgctaggcttttctctgcacagcggagttaacccaaagtgcgcatacctatgtatataaaaggaattaatttgctcttctttttcatcatttctttttgccctctgatcatcctacagtttttcccctttaatttcattattttttttgctaaataatttctaaaatgataaatttttgctcaaagcattattatattttctttgcatgtactgataaatgtgtttcggtcgaaaagagaagaaaaagcggcccaattcgcctgcttacgacaaaaaagtgggttttgtccacgccgccatttctttttgcgctttttcattccctttttctgttaagcccgtccatccgtctgccgcgcgtgtcgtcgtttctcccactccaatcgctctctcgggcccttcctcgtctgctccgccttcgcttgttcctcgtactgctccaacttctgctgctccgagcgcgccgaacaaaaaagccgacttaggcaaagtgaataatattcctgttgtttttcggcatattccctcgtcacaatctcatcttttttctgtcttaaggctgtcgtccgtccttcacgtccttcgggcccgaccaaaccactcaaatcaaccgcagtgagcacagcgcggcgctttttccaataatttttgcatttgtttgattgcccccatcataagatctctccggtgggccttccgcatccgaaaaagggcgttagcgcgggaatagtgagttttgttttgcgcttttcctttttaaattcctattattaatacgtttcaggatgttccaacttctctgtattcagcggacccaattgattgtgcaaaaacaaccaaagggaaaaaagtgcgttgtttcttgtttcttcgtcttgtcttcatatttgcttccgcttccttaattaaggctgtttcgcgtcctccgccgccgtcgtcgggcaaaaaagcggatgcaaaaaccaaagtgagattcactgacgaagattctttttgccgttgttgttttcgaatccacgaactttttttctttaaggctgtctctcgtcctccaccaccaccggccaagaaaacagataaaggcaaagtgcgtttaattgggcaatcgtcaagaattggtaattcgttttttaaaaggtcgttcttccgccgcgtcgtcctccgccttcggataagaaaccattcgtcaaagccaaagtgagttcattcattttcgtcgtcatcatttttttatgaaatatgtattttggtttcctatcaattcatcgtaatttaaaatctgaaaattcgaaaatgaatttttatgggtcgggtcatagtgctttttactagatggtgctggacatgcacaaggacatcatgtatgctactaacccactcatcgcgggagatctccgactaacggaaatcgatgtgggcgaccattccggcgtctccgctgaagaagtaccagccaaaatggatgaatttttggaatggtttaacaccaacgagaacaccactaccatcacctcactaacagcggagattcattaccgccttgtaatgcatagattattattaaaaatgcattaatttgaaaagtacagaaaatatgctattaaagcattcttaatcttgaaaagcaaatttagtaaaatatataaaacaaaatagaaattaatgtacatacatttaattatcaactaaaaataattgtaattggatagcaaaatgcagttattgtccctttactcacccaatcaacatttagaccttcattcaccccttcgccgacggcaacgggcgctgttctcgttttttatctaattttgtgctggcccggttgacaaagagatgcggaaggaatataatgacgccctcacacatgctaacaaatccggaggccccggcgcccacacgcttgacctctcccgtttcactaatttatatgcccacctcatacagaatgcagagtttttctaatggataaatatttttggtctgggaactttaaaataacattttgccaaattcttattgcaatattaaaaaaaaacactgtattctgtatgagttctcagcatacttttctcatattatttctaatgtaatttcatatgttcccccccccccccccttcataaatataagttaatgtataaatataatttatccccccccccattcttattaatgatctaattaatttcatatccccgcctataattattttattttcatgtccctcccctctttgtatatatcccctaattaatgtattatcataccctttctccttataattaatgtatttccgtacccccccctcccattttcttatccattctaaattaatttt

SEQ ID NO: 13647 - DNA, 1050 bp, Heterodera glycines
catcgacggagcagcagtgggctgagcactgaaatagtcatcgacgcaatggcaaatgccattcgggtaaaaaaatgtttggagtttttaataactattttctgttctatctactataccatgttttgggggttgccatatgaaatgttatgggagcaggacaaaacgtcgccggccgaaacatctacggtacaaaacttcgcatgaaagtttttatagcgcttgtgccatatcacatttcgaattagcaatgcccattttctcggactcgtggtcacggaacgatttgtgagaccaaccctctttcctattccgttttaggctgcccctcctctttctcgcttccccttcatggaaaagaaaaacactgtgaccaaagtgagtttttcggatttgcatttcctttttttctcaattttcccttcattgtttaagattgtgcctccttcaatgctttcgaaaccgcagaaaattgaatcattcaaagtgagccaatcgtttttttgccatctttcccccaatttgcctgtcatttccttgtttaagccacagccatcgccgatgggccttccgcatccgaaaaaaggtgtccgcactggaattgtgagtttttgttttggggcgtttcaccggccccccccgtgaaaatttaaaaaagaaatttttactaacataaatttttaaagaaaaatcttataagttgttttcataagaaattctaaaaaaaattatttgagaaattttatagcgaattactaagattttcggaaaattttttcttagactttcctcatgaaaaaaaactaaaaaaattttaaaaatttcatggggtaagcgtagtacaacacactttgtttggctgtgtgttggtttaatgttttttgacaatcgatgtttaaggctgttcccacttcgatatgggcccccaacgatgatgacatgtacaagccgaagcagtacgaccagcaggagcagccgaagcaagcggagcgaccagcagcagcgcttaaaggctggccgacgacgacatttacaacccgaagcaataca

SEQ ID NO: 13648 - DNA, 1007 bp, Heterodera glycines
attcttttcatttttaaaaaaaaatttagttttaatatcctcaaaaataggcattttccttccatttaacaggcaagacaaaatcgatatccattagacaagttttgtttccgctttttgtgctaattaaaatgcaagattccgtcagttcattttgaaaaatcactggataattaacaaaattcaattagcaattaaagtcaattttttttagcagaaactcatcaatcagtgggcaacgaaaaactttgggcatttgattgatggaagagaaaaatatgttctaattgctctctaattatcattttttattaataatttgagcgaaatgatccacgggagagtgattgtgccgaaaagaattcagaaaacctgtaattttttttcgttcgatatcataaaaatttttttggtttataatagaaatcaaaaaatgtttttattcggaattcttgtttatttctcttcgattttcaacacttttcaattcttctcaaaatgattacgctattcacatgtaaaatcaatggccaaggtgactttatcctcgtctttgttgtacaagcctttgctcgggtccatcaattccttaatctgccatttaaaaataaagtcacattattttaattatattgccactcaccgcaaaagaaatgaaattttcaaaacccaaagacagtgtatcattgttaaaaacatctgtttcatcgcattctttaaaatcctcaacaccgttcttttgagaaacaattcgaggttttcacatgcattttttaatctccatttattcggacattcttttattgccaacactttttctggggttttcaggatcattgatcacgattttggtacccgtttcggcgtattggtatcgctgaacactaattcgaacaataagtaattttaatttgaagccgaaatttgagaaaaacactttcttttttgtgtctgcgtataaaagtcgggacttttatttgcatatttcgagatttttgtgcatattt

SEQ ID NO: 13649 - DNA, 1096 bp, Heterodera glycines
tcgaaatgtttatccaccaacgcatcgaaacgtggcgaaagatgtgccaatttgaggccgagttgagcatggtcaaaactgggcaaaatgtccatccaaacgtcgttgcaaatccaactgaaatggaaaaacagtttagctaaataaatgacgaatttgtgtgacttttaaaattcattaccgtcggttcatttttggcagcaattagcacaatttggccgagttccgaatgatgtcacacaaatagcagaagaattaattgcgttggaaactttatttttatataatgagaaaagcggaaacccaaaaattttaacgaaaatcacattttatccaacaatttttgaattttgttcgtcttaaattgttgccaatggccaatgggaggcgaaaaatcattgacaaaaacggaaggcgcggaaacattttgacataaaaaggccaaaccgttttttattagcctataaaatttcaaaaagtttcgttaagtttcaaaaaagttataacttgagaagctcaaaaacccaagttttttacaacattttagctcataactttcttgaaacttaacgaaactttttgaaattctgtaggctaatagaaaacatctagaactatcgaatgatataaggaattaaaaatttgattgattttcacacatgaacgcggcgaattgctgctaattttcaccaattgctacagaagaaatattatacctaattcaaattaacaaaaaacggaattcctaggccaaaattttcacaaattggaggtacttttccgttattatgcatcccctaaaaatgttacgaccaaattctatttatccccctgggggataaatggagactgggggattatttttcaaacccctcctagactgggggataattggagattgggggattaatggagattgggggataattagagcaaatacggtattttaatacggtatttacatatagattttcagcaaaatatgtacagtagcccaggccttaatggtgtcccgctcaccgcactcattttccaaatttttggacgttttaaaatgtaatagtaaaaaatgagaaaagggggcacagtaaaaaaa

SEQ ID NO: 13650 - DNA, 2062 bp, Heterodera glycines
ccgagaaaagagcggagacgacaaaaagtgggaatatctcgctgaacaaacgttgcacactttgcatttgtttccattaatataaaagtcagaaagtatctctgaaaagggaatgcttttgcgggtgctgtgacgaagttacaaaagtatcaattaaagaaatatttaaatttaatttttaataattatattcaaattcattggtacttttataagctcggctagcgcgactttggtgcataatttctcattattagggctgtcaattttatgtaaatacatatttttttcctggcttctctttgctctaaatagcaggaaaaacactttattttttgtgtttgcgaacaaaaaccgggacttttatttacatattttgggattttcttacatatttatgtacatatttggaccactttttgtacatatttttcgcagccatagtcattattagggatgcgataatacataaatttctgcacacttgatacgcacagataagcacgaaaattgcattttatgattggttaggggtgtctctgatgacttttatgcccccagtcgtaccggcccgtagtttttaacaaatttcaagtataacatttggtaaatcgcaatttttttttgtaaatttcgtttggaaaaaatgaattctctctctcttttcgctgccataacaccaaaaaaaaatccagtaaagtttcggaaaaaaaatttaaatggacattattggtaaacaaaaaatgcacagagtaccaggaatgatcgccttcatcacgaggtcaggccttgctacagccatacacgcaatgccagtacctgaaaaaaaggagggggcgtcaaattaggcacaaaaattggaatgtaatttagtaaaatttaaaaaattcatgaagatttaaaaatttgagagggagcttaagtttttggatgattttttgatatttccctaaggcgcataaatcagctccgtaattaatgcccatttcataataatttaaattcttttttctcaacaaaaaagctctaaaaacaattttggaaggcaaaatctggcgaaagaaaatcgcaagtttttcaggtatagggctgcgtcaagcgctcacaaattttcaaaattccaaccctccccctcccgcgcggaaaaaacttgccggattttgccgtgccataggccgacccggccgcggtgaaaatcatcgccgcagtgacgccaagtgagccaaaaaatgggccatacgccgcttgctccgctgcaataagtgccgaattgtcaccagacatccctcaaattgttggcacgaatttgtaaaatgctaaaattagtaaataagtcgtatgacaaaatccaaatttcttaaaatcatttaaatcaaaaattttcaagaatttctgattgtacctttattttttcatacaaattaataaaaaaaacggagttatagaaaaattttaactaatctttgggcctatacatcaattttaaaacgaaaaaagccaattcaatcgtcaaaatccaatgaaagagaagtatcaaagaatcaaagatcaaaaaaagttcttttgaaatttgaaaacaaaatgccaaaaaaattgccaaacaaattttgaaattttatttttattcgaactcgaagtaaaaggtaaaaacgcaccgaaccaaccctaacttaaaacaataaaactggcaatctttcggaattgcggtcccgaaaaaaaaattttttttttaattcgtaacactttttctaggcttaaaaatacgctaatcactgaactcggattttgaaaaatctgacatccatttttgaccaattcgaatccttaactcaaacaacaaaatagaatttcgactttttgattcaagttttagaacagcgctaaattttgaaaattatcagtttttaaattaaaatttttttttcattattccccctcaaaaaaaaaatccgaaaatccagtggtcatggccggcattgtggccatctacgggctggtggtggcggtgatcatttccggccggctggaggcggccgggcccggctacaccatcgaccgcggg

SEQ ID NO: 13651 - DNA, 3977 bp, Heterodera glycines
ctcttccgtctctcctccttccccaatgctattttcatccttttcctcctctttctccccctccttgcttcgaatttttccttttcctctctttctcttccgtctctcctccttccccactgctattttcatccttttcctcctctttctccccctccttgcttcgaatttttccttcttctctctttctcttccgtctctcctccttccccactgctattttcatccttttcctcctctttctccccctccttgcttcgaatttttccttttcctctctttctcttccgtctctcctccttccccactgctattttcatccttttcctcctctttctccccctccttgcttcgaatttttccttttcctctctttctcttccgtctctcctccttccccactgctattttcatccttttcctcctctttctccccctccttcttgcttcgaatttttccttttcctctctttctcttccgtctctcctccttccccactgctattttcatcctttccctctatccgtccaattgattatttgatcgattgatttgtgggtggggggataaggtaaaacgcccggcaaatggtcataattttgcaaaatattctctttggtggtcctcctctcctcttctgttgcgttccctttttctgtgtttttcgagcttctcaaattttgttttcattgttttccgctttgttctctaattataaaaatggtactacaggagtttgtatccacatttttggtcaacattttttcaaattctttttttggtttaaaaagttcagaaaacaagtatccgccgggggtttccgaggtcgctgatcaatgatcacgaatatggaatcctcttgattttctacttctttcccttggttcaatcactctgcagaaattcaaatattttgattttctttttgttcatgggttcctacatatcgacaagctatgcttcctcatacttttttttaattgcgcatattttataattttttaaagaaaatccatacaaattgagcccagtagtccaaaaaaccagccttttttgttgaaattcgtaaacaaatctcactcaaattttcaaaatttttccccggcggcgcctaactgcaccgccggacccctttcttcccaaaaagttttttggaaaaacgtgccgaaaaattatgtgaaaagcaattctggatttctaagattattcgatcatttagtccaaaatgattaattgtttgaaataactgaagtaaattcgtttaaaaatttcattaatttaatttagctttaacttttagattttataaaataaatagcaaaataaaaattaattttgtgttattttcacttgaaataaattaaaatttgaattttttttttaattaaaaaattcccggaaaaccaaggtcccgtcccggcttctcaggtcccggtcccggttttgcccaacattcccggtccgctcaactctacggtagtaccataaaaataaagtttccaacgcaattaattcgctgcaatttgtgttatgtgccaaaaaacccccaaaatatgtgctaaaacccaaaaaaaggccaaaatatgtgccaaaaattgaaaaaaactgctcaaaaaataagttaatttctcaaaaaagtctcattttttatcaatttcgctagcttaatgtaatgctttttggcgtaaattttttttcgctctcaaagatttactcatttttcggaatttcttcgctaaaaatcaaattttgctttaaaagtgaaaaagtcatgaaaagggtcaaaaaaatacaaaaaaaaagaaaattttgaaaaattattgggcatttatttgaccacgaatttgagtgccaaaaaagacatttttgtaaaaaaaaaaaacctaatttttccaaaaaatcgccaaaatatgtgacaaaaactgccgaaaccccaaaatatgtttttattcctaaaaagtccaaaatatgttttttatatgtgctaaaaactcgctctgattgaaaggaaaacaggtaaaaatgctatttttgagattttcatgcgatagcatatgcgcaaaaaaaaagtaaaaacatataaatccgttccctgataatatacgtcaagaaataggaaaaccctaaaaatccaagctttacccaactcaattaattcttctgctatttgtgtgacatcattcggagctcggccaaattgtgctaattgccacaaaaatgaaccgacggtaattaaattaaaagtcacacaaattcgtcgtttatttaactaaactgtttttccataatttcagttggatttgcaacgacgtttggatggacattttcccctcttttgaccgtgctcaactcggcctcaaattggcattgctttcgccacgtttcaatgcgttggtggacaaacatttcgatggcaaaagcgaattgacaatttggagacgaatcgaaattcgcaaggacaaaggaccagaaccgaagctgtctgtgcggatggatgacaaatctttgccggaccgtccgctgcccagcaaaattcgctttgattctattcagattgagtacttaaaaatcaaaagctattgcaataaaagcattcttttcctttttcagttacttcgatcactccgtcatcgcttttcttcgttccaatcatcaaattttcgacaaaagaggcaccaatttatatttgtggattccatcaccacacaacacggacggccagccaattcgggacgttttcgttcgtgaaatttggccaattttttcggcaaacattcgctcgtttgggctttaacaatgctgagcatttggacaatttgcttcgtcgcacttcgccgacaagtggtgcggaggggggggggggggggagcaggaacaaatactgctgaaaatccccgaatgagaaatttctcgagcttttttgaactatgagttgggttcaaggggtaaaccaaaaatacgtttaatggtcttaaatggcgttaattaaaaggtataatcattttttggcgtaaaaccaatgatttcagagtgaaatacaattttttgtttaccgaaaaaatggacaaaataggacaatttagccttttaaaaaggtcaaattcagacaaatttagggtaatactaccgatggtaccacttcagaatgtttccatgtgattacccatttttagacgaaaaatgcaaaatttgaacttacgaaattttgttcgagttcgggtccggggttcgaaattagtcgaaatggatgtcttattggtgatcagcaaccccaaaaaccccagggaacatgttttcacggcttttgaaaacaaaaaaatttttttttcaaaaaagttgtggtaccatcgggtagtattaccaaatttagtatcattcgaaagctcttggtgagttaagtctaaaaatcaaagaaaaatgtcaaaacgggagccacctaagcacaaggacaactgagtcccattgaatatagacagttctgtaccaaaaaataatgaaagaaattaacaattaaaagtagagtgccacgggaccgggaccgggccgggaattcccggtcatccgaggtcccggtcccggttcccggtcccgggttttgaaaagctcaggtcccggtcccggtcccggtagggcaaccgggaaccgggaaaaacaagcactggtaagaatggggggtctgagtgaaaaattagtgaagaaaattggagtcaaagggaaaaataaaaaataataattaatatattctttaaaagtaaaactcctaagtgtgcaaatggcctagtggctagtctccttgactttccttgcttctttcccctggttcaatccctctacagaaattagattattttcaatttttttttgtatactcgtgggtttcctataaagaaaatatgattcctcatagttttttttaaattgatacatattttatcattttttaaatgaaaatcctaccaattgagcttaataatcc

SEQ ID NO: 13652 - DNA, 1187 bp, Heterodera glycines
  misc_feature (1168)..(1168): n is a, c, g, or t
ggtccttaatgaaacggttggcgtcttttgatgcggcgttttccttgacgaagcagtagcagtatcagtagcagcatcagcagcagcaggctcaaactgatcagaagcagttgaaaagtccgtgtcctcttctacatcagtgttgctcttacttactgctgcaccaattgattgaattgaagccgaattgcggtgtggtgtgctcacatgcgacggtgtttgttgtttttgaatgcccatatacggcgcaacgtttggtgctgtaactgagccactctcaacaattactttttgaggtttattatcaataatatcttttagctggtgtctacgtttgtacaaccatgagtgacgcttcatttttatttctgcgttcctttttggatcagccaaattcttttgaatctgtacatcaagcagcgttttctcgccctgtaacgggtcggcaagaggaggatatacgccgctgcttcctttcagtaaattaatgagtgccaaatactcactctctggcaccataaccatcttttttgtatatttcattggtagctcccgcctgttaggccgtaattttttcgaccaggtgttgagctagtgcgccaagaataggcactaatattgctcctaatgctataccacttccctgttgtagcctttttctagcagtcttttcgctacgcgagcgtgcaattgcacgataatagtccgcgtattcggccaaccgtttcctctggtttctgtttaggctgaaattgaattttaatatgtttgcacaaatttcaacaagtcctaatatttgttcggctgttgcgtcttgcagaaggatgtttttctttttttccgatttcgtagaggcgattttttttaaaaattctgcgttttcacttatatatggactgaattcatacatttgtagtgaaaattacagattttctcaaccttttatactctttctctattcaattggtaggtacacctcacgctgttcatccgggaaaattttagttgttaaacgttcagactcgggcgcattaggatgcatatttataaccaaatagctgaacggttcgcttgttgcatcgttgtatgcctccataaaatagtttagcctcttcggaaacaattgagagcctaccgttctgacctgaagttgaccagaaggattccngggttaaaaccaaataatg

SEQ ID NO: 13653 - DNA, 1052 bp, Heterodera glycines
cagtgattggaatgtcattgaaagtggttgggttgagtcccagtgtttggaatgccggagatttagtcccagagattagaatgccggagaattgagtcccagtattggaatgctggtgggttgagtttcagtgattggaatgtcattgaaagttggtgggttgagtcccaatgtttagaatgccgcagatttgagtcccagtgttttggaatgccattgaaagttggtgggttgagtcccagtgattggaatgccggagatttgagtcccagagattgaaatgctggtgggttgagtcccagtgattggaatgccggagaattgagtcccagagattggaatgccggagagttgagtcccagagattgaaatgctggtgggttgagtcccagagattggaatgccattgaaagttggtgggttgagtcccagtgtttggaatgccggagatttgagtcccagagattgaaatgccggtgggttgagtcccagcgattggaaagcctgagaattgagtcccagagattgaaatgctggtgggttgagtcccagagattggaatgtcattgaaagttggtgggttgagtcccagtgtttggaatgccggagattttagtcccagagattggaatgccggagaattgagtcccagtattggaatgctggtgggctgattttcagtgattggaatgtcattgaaagttggtgggttgagtcccagtgtttggaatgccggagattttagtcccagagattagaatgccggagaattgagtcccagtattggaatgctggtgggttgagttatgattggaatgtcattgaaagttggtgggttgagtcccaatgtttagaatgccgcagatttgagtcccagtgtttggaatgccggagatttgagtcccagtgtttggaatgccagagatttgagttccagtgattggaaagcctgagaattgagtcccagagattgaaatgctggtgggttgagtcccagtgtctggaatgccgaaaaggtgagtcaccgagattgaaatgctggtgggttgagt

SEQ ID NO: 13654 - DNA, 1265 bp, Heterodera glycines
ttaattaattgtgtccattttaaaaatattttccctttgacctttgccagcaattcggcgattgcgttttacttatttttcatttcccattatttctttaaaatcttttgggaatggcaactcgcctggagggcaaagccctgtggaagtgacccgtagttgttgttgcggttgatgtggtgttgtgcgtttgccgggcgtcgtcacggcccccgcccgtggtgtcagcccgcgcttcaaagccggcgagacaagctgaggagtgccgccattggaagagccttcgcaggaggagctgggcctgtactctgccaccttctgccattgctttatcagcgcacgacaacgtttggagaagtcgggccattgctgggcagtctgcttccgcacgtcgttcacaaaacggccgatacgagttgcctggaaaaagcaaaccccgtaaatggttgtcaggcccgaagaaaaatttgtaaatccccaaaaaacgccattccctctgggtcatgatcatctgtggtgcccataaataaaatgataatatgattttccattttcggcacaaaatccgtggtgtccttcaaccaaaacacatttcttcatttgggttcgtttaattttaataattttcccactcatcataatttgttacctgtttctcttttcctacattatttcggaagtatgaaaactgttcacgcttcgtcctttatattatataaatttccaatttttatttgcgttgttaactgacaatttctctttttacgccgtttcaaatcttttttttcacattgtcatttgttttcctcaatttacttccactttccatgtataaaaggaaagaaaaaggagcactttccacacattcagcccattttctacccccaaagtcccgtccgtcgtctcattagtcgggagagaagggcacccgttgcccaatacactcaaggcggcgctaatgcccgtgatcgatatttacggcattcattcattcgcacgcgccaccacatttatactcgcacactcaccaacaacacaacccattgacgacgacgaccaaatgacgatgggggaggggggcttcgccctatcgtcgtcaaaatgaaattggagagaggggaagaggcggaggggactgcaacaacacacactctctctctcacacttccttccctcctctttctccaacatagcaaacgactgctgcttcatcataaacgctccaagggaaacagcttcgcaatgataacgcgtgagggggtggg

SEQ ID NO: 13655 - DNA, 2843 bp, Heterodera glycines
tctaccataaaaataatatttcaaaataaaagcaaaacaaaaaatggtaaaattatcaaatcaaaacatcataaatttatgaaagtatgaacaggtcaccagctcaaccacttctgaattttcctgggatttggccagttggatgtctttcctaaaaatagcggttttcaaagtaaccgtaaaccaaaaaggaccaatgatcacgtaggcaaaaggtttgttgacaaaatagcgacgtccgatgctccgtatggtgtctggtgttattgactaaataaacaacaaatacacattaaatgcacaaatttgatttaattggtctattatttatatcaatatattgcagtttttcagtgttcgttcaaaaattaattttatgaaaacttacatttattttctcttccaattcctctgttgaaatgcgccgatcaaaacacagcaattgtctaaattatgcaattggttgcatgcaagggttaatgaaggttcgtaaaataccaatgctgggtcggtgcaccccaaaactctcagccgaccaaaattcagccgggaataaatttaaaaaaaaatttttaaacagaaatttttcaagaaaaaattcttagaaaaattttcctttgaaaattatgagaaaaaattttttttttaatttattcccgactgaattattattaatggatggccatacctgtgcaagggggtagttaaggaggggggggggggtcatgacgtcgaaaaagtcttcactgggcaaaaatggtcgaacgttggaaaatggggctctgaccccccatgggggagtcaaagtcgaacgtaagaccctttcactgcccacccccttgcacaggtatgtggatggctataaattgacaaatgaaaaccataacgttgcttaaaagtgcggttttttgtattttattagaaagggataccgaaatttgagtcttcgaatttgttttaaggatgccaaaataccttccaatatcctcgcaaataggcgtagaaccatccaacatcagaagagaattggtgagaagagaccgtttggcacgttccaactcgtccacgtccacctcttcacaaagttgccgccattccttgcatacggactgggccaaattgaacaatgcgtccggctcggcacagaaaaataacccagtcaggcccgtgtctttataggaagtctaaacaataatttatactttgggcgtagatccatctattaatcagaatcacgacaatttatgtataaaaaggggtcgttcctgatcattcgtataacttattttcaaaaagattaaatttcaataaagatcttaataattgtctcccaaatcataccgtatatgacatgaatgaactaacgccggaatttgggctcaatgttctagccaatcgtgaactattccgacagtgagttctgtcgaattggccgattagctgaagagaattttgacgtgtaagagaaactttgtgggagcattgacgtcacccaccgtgttcacaacttgcacaggaatgttgtcctcacttgtccaactcgtgccttcgactgccaacgaaccgtagaccatctccatctgtttgtcctcaatgagttgctaaaaaagaacgtcttaacatttcgaattattttttgctgtgtacatgtgactctgtgaaaattccaggctcataatcgagcacatgttcatctccgtgctcaattttgccaaaatatttcttggcaagttcgaccaaatgcgaatggtcgacaccaccagcagcggccaatagcattcgcggaccttaaaatttaatggaaaatgaaatttattaataaataattttaatttttgaaatcgttgcgaaaaaggcgatggtagactgggcgacagcctggtttttataaattcctttcagattgtccgaattgagtcaaactattatgattcgatagtcatatatcattcggtagtcaatgttttcttgtccgaaaaagaaattgaaattttttcttcataactttaaacaaaatcatccgaaacaattttgcccttgttggaaaaataaccgttaattgttctacctttgtaatatttcccaatgtaagcgatcagttgttcgcgatgcatacgactgaaaaatgcatgatacaattcgccttttactgcttacggcccaccgaatgttttcatctgtgccgaggattgtccgggacaaagaacagccggcgtaagcaccggcatgcaaatggtcaaagaccacctcctgcatattctgcgcaacttcttccgcctcacggatgatcacctgtcgttcgcgccaaatctcattctccccgtacacactgttcaacaaaatgtcagagagcatttcgactgctaaatttgagatttttgagacagaaaaaagaaaggggaaaacaaataagccccacccatccaacttaatgtagaaaagacaaacctctttccaagtcttgggcaaaacatttcgcataatacaccgtctgctcctagggtatggaaaggaagtgagtttttccaaccattggtctatggtcttacccgagaagtgtacgcgttgagatgggcacccatattctccacttcaatttccaaatccgactgtttacgacgacttgtacccttgtaatttgttaaaatcaaataactaggaaattagaaatgtgatactttgaaggccatatgttccaagaaatgggcaactccgttattgctcgcgtcctcgtaacgactgccggcgtctatccaaactccgacctgaaaaatgaaagtcaccacttgctataaagaaatttaaaatgacgaattaaggataaaaattgtccaaatgattcg

SEQ ID NO: 13656 - DNA, 1762 bp, Heterodera glycines
ctttttatgttacatataatattacttgtggctatggaatttctttacatatctcccatcttattgcgcgatcgatcctctacttcccttaattttattatccctaacagtgaaaagttcactattacaacagaattccatatcattattcttattattttatatttcaccacgaaatttcgccacattaatattataattataataaatatctttattgcaaactgtatctgatctctattatatattcatatttaaaagaacctgatcttatctaatatatgatgtactgagatttcaaatatatactaattattaggttattatcaagatttaatccacattatgctgttttacaaccctataaattactttctataatattatataaatctttcttaatacagttatcaatattttattatatttataaatttgtttttaaaattatattttgcaattaatggttagtatttagagcacaccatttgtccggattacggtagccccccccacacttatgggaggggtgcatggccaactgagcgccagccatttgagcgccaaaatttttcagtactgaagcaaaaccttttgcgcgacttttcttgcaaacccaaacctattgtaagggggtgcgcggcttttttcttactgcgcgacttttttgctgcgcgactttatttacattattttaattaattttaaattcaatttaaacatctaaaggtcaaaatatcttaacgtgttgaatttaaatgcatttaaaatttatcaaaaattccccgcaccgagcggatccgaaccacggagggggtagccagactgacgtactacccattcggccacattggcaatgggtgataaacattaatttgctctcataaagggaaaaattgacgtcaccagcggggggaggggggcgagagcgtgtggcaagaagggcgggggtgttgaaaaggtgccaaataaacaaatcaattaaataatttccaatttacgtttttaaagacaaaatgaagcgagggactatataataaaaataatattattaaaataattataaaaatgtttaaataactaataattatttcaaaaaaaaatattttaagtgaaaattaacaataattttaactttatttatttctcattaatttttagagtttaatttatcgtttgctgtcgggtgttttttactaataaaataatttacttgaatttattgatttgtctgttcatttttatctgctcaaaaataattacagcaaccgttcaggtgttgaactttgtttattttgccgtataattttaatttcgcatccttgcgctgcccctcactctcacctgctcattactttattccaataaattaaatttcaattaatgttatttaacatttggacacaaaaacaaatcatgagcctaaaccgtgacgaaaactcgcagtcccctgtactcgatggaccgtacccgcgggctcaagatgacattgagtttgtggaagatgaagcaccggtgctgcttgaagtgttggatcgtctgtcacgagagtgtgtttttgtttctatttttaaaaatattttaaaattacacatttaaaattaattgttttattgtttagggaattcgtgaagtcaggcctgtgggcccggggcggtcgggttgtctctatgcctatgcaaaattgttatcgaccatttgtgggcaagggaattgttggtccaaacttcaaagttttgaattttggtcacactttgtaaca

SEQ ID NO: 13657 - DNA, 1679 bp, Heterodera glycines
  misc_feature (32)..(32): n is a, c, g, or t
tgaaacaaccggccaaaacccaaattcatttntcgtcaaaatgaagaaatccgttaccatctctgtccctgagcaaaaagaaattaaccagcctaatgcagaagcggagccaccaaagacggacactacaaaaaagcgcaaggtggaggaccgggagctatggaaactggcaaaaggaaagttcatgctagcgacatatttgtgcgcaggtaaaaatgaaaataattttaaattttgtgaaataaaatttttaagacgactgggaccgactgttccataaccaacagaaagttgcgcgcttgggtgatggccgttttgcggtcagctttgagctctgtgaagaatgcgcgtgggccaattgtcgcgcaaccgacatcattgcccctgtgaagaaaaagctgaacaatgcatgcgagacgaattttttgagtgatcgatcaacaatcaataaaatttttgaaatatttcttattgttgtcatcatcatcatcatcagcaagttcaagcaactccatcgggtagtggcggtcctcccctccttctcccaaaaatcgttcaattatgcatggcaaataggggaagtgaagccttatgcggtggcgtgcataaaaatgcgcggtaatattgatgttaaatgaaacgcgcagctgtccatatgctggaataaatgccgcccctttactcgaaatgccgccgacgaaaaatgttttggtcattccgttccgatcgttgtaggttgtgcgcacttttcggccaataagatgctttagaacaaggctccgatcctttggatgatttaaccgatcgcgcagcgacttgggttaacaattgagcagtttagagcaaaagacagtgacaagcaccatttcagaagaatgacaaatttgcaaaataggacacaaatttatactctaaaattttagccacgttcattaaattcaaatttgacaccgcccattttagcgaaattgaaacaaccggccaaaacccaaattcattttcgtcaaaatgaagaaatccgttaccatctctgtccctgagcaaaaagaaattaaccagcctaatgcagaagcggagccaccaaagacggacactacaaaaaagcgcaaggtggaggaccgggagctatggaaactgacaaaaggaagttcatgctagcgacatatttgtgcgcaggtaaaaatgaaaataattttaaattttgtgaaataaaatttttaagacgactgggaccgactgttccataaccaacagaaagttgcgcgcttgggagatggccgttttgcggtcagctttgagctctgtgaagaatgcgcgtgggccaattgtcgcgcaaccgacatcattgccctgtgaagaaaaagctgaacaatgcatgcgagacgaattttttgagtgatcgatcaacaatcaataaaatttttgaaatatttctctttctttaaattttatttgttaataaaattatttagtgagaatatccccactgtgttcatttcgcgagactttagccgggcgaccggatatctatgattaataggcgtcactcgtacagttgaatctgaacagtgatgggagggaggggggtgtggggatgagccgctgaaacatcattaattattagagggtgatgacaggcacaagaaagaccatattgttcattttttgccgtttactta

SEQ ID NO: 13658 - DNA, 1785 bp, Heterodera glycines
tggcataaaatgaccgattgaagaggaagaaaaagtgaacgcaacataagaggacccatcaaacaggagaatattttgcaaaatgatgactagggctgtgaattttaggttttaactaaattttttgctcgattgatttgaagaaaggagctcaaaaaacgcatttctgcattaaaaattttcgattctgatgtcattatcgggcactagaaatcactattttggcgacttcgtcactaaaatagttaaaaatcactattttggcgacttcgtcactaaaatagttaaaaatcactattttggcgttttgtcactattttttcactatttcgacattttttgaaaaattctttaacaaaaatgcaataaaaccaaaaaatacactcctaagaatcgacctaaaaattttttcaaaaaatacacccctaagaatcgacaaaaaaaatttcaaaaagcactcctaagaaatagagttgctcggtaccggtaccggtactggccggtaattaccggtttttttggtaccgttaccggtttgtctagtaccggtaccgccggtaaaaatttgcactggtaagaatgggggtctggtcgagaaaaaaatagtaaattggtaaagaaggagaaatttttgagaaaaaaataaattttatttcgtttagcaaccatgcatatgtggtgtaatggttaaaccttttgcctttcattatttttcgcttgggttcaattccccactgggatagaatattcttcatattttctttaccattattttaattgaaattttaatttaaaaaaatattccaactttttttctttcattttaagcatcctaaaaacccaaaaattaatcaattggtctttttttacaaattctgttaacaaatcgcattaaaaaatacaaaatttttcccggcggcgcctatcggcaccgccggccctccttgttccccaaaagtcttgagaaaaacgtgccgcgaaaaaagcggtgttgaaagcaaaaaaggtcattgatttacattaatttacatggccggagaccccttcgcaaaattggaaaattggctgctgatcccttgttttgcaataatctgaattttgaggtctacatctgaattttagtgttctttatcctgaatttgaaaaaaaaacttggtcaccctcaatatacatatacttctgaacaattctaatgctaaaaaacaggcactcgcgcgaaaactgaataaaaattttgtatttggaaaattttgtccaaaaatttttacgttggaaaattaccggtttttaccggtaccggtaccggtaccggtggaaaaagttggtaccggtaccggtaccggtttttgcattaccggtcagtaccggtaccggttttttagcaattaccgattaccgagcaactctagaatcaaggagcaaacacatgttttttggctgcctttttaaatcattctcacaacctttagtacaccattcaatagagtttcaatagctctacaattttactcagaggaatttttgctttttctattaatagacacaccgtttcaaaaaacgagagatgaaccaataaatagagagtgcggagaaaaaaacatctctctttttggcgtactattttttatctctgttaatagagaaaaaccgaatttacttcgtgacgtttaacttttttcctgcacgttaaatccacactaaatttggcagatcgatggagaaaaaaattctgcatttttctatactgatttctatttttgtttatactcccattcaaaaattatt

SEQ ID NO: 13659 - DNA, 1709 bp, Heterodera glycines
gaaacgtcgccgaattgacggtgccgaaacgatctggaggacaggacattccgccaccacttcattttaaaaaaaacatccattcttcccatcccgaaaataagaatattttcaaatatccattagttccttcagaattaaaaattcttcttcagtatatcctaagaaaaaaaaagaaattttatttttgaaagaaaaaataataattaaaaaagctttttatatgattcattttatgaattattttgattttgtaaaacttagttaattctcattacatatgaaaacgaatgtcatattcgtgatcaatgaccctgaaaagctccggaagcatgctttcataacttcaaaaaaacattttggtcaaaaacttttcgttgaaaaatgaagcacctttgaaattagaacccgaaacggaccgaggcactaccgaacttttgtttattttggataaaacacctttacctggagtttcggaaaatgggtctaaaaagtgtgaaactcggatgtctgagcctaaaatctacctgaacacaccaatgcataaaaaagtcagattggtataagaaggtaaaagttaaactcagggctcccaattaaaaactttcaaactcagaattttgggtgaaaaattattttgaaaattttccaaatgatactataagaatgctttttgagacgcactaatttgttaaacattttcaccaaaaaggacaaagttttgcgatttgagccaattttttatcatcagcaaaatgatgtaatgtagaatatgaatgataaaattgactatggctcggccgcttcgcggcctcgcacccttctattggcatttctttatggcagaatattcttggcattttcatgaggcttctgtcatttcctttttataatgcgtatataatttaggctatttgattttatcagcaaattccgaattagcttgggaatgggcccttttgaagccaacctttttttatgaatgttgtcccattttacgttgtggtctgcggcctatggacgcttcagagccatttacgccttcttttcaataatcgtatgtaaaaacgactatctctttttttcggaacacttttttgaaaattttttccggaagagattttgtgacacgcaatataactaacattcgaggcttctgtcatttcctttttataatgcgtatataatttaggctatttgattttatcagcaaattccgaaattagcttgggaatgggcccttttgaagccaacctttttttatgaatgttgtcccattttacgttgtggtctgcggtctatggacgcttcagagccatttacgccttcttttcaataatcgtatgtaaaaacgactatctcttttttttcggaacacttttttgaaaattttttccggaagagattttgtgacacgcaatataactaacattcgaggcttctgtcatttcctttttataatgcgtatataatttaggctatttgattttatcagcaaattccgaaattagcttgggaatgggcccttttgaggccaacctttttttatgaatgttgtcccattttacgttgtggtctgcggcctatggatgcttcagagccatttacgccttcttttcaatattcgtatgtaaaaacgactatctctttttttcggaacacttttttgaaaattttttccggaagagattttgtgacacgcaatataa

SEQ ID NO: 13660 - DNA, 3253 bp, Heterodera glycines
tgtcctaaaaatttcaaaatggttggcttaaaagaattctccccctgagcgatttcacatcgaatacggcatatttcagaactaatctttattaaacctgaagattttgaaaaaggagaaattgaagtccttaaacaaggacaaattgattggaaaaattacccaggaaaagaccaattaaaaacatttgttgatgaatacggactgataagattagactcaagaattaaaaatagtgtgatgaattattcattaaatttcccatcatatttccaaaaggagcttcaattcttgaattgttagcatggaaagcacatttaaaagttagacatggtaaagttgatgccagtttaaatgaatttttaacggaattttgggctccaaatatcagagcaattataaaaaagattattaaaaactgcactacatgtaaaagctaaatggtccgtcatttgcactacctattatgccatcacatccgaaggaaagagtaaaagcatcatccccatttaattcggtggcaattgattatttaggaccttcattggtgaaaaatgaaggtaaaacgatcaaattttggatagtgctaattacgtgtttgataacaagagcagtttatcttgaaccagttttggatttatccgcttgcttttttacaagttttgaggcgttttgcgagccgaagagggacaccaaaacgaataatatccgataatgcacagacctttcgattagctgccaaagtggcaggtgcttacgaagcaaggggaggaaaaggaagaaatgaattggaaaaatacttggtaaaaaataaaataatttggagatttattccggcattagcaccatgggcaaattcattagcagaaagactcgtgaaaatatgtaaagatgctttcaaagccctcactcgggaaaatgattttgcaattagacgaattgcgtacttttataacagaagtagaatggacaatgaataatcgtccaattacacatgtctcaattgagccagaaggagagagagcccttcggccaatcgattttattaatccaggtttggaattagggataaatttgccagatgccactaatgagtcaaatagcgatgatgaattttgtttagaccctgataaattagaaaatcagttaaatcgcagtggaggaaacaaataaagttttggaaatgttttggaacagatggcacaatgaatatttagcagtcttttgggaccgaacacaatggcaacataaaggaccaaaatcacaagaaaaacgagtacctaaagaaggagaagtggttttaattaaagatgattttcaccctcgaaacacatggaaaattggaaaaataattagtttaaatggccaaaaaggagcaatcagaagtgcacaaattaaattagcaccaaaaggtaaagaacaaaatggaagaattatagaaagaccaataaataaactttattcgttagaggtgaataaaactttaaaagagagtgaggaagaagagaaaataagacaaatttagaaattaaggataaaatcagtgaaatgaataaagaaaaagaaaattatgaaataaagaataatatgcatccaatgatgacgagagctaaaacgagagactttttgacaaaaggaaacattggattaatcatggtattattattaatcagtaatgcgaaccgatagaagaatgcaaattaattaattgttggttttgcttagagaaatttgcaaatcccgactgcatgatcgtggaaacacgaattttaatgggcattggcctagcatgtattttgtcacttataatatgcataattggaaatatagcaaaattaataataagttaatggttgattttaaaaatagccctttatgggccttattctgcaattaaatttttatggaaattaaaagacaataaaaataacgctaatgagttggaaaagggcttattaaatgaaataagtaaaaaggaaaaattgcaaaaaagaagaaatcggagattatttaaattagccaatatcacattggttttaatttatctgaatacaatcacaaaaatagtaaatggagcagcagaagttgtgtccatacaatcaaattcagaagattgtgaaagaaaatctaacggttcagtatgtcgaattcgtgggacaacagaactaacaattttgccagctggccaaaaagtgaccctcgctttaaaagatgataaaggcaaattagccgggtcattggatttgttcgacattgggtaaattcgacactgagtattttcgacactaagtaatttcgacactacgttttcgacatagagaaatttcgatactgaactatttcaaaaactttcactgttttccagcattttcgacactggaccatttcgacattgagtaaattcgacactatagagaattttttagaaagtaatatggaaaatttgaaaatgttagtacatatttatgataaatagggcgaggatttctagttttttaacaattttttctgcggctttattttgatgagaaatgcacgaaaaacacattctttttcaaaaaattttcgtttttagtgccactattcatcactagattctcaggtttagttggagatgctgcgagttatggatgatcaaaacaaccaatgcaaaaagggcagtgatcactgatcagtattttttttttgaattagggcctaaattatgctatttggcattatgaatcattttttctaacactggatttgatttgtctaacattgatttaaccaatagttataccatctacctttttaagattacgaattagaaaataacaggaaaatttatcataaatatgtactaacattttcaaattttccatattactttctaaaaaattctctatagtgtcgaatttactcaatgtcgaaatggtccagtgccgaaaatgcaggaaaacagtgaaagtttttgaaatagttcagtgtcgaaatttctctatgtcgaaaacgtagtgtcgaaattacttagtgtcgaaaatactcagtgtcgaatttacccaatgtcgaaattaccagccacgaaaatatcgttttgcggacaaaaacaaatgatacacacgcacatcagctcagcgtaaattgtattaaaatataattaaaaattaaatgaacttaaattcaactgatcaataattgaattttgtttgatccaataatccttacaccgatatattacataaaaaccaaaaagtacaaaaattttggcata

SEQ ID NO: 13661 - DNA, 4600 bp, Heterodera glycines
ttgtacgctttgctatttttaatgctaaataacttttcttattataacttaattataaaaatttcttaattaaaggattaatatctaaccaaaaatctggaaattcaaaaaaaagagaaaataaatatttttctaattaataaaaattcttaacaatatatatatattaaagaaatatagaattttgttttattttttaatactttttagaatggcattcgaaagaggaaaattgctcacatgccaattgaggtggaaaataaaactttttcatatgtgcatttaactccaaatttaggttcaattattaatttatggggcgagaaattataaaaaataaaaaacattaaaattttattcatattacacattttgtgcttttagtgcaaaaaatccactttttcttccgaatttattggcattatttattgcgaagcataagaccaacaatttatttttggcacaacaataaattcatttgaatgttttggcattgtctcaacattcacttaattgaatattctcgtcgcatgcaaaaacggcacaattggccaaacattggccataattattattatcattcaaatgcaaatgggaaaaaaagctgcagcagacaataaattgatgccatttttgacacatttggtcaaaaatcattgtcattatattattgttttttggttctggcaaattatggcaccgaaaatgccaaacccgtggctttattctcacatggcaaaaattggtggctataaatacataaatggacagagacagtaaagcaaattcttccatcagtcagtcacacaattttaaaaaattccaccgattttctctccaaaaaattaatccaaaaatgttttccacaaaattttcatcctttttgcttctttccctgcttgtttgcattgtttacccaacaaaatcttttgcttatcgtggcgatggttcttttgtgggagaagcaaaacacgaaaaaatggcacgtaaattggtcaaaagtgggctgacacaggacgaattcgagcaggtcaattggggaacgaaataaaataatttaaacgaataaattaaagctttttttggacaatggggtatcaaaaaagaaaacggtgcccaaaacctttatgataaagccgttttttgttttttttttatttttaaatcttttttggtattagatcttcaattttgctttcactaagtttgtccgtgtaccttttaagaaacgaaggaatgaatgctcgttccaaatgtttaattaatccgatcctttatcagttggcaaatttaattgcccattcatttgccattcgatttttttacaattttaattgtcctttcttcagacttttttgccattattgccaattgaacttgagcagaagaaatttgagcgacgcattgatcaaatggaaaagcaactgatcaaagtgatctcctccgttcacgatggcaattgtatgacgaagaaaagtgcaaaagaagaagaagaacagtgaatgaatggaaaaagaagacaaacaaaaaacgaaaaaatttgatcgaaaaaatctaaaaattttctcagtattttatggcaaaatttttgtagcaaaacatttatctcccaatgcttaacgccaattatttgtatcgtgcgaaagatagacgcaaaataaatgtttagtcagcaaatgacaagatatattttctaaataaaaatttagattcgaaaatttttcttattcgaaaaaattataaaatatttatttaataatcatttaaatgaccaaaactaagtttttagattaagttttacgtgttttgatccctaaaacgccttaataaatagggatgggatttttatgtgctaaaaatgctgaaatatgtaataaaatatgtgctaaaaaatgctgaaatatgtaataaaatatgtgctaaaaaatgctgaaatatgtaataaaatatgtgctaaaaaatgctgaaatatgtaataaaatatgtgctaaaaaatgctgaaatatgtaataaaatatgtgctaaaaaatgctgaaatatgtaataaaatatgtgctaaaaaatgctgaaatatgtaataaaatatgtgctaaaaaatgctgaaatatgtaataaaatatgtgctaaaaaatgctgaaatatgtaataaaatatgtgctaaaaaatgctgaaatatgtaataaaaactagagtgccacgggaccgggaatttttgccaaaaccgggaccgggacttgccgggacctgagaagccgggaccgggacctcgattttttttcgatcccggtccctttcccgtggcactctactaaaaaccccaaaaatgccaaaatatgtgctaaaatatgtgttaaaaattggaaaaattaagtgtctttttgcataaaaattcccaaaaatctcatttttttttatcatttttcgcccatacaattgcccgcctttgatgcagacaatggcctgaatgaattgcaatttaaatttgattattatagcaaaagttgatgccactcacccaatgcaattcgtgccactataaaatttaaagttgacattgctcaaaatgctcggattttcttcctcccactgaaccgtcgccgtgcccccaatttggcatcgcttcaacagccaatcgccataagtatatttatctttctccgtgttttcatcatagtcctcttctttctccaatgtcagtatttcgttggtccgtttgttcaaccacaccttctttgaaatcattgacaaatttagtggttcttgacgtagcagcacaacaactcaattgctttggctgtccatcttttgccggaatttgcaaccattttgacagcgcttggccagcagttgaatttggctcatcatcagcaatcaaatcgggcaacaaatcagcggaatggattgaaataatgttgagatcggagagaattgtcggcgaagtgcggagaatcaaatttccagatcaccaccatgattaaaattcaaatagcgaatgtttgtcgcaaaaattggccaaatttcaagtgcaaaatcatcccaaattggctggatatttttggctttataggggtatggcatatacaactccaaattggtgtctttgccaaaaatttgttgattggcacggagaaatttgatgacggaatggtcaatgtacctggtaagggtatgcttttattagttaattattcgttgatttgtttgatttactcaatatgaaggtcctcaaagcggattttgttgggcagctgatagtctggcaaaggaaattgcacagatttgaaaggaaattgcatagatttgcgatcaatccatacagataattttggttctggtccagcaccttttgaattctgatttgtctccaaagcgtcaattggcttttgccatcgaaatgtttgttgaccaacacattgaaacgtggcgaaattagtgccaattttaagccgagttgagcatggtcaaaaagtgggagaatgtccatcaaaatgtcgttgcacacccaactgaaatccgatttttgaggccctgtaactctcgaaggaagcaaaatgcaccgctaaaattaaaaatcacatagaagtcgaccctgctctatccaatggtatatcgtttataggcattttctgactgacagctcgtaatgttccctgttagcgataagacaattaccaaaaaagttataacatgaaataacaaaaaacccaaaattttggaagttttttcttaataacttttttacaagctaaaacttgggcgctggcaccgaaacgtccttttccggttcacccccccccccgccattttagaaaaatcttagcgattttttggaaatttttttttataaaaatgaaaaatcagtaattcatatttagaaaatcttagcgatttaactaagattttttcttgtaaaaaattctaacaataagttggtaaatcttttggcattcctgacttatatggattgttttaaaattgattagcttatagcgtggacaaatatggtaccattcgaaagattgttgccaatttgtggtgtttatttccaaatttgtttagcaatttcgccgtgccaccaatgccgccagctacaaaattcagtttactgctcatgcgccgtcaacgtcaaccatggtgccatttgaattggtgaatgaaagaacccgggaaaagctgacattgaccaaagcagcatacgaccgatggataattaaacgatgccaaattggggacacgacgacggcacaatggacggacgaaaattcgatcaacaatttgaacaatgtcagcattaatttgagcggtgtcaattgcatatggtgagcagaatttgcgtaaaatttaaaataattataaaaattttttagaatattttgtttttgttcaaattcgggcagagacaaattcgattaaaatttaagattttcgagataaaaaacattttggcatttctttaggccattgtcgtccacaccagcgacgcgaaaaagccgcagaaaaatgacgtagaactgtgcggaagtgaaatataattgagaaatgatcggctttattggagattactattgaatggacaaattgatctgctgaaccatttttg

SEQ ID NO: 13662 - DNA, 4370 bp, Heterodera glycines
  misc_feature (4213)..(4213): n is a, c, g, or t
attaaattacagtttcatttgatcggatgggcgtgccaaatattccatcttggacatgagaaatgacgttttaaaatatttttaaacagaaagtggaaaggatcccgagacgagaatccaactgcgatacattccgccccagggcgcaattgctcatcacatcatcaaagtgggtgatcgagatccagaggaacggatggatattccctcatgtttttttaaaacgcacttttcagaattggcttctacgagagttctaattgcaagcaaaaagtccatcttgctgttttgatcacttattattatgctaattgtttatttttaaaaaattgataaattttttaagcgaacatgaaatgttatattttaaaggttatcccacatttgcgtcccgacattggcgcctatgtccaaaatcgggttcaatcttcaatttttcaatcccaaatacccaaacagcattcaaattaataaaatacagtcttttggttcattatgccaatttatcaaaatttaaaagattctgaggatttttcccaaaggcctcaaaaagccacaaaaatcctcattttcaaaaaaaatcctcattgacatatcaataagccacaaaatgaggataaatcctcagatctggcaaccctgggtttgggttttataattcgtatatgagtgaataaaacatacataatacgggatcaatcacaatgaacaataaatacataatacggatcaatcataaatgatcaacaataacataatacgggatcaattataacttatcacaacaaataacataaatacaggatcattttccaagaaagtttatggttgcctcatataatctggtttgtctgtgattggcttcttggtgctgccgccttcagaagatggtccttctccttgggcaggcgcgttctgttgggttattgatgctctgccgccttttgaagttgcttcatctaccatcgcattcggcgcgttcttggtgctgctgctgccgccttttgatgttgcttctttcttgtcctttggcttgtccgttttgctgtcgcctttggaagtcgttcctcctcctttggtcaatactcggcgcgttcgttgtgacctgggaatttgttgggttattgatgctctgccggtttttcaagttgcttcatctacctgagcgtttggcgcgttcttggtgctgctgctgccgccttttgatgttgcttctttcttgtcctttggcttgtccgttttgctgtcgcctttggaagtcgttcctcctcctttggtcaatactcggcgcgttcgttgtgacctgggaatttgttggttattgatgctctgccggttcctttggtcaatactcggcgcgttcgttgtgacttgggaatttgttggttattgatgctctgccgccttttgaagttgcttcatctacctgagcctttggcgcgttcttggtgctgctgctgccgccttttgatgttgcttctttcttgtcctttggcatgtccgttttgctgtcgcctttggaagtcgttcctcctcctttggtcaatactcggcgcgttcgttgtgacctgggaatttgttgggttattgatgctctgccgccttttgaagttgcttcatctacctgagcgtttggcgcgttcttggtgttgatgctgccgccttttgaagttccttcttcctgggccttcagcttgtccatttggctgtcgcttgatgtttgttttggacatcgaggtgctgtcgggccgacctgggaatttgttgggttattgatgccctgccggtttttcaagttgcttcatctacctgagcgtttggcgcgttcttggtgttgatgctgccgccttttgaagttccttcttcctgggccttctgcttgtccatttggctgccgcctgatgtttgttttggacgtcgatgtgctgtcgggccgacctgggaatttgttgggttattgatgctctgccggtttttcaagttgcttcatctacctgagcctttggcgcgttcttggtgctgctgctgccgccttttgaagttgcttcatctaccatggcattcggctcgttcttggtactgccgccgccttttgatgtcccttcttttttgtcctttggattgtccgttttgctgcttcctgatgtttgttttggacgtcgtgatgttgtcgggcttccatagtgcctaagagtgcaaattattgaatggtaagacaagaattttttagaccaactttgttcctcctccctgagccttctgcctgttcttgttgctgacgcctgttgtttgtgctggtcggcgtttccctcggcctcgtctctggtttgctgctgcggcctgttgttgcttttcctcccttgtcagttggctgttcttctttgctgtcgccttcgggtgaagcttctgcgcctctgtccgttttgttgtcgcctttctgcaaaaagggaaaagggatttttaatttgataaaacgaaagttcttcctaaacacctttttcacacaaccgcagcactggctgagcaaaacaatggccacgagcaaaagcaaaataaggggcaaagggaataagaataacattatctgttgttgttgaatgaggaatggaatggtcgaaactgataaaatgcattccttttataatgatgacaaccaaaaaagaaacaaaaaatttagcaaaaaaaggagtatgattttcttcttctctatcctccattgtataaaagaaacacttttccggcttacttttccatttgatcatcacacatttactatttatgcaataaaaaagggaatttctacgttaaatttttttgatttggtggaggttttttatgcttataaacgcatattgtagtgattttcgagaataaatgcatatttaccatttttgcttttttagagatatgtatttcgggcattttttgtaatttttacaagaaaagcgcttcacaaaaaaaccaaaatttttgtaattctctaaaaaactctctttagccatcgtgtggtgttcaattaaaccttttttcgtctcgcggtttacaaccatccactttttgcctatataaatccgatttatttcatttcatttcctttacaatttatattgggttatgtatacagggaatgggtcttttcagtatcggagttaagcgccagctcgagttttttggaatgagacattttttcattgtcgacaaaatcctagaatattggcatcattataaaacgggtcggggtcacttcggcgcggaccatttcggcgccgcaaattttgaaatgctataacttttttatttgtcagttagctttagccaatctagcatcatttgaaagctctatgtgtgctctatatttacatgtaaaaatagaaatgaatgattcaaaaataaaaaagttatgccacgtggcgccgaaaaagccaagaaaaagtcaatttttgaggttttttggccataacttttttgtaaactgacgaaattttttgaaattttacaggctaatagagaatctgaagagctatcgaatgataacaaaaatttttaatttggttgatcaggaaaaaagttgttagcaacggcgccgaaaaggccggcgccgaattgggcggttccctataaaactctacataagctctatcagccttaaaaacaacaaagattttcggtaataggtagtttagatggtcacaccttttttgttggtttaaaatattgattaaatatattataatttaattaaccgttaacttttgagttaataaaaaaccaaacaaaaaaaattaattatttaatatttcacttgaaataaattaaaatttgaatttttttgaatttttaaagtttgccggttggtctcggtcccggcttctcaggtccggttttggcaaaattcttggagtattattcgccttaatatcataccgtatatgctctaattatagctcatgggggattatttttcaacctcctcagaaaaggggggataattagaaactgggggattatgatagagggattatttttcaaaacacctcgtagactgggggataattggagactgcgggattaatatagactgggctataattagagcatatacggtagaatatgatcttgttgactctgtttggattttttagcgtatttgaattgcttttcatttcaacaatattaaacgccattattttcaatttccgactgctgccatcanaattattttgctaatccaattttgagacattacgaataatgggcgtgttgggcgttggatggatgtgaggaacggtgcgggggacggaggatttatgtaggccttaattctgttgaccacatccacgtggccactcgttgggaatacctgagtcatt

SEQ ID NO: 13663 - DNA, 987 bp, Heterodera glycines
actcatttctcaatacaaaactcactgtttctatgtattgcccccgcccttcccccgcaaatcccaaatccctcttaatccactcctccccccctcacatctgtcccatccccccggggatgacagcattttccgatgtgaaacgattcgctttccaacaacgcatttttgggcatttgattttaattgcatttcctaatccatggggaaaggcaaatatatttttcgaccaccggtcccacagattgacaacgaattcgtccttttctccttctctcgggttgtttagttcctccccccccccctccttttcccatcaatcggattaattccaaaagtccccctttttcccccactcatttcctcccaaatgcaataatcgtcttcccatccattggccaatattgttgttgttcatccgttgtaatccaatttgtcccccccccccccctcccgtggcccttccgtgccaatccgatgcctttttccccttcccttcgcccctctctttgcccactttcccccattctcgagcaataattaaaaattggtccatctcataagcatgacggaggagggaataatgaggaaattgagaacattgggcggaggaggcggaaaagggagggaaagtgaaacgattggcccatcgactcgataaaatgtgccaaattgcgttaaccccaacaaattcattgttaatttccttctcagcaatgggcttcttccatcggcttccgtcgacgaattgcgcaacgctttgttcgcgtcgttccaacgccaattgttcggccattcttttctttgtgcgccgccgccggcgcaatgccaaccgacggaaacggcggcggaagagccgccaatgaaacggacgaagagggaaaatggggtggagaaggaggaaaaggaagtcggagaaagggcggcaaaatgggacggagagagacgacgagatggagcagtagcagcagtaaatggaagcgaatg

SEQ ID NO: 13664 - DNA, 2577 bp, Heterodera glycines
  misc_feature (2499)..(2499): n is a, c, g, or t
  misc_feature (2502)..(2502): n is a, c, g, or t
  misc_feature (2509)..(2511): n is a, c, g, or t
  misc_feature (2515)..(2515): n is a, c, g, or t
  misc_feature (2517)..(2518): n is a, c, g, or t
  misc_feature (2520)..(2522): n is a, c, g, or t
cgacgaggggccctccgtagcggacgaagcgacggccaaatgcaaagcggcgggagcagcagcgaattgtgctgcctcttcgacggcacaacaaatggccgcgttcaattgccacccaatggcactgtttgcccagttgcaggcccaactgattcaccagcagcagcagcaaagacgagaggaggaggaagccgagggacggacggtgatcagaagggtcggaaagggcggcggatgatcagcgatcagccaaaagcaccgtatgacagaggacagacagacacagagtgatcggacgaattgaaagaaaggtcgccgggggagggggggtaaagtgcgatgagtcactccactcgaaagggattttgttctttgattttgctgttgccgctgattaacactctctctcgcccttttctctttctctggttcagctttaaatgtttgcacatattttagtttttttatttctctttctctctctctcacgtgaatatattcagacagaatttccttcccgcaattcattctttttcgtgcaattccattcgttttttcattttaagatttaaatttaatgccactaactctgtttgacatttgtattgaaaatgaaatgcgttgaaagttcttaaaaacccaaactggtatgagcaaattttgccgttttgacgcattccctcaaacgccgaaattgaaccatttttgccaatttgaactattttaatttttatgataaaactgattaaacacaggatatgtatgtcaagatagattatactaaaactgaattatttaacaacagtactacatatactaattatttttattttacatgtattcgattcacaataattgctgatcaaatgattaaggaatgtattgagaaaaaaaagcaaaaaaatggaaatgggaaataaattatggaagtcggcacaggaatgaacagatgactttttaggaatgttaaggaaataaaaagcggaaactaaataaaagtctaatcaatcacacccgaacaagaacatcgcgactgatcagtgatcacttgagcgttgaagaggcagacggtctgaagtactgctcacgaatcaccgagggcagctcggggcccccgtcaatgccaatcggcggcgccatcggcgggtccgccaggcgtctgctccgtttcaggtaccagaagaaggcactgagaacgcccagcgtcacggcaccagccaaagccaaggcgctggcggcgaaaatgcgccagaaacggtggttggcctcctcctcgttgcgctgttggaccaccaaatcggcgtcgaccttgttgatgtcgtagggggagaaggtggacatgggcgggtgctcgaacgtgggcaacttcttcatgatttcgtcaatgctcagatcgggctgaacaaaaggaaaaaatgtctcctaattatttgcgacgaatgactgattgtgagactgacattgttctccaacgaagcaacaagccggtcaaagttatctttgatccactgctgcaaatccaacggcaacttggtcaagtcgggcatttcaccgcgcatcacttgctgagtgagctccggcggaagtttgctcagattgtaattgggaggcaaaagcttcatcatttggaagactttcggtggcaaaaggcctgtcagattgagcggctcagaggcgttgccattgacggcgatgccgaaagttttgccgatgtcgccacccgaagaggatggcatttgctgcatgtaatattgctaaaagagaagcattgcaaaattgaaattaatgaaccatttatgccaattttccccttactttgatcacttccgtttgttcctgcgtaaggtgcggcaacggtttgttctggacaactttctccaccatttcgttgggcaattcggaaattggccgaagcaatttggtggggtcagtgcccggcggaaggggtggcaattccgttgttggacggccttgcaagttggaggcagcgacatacaaacgctgcatgtactgcttgacaatgtggtccaacgtctccttgggaatgccggggatttgaccccctttcagcacgtgttcaaccagagaaggatggagctgaaagaagtgaaaatcaaatgcattgaattataagcaaagccgtggatcactcactttgcttgcgtccattgtgccaaagccggggatattgaccaccaaatcggggattgaagaaagcattttgccgacgtcggagctggacggagtggcgccagtggcaaatttgaccaaaggctcggaaaactaaaggaatgactgttgacagaacaaataatattaattatttaaatcgatttcgcccattaaatgattcagagactatttcgccattctccgaatttcaattacagtatctccccggtatacggtaatccctctgtcattccccacctgatctattgccgcgtccaatgtttttacgtccgatttgcgttgtgtggggattgtctttagggggantcnccttccnnnaatntnncnnntctcccccttaggaaggcggcgcagcgaaccgagcacttgagagcacaatttgcg

SEQ ID NO: 13665 - DNA, 1530 bp, Heterodera glycines
ttaaccattttatacataattggtgaaagacatgtcatcttatgctaacacggaggtagagcaagattttatctacgaaacttgaatttattaagaaattatggtataattatttagatgcctaataaaccaaaatatttgaaaaacaagtaaataagtaaacaaataaaaatgttaaaaatactaactaaagtaatataatgtttaggagaaaagaattttgaacaatttatgcaaatatatatttaaaatttaatatagaattatttttaatttttaatttgtatatcgaaaacatacattaccaaattgccctttgaatgtgagtcaacaacttatacccgcttatgggcacttcaattttgatttgataattgctactataaaatgcacaatttccttaagaggaaagttgctgtaagacttttttgttcagcataaaaaatattgttgtgcaaaaaattgttcgtttaaattcaatcaagcaaaagagcaataattttgcacgatttagcatttgtccataaacttttgacaatgactgtatgcccaattaactattatctatattatataaatagaattaaaactaaaataatatcagcaaagatttaaatgtatatgaattgccgaaaaataaacatttcaatcaaaaaattgtttttacatttaacaaaataaaatttaatttgtcattatataatgcaggcaagaatcaaaatataatccttatataaatttgacaatttctgtgagtccccggtgttgaatttggcagtgtataaacgttatgccaattttctttgcatgtctgccttgcactatttttacttatttattatgacttgcattttggggggagttagggaagacagcagacaaaaagaaaaacaaaaacaactttaatgcattagtttatgatgaaataattgttttttcattctttttctgtcaataatttttgttaacatttcctattgcttatgttcgttatatttcccaattagtttttccgaaaaccttattttatttgtcacaaaatatttggaattattttaaattactactattttcaattttttttatattttttaaattttatggaaaaatcatgattaaattatggtagatgtcaaatatgatgtttgttatcagcgaccccaaaaccctcctgaaacttatttttttgttggcaattaatttcgcgtaattccgtttaattttaagtggcgagaagctcccggacaatctgtcagtggacaatccgtcaatgaaagacaattctgcagtaggggacaatcggttagtggacattctgtcagtgcacaattcgtcggtgaaatattttttaaaaatatatttttaatatactaataattccaccccaaaagcctaattatcttcttttatcaattgtagaccaaaaacaaaaacgaaaaattcgatattttttcaaagggagaaaaaaatcagaaaatttgtccggagaaaataaaaatttttgattttaactttgagaaatcttccatc

SEQ ID NO: 13666 - DNA, 2395 bp, Heterodera glycines
  misc_feature (48)..(48): n is a, c, g, or t
  misc_feature (2385)..(2385): n is a, c, g, or t
cataaagtatatgaatttcaccaagaaaaactttttcgagtttcgggnccgctgatcacgaatatgccatcaaattcgacatctgccataatctaatctatgattttccataaaaaataaaagaaattagtaaaaaatatagaccagatgtagaagtcaaatttgatgccatattagtgatcagtgaacccaaaaccccgaaaacttatttttaagctatataaaaaaaatttcaaaatacttttttttaattgcaccctcaagtgtgtaattttgagacccatttttaggggcctatttttttgtatttttctaaggaattccgaagtcccgaaaagtggaccaaaaaaggcgaaatgcacaaacataagcatttagccattaagcctaaaaaattcaaaataggcaaaaataacattagaaggcagttataaattatatttcacattaaatagtgacctctctgacatatttctaaaattttgatcaaattgatctgatcgattttgcaaatttttgcccttaatccacttttatgttaattttgacggattgccttcactgacggattgaccgctgacggattttctactgacagattgtccactgacgaattttccggacctcaatctttaacgtttttattgttttttagtctgaattatatgtgtatttaatccatattagtttttcataatttatgataatttgtgtttttagatcaatatattatggttcgcaaaaagcaaagtttctcttcggaaacaaaagataccaatgtatcttcattgaataaaggggttcaaagctcccctgaaaaaaagcggtctgaaggggttcaaagctcccccgaaaaaaagcggatagattatgaagaaggggttccaagctcccagcaaaagcggatagtttttgacaatgttcgaacatatgaaaagcaaagcaaagacaatgttattttgatcaatttggatgatgaagattttgaaccgtgtacaagtaaacgaactatatgcaatgtagtgtccgaacaaaaaattgatcaattacggagagatagagaaaaacgtgtgagatatagagaaaatgaagcagaagcagaaagggataaaagaaccaaacaacatcgcttgcatatgcaaaatgttagggaaaatgaaatggaagttgaaaaaaatgaaagacaagaagctgataaattacgtaagagaaacattaaagaaaacgattctcatttgcaccaatataaggctaaaaatactaaacaaataagcaaggtttcttttggttttatgaatattgcatgtacgttttgtggtgctttacattgggcttaccaaaaagtacaaggaaaaaacagttttgatgattgttgtaatcatggaaacatttttttgagtgaaattccagaaccacctcaaatacttcgtaattttttgataggaaaggacaaaaaaagtcgaaatttttttgatgggattagatatttaaattcgagcttggcatttgctactatgaatccaatgcgtgtaaaacttccgaattatggtccgtattgtttccgtattcacggacaaatttatcacagaattaacattgctttacatccagacgatgatgaatcgccatctcatggtcatttatttatacttgatccagaagatgcaattaattccatgaaacaaaacaatcttaatgtggatacggatgttttggatcttttatataaaactataaaagaaagtagtccatttgttgacggtttagaaatgatgattgaagaagaaaatgttcaaaaagaaattgctctcaaagaaaatcgaaaaccttatgaggtccaattattattatcggataacaaaaatcttgacaaaagaagatacaatcttcctagagcaaacgaagttgctgcagtttttgtctgtgattctgaaggtataattcctgaacctcgcatagttattaaagaaaggggaaaatctttaaaaatattaaattgtaattgtgctgaagcagatccacttctttatccgattttcttaccttatggtaacaaacaatggagtcctgatattcaaaataaaaaggaaaaaaggatttcaagaagtcaatttattagatggcaattagctattaaagaaaatagatttaactcatttcttcatggtcgaaaattgtttcaacaatattgtgtagatcagtatgttcgaatagaaaatgatagaatgaaatatataagagagcaccaaaaagaattatgcgcggaaagttattttgaattagcagaatggttggaagatgaggatcaaagagaaaacaaaaaattgacaaaagtaattttaccatcaagagtaactggatcacccaagatatattgaacaaaanttaccaagac

SEQ ID NO: 13667 - DNA, 1213 bp, Heterodera glycines
gcggttttagaaacgccctggcggttttaagaaacgcccaaagtggcggttgtaagaaacgcccacctggcggttttaagaaacgcccaaagtggcggttgtaagaaacgcccacctggcggttttaagaaacgcccaatgtggcggtttttaagaaacgacatagcaccataaattggtgcatgatggtgcatagaaaaagaagtatcgcgatgccgacgcacggattcttcgtctcgtccaacgctataacgatatcaataacaatattgtccctcaaaatgatcacaattatgccaatgccaatgtcaatcccgaaaaccttaacaattttctcgctggtattttccgaaattatgagatgcgacctagtttgtcccggattttgttattattataaagttatgaattttctacaaaattttatgaatgggaaacaaaaaatgataaatttggttttattagttcttaagtttttctatttgaatctgacgcttgtacaagaactcgtacgaaaatgtcccccgtacgaaaacagcggtacgataacgaccctgaccgcatatttaatgtttactaaattgttttcacttttttagtttttaaattaaatataactttttgcttaatttttaacattaatcaatgaaataaaacgaatatgcttttatggaatatgtaaggaaaaagagcgagagcgatacagagagagaaaaaaagagagagaaaagtggggagagagaaaagaagatagagagagaaaaatggagagagagaaggggagagagagagaaaagagaagagagagactggtagagagcgaaagactgggagagagagaaagagaaaagaagagagagagaaaagaggatagagagaaggagagagcgagagaaaagagaaaaagagagagagactgggagagagcgagagagagagagagaaagaagagagagagaaaagataggtagatagagaaatggagagagagaagagagagtgagagagaggaaagagtagagagaaaagagggagagagaagaggtagagagaaagagtgagtgagaaaagaggatagtgagaaggagagaaagacagaaaaaaagagagagagaaaagaggagagagagactgggagagagagagatagagaagagagagagtgagagatagcgagagagagaaaagaggatagagagcaggagagagcgag

SEQ ID NO: 13668 - DNA, 1993 bp, Heterodera glycines
cgcaaacaaagttaataaatgattaaaattcatagttattcattttgcattgttttccctacctgccaaatcgttttcctttgtctttgtctttccatttgtcctcctttgttgttgttgttgatgtcgttctttttgttcagcgtcctcttctattttctctttcttgccgtaggcaaattttgaaagccctcgcggcggtgaaatgtctccgatttcttcgaccaacgaatcgccgtgggtgtcctttgtcattatttgatcctcactctcccctaccacaattctctccgtttctatttctcccctcctcctcctcgggctgttcccattttcatcaattaattggcctttttcctcttcctccaaatcaattacaccttctgcttctgttgaagcaaaaataaaggttagaatatacacaaatcatctgcatttgcattttgtacttttgctttcgtcatctctcatccattttcaatttcactttggcattgcattcattttcttattttctatttttattaatggaaactaaacttcttatatataaaataggttatttcgatgttgattgcataagttgatcacattactctttaagaatggtgttcaagtcggaaaatgacaaataaaactaatttggtcactcagtttttgaaaaaaaattaggcactatatggaaagtaacagtttttgaaacaaaagggggatccttttgttttgcaaaatttttttaagataaaaaaccatgataattttttatccggggttttaaaggtcgctaatcacgaatctgacatgtattttgactaattcctaatccctaacccgaactcgaataaaaatcgaaattttgaatttttaaaattatgattttttgttcaaatttagattaggaaatcggaatggatcaaaataattgaaggattcgtgatcggggaccccaaaaaccccagagaataaatttttatgactatcacaaaaaaaattttgcaaaacaaaagggtccccccttttgaaaaaattttcaaaaactgtcactttccatatagtgccaaaaattattattttttgttttttgacagtttagcccagaaatagtgatacgcaaatgtcggtccgaaaatgtcgcactacgtttcctttaccttctctcagtcgtccattgctcctccaatttctgttgcttttcgttggttgctctttttgctgttggtcgtcgttctctctgttggtaatgggtgccgtccgccactcatttccatgcctttccgttggcatttgccatagttccgctgactctccgccagcgcccgttttccggtggaaactcgtgaaaaaattgggaaaatctacggatgagtgcgcgacagaagggcagcaatttgaaatggcgacaccaattttttcgcctccgttttcgtgagaatgggacgactgtcgaaggaggtgagggagcggctgaagagggccatcggcacgggcactgccaccatttctcaccatttgtcggtcggttccccgtcctgctgaaatttggcgatatacaataattgctaattcatttttcacttttattaactcgcagagaacactttgaaaaatggaaagccaaaattaagtaggacaacaatcaactgtagttaattgcactgctctttgtcatcagacatttgttaaatgatcctatgaaaagaactctgtcctttatttgtgctatcgatttgtgaccttttggccaatcgccgcggggggggggcaagggaatgggacagcgaaactgcgaaagaaaacagaacagccaaaagttaatgagggacaatgaaagaggggcagttaaataaacgggacaggggggatacatgagaaaaatggacgaatggaagcaatgtttaaaccgtgctgggtcgtttcttaaaaactggcaagtgggcatttcttaaaaactgccaccatggggctttcttatatactgcccaagttgtaggaa

SEQ ID NO: 13669 - DNA, 2070 bp, Heterodera glycines
gtcaatttacgtttgcaaaaccagtcggttaattactggaaatgaaacgctattgttaaacagaaaaataacaattaattatagtagtaattttctttcccaaggtaagattcaaaatggcatcaattttaaaacggaacaggacgaaacacagccgccgaaacacagtcgagacatacacagccgggaataaatttttaaaaaattttttcaaacagaaatttttcaagaaaagtcttagaaaattcgatgaaaaattcaaaaattttccagcgattttttcaaaatttactgatgaattactgagtttttcaaaaaaaattcaaaaaaatcgctggaaaataaaaaaaagaataattcacatttatttttcaattttagagcagaaaatgtttttgatggcaccttttttctcatccatcgaccaacgccaaatgcatatgtaattgtccaccccagcggtgaaaatcattcgctcgccctcacaaatttccaatgcaaatggcctggccccatgtccaaatttgctgaaaagctaaagagaaggaaaagtaaaaaaagaaattggcacactcattctgacttgggcacccttttgaatgttccaaatgcgaagtgagcgatcgtcgccgacggaaaaaagccaacggaaattggaatcgcaacgaatggcaaaaggcattccctaaaaagaaagttaaaggcggaaaaagcgattaattgaacttcgtttcccgcaaaagtacgcaaaatttgaggcccaattgcgggttgaaagaaatgaatggcaccgaacgaagtgccggaaaaaacgcacagcgatggccaataatttccatgaagaaaggaggaggtccttagtttctttaaaattatgggaggaatttaagacaatgccaaattcttctgataggtccccttctgaaattggtattaaaagataatgtaaaaagcacctgaaattgcactaataaattacatgtatttttcaaagaatatggtaacttaatcgtaaaattatttttatacacaaatttaaaaacctaaggccaagaaggaaaggcaagtagcgatgtatgttttcaaacaagtttttggcactttttcgagattaagtcgtttagagactcagtgaaaatgcggcgcttcgaatagcttatttaaaataaaataaaagaaataaataaaatgtttgcttacacaagtgcttgacatcccaaacgaacagagaaaacttccgcaggcgatgaaacatttacaccaatttctccctcaggcaattccatcgttttgatccaattattggcaaaatgaaaggttaaaaagagctgtaaaaaatattactgacaatgagattattttcgtcctttcttccacctttttgcttttgcaagtggactcgtccttcttttcctcgttaagtattttagcacttaaaatccaatcataaaatgttccaaatgccattcgcttccaatcccagcatttccctttccgtgcattgtccaattgtgcatttttgaattttgtcgcagtgaaaaatgcgaattcacattcaccaacacatagaagagctaaaatagaatagaataaaatgatttgaaaagaaactatcgtagtactagtaataatgtgagaaataatacttgtctaaaattaaggcaatggtctagaattggtgtcccgacgaaaaaaagttaaaaattttccaggtatttttctaggcttaaaaaatatgctgatcacgaatctgagctcatattttgaaaatcattgatttttatccaagcttttttgtcaactaattgattttttaaattttttgaattattttaaaaaagtttagcaatgaatttggggttaaaaaatacgctggtcacgaatatgaactccgattttgaaaatcattgacttttatctatgatttttcatcaaacatcataaaaaataatccgcagccaagcggattcgaaccccagacccagtttatgtgcacgatcaaataaatgcgtaaatatttttgatgacacaaatcaacaatagtcgtaacaattgatgatgaaatcctaa

SEQ ID NO: 13670 - DNA, 734 bp, Heterodera glycines
ttacaaagttcttcatttcgagtaaattattgcagttcaaacaaaataaactcacaaaatttcctctcgcaagagccaaatggaaataattggtgtatagtatttttggtatttggaaaagcatcgaaagcatcgatcaatttataagatccactacagtcggagaatatttcgacgtaagaaccatgacctgaaaagaaattgccaagaattcttttcaatcctcaattctgaaaaacgaacttgaaaaacgcaatgtgaactcagttccacaggaaattgtgaatgacagagaagcaaaactgagacggggcaaagaaatcggaatggaatggaagcgaacatggaaattggacacagaaataccaaccatttgaaaccaaacctgggattggacaccaaaaagttattaagatggtaataaattaaaacaaaactaattaaaaagatcagtaaaagtttggcaaacaatttcgtcaatagaaaaagggctaaaagcattaaaattgtttatttttttcatcaacacaaacataacatttgggaaaagtccgagtcagcgcatccaattgatcatgtaaaaataccaatgcttttgcatcaagcaaaattgtctgctttcctccatctgttgtatttatttccatgagaatttcgtatttgttattcaaatgcgactcgtcacgagttgagacgtgcaaaaaaaaaaggttaaatgagaaagctgcacaatt

SEQ ID NO: 13671 - DNA, 1773 bp, Heterodera glycines
gggaactaatccaacgaacgaagagcaacacgccttttcttcttgctctattcaaagaggataaagaagggagagaacgtgcttttgcttcacttgtgaatcgttttggcctaaatgttgtatcccgttggacttatggacgttggtggaagaacttcgaatctggtcaattcatgctgagtcaacgtggacgtaagaataggcggataacattaaaactgcaatataaaaataggaaaattttcaactccaatggcctcgccagcgtcgtcggagagagatgacgatgacaatcttttttaaaaacgctttcaatcttctaatcaaggaggcccaaattcaaggacgtcccttgaatacaaggaggaatttaatttttatgaaattttaaaaatttttaattttgccaaaaattttttggactggcagttttccctgccatcattcccatcaattggctagtattaatttgacttttgattgtacgttgggtttgattagttttattgttaatttgccaaaaaaattcttaagtaccgtaaccttaaacggtgctaggtcgtttcttaaaaactgccactatgggcgtttcttaaatactgccaagtgggcgtttcttaaatactgccaagtgggcgtttcttaaatactgccaagtgggcgtttcttaaatactgccaagtgggcgtttcttaaatactgccaagttgtagtaaaataaaaaatgtaagacatataaattcgtatcttggcccaatttcatccaaattaataattattggtattattcaatagcattaagtgttgtctatcagaatagaaattttgaaaatttttttacaaaattaaaaaaaagttatggtcataaattttcaatgaattttcagtcaaattattttaccagaacttttttaaaactcgatggaattttttgaaattttattcataaatagagaattcttaggactatcgaatatataaatttattttctcttaattgcattttaatgccttgaaaattttaattttttctggacaaaaaattccgacttaaggttttgtggagttgaataaccatatctttttatatacttaagtaaaaaatttaataaaattatattctgatagagaacacctatagctattgaatgataccaagaattattaatttggttgtatttgagctaagttatgaatttatatgtcttacattttttattttcctacaacttggcagtatttaagaaacgcccacttggcagtttttaagaaacgccctggcagttttaagaaacgcccatcgtggcagtttttaagaaacgacccagcacgatttcgaataacgaagaagatggtggggagagaagaggagggaggaaaaggaagaggagggcaaacagtagcaggtgcgtgggggggggcgcccatttttgtgccggccattttggcgacaaacgctataattagggttcgaagttgtatgtaataacaaatgccaaatatgcgcatgcgtttttggataattgcaaaaattttgacttataagatttataaatgcaatttcgaatatttacattttgatacatttcaatggcgtgagaatgtgaaactgaagttgtatatggctaaaacaaaattatatttaaaaattttaacgtataaatattatttttgagcctttttcatagcggtgtccagacatttgcggctcggacatttgcggccccagccaaattggacatttgcggcgcgacttttgtggcccgacatttg

SEQ ID NO: 13672 - DNA, 1213 bp, Heterodera glycines
atttggcaccgatttgattttgttcgcgctttttgtcggcttatttggcgtatttggtgctgaactggccttctttttccgcaaaaatgatggtgtgtatcgtgaactgtttgatgctgatgatggtgattttggtttctttggcgttttgtccacaatttttgtcgattttggatttgtttggatcccatttggctgagcgcgttgatcaaatttcattttctcactgtgtttaccgatcagaaacacttggccataactgactatttcgtcaggtttttttgcattgtataaaactgtaaattaaaaaatgggtttttaattcatttaaatactgattttttgggtattgtgtctcataccgtatctctcctctctctctcccttccttcactcttttattccattctctctcccccctcacctttatctttcgcttacctctccctcactacctctctttttgtctttcactctctccctctctctctctctctctctctcgtatcacttctctctctctcattcttctcttactctctcccttcctcatgtgaaatttttcttgaaattaatatgcgttttttaataaaaaaaaaatattcttttataaattaaaataaactaacccaaaaatgaagagatagcgaaaaatgccaaaaagaatgtgctcatttaaaaaagaattatataatattcttatgaaatattaatataatacatataaatatatttaagctaggatgttgcttcatcttttttttatatgacttaaatatagatcaataaaactcatttttatagaaattattgcagattcgcgtgccaccatcatgaggtgacatcacaggttttttcttaaatattgaatatgacatcataaaatattatttttatgtgtaatatccttaacgaaaaaagtttttgaaatatgtaaaattattttaaatttataaaatttttggttatttttatgaatattttttttcgaaaaattaaatctaaatatataagcaggaatagaagaatgcttagaaaacagtttttatttgttttaaaaaaaagagttcatttggtaaactttttattcgaaaatctaaattttcgtattatttaaaaatatttcatggtatataattcaaatataaaataaaaacatataggcgaaaattatctccgcaaagaaatatacgaaaaaataataaaaacaaat

SEQ ID NO: 13673 - DNA, 2136 bp, Heterodera glycines
  misc_feature (45)..(45): n is a, c, g, or t
  misc_feature (91)..(91): n is a, c, g, or t
tccgctggccgtctggtcgttcgactgttgtcgttctgctccgcnccgtttgcccgaagaggcagccgacgtgcccgtgccaccgccgctngtcctccgcccatggtgttcgatttgtggcccttgaattgaagggaaaacgttttcataattgatagtaatgaattattgcaaggaaaattagaataatttatttcgggggacctcaaattccattcttattagttaaggcatagagcaaagaatcgcaaaacaaaaccaaacagacaaagcccgatgaatgaagacatgagtcgattcgaatcaaatcggttttggtgcatttttttcaactcacgcaccccatcacgaaaacacacatccaaaagtgtattcgggttgctgatcataatccggcatccatttcaattaattctgagcccctgaccgaattcgaatatagtcaaaaagttttgagttttttgcttgaatatgggtcaggggttcggaattggtcaaatggatgccaaaaaatgaaggctttgtaccgagactcccgccctgctttggtttccaagccctgccgttcctagtcgatttcaaatttccatccccaattaaaaccttgttctgcgatgttgtcgacatctttctgacctttgcttcctttgcagccgactcagaagaggacaaaacaacggcgttattcgaccctaaacaaacaaaatgtttggccggcagtcaatcggtaacttaacgagtcaatggacttgggtatttcaaaacgcacccgggtcaattatcaaaaggatctccgatatggtttttcgaaaaaacaaataattttactcccggccatgttaaactcaaaccaatgacgaacagtgtggcgatttttgtggacatgaacacctcccagcagaaaccaaagcccgggaataaaccttgtcccccagcggcgccgttcgccgagtccgtttggtttgcgctgtgtcgcttccgctgtccgcttgtcgtctcagtgcgtccgtctccttcgccgccactctctgccggtggtggcgtaacagcactttgttgatgatttgacatcaaaaagttaattagcaattgtatgtctgtgcaataagtggtggaataattttgcgctattaaaaacattttttgaaagtgttagaaccaggggaggagtatattttttgaattagcgggaacaaaaacaaaatttggcgttatgtgtaactggcctagatctttaggcaaattatttcaccacttatcgcgcacagacaactacagatcggtattttggaaaaagcctgtacctgtaactgtacctgtatttcccgatcggcctgtttccagggtattctggtccgctgaacatgaatataatatttatttcgattaattccgaaccccgggcccggattcgaataaaaagtcgaaaaataaattttatatttcgggtttgattgggatgaattttaagttattttatatgttaggtgtgaactttatagaatttatgcactgttgcatatcaattttgggcaataaatgcgaattttgaaaaaattttgtttttcaactttttgttcgagtctgggtccgaggttcggaattggtcaaaatggatgtcatatttgtgatcagccgttccgaatacgtttttctgtttgtgttcgcagagatttgttaaaaatggtattagattcgtgttagcaaccccgaaaaaaacccctaagaacgagttttgcgcttttttatgacttatcctcatttatgttttcacgtatatttaacgtcctacgtcgccactccaatcgccgatgcccgcgagcgcagaaggaggcggcggttggccgcctcgcgtcactcccaagcctccctggtgagcgaggacgaaatgattttcgtcattgccgccgggggtggcgagggaggtggggtgccgccaccctcctcctcctcctcctcctccagcagcagcaacttgccaccattgaacagttcaagggcggatcaccaacgctgcggcccgcgagggtgttgggcgccaccacgcgcgggcccgccgcttcgctgctacccgccactcccaggcctccctggtgagtgaggacgaaaatattttcgtccctgccgccggggggg

SEQ ID NO: 13674 - DNA, 2472 bp, Heterodera glycines
accaaggacaagaagaccaaggacaagaagaacaaagcagctccaccaatgccagcagcaccaccagcagcagtagcaacaacagtgtcaactagagtagagcgggaccgggaattttgggcaaacccgggaccgggaccttttcgggttgaaaaaccgggaatttttggcttggaaaaccggggaaaaacccgggactggtcccggtcaaaaccgggacctcggtactcagttgtccgtgttttggtcccggtcccgctctactctagtgtcaacgacactgatgatgacgacactgatgctgctgctgatgaggagggctccgatggagaggaggaaacgacggatgaaatcgaggacaacggcgagcagcaaccgaacgcggcgccgacgccatccgccgcttcgtctggtgagcaaagctttggaaatgtgaacaccagttctcggacctaattccgtaaaaacgaagcatccctacccttcccctttcttccaacaccaacaattaaattccatccaattttcttcctcattatcctaatattgttcatgttttcagcctctacgcatcgtcgacgctccaaatcaactcacaaaaaacagaaaaaggcatcaaccgctgggcgtggttaatgtggccactacagcaggcacatcttcttcatcgtcgacggcggcgtcttcgtcaaaaataggtccaatgaatgataattaaaaaataaactctttaatcatttcccaatttggtctttttcatgcgctttcattttcagtcgacacaaagtctgggcccattccatcgccgctggaagcgtttttgaaaccgcagctgaacaacgcgatgtccgacccgtctcagaactgtctgattctgctgcaagtgctctacgggctgaacacattttggtggcgaatttttgatgcaaatgatgccgacactgatgaggacggcaatgatgctgctgctgatgaggaggagggctccgatggagaggaggaaacgacggatgaagtcgaggacaacgagcagaaacaaccgcaaacaaatttaccaccaatcacacacagaccgatcatcgccccgaggtttgatttttttaatgccatttttatttttcattggttttctgcgaattattttaaaattatggctgacaaaacagcaataaaagtctcataattttcagtttcttctactcaccaaagctgaattccaaagtgacgcgtcaactgtctgactttttgacggttgcaacccaacaaataccgaaatgttagtttgtcttttttttaatttagtgtcattttttatttttttttagggacattggacttggttcgagcggtgtaagtttcctaattcttttttaaactgttaatcccatggaattttcctggtgttttttttccaaacttttttcaaatttcgtccaatgtatccttttcagtccgttcatcttcaacttctcctcccgccattccttcctgttttgcactgcgtttggccgtgatcgggcactgatgcatttggtgaacgagacgagcaacgacgagcaggacggcgccgggcatgacaccgcctcgcggctgatcactcggctggagcgccgcaaagtgcattttgtgccaagtttggttcaaatgcttatctaatatttataattgatcaattcgatgaaattgttgtcttgatcaacattgagggatttgcgctaagactttccctctaatgccatttgctggcgcattttcaaatcaacatcgaaatgttaccatcactgaaattctttaaacatcccttttaacaaatttattgatgaatgcatttgctccctgctggtctgtgttgaagttgaatccaattggtcattacagtgacgcaatgatcagtgacgaactgaacagtgaatcggaatcaaaaaaatcagtttttacggtttttttcagcaaatttttcaaaaactttagggaaacacgggggaggccggcggtgccgataggggccgccggaaaaattttgcaaatttgaatgtaatttattaacagaatttatcttaaactgtccatagtttgtgattttgaactaatttataagaaaatagtgggtttttaggtctggcagtgccggtcagggcttggcgaagctcagcttggcactcgaagccgaagctcgaaatgaagcccaattttttcgaagcacgaagcccaaaaaacgcgaagtttttaaagctcgaagtttcgcccagccctggtgccgataggcaccgatggaaaaatatgtagacaacaatttttattctgattatcggacaaaattcttagaaatcgttgtgccatgaaactacctaataagatttagaataatgttttaggaatttaaaaaaataatttattgataattcttttttgaaagtcacaaatggccaaattttgagtcaaattttgaaaactttagtggaattttggaga

SEQ ID NO: 13675 - DNA, 3747 bp, Heterodera glycines
ttaccttgattagttaccatcccaatgaaatccgcacattccggccacttttttcgcgcgtcaaatttggacggaagttctgtagccgacttctgtgataactcaatttcagcaagaaattatggcattatcgcatttttacaaattaaaataaaaaattgattaattcaatctatagaaaatttgaataattttcggtaattcatttaatttgttagccttttgctgctgcgttttgttgtcgtgtagttggcttgccaaggaaccattagcgttgtatcgaggtgtttcaagtgacccaaccatatttctaagcatttcctcgtccataagtgcgaaattttcgtggacgacggccttaaaaaatattattaaaaaatattttatgccccaacgaactgtccaataattttgcgcttcattcagtatatccacatattcctgttctttctctaacttttccatacgttgcgtatccttaattattgtaataactgctttttaattgaaattgtttcaataacactaataatctaccgcctcattggtcaaattgttggcaacgcatgtcatcccatcggtgattgcacttggcattactgctgcgacctgtgttccaaaggttattttgatatgtagaaagatagaatatttaaatacaataacaaaaagaaatatgaaaaacaaagaatgattttttgactttttcctatttaattattttaaagtcaattcatcatatcgttttgtagtttttatgaaaatatacacatgaattaaaaatggcaattactgcggcattgtccgcgtcggtgacattctccgcatcggtggtattgttttccgccaaagtgatggcgattacaatgacgagagcggtgaacaaaaaaagaacaaaagaatgcttaaaagggttggattgagccattgctaaaagaaaaaaagtttcgcttttggataatttttgtccaaattttattttttatttaaaattaatttatgacatttgtgactataaatatgaccacaactgttcctttatatagagaggagaaatgggaagctaaagaaaataaaatcaaaaaataagatggaaaattaattcggtaaggaatggcaatgaaagtcagcaaattgtaatgtgaaattattcaacaaatggcacaacatttttagtgtaaacagacttaataaattcacaacattttaaatttctttcacttttcatttgctgaatcaatttttactatcagaacgaatgccaatgcctttcatttacattctttttcttttgacatttactgaattaatttttcctttcaaaatgaattccttttccattttttctttgtttttcaacgtccattgctttttctcctccatataaaagcgatacataagctgtgattcctttgatcattttatctcaatacattatcgtttctttaaatgtcataacttttcccagtcaaagaaaaactaaaggatagtgaccagggctgcacgcaagtggatttacaattacggaaatccgcaatccgcaattgcggcgattttctcagttgcggaaatccgcaatccgcaattacgggtgtccaaaaaccccgcaatttccgtaatttccgtaatccgcaatccgcaattaaaaaaaaaatttttttaaataattttaaattttattttaaaaaatcctataaatcttttaaagcaatttaaaagcatattaaaaagcaaaatcattcaattgagaaaccggttaaaagcaaattgtgatgaagaaacaaaagttttgcaagattttctggtaatactctttcgcaagtcatctgaaattagaccggccgttgagaaaagcctctcactttctgaacttgttgcaggcggagaaagaaatttccgtacaacggcaccaatcattggccatttttgtgaattaacttcccagtataatgatggatcggccctggatttgattttttggtcccgtaaatattcagctttacatttagcagttgctttgccttgacgctcaaaataataccaccaattaccaggatttaagtttgacatttttaaattgctaaagaaataagaatttaaacaaatgtatatattttctttaaataaaaatagaaaaaaattcattttataaaaaataatcttacaagaaatcgtctcgaaaaataatccaatagtcaaattacggatcaaaattgcggataaatcccaaaaatccgcaacccgcaatccgcaattacgggggtccaaaaaccccgcaatttccgtaatccgcaatccgcaatccgcaattgcgtgcagccctgatactgtagcaccttaggctcaagtgatggcgatgttttttaaaattttaaatgtggagggattattttaattccctttttctcaattttagatttaaaatatttttgtctcaacttttttcttcaatatagtagtatcatatagaacatttacaaaatttttatccatcattttgatctaactattttcacacttttacgaatttacatagatattttatgtgggcaaatttttttcggtattacttagggtgtaacataagtttccgcacaactttttttaaagaatttttttatgaatataaatttaaaaaaccacaatcatgatccgaaatatctgacattattattgagaatgagtttgctatttatcgggcaagggataaatcccattagaaaagtatttaaggagttagagttgataatgtaaaaatggtcattttcgaggtatgtatttttgatggctgatttaaagaaaatgaaaagagatacagaggcagagaaaacgtgagtaaaaagagcaaagttaggactataaaaaattataagaaaaaaattttattacttcaaaaatgaattattggagggccgagtctaaaaatggtctccaaaaacggcatttttcaagaccatcaaataacaaaatgttttaaaagtggttttggaaattccgaatttaattaaactaagtaaattgaccacgctgagtccgaatatggctttagatttggtctctgggttctcaacaaacctgtacagctccaacttcatgcatggagttggagcagtacaagctcagggttaaaagataggtcagatttaaggccatattcggattctactggtctaatttgtacagaaaaccttcttttttgttatatcaggttacttttttgaccataaaaaaatcgagaaaaattagtgggccaattttcaatttttgcatggtcgggaaaaaatactaaaaaattgaataagcaaataaaaaatgaaacaatggcatgaaatgaaagaagactttctgatgaacaaaataaaaaaagaattattaaaataactgcagaaattacggagttatgaatttttgaatttgtcaaaaaaaaattgtgcggaaacttatgttacaccctaagtatttttatagacgcctataggaagccaaaagctacggtaaacaaatagcaaacacccttacaaaggagaggtacccaagtgaccatgggacttccgaatgaaactttcagggtaggtagattaccccccctttgtattataaatttttttttatttttgctaaatgaagcttctggccgagatatgaagcttttcctttttgccttttcaatatcattttcaaagaatgtaaagccaatgtgagagtgggtggcctggtggttgtgccttcccatacttttttcttctt

SEQ ID NO: 13676 - DNA, 1895 bp, Heterodera glycines
  misc_feature (1868)..(1868): n is a, c, g, or t
  misc_feature (1885)..(1885): n is a, c, g, or t
attgtatgccaccctttttacatgtttaaatgccacttcttagtcgtcattttctgccgttgtacccacacttttggaattctccaacattccggcatattcgaacagtggtgtcccggcatcaatgtcctccaatgtttgaagagcccagccaatttccggatccttgaagtacacctgggaaaataatagtaaaaaattggaattaattaaagtattaattgcattggttgcttataattacttgataacgcccactgggacgcataattgggccatttgtgttgggaatgtcctggaaaacattaaatgattctagtttaggaaaaatattaaattatttttagattttagacagtaaataaaaatataaattaatttttaagcgaattttctcaccacaacattttctcccttttctgtgctggtgatgtattcaaatgagtccatttcctcgtcattgtacgtgttgagcacgcgcagtttgttcagttctttgccgttgctcaggtcctcgttcacaactaaagaaaacaaaataatgaatttttcatttaaattttttgcgtttattaattttattttaaatttgggaacatttgaatatgccgacagatgtcgctggattttaaaaatttaatccattttattaatagatttaaaaaaaataaataaaatccaaggatataatttgaaactaattaacggatgggagcccaattttactttatctatttgcgttaccctttttcattttccactgtgtgatgaaaaatgaacgcttcgccggacgccctccggcacatttgtaagccgtctgttttcgtggcatacggccacctgtgcttttgcaagctaattgctttaaacgcattttcaggtattattttgcgaataaaaaaagtgtctctaaaagttttttcttttgagtcgtcatataattttttcggtaaatttgaaaataatttaaaactgtgtatgtataaagaaataaagaatatttaatggtaatttatgcacaaaatggaacattaaaatgtttttttaggttgaagaggttgatgcctgatgagggtaattataattaatctgggaatgtccgttaatgagtagggctgggaattaagtgaaatgtctttttttttttgccgattcgtaatgaccttaattttccatgacataaattcccaatcaatgagtgagtcatcatcacagacgcacatgagaaaaattaaattttctcgaaatttttaaaaataaatacaaaaaatttgggttaaattttgaagatttctagggggacaggtactataaaggccacgagagaaacaaatgatttcaatttttataaattttcaccgaatatgctcactttttgaggctttaaaaaggaaaaattcaagagatgataaaaattttgaaatttaatgaagttttaaatatttttattgtgagtcaaattggaatttagcgcgggcaatgggcaggccagtgagagagtgaatgagtgagtttctcttaaccgacgcgccgtttttcgtctttgtcatcgccgccgtcgcccgccctcaccgccgccgccgccgccgtcgatggagaaaattgattttggggtaaagtaaaaatgtacatgtggacgagatatacggcatcaaaacggtcaaattgattgaatttgtctgaccgtcccgccatttggccttttgtttgtccgtccgtcgtccaattacgaggtggacgggcagaatatataaaacaaatttgttgagcggagggggggggggagatggctaagcaaataatttttcttataaattctcaatttcccttccgaaaaagtgaaatacaaagaagaatatttactcaanagtctttccaagatctnatgttttcga

SEQ ID NO: 13677 - DNA, 1278 bp, Heterodera glycines
  misc_feature (1169)..(1169): n is a, c, g, or t
  misc_feature (1177)..(1177): n is a, c, g, or t
  misc_feature (1243)..(1243): n is a, c, g, or t
ttgttgtaaagtatgttaatataatgtaggctaaaaaatatcaggaatatatatgattataaaagtttattccataaaattctctccctctttttataactttcttttattttctttctctctctctctctctatatgtataggcgcgctgtcaaaatgtccctgcgtcaaaatgtcccagcgtcataatgtccccgcgtcataatgtcccagcgtcataatgtcccagcgtcataatgtccctgcgtcataatgtcccagcgtcataatgtccttgcgtcataatgtcccccaagccaaaatgagtcaaaatgtccccctctaaaaattagtgaaaaaactgaagattatataatttttgatttcgcaaatactaagttcattaaaaattgatcaaaatcaattaaacaacaaaaaaatcaatcaacaatgggattttctaattaattgaaggaataataacaacaaaatgaacaattttaagggacatgcatggtcgaatcatcaaaattttcatagtccttcaattttcctgcatatccttcgacctgcagaccaagagccgtcataacatcgtgaatttcggcatcattgtcgtatgtggcgtccgctaaaattcgcatgatgactgcgtcttgcagcacgtagcgtttgtgtcgtttgtgtatgaagttccgagctgatctcgctgcgtccacttttttgtcgatacttctgctgacttcataaataaagtcggaaagggccgggtggtgacaaagacccttctaaaattgaagtttttgggggaggtttcataagtgaaaaaatacagcgaaatggaggtgcgttgcttcgaggccattgttggttctcgcgagggcagaagctgcatgtgagtgcacgttccaatatggaattgggaacagtgcgcgacggacgacgggttcttcccagggacggactaaaattataaaaatgaaaagtttaataaatttgggtatgcctgtcagcagtgtcgttgttgtccaaaaacttacgcttacgacttttttggagaatttcaattttgttacggtccatattgatgctaaagcataaatttaaaaagcagatcgtatgaaggcatataattatataattttcagttttttcactaatttttagagggggacattttgactcatttntggcttgngggacattatgacgcagggacattatgacgctgggacatttcgacgctgggacattatgacgctgngacattatgacgcagggacattttgatgggcagcg

SEQ ID NO: 13678 - DNA, 1728 bp, Heterodera glycines
  misc_feature (1694)..(1694): n is a, c, g, or t
  misc_feature (1722)..(1722): n is a, c, g, or t
cgaatatggcattaattgtggcctattaagcaaatttggcgctagttataaagtgatagattttgaattttatcaaaaaccataggggggacccttttgttttgtaaatttttttttggataaaaatcgtgaatatacattttattcaccataattgtgctgttaatacttaatattcatcattatgtgtaaaaaaaacaaaaaaaaaatttgaccaaaaaaaagttgaaaaaaatttcaaaaggttactctttgcaactagcgccaagaatgtttaaaggacccttttgctgatgatagcgcagaccaacagcaaaagtgtgctgatgccgtagccactcattccgctgattgtgaggactcggaagtcgcatcgccatgcggccaaaatgtcgaagaaatatgggaaaagcattgcgaaatggacgacctaataattgacgaaatgtggaaatatgcaatgacatattcaattcgaatgctcaatttggtcccaaattttattccctttaataggccataaaataaattcaaaagtaaatttaattaattgtcaggaaatggacgaacaccaaattcctgtttggtatgtcatggacgaattcggtgttcgaattggccattctcttcagccaaacgtaaaaagcaattaaaactgtctttggtttgcatttatattcctgttttaaaggtcaaaatggttccgtttctcgacttttctgaaaatatggcctacagtttgcttttccccgtccaaaatatttcagaggggggttagtttttcttcaaattattgttttaaactattttatgtgcaattcttaagacactgtgactcgcaattatgtcgatacgcaacttctcaaaactcatcccgattggttggatgtactgctccatccctggcaacccttccccaatttcgctgctttctcaatttgtcacgttcccaagcgggacgaatatttcatggtaaaaaaaagatttttacccattttctaagcaattgtccgtcttatctctcctcatttgtccctccaattcagtccggtcgtctgctcgacttaatcccttccggagaccaaagcccaacggtcaatttccaaaagtctgtggatgacccggacattttggtgtgtgcctcggatttgcaactcatcggacatttgcgccgattccgtgtgcaagaaacaaacgatccgatgaaagcgcatatcatttggcgtcgtgaccatttcaacgattttaggcactcattttcactgatttacattttcattttcccttttgatcagatcgttggcgtaccaaaatccaagcgctttgatcaaccaatttccgtttgaatccgttctgaccgtcaaagatcttttcgcagctgccgtccaatcattcgtcgaaaattgccaagatgtccaccccgaccagcaattggtggacgaattatccctccgttggtcccccgaatggtttccgctcaccttcaaccttcacattgaactgccccaatttgtcgcatattttcagagacgggcagcgaagtcagtgtttttaactttcatttcgcataaatatgcttttattttttgagaaatttggacaactgttggattgtgaagccgtggaatttggcacgggcaatggacactcacgtgacacgcaatttgaacacgatcattcgtttggccgaaagntggtcccaaagtctagtcccattgactngtttaa

SEQ ID NO: 13679 - DNA, 632 bp, Heterodera glycines
tgattataaaatttaaaaatatacccataaatttttaaaattttcgtttggggggggaggaattcaaaacaagtttccattattggcaaattaagtgaatacaatttgcaaaatttggacgaccattttgcgcatttaacagtacatcagtacggagacaaaaaggacagtgtttaccaggcaacggaagaatttggacaagaaaatgtcgtcatctaaacgtattttcagctccgttgcgatgaatttgtggtccaactttgcaagcagtatccgaagctgaactggaaaatagtgcagggaaagattaacgcagtgatagcggaagtgttcaaagttgtgataaagtgggtggacagattaacaaattgtgcccttaagatacatggaaagggggggggggggggtcgaccgaaatttgcgaagggttcagccatgtaattcgacgaccttttttttgcttttcaaagcctctttttgcggcgcactttttccaaaaaatatttcttgaacagggggccggcggtgtcgataggcgcggccgtggtaaaattttaagaatttttaatgaaattggttaagaaaatagccaaatttttcagaaattttcctcttttcccctcgttacgacc

SEQ ID NO: 13680 - DNA, 1710 bp, Heterodera glycines
  misc_feature (1693)..(1693): n is a, c, g, or t
cctttgcaaaatgctttttttctttttgtccttttccgtcaacaaaagcagtttgattgtcggcgaccgacgaaatcggtccgccgactgcgcgggggaccgacggacggagggacaaacagcccaaactcagtccaaaacgaaggaggaaccgaaggcggacagaccgacggcggacgacgacgacagacgaactctccttctcccccccccccctccgagtgttttactgctccatttcctcgtcgtcgacaaattgcagcagccgatgggagagggttttgctgtgattagtgaattttgaagatgaaacggagggcgtttatttgaaaaacgcactttgaaaaagatacttttttatgggaaaaacagcacaaaggccatttgtttttgtttgttcctgactcaatttgcccaaatccatcattcatttctctgctttcgcttaggggggggggggggggtaatacaattgtgtaaattattgcaaaatatcaattaaaagcaaagttttacccaaacaaaatattaaatttcgaatattcatttatattttttttaaataggattctttctttgtggagcaatttgtcattcagtaaaatttatttccacacaatgcatccaatgaatcattcattaatttataaattgaaaagggaactaaaataaaactttggtttctttgccatttctttattgttttatcagtgtcattaaaaattccattgccaattaattaatttatttatttgtttatttatttattcgatgccttttgacccttcgctttgcttcagaattctcgagggtattcagcgggaaatgttatcaaataatttggccaattgcatttggtcatcatcatatttggggacgaatgtcaatgtgcaaagtattcaaaagcaaatgaaagccgtgcaattcaaagtcaaatgattcaaatggcatggcattttaacgaaagaatgcaaaaaaagtatttttcatttctttttcttttttttctcaccaattaataaaaatctgtacttacaattagataaacaaaaacattcaagtagaagtgtttttattgctttgtttttgcctttttctgccgtttataaacattttcacaaattcacgtgaattcggcactgaatttggaagattcacgtgaagaaagcatgtctcaccgcttttgcattcatttgtgacctgtgacgggagtgcttttaagcacccgacacaaacgcccccattcattcccacacaaaaatcagcagcgagcgaatcgcccctccccccgccgcccccacggcattattcaacaaatttccaaattcttgacgcaattctcagagcaaaaatggaagcaatggaatgaattattgctccaatgaaaagcagcaaaatgagtaatcattgctaaaaattaatttgcgagagggaattactcactgcacgagaaacattaattaataattattatttgggatggaatttcttgaaaattgtccaaaatttgtacatacactcacataattaaattttaatagatacaacaaaaaatcaaaatgaaaagaaacgcaactccaaaactcccttttgcaaattaaaaaatgataatttttgaaaatgatttatgaaaattttcaaaatttatttttttaaataaaataaatatcaaattgattttgtctgtcgccanaaaatttcaaattaatt

SEQ ID NO: 13681 - DNA, 1073 bp, Heterodera glycines
gcattccattcagaaataggttgagattttttttaaaaatttaccaaaaagcgctatgtcattttttggacaaaatctgtcataaaatgcgctcaattttttaaaattttccccggcgccgcctatctgaatcgccggcctcttcacttttttccatttatgccgaagctctcaaaaatttcttcttcttaaattcagttttaaaatttcacggttttttcgatcaaggtcacggtcaccatttacggggtcaattcacggtcactattcacggtttacgggtttttcagtcacgatgcaccgctaactattattccgcaatagtttttgtaattctattttttaaactttattcggaaatcaatttacaatattacattcgtgtacataaaaagaaatttgttttattttatttttcaaacgtatattttcttcaaaaaaattattacttattaataagattttacaaagttttaaatattagagaaaactttatatattaaacatagttctttttattttataaaattttcagattttagtaaaaaaaatttaaaaaaatcagagccaatttttttactaagtccaatgacacttcactatttctgtcaattaaatttaataatctttttaataattttatccatactgttttgtgacttataaagtttcatttttattaaataaatttttatttattctgttattatttagtttattcgtcaaaaagtataatattgcaaattcatttgtctcattataataaaaatattatttattacgattggtttaaattcaccctttaagcaaccaaataatgagaattttttatgcaccaaaattttgcctcattaaaccaaaaaaccaaatgcaaggatttacaataatttttctgttgaaaagcagaaatagttaaaaatagcatttaattcacaagtcaaattagttgctaaaaaatttcataaacgaaaatagttgctaaaaattcgctctaaatcgaaaagtgattgaagaaaatgtgtttttgcgcttatctcagcatatgaaatccgcaaaaaataggtgaagaccta

SEQ ID NO: 13682 - DNA, 1850 bp, Heterodera glycines
  misc_feature (1834)..(1834): n is a, c, g, or t
ttctttattcttcttcatcaaaaatgttttgtctgacccttcttgagagttcagcactctctcattttgccttatctctcttcaaatgttatttctcgctaaaagtcatttttaaaaaattgctttaaattttcaaaaaatgatacaaattttaaaaatagcgttgatattacgttgatggcataatgttatgttgatttaattaaatatcaacattgatgttgatatttattattttcctcatgctataaaaattttttcattgtatagcattgattttagaaaattattcctctgctaattaaaacatttttatgtaaaaaaatatttttgacagcaacaacaaaaaaaatttccgcaatttgccacactttgtgctttggcaaaattgataatttccgacagatatatttttacttcctgaccaacgcaaataaagcgtattaatgtttaaaaaaatttgaattaaaaaaaaagaaaaaaatagaatataaattaaaaaataaattgtttcaacaaaaatatttttgcaatttttactaatattatataaaaacaaattaatttttaattaattaaaaaataaaataagttttgatttttttttgttaaatgaaattataaattttaattgaaggaaaattttttttattattataattatatagtaataattttatcatcttgattataatatcttatataaaattatttataacatatattttttaattataaatttacatgattctgtccgtagccacttgcctcacagcaatttgagccttaatttgtttctcaattactttaattatgctttattaaagaacatgtttctgcgcattgccgtgtgattgaagtgaacgatttcagcatggtcagaattgtagtcaaaaagcaattttttttttaattttgccattcttaattaacatactgaacaatatttttcccagggcggcacactttaaaatcgttttattaaaaaatttttggaatttaatttttaaattaaaaaagccaactttaattatcgttccggtaagttttgaatttaattttgtaaagaaagtacaaaatgagtttatgttccaatttttcttgcatttaatgccagcctcactttttattaatttaattcagttctttttagtccattagttttaattatggctcttaaaaatagaatcccaattttgggttatatttcatggatataatgggattactggtttgatagcgttgtccggttccatttccaccagtgtgtcattggcacaccattcttcctcatcggcacccggtgaggccaacgaatttgtgtacgtaaaatggcacgcttaaattttaaatggaattcattaagccttaattgttttttttttaaaataaccaaagcaactgagtgaatcggtcaagctgaaattgacggaataaaggaagaataaaatttaaaaaatggagagttttttatttcaaatttttcatttttggtaaaaagaaatttacgtatttaaatgggtaaagaaagaccaaaaaaatatgtgaaaatttggcctttccttttctttcaaaatgtttgttgagagaaatttaatagtaaaatggagtgaaagatacaaatcttttgaatattatcaaatttattagccgataagtaatttaaaatattcgaatgtccgaaaaatatgcaaaattttcaaaattcgtttcaaaattaaattcttgaaattagttaagtgaccatagaacgttaaaaaaattcaatattaactattttatttatttatttgatattttaaatcttaccgagtcttatgtctaggtgtaatanaaaaatttatgctttt

SEQ ID NO: 13683 - DNA, 1250 bp, Heterodera glycines
agtacagcaagttcatcgagaagtgagcagacttcaaaaattcgaggaaagactgagccctgatcaaaaacatgacaaattgaataaaaatgatcgaaaaacaagcgcgacttccaaaaaggatgagacaaagctaaagattaagccaacatttgagcaaaatcaagatcaaaacgcaacaagaagctcttccaaaactaagcagaaaaaaggaaatgaaaagccgatcaatgatcaaaggcctagcagaaatttagagcaaacaacaagcattgcttcaaatagtgatcaagcgaagtctaagaaagaaattaatctggcaaatcgccaaggctctggtcaaattagtcagaatgcaactgcggcttcaaagagtgatcaaatcaaagataaggggaaaaagccgatttctgaacaaataaaaagctctaatgaaaaaaagagtgaaaaacatgataccactgaacaagaaatgaatgtaaatcgaaaacaaaaacagaaaaaattcattagaaccacatcatttgcatccccgtcaactcgacagatcagcaaaaagacgaaaaattttcagaaaaatgaaaataattatgtgcaaaaacaaataactagcgcaaaaaagcgacgatatgagaatttgaaaatggaaatggaaaatggtagaaatggaagaagcccaaaacggttaaagatggaaaatttaaatgagaaaacggatggacaacaggtaaatgaattttgtgaaaatttatttattttgatggcataacgaattttgcttttgaatattcaaaaagcaaacattaaatgcaattatgtaataagtaaaattaattaggaaatctcatctagacacagattgttgcctaaatactggtctaattataagcgaattcataccagggttaggcgtggacagaaaaacccgcggtcgcggaccgcaggtcgtgtaaaaaaaagtaccacgttcgcgtatcgcacatgcggattcaaattgccgcagtcgcgaatcgaagaaaagaagcgccatgaatcgcggtcgcgtcccacccctgattcatacctttctttacctaatacgaattttaacagagccaaaagataaaacagaaggtaaataggacaagaaaagtgagtatggagcaaatgatagaaaggaaaaaacggatgaggaagaggaagaaagagatggaagagaagaagaaaaaggagcagcaaaaacaatcacaatcatcggaagagcaaattaa

SEQ ID NO: 13684 - DNA, 199 bp, Heterodera glycines
  misc_feature (25)..(25): n is a, c, g, or t
agacaagaaggggcgggggggaagnatcggggagacagaaggagggggggggcagaatgagagggggggggagatgggagaggagacccgggggagacaagaggggggcggggggaagatcggggagacaagaaggaggagggggggcagaatgagaggggggggggagatgggagaggagacccgggggagacaagag

SEQ ID NO: 13685 - DNA, 4892 bp, Heterodera glycines
tggagaaattcgaataattttttgactgcaaatttctttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccatacgttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttctgttggataaggaaccacaccgattattgattatattttccctttcactccctctcttattgtctctctcccgccccttgaccagccccataaatatgtctccctttccctcactcggggcattctcccattcattccaccatttcattattttatttatttattccctgctgtcctccatatttatttgtttaataaattatttatttatttatttgacaacatttgttttggtcgaagaccaaacatttttattgttgtagtaaatacacaacaatttggcgcagtcacaaacaaaggacctgctctacatcttcgggtgagaaaaggcatcaaattttgttttaaggaccaaaagccgagacggcaaaacaacccatcaaaaagccgggattggctctgagttttgttaaagccgagtcggccatttttcaaaaagcagtcaaagaaactgctagacaccaaaagccgggtcggcgctccgaattcgtctaaagccgggtcggctcatcaaaattcgtcaaaagccgggtcggctcagcaaaaattcgtcaaaagccgggtggctcgtcaatttcgtcataacgcagtgaaaagaaactgcttattcttctaaagccgggacggctcgacaaaatacaacaaaagccgagtcggctcgacaaattcgacaaaagccggttggctaatcaccaaatttgatggaccccaatcagcttaaactgattttggaggctgttttgaaagcatcagcggaacaaaacaacagttctgctgcattagcgacatcaatcgatgctcgcctttcgacatttgagtatgaccctgagttagggcatacatacgacgtttggctcaagcgctatgggcagaccatcgcccaggatggacaagcactcagcgaccagtcaaaagtccaactattgattggcaaactgggcgaagtcgagtacaagcggtacatcgacagcatcgcaccaaagtcgcagaacgacttcaactgggatgagacgaccgcaaaattgaaacatttgttcggtgaaacccgatcattgtttctccgccgttttgattgcttccaaattcgtcaagacgcgcatcaggacgtgcaaagtttgatcgcattgatcaactcgtcctgcgaaaatgccgatctgtcgctgagcaaagaggagctcaaatgcatgatactgatcattgcattgcgggacgaattcaccgatctgaggcaaaaatgccttcagcgcttggaagacagtcgaacgagcggacggtcaacctcactgcaagagctaggagaagagtgccgaaaataccaaattctaaaggaaagcgcgctctccctcggctcaaatccctgcagcaccagtgccatccgagccaaaccgcagcaaatccgggacaaacagaagtccaaaacgaagccacagcaaagccacaaaggacatttccagccgaataattcaacggcaattaaaaaggaagtgggcctgcctgatcagccctgccattcatgcggaggcaaaaatcattggcaaaaagactgttggttcaaaaattcgacgtgcgaaaagtgcggacgaatcggccatatcgcaaaaagatgcaaaaacggcacagaaacccgacgtgttcgtgccgtggccacaaattctgggaatgacatgcacattcacaccgtttcacttcagccaacatgtatggctattgaaggaagtagtaacaaatggtggagaattgtcaccgaaatcaatgggatggaaaacccaatgaatgtcgacaccgctgcacaaatcacggtgatcacagctgattcgtggcaaaagcttggcaagccaaagctgggcaagaccaccatcgcagtcaaaaactgcaacgaaaaggcattcgcaattaaaggaaaattcaattgccaagtttcgtacaacggacgaacagcgaaactgattgcgtacgtcagcgacgaaatccatcaggatttgctcggcatgccttggatcgaagagttggaaatcattccgaaggaacttatgtttccaaattcttcgcaaatcaccaattcggtgccaatgaagcatcagaaaatgccggcagtcaatttcaaaaattttggtaaatttcaacagaaacaccaaaatatggaacggcaattcaacgacaaatacggcgccaagcccatcactttccaaaatggagagccagttttcatttggaatttgaaaggcaataaggcaaattggttgccggcgacgattatcgagagagttggcaactctccgacttatcgagtcgacgttccgacgctccgttgcgcagtccaccgccttgccaaccaaattcgccgccgtttcccagtggaattggagataccgcaaattggccaagcgaatggaaatgttttgatcgggaaccaaccaaatcgaacaccgattaaggagattaaaaaagccaaatctcccattggccaaagtcaaaatgcgccgcgaagatcaacacgcgccaagacggcacctcagcgattggacatggatccgtcgaagtcgaagtacgatgtcatccggccatgatctcgcgcaggagggactttactcaagaagggaggtgttggataaggaaccacaccgattattgattatattttccctttcactccctctcttattgtctctctcccgccccttgaccagccccataaatatgtctccctttccctcactcggggcattctcccattcattccaccatttcattattttattttattattatttatttcctgctgtcctcctcctcatttatttgtttaataaattatttatttatttattggacaacatttgttttggttaaaaaccaaacatttttattgttgtagcaaatacacaacaatttggcgcagtcagcaaaggacctgctctacatcttcgggtgagaaaaggcatcaaattttgttttcaggacacaaagccgagacggcaaaacaaattcaccgaaaagccgggactggctgtgaattgttttgaagccgagtcggcacattctaaaagcagtcacagaactgctagacatcaaaagccgggttggctctccgaattcgtctaaagccgggacggctcatcaaaattcgtcaaaagccggatcggctcagcaaaaattcgacaaaagccgggttggctcgtcaattccgtcaaaaagcagacaaaagactgcttattcttctaaagccgggtcggctcgccaaaattcaacaaaagccgggtcggctcgacaaattcttcaaaagccggattgtctaaacaatagacgatggacccgacgcagcttaaactaattttggaggctgtcttgaaggcatcagcggaacaaagcaacagttctgctgcattggcaacatcaatcgatgctcgcctttcaacatttgattatgaccctgagttggggcatacattcgacgtttggcttaagcgctatggggaaatcatcgcccaggacggacacgcactcagcgaccagtccaaagtgcagctattgattggcaaattgggcgaagcggagtacaagcggtacaccgacagcatcgcaccaaagtcgcaaaacgacttcaactgggatgagacgaccgcaaaattgaaacaattattcggagaaatccgatcattgtttctccgccgtttcgactgtttccaaattcgtcaagaagcgcaacaggacgttccaagtttgattgcacaaatcaactcgtcctgcgaaaacgcagatctttcgctgagcaaagaggagctcaaatgcatgattctcatcattgcattgcgcgacgaatttaccgatctgaggcaaaaatgccttcagcgcctggaagacagtcgaacgagcggacggtcaacctcactgcaagagctaggagaagagtgccgcaaataccaaattctaaaggaaagcgcgctctccctcggctcaaatccctgcagcaccagtgccatccgagccaaaccgcagcaaatccgggacaaacagaagtccaaaacgaagccacagcaaagccacaaaggacatttccagccgaataattcaacggcaattaaaaaggaagtggacctgcctgatcagccctgccattcatgcggaggcaaaaatcattggcaaaaagactgttggttcaaaaattcgacgtgcgaaaagtgcggacgaatcggccatatcgcaaaaagatgcaaaaacggcacagaaacccgacgtgttcgtgccgtggccacaaattctagaaatgacatgcacattcacaccgtttcacttcagccaaca

SEQ ID NO: 13686 - DNA, 2070 bp, Heterodera glycines
tcagaggaacggaaatgcgcagaacgacgaccagctggatagaggtggactgatggaaaatgatgatacgaaagaatggcatggcaacgaacaaatggcatttggacaacaaatgggtggaggtttgcgacagttcgaaatgtttgaaaatttggagcatgcaagaggaggtcaagagcgggttgcgaataaccgcgcttttggagagcagcggccgttgttgagtcgtccacagctaccgccacaacagagcttcatccatcgccaatacattcaaagtgttcagccgcttccaccgtctttaccgtatgcgaacgaacgcatcacatctgccccgacttatccacagccaaattttgagcagcagcgttatcagccgcaacaaaattcagccaacccaaccaaaattttgatgttttgcatggcctcgaattcctctcgtactggaaaaaatttctgatttgaatggttctgaaggaatcgatgccgttaagcgcttctttaaaaagtttgacgcttatacatctgaatggagtgacaaaaagcgcatcagtgcgctggagacgaaagtgtacggctgtgctgaacgtgcgttcgaggccgcaaaagccactcagccgtttcagtacgcactgattcgccgcgacatgattaaacaacttttaaagcgaaaaaaaatgtaaaatttttgcattaataagcatatttatatatgatatttgcatttaatgcaatatattaaccgtataaactaaaattctatttcatttaaattttttaatatttttgttctgttcttaccaatgaacaaacaaagaataaaaaatatttattgatcgttcggtagacaaatgaaaatataataaaaacgaaatgaataatggaagagacaaaaaggaggggaatggtctccttataaacacaatgaggagggttgggttgctggtggaatcggttgatgatcggcaccaggattatgtttcgaattctctttgaaaacataatttcgacgaagttggttcgaatatgtcttttggttcctgtaattcaaaaggaggactggttcggcgggggaaaacactttttctttggccccatgccgtccatcgaattgttttgccattcttggccgtaattgaagacatttgatagacttctggccatttggagaaggcgtccaccataataaaataaacaaatccatcttggcagggtccagccaaatcgatgtgcacgcgttggaaggccttgtcgatgactgtccatgggccaatggtgccttaatcggacttttctgtgcaccttggtactcatcacattgccgtacaactctctcaaactccgaatccattcctggccaatatacatactggcatgccaaggccttcattcgcacaattcccgggtgcgcaaaatgcaatgcctttaaaattcggccgcgcaattggtttggaatgatcacacgacttttgtacagaaggcacctccattttccaaaaatttcatttcttttcgggtgaaattgtgaaattttgggctcattgcacttcgttggccaaccataaataacaaaattaacaattttctggagtgtcatctttggttgtcgattccgcgatttatcgtgccgtgactggaagatgatcggtttgcgtctgtaatatagtgttaatataagagtccgtttcgacgcaaatgttggcaattaatgcatcttcctcaggctttgggtaattggctattagccttgaaaggacatctgcctgtccaaatgatgatgtattcgtatatttgatatcgaaatcataatttgccatgatcaacgctcaccgttgtaatcggctggcggaataattcggtattccctttttggaaccgaaaatggcaaacaaaggcttgtgatcagtaaataaagtgaattttctcccgatagcatttggttttggatgacgttcaaattttccggggagttgcattcttaggtctcgctgcagggcgcttaagttttgtttcgtaagcggtgttgaaaaagctcgcaatccatatgcgtccaacgcatcgtttccaaaa

SEQ ID NO: 13687 - DNA, 2346 bp, Heterodera glycines
tcgctgatttccgttgttcttacgggcgagatcgtttttccctcaaaactccaaattttcagccctaaatgcgtttccatcgcggtcaacaatgattccctggttgagtgccctcgtccgggttagtggtggcgttcggagaacaggcattttgtttgagctaacgcagaggtactactcaacaaaacaaaaacaaagttaaacggcgatcctcgaaaaacggcccgatttgtcggtgatttgtcgatgtccacacttatcgcaacaatgcgttatttgtgggacgaaaatcgttgaaattcgcagcaatgcgttaaacagcagaaccgcagcaatgcgtttgttctgtatagcaacaaatataaaagaaagaaccacagcaatgcgtttgttctgggcgcttctcaaatcggcttcttctcaatagtccaaaatccacaatgccggcacagcttactcttcgccaggagcgccacgtgctaaataatgctgtttggtcggggctaaatcactgctttccctcaacaatatttccaagacggggacaattcacttttatttaaaatcagcaacaataaaaatggaagaagagtcggaggaaaataaaacaaaataatataaaaagtgcactgccaacagaatgaattgaaggaaagatgggggaacatattctgcttggaagggaatggcaaatatcgataggcaagagagtacaatcacagacaaagagacaaaattatgaagtgacaatataattaaaataaatttaaacgcaaaaaatcaaatactaacacagatatcttatctaaatataagtaatttaaaaaacaaataaaagttaacactgataagaaaagacagaatttttgtattctaccaaggaatgaatacaattggtcaaaatatgcattaaacaatgagaattttattataaaccttaaagaatatatgaataaatttataaacaacatttaaaattaaaaaactcatattaaaggttattaatgattggtatgaataataattaggaaaatttatcaaatatgtcaatttataaaataatcttaattaaattatgaaatggcataaccttgaaacttaattataaataattttcttataaatcaaaaaatagcgaaaattaactaaatttaaaacgtaaaaaaaagacaagaaatggtagaacatcatataaaattagaaccaacaatatatattcctatgagttctagagatgtacacactaataatgatgcattattataaatttctaattcaattgtaatgagtaattcaaaaatagaaataaatatattaataaaagatataagatctgaagtttttcatactttttctaaaagaaaacagacaatatctgtcataaaaagacattatataagaaaaactatatccaaaatactgaaaaataacttttttagtattgaaaaattaaaaaaagaaaacaataattttactttttgtaccaaacatattgaaaatagaagaaaagttatgacaattattaaataaatttggttgctttttcacaataaataactgagaagcgttaataaaaataatacaatagaagtaattgaatctgaagaaaaaacaaaaactaataataatgataaaaaaaagatacaaattatcttaaaaaaacaatataacaaataatattaaagatatatctatctgttgataaaatattcatcggtgttttttcatatttaaataatgacaaagaggaacatattaaaaatttaaataattatcgttataatttgtcataaaaatgattgaatatataaaaaataaaaataataaaacaaaaagattatctaatgcttgtatcactactatcttttgtgacagttttaataacttttttgggatatgaaatgatattagaatgttaaaaaaaaagatatttttggaaatagattttgagcattaaaagttgtagtatttttaatggtcgttgtacctagcaacatgctaaatcgcattttaaataaaataaaaattattttaaagcgaatttatttggaagtctcaccgctctctatgttttttaatatttttagcccaatcggttatctttagtttcttaaatttattgtcttataaaatttggtttgtgttggacttagtttttgaatttagtttatttggtggcgttggtccagcaaattcagtgcttgtttttgagtgatttggattcgttctatttttactctatcgaatatcaagaattccaaatttgattgttttaaatatttttttttgtcaaaaatctttatttgaagtttttgagttacgcacttacgacctcttaacaaatag

SEQ ID NO: 13688 - DNA, 4683 bp, Heterodera glycines
cataatgccacaatgaacataggattgaactcgcgactatagtcttatttggaaaatcccttttttccagaatttacgaaatattggttcattttggggttgtctgaacacatggtctggtaaatttatgtatctgatcatttttactgaaattttccagaaatttttgacatttgttagtcatttttaatgggatgttcttgtgggccaagaaagcttcttgcctcttcataatttaaatttaaaaaaatattttaccattttattttgaataattttcatcaaaattcacaaaatgaaagacgaacaaacattacgaagcattttcggaaactgcaaatttcttcacttttcaccgcacaatcgctccccttcatttatttattcacttccaccaacgcatgctgaaaaattgaataaatcataaagaaaattatttttaattattttaaataaatttctaccattaatgtggttggttggaaaagcatctcaatctgcgggaaaaatttaaattaaaaaattattattgtaaatcaattaaaatttaaaaaaatttaactttttcttaaaggaaacactgtgttttatcttagaataaacaaacaatcatttttttaatatcttttaatattttgagaatttcaaaaaatttatttccaaaatttcgaaatttaagccggcgcacagaaaaacccaaaaattttttcaacctggtctacttctatacaacgtccaccatatcgatttttcagaatcttaaattaaaaataaatttaagcaaataaataaatttccaatttttaattacataaagaaattttctgaatcgtcttcgatcatcaaagtcacggcgtcgctggatgaccaacacattgtcggcctaaaaataatagaaaaattatagcatggatttaaaaattaattaaaaattgtcaaaataattaaataatatttatgaaaaatgcaaaaaaaaaaattaagaaattatatatgataaaaaaaatatattatttattattttaataatcaaaagcatgcttcttgtgctatttttgctgaagctccgccaatgtgttggagctcatagtagccttgctaaaatttatttttatttccaaaaaaataattttcggaattcaacctcattaggttccctcacagggtgaactaccttaaaaggaaacattttttgataatatttaaatatgttttttgaccaatgttatgtgaagttcctgattgtttgccaatcgccgtaacatgctcacaaatctgtccttaaaattaaaattcttaaaaaaaaatttacgacaatttttgtaagtttggcataggtatatatttttttattttgcaattaaatagtttgaattattgccaaaatttgtcgattttttgtgataattttacagtgccaatttttaggcgttttttcatgaatttgaatgattttaattaattagtcggcttttttaaattttatgaagaaattgccagcgaatttattccaattttggcattttttggcacacctgttgatggattcgttcactggcactcattgtgtcaatgctaactgttgccaaatcgacgagcgattgctaatcaaacagaaaacaattgatgtgattataaattttgtagtgccgccttaccaaattgtcgatcaccaaatgctttaaaaacaaaatttacaaaatacatcatccaatctttttttttattgaaaaatcatttttacttgtatgccgcttgtgatcacttggtctcgaattgcctaaaaacgggtgatatgattgaaaaattattgtgatcagcaggggttttttgggatccgtgatgatgagcattttgcgaaaattataaactttggtgtgttgaaaaaatttttgataaatttttgaaactttttaatttttgagatgaatttaaaaaaaatttggattggtccttagaggtaggtgcattttgctttttttttttatgacatttatgttttatttttcgaaaaatgccgaatattttgcaacaaaaaaaaaactgcgggtaactaactatgttatgaaaaataattttaaatgaaaaccataacataaagccaagttcaaaacagctattagtatatgcacaaaattcgtaatatttttacagcattttttatttttcatagaaaaattaagaattggcacattttttaccccaaaatgtcccaataaatcaaattataaatcagctaataatgttctttaaaaatctcacatcagagatctccttcaacgttttgtcccggaattcgtccgacttcatgatcaacaggtcaccctgagtccgttcaaacttgtccaaccacatttcaaccgatgaatggtcttggcgttgaagaggcgccctaaaacaaaaaacattcggtttaaagacatgctttatccattcaaatccctccaattttctttaaaaaaaatcattttttgaaaataaatttttggtggaccagaatgccaaaaatccgtaggatttaaacattaatcattttacgcatactttgatcgggcggaaaagaatgcatgtgagcgtgcccgagcctggcttcgcacatgtgatggcctattttgggacgggatttgaatggatttttgcataagcataaaacaaataaacaaacaaacaaaaaaaaatttaaatatcaaaaagggaactagcaatacggtagatcaattgtaccgtatgaacgtcaaaaaaaatttgacgtaattagtgtaaataattttttatagactcaggatttacttttttacataaaaaaaactatcattaaagacataatttacccggcaaattggatgatcatccacttgagaatctggggacaaatagtgagtggtactgtaatgaatgcatgttacagtaataatagtatactttatcttccggcatttcgaagttgcaaaacagcgtgcgtatctgtgatgtggcatttaaattttatggtctcatacgtaatgaatgactttcatttaactgtgccactggttgacttttgaatacagtagacgagatttacgatacgatactgactgcctacacaggttctcctactctcatacaataatacttattattctaccgtatcctgctttcagaaagtaaaggtatttcttgtggtaacgtcaccatggcttactgtttctcttattgtctcataagctattaattcttatcataataccgtaccccctgactgtacaaatccatagagtactcgcacagaaaggttgtcttcccgtaatgaccaccactgatcacggtgatttcaccaggccgaaagccgcgcaaataattgttcagcagtgtgtagcgtcgccattgcgcaatgccgccaagtcggcttttgctctacaagcagtaaacaaaagaaaattgaaaaattttgcattttaaacaatttcgaaaaattttatcatttctccaccgaatttcttttttaattagtcttacaaaatcaaaaaatgcaatttttgttgaaaaaatttaaaaagtagagtactaaatccctcaggactcaattttcattatcccattctcatgccacaaaattatttgttagtttgtaagaaaacttttaaacacctgcacaatttcactgcgaaccgcgtctctgagatcgccaacggaacggaagcctttgtatcgaacgcgaaccgcgtcttattgagggaggagtaataataaactttttatatataaaaataacataaaaaattgtaaatataaaattgtcataaaaaaaaatcctcaccttgaatattgtgaagtacctcttttgcacgaccatcgcgcaaaagctcaaccggtctcagaggagcacggaaaatgaaaattaatgaattaatgatcaactttcacgctattagaaaaacatttaacaattattatcaataattaaatttcatttttattttaattgaaattttaatccaataattttgcttttgaaatgttaaaaaataaattattattttttggtatgaagaaaataaatctgataaacattgcttacgtgatgatgtagcagcgggttgcattcatgtaggaagcatagcttaacaacagaataacataaaatttaattatcaatgaaaatttaaattttactccttggcaaaacgttcatgaatgctgggaaacctagaaaaaaaaaataataattttcaattttagtttttcctaattagcctactaattaccaaagatagacgaggtcaaagtcctccaaatatgacaacaccgactgatcaaatcgttcacccttcggcagggataaagcggggattccgttgcttgcatcgtacacagcctttaaccattaatgaaggaaatcattttaatttatcaaaaatttgtaataaaaattatattaaaaaaaaaatttcaaatagattaatccaaataatttttattataaattaatataaagaatagtaaaaaaaacatttttgtctgcaatttcaaatataaaaaatgttaaattatttttttattaatatttaattacccaattaattaactttttttttaaatacgatttaagaatgaattattcaatcgaaattacatgtaccagtgcatcccgctcgtttgtatgaacaccacacgattgtcaaattgggtgagcatatgtaa

SEQ ID NO: 13689 - DNA, 4128 bp, Heterodera glycines
ttctaaaaatttgaattttcgaactttttttccaattcaggtccgggattcgaaattggtcgaaatagatgccgggttcgtgatcagcgacaccgaaaaccataggaaacatgctttcatgtcttttgtaaagtgcattagtaccggaatttcttcggtaaaatacatggtttttaaaatttttagcaacaaattacacttcctttcctttttattcttttcaaaatcaaataatggccgacgaaagtgccacgaatgcaggaggagccggcgccgctggtggtgctcagcccgccgagtacatcaaactgaaggtggttgaccaggtctgtttttgcattatgtgatggcgcgacttcaccgtcttaattgtacatttttaggactcaaacgcggagcggactggcgtacaggtattaacaaatttgggattgggtgttgggttttttgactgacaaaatcttgtattgaaggggcaatttgttgtggacgagtttatttttttggttgtaaacacaaacgccattcttttcaccccatttcaggtgacttctctgcgctttttgtttgatggccgctccgtcaaagacgaccacactcccagatcactggaaatagaggacgacaacatcatcgaagtgtgtggggtgatgggttggaaaacattcccggggggtggggtttcggggtcatatacacgactgaattttttcctattttcaacgatcagcggatagtttttttgcactttaaagtagcattattgtattttaggtgtatcaaggacagatcgtaggctccattttggatgattgaagaagattttgttcctcgtgtttctttttttgaccgatcattatatgatctgataattgcccctcacatttatttgttgcttctttcgtttgataatttaatttttgttttggaaaaaatggaaaatcttcaaaatttcattattttttcccaacgaggaataataatatgtagagatatcttatctctatatatttttttcgtcataaattaaactgaattttcgtaaatagtctaaaaattaaattttaagatttaaaaaagagaacgaaatattgagaatttttatgcgcattggcaagtttttctctatgagaaaatttaaatttctgtcagaaatgcaacatagaaaatagaaaaaaagaaaaacttaaagaaaaacttttctcattgaattaaatattttctgcggttcaacaattattttttattgtttttctatgcaagcaataagtgcaagcagttcggtaacgacacatggatatattaatacaaaaaaaccttttccgaaaaaagcgaagaagaaaataattaatattgatatatcaaaaattgggaacttttctggtaaaatatttttacttaattaataaattttataataaattacactcaaatagacataaatcggaaaaatgcaaaaagaaattaatcagcccaaacaacgataaagggaaattgtgaaaaggatttattacagacatcaaaatcgagtatgaatattcagcaattatataataaaaataattaaataatttttcataattcgcttaaaataaagtaactttaaaaaaataaatttttcaatatttttatcaaaaattgccttatttcaatcctaaatttaccaaaaataaaaagctaaatatctcattaaaataataaaaaaagagttcattaaaatgaatttaataataaaaataataaaaaatatgaatataaaaaattgttataaattgcaataaaaaattgtagcaaaactttgttcttaccatctaaattaatgtctttaataaaagtctattctttttacaagataaacatcaaataaaaatacaaatgatttatcaaatattaataaaattaagcataaaaaatcggcgaaattaacaaaaaatgacttacaaaactattaatttctaattaaacttaattataaaataaagctatttaaaaaataagaacgtcagagtgatcagtctcgtgcgcaagaaaaataaataattttccattttatttatttgatgttttttaattaatataatttactatcctaattataaacttagaaaatagatacttaaaacatatttaaatcaaatcaaggcctgaatgatatacagattgattattgcattgatcgtttaattttactaaattttagctaagttcggacttattattcagcaaaaaatttaacaattaaatttaaatattgttatcattgatatttttaaatgtctcagcacgtgaaaaaatggcggaaaaacaagcattagaaacccattaaaggtggggaattttttttctaattttcacaattaaacgcacccaaaaatttgagtatgaaacattaaatttaaaatttgattcttaagctcgtatttcctcagatttagtttcttattttaaaaaatacttaaataagtgcgagagaatgaaaacttttaactgttttctattcaacaaaataaactaaccatgaaacagcgcgtagaacgaatattaataaaatgcaaccattacggtgaacgaatgggcgttagcggaaattcacttattaatgaagaaactggaaaaccatacccgcgtagcaatgtgtccatgatcataaagtatataatagacaaacgagcaggtaatgctaccaaaattccaccaagatcaaagcagttggaggagaagcttaaattggatccaattttgtactcatggacagctccattaaagaaaccgcagccacaaacaaaaccgaagccgccgacctacaagaagccattccgtcagaaaggtggagctgatcaataaaacacttgatcagttatacaatgacccttcttcacctgcagcatttgctggtgtcagtagattactagaagaggcaaagaaaagaataagtgatatacaccggtcagatgttgtgaattatttggaagggcaccgcacatatacactgctgcgcccaagacgagttcatttcccgaggtcaaaaccgtggccgcaggttttatgactgatgttcaagttgatttggccgatttacaatcactttcacgtcacaacaaaggctatcgctatctgcttgtagctgttgatgtgctctccaagcgattatttgtggtgccgttgcgcagcaagcgtgcagatgagatgctgctagcattcaaacaactggttgaacaaatgccaatgacacctcatcgtgtgttcacagataagggtacagagtttcgtaaccgaatgctcaaggagttctttgaagaacatgatattgcaaaacacgaacccgtccattctgctgtgaaggcatcggtagctgaaagagccataagaaacgtgaaacaacgttttgaatagcaaaacaattctgctcagctacttagtgaaaagagaatggattgaagaacacggctgttcaaatataggtaaaatattttttggtgcgtttttgttaattaaaccaaatttaaatttagtcgtgtcgctatggaccaccagtgctgctcgtctttatctattgaaactgatgccggatctgatctactgtacacggacactgacagcataattcacatacatgacgaagctgcaaaccactttcacttggaccacatttgggcgatttgaccgacgaatacccggaccacgaaattttggagttcacttgtggcggagcggtaagttttttagcttagctttacaatttcttgatatataagataaatttagaaacagtacggactgaagcttcgacgcaaggccacaggaaaaattgagcatgtgttgaagctaaggggaataacgctgaattatgatgtgaccgtcaatcagaatttacagtacacagcattccgtgaacgtgtgttgcagtatgccgagaaccgtgatgtggagcctatttcagtattcaatccatgtgctataagaccgaatatcaagaagggtgaagttacgttgataccaaccactaaaatttacagaccatatgtggggaagggaattgtcgggcccgactatcgcatacttgattttggatataccccattcacatcattcccaattgaaattttaatcatttttgttcgttttatt

SEQ ID NO: 13690 - DNA, 3616 bp, Heterodera glycines
aaaatattttaaagtgcgcaaaaaaaaacattattcaaaatctgaaggaaagtaactaaagaattaaagaaaattgtattttagctttatgatttacgttattttaaattatatattaatgtttgaatatcattaaattttataaatttttacctaaacaataatggttaaaatcactttgccacgaaataaaaacaaaaattttaattaaaaaattgattgttttaatacgaaaaattttaaaaaaagataaatttatatttatttttatttacattaatatttaattgttctaagatactattatattatctgaaaataaataataattgaaattaatgaataattttagaaaaacaaattgaaaagatggctaaatttattttattcatttaaaagaaagggtcaatgcgtagtttacataattcacaaaataattaataagaaattttttaacttaataattaagaagaaaactaaaaataattaatggatagtgtttaaaatttagatgaataacgtttatgtgtctaataacttttacatttaggtttatgtgtcggttttttagtagttgggaatgaatagtgtgtctcctttaatgtttagtatcataaatgtgtctcacaaatagtccatccatttccctctacaatacactgccgaggcaggagctaacgaaaacgttttaggaagtttttcgaggacatcgtggactgtacgatttcaacattggcatgttctacgaccagcacgagcatcagcttcacccatcatttctgccgaaagtggctttggaatacgtcaacaattgccctcaagacttccttctctcgactctcctcagcgagcatttccaaaaccataaaattgttgtcattgatgtcaacagttttgggcccgacgcttcatgtcgttctgaaaccgaggcctttctggcacgtcggattgtcaacaagctatctgcagccggtgtggaaatgacagacattgctgttattacaccatacaaaagtactaatttatcattagacgaattgtatattaaaatatgtccctaatcaactgaaatacatgattatctttttttagcccagctattggaacttttcaaagtttttgtggttaaacatctgccgcatcggctgatttcttgtgcccatacacttcaaatcctgaactcattgttccctttgatcgtcgtgcatattcagaccttttggttggtactgtcgatgcggcacaggggaaggaattcgactacgtgatagtatctggtaagacaattttgtgacttattaaggcacattccatttataaacaaatttaaagagacatatattttttaaatctagtcacaagcgattattaaaaattttgatcctaaattttttacttaattatgtgtctcattaaatgctgagccacattaatgtgtccattaatgtgagccacattaatgtgtccattaaagtgagccactttaatgtgtccactaacatgatcaaaatcatttgaataccaattaaagttggccgcaataacacctctacgcttggttttctggccgattcatatcatccgacacttcgaatgtggaagaatggtcgcgttaatgtgatgttttcgcgtcaccgaaaagcactgattgttttgtgtgacgcatcgtcattcctcgcggttagtctgcatgcttttaaaaggaaattattaatcacgagcccgagtcacaagccctagcattcaattggaaccgcttgttagacacatatatgttaaatatacattaaaggacacattattcattctcagcatttcggggcagcattaggaaaaaggatagtgtgtctccttatatgattattatcataaatgtgtctcacaaatcctgagtaacaaatgtcgttgcggtttagaattacaatgaaaatgtgtctcataatttgttccatgaattcttgaaagattgttggaatcattatgtttagaatcctctgctgacgataaatactgctcctgaaggaactgaggccgttgcattcgagtccggcatcgaagctggtcgctttatgccctacaccaaacaaagcttcatggttttcttgaaagaagcaagacgtgaagggctcattttcgatgccaaggaccttgagctctaagactgagctgaatatcactaatgtatatatacgttcccaaaaaattaaatcccacccccactcatatttttctcttttttatgtataagacacaatagtgtcttttttaaactcacccactcatatatgtttctcttttttatgcacaagacacatttatgtcctttttattttaacggcttaaatgacatttattcaagaaacacatcagtttatttcatcacaaaaacaaaaaacacttgatcagaaggaatattttagaatggccgatccaattacctattggggacccatccccgacccgccgtagagcttatgcatggttgcatcaaaatcaatgtcatcttccaattgcctaagaaaaagataacttgaatacaaacgcagcattttgctaatggagtcttgataacgattagcgcaaactttccttaatgaaatacgcgttatttgtataaatttgcttatataaaccgcaccaggaatgattagataattcggaggaaggagcaaaagatttctctaacatcttcaggtctatatcttgtaccttaaacatttaatagagtgtttttttgaatttgccatctcattatctcgcataattaactgattgggatgccactattgctcggattttatgcagtgtgaatgggatagggtttacatctcggaaacgaccaaagaaagttcgcaatgcctcgttcaaatgctttcgagaaattccccttaacgggttctgaggcatacgaaagaggtagtcatgttctgtaatttgaggagccgagacggcagacaacttctgttggtgttgctcaacataaatgcgcaggcgtttagttagcttgtaaagacgattgctccatccaatccatgcgtcagtcgaatcagtctttgagtccaacaagggacacatcctgacagtgttctcgccagttccaacaactttagccaccttgaactcattatagcgcaacttgtacgctatctcacttctttggccgttatccacgattagatggtagataacatagctaaaaatgtgttatgtgtgtggtggtacccatgcagacacactactgtgtcctatctgactacttggaacacttattgaatgagacacatttatgtgtgtggtggtacccatgcagacacactactgtgtcctatctgactacttggaacacttattgaatgggacacatttatgtgtgtggtggtacccgtgcagacacactactgtgtcctatctgactacttggaacacttattgaatgggacacatttatgtgtgtggtggtacccgtgcatgtgaatgcaaatggccctattgcctgatcacacaaaattcacaaatgaaatggtgaaaaatgggccaaattgggagaacatgaagttggagtagtacaacggggaaattgagcgagggcaattgagacaggacaattgagcgcatg

SEQ ID NO: 13691 - DNA, 1813 bp, Heterodera glycines
  misc_feature (60)..(60): n is a, c, g, or t
agaattaagtacgcaaaaacatcaatttcatttttaaaatttaattccaaatgatttttnaaaaaataatttcgaaaaataatgcgctaatggaagcgtatttccattccttttataaaatgtaattttattgggcgcggaaaaaatgatgattgattgggatgcaaagaattgtatgtatcgcgcgcgcgcaacgattgacggattgggatgttccgtgatgggctgctggcgggcgaagaagcactgcaaattagccataaattatcgccaaaaattagctggattaaagaattgggcaaaagcatttgacgctaattgagtatgaaattgatcccactccgctaaattcctttgtgtggtgagcacaattttgtggaatggggaaaaagcattccaaaggaaagctcaatcggggaaaaatgaaaggaatttaaatattaagaattactttgaataaattacttttttagaaatttaaaaaaatttttttacatttttaataaaacattataaataaaatgctaaattccattgaatattttaactgattgtgtgaactcaaggtcagaaaacgttgaaaagaaaattttttagctgattgtgaatgcaatgtacagaaagaaagtgatgtgatttaaaatatttgacattttcgtgatcaaatactaattggtattatttgttgtttaaaaaaaattcacaaatttaagaactaaggtaaccaagcgtgataatctcgaaaatctaaaaaaatgtgtaccggaccaaatgaggataaaatggaagggtttttttcctttttttaattacaacatttactacaataaaaataattgcaaaatggcattaaaagtggcaaaatttttcatcctaagcccaaccaactgataactgtgaatgatctcaccaacaacaacagatgatcaaattgagatttatgctcatgcatttttattccattcagacattcgcgcaccattctcctcaaaacaattctatccctcgtgtttattttggaactaataaacgaacgccgccaaaattgattgccatcataatccttgtcaatttttttttgttggcactttttttgggacaaccccaaaaaatgctgttaatacatgcataatgcgatgatggtgtggcggctgctgctattagcgtgctaatgacgacgggtttgttttggctggcggccgccgtgtttagccgtcgggtttagcccttcccctccattccttggctatatgttaagtaattatccgggctttggaatggacagccccaaaaaaggggggttttgagctgctggagggggcgacaaagcattggacgtgataacggactaaacaagctttatgtgtgttggctgctgggtgagggcggtcgtgtaatgaggaagagatttttgttaatttggacagcaagatgatggacattacgccagagttttttttttaaataatgtgtggcgccaacaatttgctctgctgctgaacaatgaatgagtagtgaacaatgtattagagttcggattttaaacagaatgtcggtggaattttgaacaagcagaaaattttgaaaaataaatagacttttacggaaaattttcaattttggatttttaagacaaatttttacgtatcaacagatttaaaataaaataatgagtaaaattcaattttggtatgcaatttttcggacaaattctgttatccactttcatggatatttccatttttacaaaatctattaaaaaactgcactcaaattttaagactttcaccggcggcgcttatcggcaccgccg

SEQ ID NO: 13692 - DNA, 828 bp, Heterodera glycines
aagctctattagcctttcaaaaagcaaacaaaaactttagcttctacaaaacttattaagaaaaacactcaaaaatttcgacttttttggaatttcatgttataacttttttggtaattgtctaatcgtgaagcaatagcttagaaatatcttctaaacatgttaagctttcgattgataccaagattgctggatttggttaacaacaaaaaaagttataacccaaaaacttgggctggcgccaaaacgtcggccccaaaaacgaaaaattgcgacgtatgcgggagtttattgattttttgaaaatttttcaaagacagaatgccaaatatttttgaataaattaaataataaatttaattaaagttaactaatttttcatcgcaaatttcattaaaatttctgaaattttcccggcggcgcctatcgtcaccgccggatggactccaccttgttctcttttaaaaaattcggcaaaggtgtagaagaattatggtcccaacggaaaataacttaaaaattttatttttgtttttctgggatgaaaaaatgtgctgattactagggctactaattttatgtaagaaaatttgcgaattatgtaaataaaatatgaataaaaaatgctaaaatatgtatgaaatatgtacaaaaatcctcaaatatgtaggaaaatatgtaaataaaagtcccaacttttgttcgcaaacacaaaaaagaaagtgtttttcctactatttagagcatggagaaaccaggaaaaaaatatgtatttacataaaattagcagacggacagattacgaatctgaactcagattttgtaaaa

SEQ ID NO: 13693 - DNA, 1673 bp, Heterodera glycines
tttcagggctataaaatcatttcgttattagtaaggctaatagagcatttgaggagcttttgaatgatagcaacaatgttggatatggatagcaaagaaaaaagttatagcgaaaaacataaaaatttttgaaaatctgagtacagataacatataagtaccgattccggctctttatacatactaaaaataccaaaaatttgccacattttttttccagttttgtccgctcgttgaccatggacaagtggaaggacgcggagttggcgcgcatgcgggcgggcggcaacgcgcatgcgcgcgagtttttcgagtcacagcccgacttccgcccgcactggaccatccaggagaagtacaactcgcgcgccgccgcactgttacgcgacaaagtctgtcttctgtccaattttttttaccattacatataaaatggccgagttgcatcaacaaattttttgtaaaaaatgaaatttatatcaaacagattttcacaaaaattgcgaattgtgtgtatttttttttggaaaatttagcgaaatttctcagaaaatttgtgtgatgataagctgtttgggtaggttaccaataatgaaaatggaaaattttcttcgacttatcttaaactgattgtgagctaattcaaaatggaaattaaaattgctgaattacaattacattttacgaaatttttatttttcctttttttggaaaaaattgaaatttataacatttttaaaaaaagattttcaaaaattgctaattttatgtatttttttttgaacatttagcgaaaaatttcagaaaattaagaaaatggaaattttcttcgactaaacataaactaagctaatccaaaatggaaatatgagaattaaaattgctgaattattacgaaatttttcattaaaaatattggttttgttacccgacttttttcacaggttgccaccgaagctgatggacgcgtgtggtcatatgacacatcgctggcccgcaattaccagccaaccctgttgagcaagtgagggacaatgaaattaagggggatttttaaatttaaagtatttctcgaggatgagacatatcagaatagggttaccgaatggtaccgaatttggcagaaatcgtatcgtgttattttttggtattataaagtgccacttttcccgcatttcgccaataattttgtgaaaaaaaacgagaaaaaaaaactttattttgggttgaatgctaaaaaatatttcgtttttttgtatttctatgtccataagttgacttattacagcacagcagcaaggggtggtgggatgaagaagaacgccagcgcgggaagcattggcgccggaggtcggcccagcggtgggacaatggacgaattttttgacggtttccaagcggccggggcgcagaggtagcctaattttcttaaattgtaatttcatatgattggttagcgggtggctttataaatttggcttcatccaagatcccttgaccaaaaaatgcgaaaaataaattttcaaatattttttttttcagaattttagtgctgcctggttttttgggtttcggccatataaacgctgtctgattttactccctttaaattcctttttttcagtggcactggcaacaatgcatcgtcctcctcccgctacaccggttttggc

SEQ ID NO: 13694 - DNA, 3972 bp, Heterodera glycines
aaattttcaagaaccaattaattatcaaaaattttacttctgaaccttaaacattatgataacagtgaaatgagatgccaatttttggccggtctgaacccaaaaaaaaaaatgccaaaaaggtttttcactttctgtgccttcctgttctctctgtccatggcaaacacctatctgttttctcctttactttcaggctgttacccctgaccaactttttcttctgttcggtatgtgtatcacaacaatcactgtcagcaactttgaaaaccgaaataaaaaacaatcgcttcaataaataaaaaaaattatttcgaaaataaatttttttttacggtatttcttcgccatttcaggcgtctatggtgatgtgatcagagttaaaattctgtttaacaagaagaacaatgcactgattcaatattctgatgtgcagcaagcacaattgggttattattatttttgtttaattaaataacctttattaatatcccgttattaattaattagtcaatttaattaagtcagtttatatatattttttaccaaaattaagcgattcaacatttggacaaagtcaaatggaatggcaaaaatatgcgtgtgactgcttcaaagcacattgttgtccaaatgccgaaagagggtaagatgatgggaaaaattcataaatgggaggactttttagggccctaagattttgcctgttttcccagtttccgccctggcgttttacccggaattccattttccaagagatttttgatcactaggtttctggttttcaaaaaaaaactgtgctgttttacctccatcccgttttgatcacctgcatccctggcactgttctttaacaattttgttaatttggtttgagtttttcgaatttgaccgaatttcttgatggcataaatttcaaatttgggccaaccaaacggggactgaccggtgctaaactggaagccaaacaatccgtgaatattgcttataaaaaatttgccaacaaattttaaggccagcctgacgccggactcacaaaggaattcacgaattcatcgctgcatcgtttcaaaaagcctggcagcaaaaactacatggtccttaatgccttgggcatattaaaattcggattttcaaattatagaatatttatccgccaagttcgactttgcacttgtcaaatattccaaacggagtcagtgaggaagcaatgcttgaaattttcaaggatttcaaagttgtcgaattcaaatttttccagtatgttttttgaatattattttctgtatttttattaaataattttgcttaatttagaaaagatcacaaaatggcacttcttcagcttgaagacgtggagaatgcaattgattttctggtcacaatgcatgtaataatcgaattttatttttaaactaattatctatttttgaatttaagaattacaaattagccgagagcgctcatttgcgtgtttcattctccaagaaaggcatcaacggctaagctgcaaatttaatttatcatttttatatattttattttattttttaatttcattaattcaccacaccacacgtggggatgcaagttcctaatgagctttatcatttttatgagaattattttttgtcttcattgttgggaccggacataaacaagtccaataattggtctaacaacatttggacaccgaaatttttaaaccaattagtcatttttatcttttgggatttcacatgatttaatacattccaatacatcgtctagtctcttattatatattttttctctctactgtataaggcatattatttcatattaaaactgcacaaatatttgtagtatttcaggttcgattctggacctggatccaggcctggattttttctgagtccaggtcttttctggggtccggattttccggggcttttgtccaggaaatccaggtcaagatcaatttggaaatccaggcccaggtttttgcaaaatgtcgaactctatttgcattattatgcgttagaaaaatctttttctttgtataatttcttgttattttaatcggattatttcaataatttattcaacttttcaaaatattccggttttccccggttttatttattttgtttatttgtatgattttcattccaggaagacacatatccagatattttattgtgtgtaaaattaaaagttcacaaaacagcagccatctaattcataatgctaaaattaaatttaaaaaaacaggaattttagggatttttgaggaattaaatatttttctagtttttcaaaagctaaaaatttctcaaatcaatccctaaaatttctaatatcctatagccttttgaattggatggaattaaacaacaagttaatcctctcttatgcatttaatatttgttctaaattctaatatatattcatcattttttaatttacccatttttcaaaaattttcatgttgttttttcccattttattttctcactcaaaatatgtagtgttcaaatgtgttgcaaaacgaacaaatgatgtttatgttgacaaatataatgttttaagcatggttaaatgaatgattatgattaattaatagggaaagggtatttattttgtcgattatgaatttttcaaaaaatcccatccccattaattgagtttattagctcatgccattttaattggtaacaatgtgattgatcgatcattcgagcaccattaatgatgtatggaaaccatcgtggtaataaaaaaaaaaacaatgttaaaagatgaaatcggacattgctctgttacagatcaaattctgttttgaaatgaacattttggtttgatctggtcatttttttaagcatatgagatgagaaggcaaaaaatttttacaaataatttcaaataattaaattgtccggcttcatcttttaaaatcaaaaaaaaaatgtttataaaaacataaattagacaagtaaattcggcagaagaggttgaaatgtgtttttaaaacaaaagatacttttcttatatggtaataatgcaaaaaaaaaataggaaaaatcctagtaattttgtgtagaaaattaaattaaaaaaaaaaattcaaatacgaatcgaaaatgtaaaagaggtcgtgagatttcgaattacagttaggtttgatgaccaaagatgttgttccattgttgaaatccttcctaagctttctcgcccataagcggcttttgctcggaagcaaccttatgaagaattatgggttaattaaattcttataacagtaaaaaaaacatttagcgttcaacaaaataaaatttatcgcggcaaaaacctggtaaatctaccgttaacaagtcgatttttggaaaaactaaagccagaaactacggtaatttccggtttttaccgttaccgctaccggagaaaatcgaatttgccgaatgttagaatattttccaacttactcttgtctcagtcagttcgacatggtcaatgtggctggtaacctttaaaagattttggaaataattttttttaggttttttttccaaaaaattacataccctcgttgtaaagtcatagtcttcgggtacttcgaaaaagtccgcatcacaatacaccttaaagccatttaaaatataattttgaaacttttgaaaatgtagacagaaaaaaacggtggaaaaattttttgcataattctcacctccttttctcggatatgagtaagcaatttgattttcaggatgagacctaaacaattagtaaataattttttttttttcattaaaaagcgcacatcaattaaaattatttatttattcaccggtgatggcgccaacaacggtggcgaatgccgaagtgatgcccaaccccgccggctggtacaatgcctgttcaaacttgtaacgtccggacggcacaattcgggaacgataacgtataaaaaaaaatttccaatccaatctttgg

SEQ ID NO: 13695 - DNA, 1534 bp, Heterodera glycines
ttcttgcgacatttgagccaacactgtgctaaaccctccaccctggcattttctctttgaagctatgtcgatgaccttctttaaatgacaattaatattcaaaattcactaaattgtgtgtcatttaccagaatgccatcggaggtccaagaaaaaaaggacaaaaatggcactatttaaaaccaaaacttttggattttggaaaaggggtgttcgaacagaggccgcgagtgtttttttattttaaaaaacctgacctgaatatatcttttttttgcacgtttaatgaaaaaacattcccaaactaataaaaggactaaaatgttaatgctgcttctctttaatcatctgcacagatacactactgtatactgtggatgttcttactgtatctttttgactgtaactttcgtatggagtctctaattctccggctaattttctgatgagtcgcacaaaaaagaagagcattttgagttttttgtcgccgtttgtgtccattactccaataaatttgacattttcgtctcttccaccaacttccattattctgaataaacatttagcattcattactttaaacactttatgcccatttggccactcacttaaatatttcagaaccgagaaatgtttgtgactcggaattaattgcggtgatcgttttggcaccaaagttccatgtcgtttgcagctgctctttgtccaaaaccagcagcgcttgagcagtaccgatttggcgaagtgccaattcaaattggggccatttgcccccattcatttgctgctcaatcggctccactgcgatgcccaacatggcgaaactgaccgtaacaatttgccagatttcgttcacttgaaaaacaaataaaacttttaaatcagttttttccatttttacgaaaagcttttttgatgccaagcagacgacgggtgctctctctgttctgtctctgcttttcctccccctccgcttcttccgccgttctcttcccatctctctttgtctgtttctccgtctcctccaataattcgctgcttttcattggccgtttcatttgccaattttggactgtttgttccgattcatcatcaaagaacataattggattatctgaggatgagccgaactcaacattttgcatagtaatggcaaaatcttggcttaatgtcgacaaattttcggattcgttttgctgccccgccgaatttattggccgcttttctttttgcgtttgttccaaatttattaaagtgttttgttgctttttcattaaattttgcttttgattttcttcatttaaaatgtttagcagattttttgataaattttgagaatgacttttcttaaattgcttttgtgatgaattttcggcctcattttgtgccaatttccctttttctttgttcttcaattgatctggccgttttttgtccactttcttttgactacgatttttgttatccttggcttgtacactgtttaaatgatttacaattagattaatgattaaaatgctaatgtttgtttatt

SEQ ID NO: 13696 - DNA, 1278 bp, Heterodera glycines
tgatgcttccagcgttgatgcaagtcgttacacgcacgtcttctcatcaatggaacaacaattaggctcggttttggcattaggtcaaaagactccttaataaattagggttggttccagacccgactcaggggaattgcgaagttgtcaattgcacttcaaataggaagaatgtgttgaaatgagtttttaagatttttttttgcttcagaaaaaattcttttattttcgactttttatgaaaatttcctccacgacttgttcggccataatttcctcaacgattcccgacttttctctccgaaggtcgattttcgaaccattccgcccatcccaccccactcatcccaccccaacaccaccgtttatcctccctcatcatctcattattgttttggcatttttgttccatctttatgcgctgacctgcacaattggctcggcattggcacactcttcgcaccaatttttgccgtccggcagttttgaatcggtgagatgcacgaaaatcacttgcgcccgttgctggtgctgctgttgcacctccgtctcctcaagtcgtttcagcaacatcagcagatcatcatagccgtcgattgtgtgagggaaaagcattgaagcgaaacgaatagaaaaacagctgctgaggaaaaagggtgaggaaattaaacaatggtgaattcatttgtataattgagacattatcagcagagcaatgtgaattaatttaaatccaaataccaattaatgtaatgaaaactattttatttaagtgttattttgggttgctaaaaagagaattcaattgggtaaaaaaaagtttgatcgcatttcttttttgtgatggaaaaataaattttcaaacaagaaatttttgttctaataaattataaatctcaaaatataatattcacataagtattaagttaaagcaaaaaagtttaaggtttaatttattgggaacaataaacattattaaattattaaaaatgttcctttatatttccgatttttggcccatattttaaaacaaaattttgtaattttgtgcggtcgctatgagagacaaaatgacataatgagaaagtttgcttggaaataaattattgatggagaaaataaaataattatttaaatttaatgtcaaatacataaatttattggggttattgttgtgttgtcggctgctgcctgctaaaatcgagtgtttcccccccccccggcgcaatttccccaatgttctcaccgattgatggccctaatgtttactcatcaaaa

SEQ ID NO: 13697 - DNA, 2345 bp, Heterodera glycines
tttcttcatttaccggtcccgtcgtggtcctccggcacccaaatgttcatggccaaacagtcctcgtccaactcgttgggcggattccacatttcggcacccggaaaatcggggaacattgtgtctaaatcgagcggaaaacgatcatcaaaaatccgaggggccaggaatgacgcctggggattggtttttgcatcccatcggaggctatggttactgtaatcggcacccaactgtaggacccatgagtcaaaggtggtgtcgaaaatccgtggacattgcccaaaaatggcggggaaactcagtgttcgacgtcggggatggaccgcaatttctgcgttctaattaaacgccgttccccgttaattgattcaacaattaaatcaaactgcctcaattttgtacagattttaccgatcggataaaagcatgtccgtgccgaactcgtcgcttccaattcgccttcccatcgatcaatctgaaaaatgttaaataaaatttcagaatttttaccaaaaatttgacaccatttttgggattgcaaaacgtagtccaccgataggtcgctgagcgtacggaacgccaaggaaagtgcgcacagttttaccattaaatttctgaaaaattaaaaaattccgcctttttttcaaatttttcattaattataaatccaaaaacggcactaaattcgttaaatttaaattcctcccttaaatggcattttttaaaattaaaaaagaagaataattttcacaaagcctttccctgccaaaaatggcaccgaatcccaagaaattttataaatagattttaaattattttttttaatttaaattatttggcattttttaattttcaaaaaaaaattaatttttaaaaagccctcggcactcacctgattgaacccgcgaattttgcccaatttggtgaccaccagcggtggctcgtccccgttaagcatcggtgccgtcagtctctgctggtggtgccgttgctgggtagaagaagcggacggaatggcacggacggaaggagaacaaaaacaaagcaaaatgaacagcacaacaagcagcaatagatgatgatgatgattagcaacaaattgtcggcgaccatcaaacagaaaaatgctttgatgttgccgctctgaaatttttcgacataattaaacaataattaatgttatcattgtaggaacatgcgagatactcgactttcggcaaaatttttcgataaaatttgaaatttttaaccaagctggcttatgtttgaaaaatttccctgtttgtgccattaaaaattatttcctgagttctatatctcaactttttaacccaaattcccagcttgagcagctcaagctgatctgctgatctattgatatcaatggtggaaaagtgatcagagcgctttttccgttggtcatcaaattttatccagatgttcaaccactaactccttggcatgccgcactgatcagttggcacttctgcagcagctgccggcactggtttatctcttggcatttgcctcctccgttgcttttgctttatttgccggcttttccttcgctttttgcgcattctttgcaacgcaaatctttggtagatagggaagcaatttaaaatccttaacatatattttttaattggtttaaagcccgaattggaaaagctaataaaaaccaaaagtattcttttatttcccacctaaaggatcgccttccatcagaaaacccgactttttttcgtctcgcaacttttttttcccgtccggtctcgaatcccgaaattctttcatttttcgtcccgagtctcgatccgatttggtttttgtagttccgattcgaatcccaaaaccgttacatttctattcacgagtcccgagccgaacttttttttttttgcagtccctacccgaattctcaggacacggtaaagtatgatttctccaaaacatgttctccaattttggtgccattaaggcttcaattgcaaaaattccacatatggttccctgggttgtgacagaaccgtaatacgaatattgcaaaactacccctatttttcattattcaaagggagcattgccctctggcaactcagcgccaatgagttttctccactgacattactttgtctttgtttgatcgctgagtgatgaacggagaaaagagagtggatgcaggcgatatggaaagcgatggaatgagcgacttttgctgatcgaccgcaaccggtgaagtcatactggcacagacagccccgtctctctgctgctggtcggtcattgtcagtgccgatcttgacagagattcgtacatcaaaatgctcgctataaagtcg

SEQ ID NO: 13698 - DNA, 1491 bp, Heterodera glycines
cgtattctcctccgcttaccgtattttctgttacaacacgtctactgtagtgttagtcactgcttgcccaagactttggtgatatggtggtgcatcactgctcctcacggtgctaagaatgtatgttgttgtgttcggcacttttgtgccctcgggcgatgtgttcgttcgttcgtttatcccgtgaatgaagtccgttttgccgggggcacaaaaattgtgaccaatggcattggcaatttgaaatattacaccaaaaataaaaaaaatagtggggacggtagaacacaaaattagctgcgatttttctcaatggagcgcaaatgaataaatatgaaaattgtatggacacacaagtctcggcggcgaatgattgaagaaaataacggctaatttggttgccgggaaggggcaaaaacaaagacaaaaaaatatatgcccaaagggtgtgtaaatgccataaaaattaaaatatgaaaacatgaaacgggacaaagtcgggagtgtgccaaggttttccgggaactcgtgggtctcggcaattttgggaagccatgtgagcatcagtctgaattttgctaattaatgctaattgtcattgcttgggaacttgggaagtttattgtatgggctgctacggtacaatttgcccgccacagtaaatctcatcttcagggaaaaagggtgctaattaagggaatcacaaaaactaatcaaggtaattagctcatttttagggaaaaaataagataagaatgaattgttagttggtgagatgatgcttcatgtttatcgcctttttaaaaatccttaaaaagctaatgagctgacggcggcacaaaatgccaaaaatgggccaaaattgcacgacaaatgagggaaaaaacgaatccacaaaattttctcacgtagcataacaaaaaaaatatgcgtaatgtgatgatggctgagtgggtgttttgcaaaaaaaaataaataaaatgcaaatataataagacaaatgttattaatttaaattagtatcgaaaataataaatcataaaaataaaaatgtaaagtcttataaatccatttttcaaaaaaaattaaaattaaattttttcattgaaaattaattttgtgccaattttaaatttgccatattttctctgtcaagaaatcaaatttaatttggatatgaatattaactccaattctgaagcttttcatgctttagtgagaatattattttcacagacaaaataatttagctataaaaattattttaaaatgcaaatgcggaagtgaatttttcacacagaagcaacgaagatttgaaaattggggaagaaaaatttcgctcaaaatttttgcatttttgcgattttttaaatttcaattcaaataaaaaattttttttgaagatggcattgaaaattttgtctttaaaactttctgaaaaatacttaaaataaaaccgataaaattaaaaagattattgaaaaaaaaccc

SEQ ID NO: 13699 - DNA, 1407 bp, Heterodera glycines
tgaattagaggagaagggaaggtatttgcatgtgaaattcgtcattttcgaaccaaaatatggaaatgacgctctattcaaaaatagcgttaaaaacttatggcgttttattttatttttttttcttcagcacaattcctttccccatctgatttccattttcattttaatttcgtcctcagtttttgtcttgcatttgatttatggggaatttcctcttcccccgtttatttttctctttttatccgagttctacttaactttctttgttggtacactttcattacaaaacagtacattcaattcgaatacgaatttgaacaaaaagtcgaaggttcaaattctggaacttaacatttttcttataaaagtacttaaatgacttttttttgcagggagtgatggctttcagtttgcttccgtgtattagccgttcttagactaaaaatacaaaattctaattttgaactttcggttttttgttcgacttcatgttcgggattcaaaattactaaaatgggtgtcatatttgttttcaccatgcctggaaagccccactgaaattgttttaattccaagtcaccaaccaatcaaatattttccccattttttcaggtgcatttaatttgtaaaaaaatgtttgtgccgtttttgcaccaaacttttttccattgtgcaacggtatgcattttctttattctcctcggagtttttttccgatgccaacaggtcacccgtggcactcttgcgctctgtgcgaaactgtcgttgtcttccacccgctcaattcgttcaatgaagaatgatgcccgctcagtggctgactttgaccgctcgggcaacaacaaaatcggcgagtcgccaatttccatgccgttgccagtgggggcggcccgctcgccttttgaggcgtttgtccaagtgaacgcgggcgtagtggacgccggaaaaacgcggttcgggtaattttcaacaaacatttttaaaattgctttttcattccaccattcgaactgatttaatttgccattgatttttttgtccttttcttaatttatgtctttttttcagtgtcgaatgttcggtgagttcgtgcacccgcaattcgcgccttgtcgtcagtgcacttcgcccactattcagcaactctgtcagttttggcatagccaatctcttgacactgctccaagttgaatgatcttccatccaacccacgcaggtcactctgtccacggacctcaacactgccgagcccggcaagtcggtgcggttccgcctcagtgcagtgccctattcatttgtcggactgctcgcggtggaccaaatgccgttgtcagtggggatggcccgcgagaatgcggacaacccgggcgtggtggacgccggaaagacgctgttctccacgta

SEQ ID NO: 13700 - DNA, 4124 bp, Heterodera glycines
gtcggtgcggttccgtctcagtgcagcgcccaattcgttcgttggactgctcgcgggtgatcatggaatgcggcgaggaatgatcggcggagggcgcgaatcggtaaacggcattttgtcccccctatcagttcctcataccgcatagtttcccgccccctgaaaatttataagaaattgaataaaaaaattgtcaaatctttcagcgttattttggtaacatttttgaaaagtcggtggacttttccaataatccaattttggagtcccaaccttccttaaagctcccaactttttagttcggcccgatggcttatttgcaaacgcgctcagtgagcacggatgggcgcgatcagattcgtgcggaagtttccactaaatacacggagctccttgacaaatggaccaattttgcgtacttcgccgtttccgtctttgtttccatactcatttgtatggtcgtcgggtttgttgggcttttctggtccatgaagctggagttcgggcgactccgagaccagattgtcacggagatcaggaatagaagaagggacagcacatcggatggcgcgggcaatttgacttgacacatcattttttctcattgattcacattgttttaaataaatatattggttctaagcataaagacataaattctctattactcattatgctcgttattcattatgcgtccatccacttaaaaattttttggggtttgaactagagtgccacgggaccaggacctggaagcggacaactgagtaccaaggtcccggttttgactgggaccagtcccgggtttttcccagccaaaaattcccgggttttcaaaccgaaaaggtcccgggtttgcccaaaattcccggtcccgtggcactttagtttgaaccatagtaagggatgaaagtaaattaaaaatttgaaattttccatttctaattactaagacacctttttcaccatattttgcaccgttttggtccgaatttttaatgtttgtttttccatgttgtcaatatgatgttgatgttatgttagaagatctaaatggcaaagtgttgtacaaggaggctaggaaacagttggacacccacacgtacaaagtgagtgatgaaggcaccggtgaaatcgaatgccaagggtttatttttcataaaaaaaccattaaaatctagtttttgcctccattttcctgcattattgccttaatttttttgtgacagagtaaatttttgagtttttcaaattgcagccaggcacagtaaaattcacaaaattgttgagatttgaaaatttttaagcccgtccttgggaagaacccgtcattcgtcgggcactgtttccaattccatattggaacgtgcactcgcatgcggcttcagcacttgcgaggaccaacaatggactagaagcaactcatcttcatttctctgtgttttttatttaaaaaaaccaaaaaaaaacttcaattttagaagggtctttgtcatcatccggccctttccgacttcatttctgaagtgtgtagaagcatcgacagacaagtggacgcggcaagatcagctcggaattcatacacaaacgacacaaacgttatgttctccaggacgcagtaatcatgcgaattttggcggacgcaacatacaacagcgatgccgaaattcaagagcttatgacggctcttggtctccaggttgcaggatacgcaggaaaactaatggattatgaaaatgtggaagattcagtgcaagccccttagaattacctaaatttattatgttcatttttgttatcttattatcttctttttatttcccgctgattttattcatttattttgtgccaaattgaataaaaaaggtttttttttaatgtaatgtttctgccttttttgttttattcattagcgaaattagtttttttttcgtggggacattttgactgattttagcttgggggacattatgacgctggacattctgacctctggacattatgacgctggacattatgacgcgggacattatgacgcgggacattatgactgcgggacattatgacgcgggacattttgacagcgcgccaaatgaagtcgacccgatgccatctgagcactgggacaactgagtcccagtgaaaatggacacttcagtaccgaaaaataataaacgtgaaatagcaatttaaaagcaaaatttcgcaaaagggagcatgcgaagacggagcaagtagtggggcgagaccgagggaggaggaagacgcctgattagtgcctctggattatgactgccacaaaaagtttaaacgcgtaactgctcagctggcgcacccgaccaacatccatttgaaaagttcgccaagtcaatttgcacaccgaattaagctcatccgtctttaggtattaattttaatttaaatgcaaaaaagtcatttttataattgagcaaaattattttcttctattttatttttttttcctaaaatagctaatttaagttgtgagcgttcaaatgatgccaaaggccacaggatatgtttagcggaattcaaaccctgatttttaggaataaatcccaaatgggttaaatcactattttgccctagaatctttattaggtgttgacgacaggccacaaatttttcataaatttctatgcttattttaatgatttaataaaattttgaggaattttcataggagctggaatccgtcgaagctattatccacgaaaatcggattaggtaatataaccgtaccatggatttgttctgtgtgatatttcccaaatcgtacgcaattattttttctttacagccaaatctctgttttatggttgcaattaatacgcgaaggggtttgaaataagcatcgttggcggaagtaacgaacacaaatttgggatggccggggtatttgacctgtgaaaaaatagaatacctattagaaaaatgaatatgaaaatacgaaaaaacccagaaaaaggaaaataattaattaaatactatcaaaaaacataaagaaaataagaaaatacgacaaaaagtcatgaagtatttaaaaaacaaatacacgtaaaacaaattcacgaaaaaaaacacaaaaacaaaaatgagtaattggaaaataaggaaacaatttaaaacacacgcaaaaaaagaaataaacacaaaaaaatacaaaaaaacaaaaggaaaaagaattagggaacaaaaaatacaaaaacacaagaaatgtgaaatacaaaaagacaaaaagaaaacggaaatacacgtaaatacaaaaacacgaaaaaaacacaaaattcaaatgagtaattggaaaaatgaaaaacaaaaatttaaaaaacaccaaaaaaaaaaaaaatatgaatagaaaaaacgaaaggaaagaaaagaaatagggaacacacaaatacaaaaacacacaaaaaaacaaatacacgtaaaacaaaatcacgaaaaaaaacaaaaacaaaaatgagtaattggaaaataaggaaacaatttaaaacacacgcaaaaaaaaaatacataacatgaaatacaaaaaaacgaaaggaaaaaaaatacaaaaacccaagaattgtgaaatacaaaaacacaaaaagaaatatacgtaaatacaaaatcacgaaaagaaaaattaatacacgtaaatacaaaacagaaatatacgtaaacacaaaaacacgaaaagaaaaagtaatacacgtaaattacaaaaggaaatgaaagaatagggaagacaaaaatacaaaaacaccagaaaaataacacggaaaaaaatgcaacaggaaattacgaatacaaaatacaaaaaaaataattaaataaaatacccaaacaaaaacacacaaaaatgactaattaaaaatatggaaaactaaattacaaaaacatgaaataaaggaatataaaaacgaaaatgcgtaacaggaaattacgaataaaaaagaagaaatagaattcaaatataaaaatatgaaacttcactaattagataattggaaaaataaaagacaaaaattaaattcatttaaaaaaataagtacctcaatcttttccttaattgcaaataagtgcgaaagtttgtatttttccaacagccacgcaaatga

SEQ ID NO: 13701 - DNA, 1327 bp, Heterodera glycines
ttaaataatatcacacctctccctctctctctctctctcttcttttcgtccgtacttcattttcctctttcatcctctcctttgcgcgcattcggtcatcttccacctgtttttacttcagtatataagtgccttttttgtctgtccgctctctttgttttccactgtctttcaccccaaaagtgccacttttgttttcgccataaaaaacaaaagtcactaatttgcgagtaaaaggagtcaaaagtaaaaaaggagaaagctttttttctcgactttcttttccttttggactcaattcatttttcagcggcaaactttgcctttgtttttcattatcaaatttacttgacaaatggtaaaatggcatttgcttgggaggtgccaatgccaaggcactcttagggccacacggagtggcgccaaagtgcttcttcttaagcagaggcccagccaatgttcggcatggaaatattaagcggaaatgggaaagttttttatttgttccctctcttcgacttttgaccctaaaaacaaactttggcatggcattcgccgcttttcttcttcccttcgcttcattacgtcaattcctccgttaaattcctttacttttcctttaaatttcgttcactgtcaaaatgattagaggccacacatacaaggaaaatgtgccgaaaatggaaaggacaaaatcgaaaaggaacggggaaagccgagccaaggggacggggggaagcgacagatgacgggaggaggggggctaaagcgagtggcattggcattgagaaagcaaatgccggaagacggagtgagggactgagctgaaattcccaccccctttgcttttccccttttctcttctctgtcccattaaatgcttctcatcccttttatccattagcattctctgctgccgaaggacaaacgtccaatgctttttgcatttgtgcgcagtttctcattaatctcttcactaatgaatttcgggttgacaataaatagggaaaaatagaaaacattgcaacaattggggaacattttattgccctttggggaaggggggaggaaattgacaaggaaaaggggcaccatcagaaagagccatcagcagaaagagccatcagaaatgcatggcatcggaatggcattggcatggacttatagcaattagagctttaaaaggggaacggacttatgcatcaacaacccaatgcttcattcttcagcccatcattctcctttccctttatcttttttgcattttattttaaggagcggatttatattaattaaggcggggagggagggggcaaatgaaacaatt

SEQ ID NO: 13702 - DNA, 2348 bp, Heterodera glycines
cccaatgtataaaggcaaaacggatgggtcgactcaaacttctacggttttttagtgaggcgataatggacaaacgaaacgtatggatttgtgatcagtgatcggcacagaaggagaaggccgtggcaaatatgtgatcagatttaatgggtacgaacggaagaggcaggcatttctaagattaataggattcattcacaccctcaatttttggttattttgtgaaaaaataaaaattacaaattcctggttaaggtaggggtaggggagaggaaaagaaacaaaggaatgagaaaaacaaaatagagagagcgagaaagagagagagagagagagagagatggggagaaggtgaggaacactgtgtgagagagggtagaaagagaggagagaaaaagagagccttcgttccaatcgaaccgatattcgcatttgaatttgaatttaccatggcttttgccatttgcatcattagtcatcgcctttgcgcttgagggcgaatgaattgcgaattgactgacgatttgtcggctgctgaagatgtgagtggctctgttgctgattgctgattaagcttcgcttgctcattcccgcccccttttccattttttccaaatattcctcaaaatgcttctccattttcttttcttttgcctcttttcccctttggcaacattccctttctctgatcagttctttgatcaccttgatcagtccaatcgatcggctgattcgtcaaatttttcgtcgccttcagcagctgtcaattataaattcgtgggttctaattgcataatttgctttttccttttcccctttttcagtttatctctgccggccttttcttcgttttgttcgctttggcacttttcgtttggccttgtgttaccgtcgcgctttgttgctttttggaaaaaaggacaaaataaacaccaattaaagaaataatttgacattttataatgttaaatcttttgaattccgtctaattctccttatatttatgtcggatcagacttttgacaacaataaacattctccattgtgtttttttggtctttttcagatcgtcgattccttttccccctttggcactctttccgtcgtccctttctttcgctcacttttctccttttccttcacatggccattttttgcttttgtgtgttgtgccagggaactcaaagtttgtgcatggtttccttctgatcagatattaaattgataattcgtcctaagtttgtgaagaatcgaaccttttgggatgaaatttggctgatgagaatttgaatttgaatttggcattgccattggcattgtgccgtttggcggaagggacaaagagggcgactcgctcagtttggaatggagaaaatgctgctgatgttttgtaaacggagacactgaattatgattgtccttttggttcggacaaagtgaccaaccgctggaactgctttgcctttccatctgttggcactttcccttcgtatcggcctctgtttcggaatagtgccgtcgcaaacagtcgggaaacaatttggggtcccaagaataggtccaaaggtcaatggcctagaaaaacaaaaaatggccatctgctccgacaacaggacttttctaaatcactttcattaagtgccgtcgagttttctgctccagtgccaactgattggaacagagccaaaagcggcacgcgagaaccatccgatcgcactccgaagggttcagctgttgcagcttatggccaaactcggcgaacaaagtgccgaaacactcaaattggagggggagggggaagcgtcatgccgtcatcgtttgtaccgtaccaacatgtcactgtcatccggctcattctccgacagcatttgcaagcagcgcaataaagggtcgaccagacaagcactcaatgacttatcgatttgtctgaccagaggaaacaattggtggtcaaaaatggcatttggttacccaccaaaaagtgaccacctcacctgtacaccgggtacagttcagtcaaagttcggacgtaattccgaaacattccccgactttgggcgcgaatttcgtgccgaaaattgtagtcgcgcaaaaccaaagcgagaacttgggaatacaccttcacattctgaagttggaacaaggcatagtgccaagcatttgccaatgtataataccgtgctcatgtgggcaataatttttggagtgattttggcaaaatgcgagtcggagagccatcgctaataaaaatgggggaaggtaattgggggaatgagtgcgggggggggggggggggtggatttgtatggaccattaatacaataagggcttttgcatagacagactta

SEQ ID NO: 13703 - DNA, 3650 bp, Heterodera glycines
taaaaataagtatcaatgataataatatttaaatttactttttatttaaatattttgctgaataataaatcataacttagctcaaactaggtaaattaagagatagctttacatgccatccactaacattttaaaaaaatttagcaaaattttataaaaagttctgacaaaaaatttcgtaaaattagacccataattagtgaacaaccctagttttttcttctatcatttgaaatcctacgaattttaacattttcttagccttttatcagcaaatcaattaatgaaaagaattcccaaaaaacgctttatcaaaaaatagtgataatccaaatacaatgacatcttcaaagttggtattatacgaataaagaacaatttaaaaaactaaagaaaattaaaaagaataaaaagaccaaaaagaaagaaagatgaaaaaagcacaaaaagcgacttatttcaacccaaattcaggaatttgatcatcaaaagcccaataacgagagccaaaactttagcacttttctagttacagtggcccgatgctgctagttaaatagatttcaaattttagtgtcaacaaatttgtttataaggtattcgtggccagtgatgtttctattctaacattaaatttcattctgaaaactttagactgatttactaaatcaactcgaacaaaaaccgtgtaaaaaaaggcctgaaaatagggtcccaagaaaaagaaaacgaaaaagagttcaaaatccaaagacgctccccaaaagcagcaaatgcatttttaatggggcaaaaaagaagctttgcaccggcacgcgaatatggccatgccgaaactcaccaaaatggtaagaagtgagtaaatccatgcgaccaattcaagtacttgaaaaaatgtttcaactcccgttcgatgctcatcagtacgcgatgaatttccgatcgaaaaagtgtgttgttgagttaagcgaaccgtcatgtcagtgaagaggatgctcgacgttaaagccaggacgacgtacagtgaacagcgttctctatcatgaactcttttcttaaaaagattccaacggtcgttgtcctttttttcccgtcgttttgagatgcctttcggctgatcagcaggagaagccgaagtctgatcagacggagaatcagcaatcgttttgagttctggaaagaaatgtgattatttttagcctctaaattcgaaaacagtcatcacctttaagaattttagttactttcggcagcaaatcaataccaactttggccaattttccaaattcttctttgtttttggggttcaaaatttttatttcagacaatgttcgaagaaaactttcgtgtatttgtgggttcactttcaaattgctcattgctggtgctacgcttccattctctgcctctttctgttctttccgaatgcttttgcgatttttccaattttggcagacatttttaacagctaacaaattggcatcttcttttggttttatcttctctgccacaggctttcgaacttcaatttccgagttacataaattctcaacggctattaaaaatttgtcgcctttctcttccaatgcttttgctttttgtgagtcgagttcgtcatcagcttcatgctccactcgttcgttgtctgtctgctttttgacttcgtcgagaagcattgtccccgtctcgagcaattcgtaagtggttgaaaaggaaactaaaaataaataattttttctattatttatttattttatttcaagaaaggttgtttctctcttcgttggccagtaaaaccttttaaatattttttcgagggccgtgcactggatttgctttatgagctattggcgtaccgccggacgttgtgggggcgaggcccactttggattattccttttttacaaatccattacattgttaataatcatttgctacctttacaacaaacctttacactcagtcggcaaatttaatgccccaaacagcgccagaagaaggcaaaatgcaagcattgctgctgaaggcattttcttactatttctaaacaggaattatttcaataaaaaaaattttttaataattataaaattgtgatttaaaaatatatattaatagcatataataaagaatggtaatgaaatgccaaataaaatgtcacgcccatcactgaatggaaatacgtaaatgggagatggatgcattaacaaaggaaagcgtggcattataatgtcgacaatgaatcgttaataatgtaaaaatatatttctgcaattatatcaaataactatataattttttatgaatatttggaggtcggattttttaaataccaattaaaaatgggccctaaaacaagcacttatgaggttaaaaccaacttctaccagtggcgtgttgaaaattcataaaactttctttacggtgcaatttttatgaaaaacttcccggcgacgcctttggtcactgctccggctggcgcccggaaaatgcgtcagtggaaaatgcgtcagtggaaaatgcgtcagtagaaaatgcgtcagtgaaaattttattgtcataaaaacaagttctttgcgttttcgggggcacttaccacgaatctggtatccatttcggccaattctgaaccccggacgcgaattcgaacaaaaagttgcaagtctaaattttcgaattaagcattttttgttcaaaaacggcatacatgatctcctattgcaggattgatgtatttcagtttgtttctgtgtatttaaaccgatttgaagaaaaacactaatttcgaaaattttgactttcgattttttgttcgagtttgggtccggggtaaaaaattgagaatgattttcttatagaagtttacttctatattacaatactaatgccatagaattttattttaaaatatttgcatcactgacgcattttctactgacgcattttccactgacgcattttccactgaccgattttccggtcacgagggaagaatgcacccctcgggcaaattcatttgtcaaaaaaatggcgtggatgtattatctctgcagctcttgcccaagtgatttgttgtgcgtgagaccacggggctatacaaagcccgtgatttgcttgcaccgttcgatcgacaatttcacgcagctgctgcgtgaaggtgttcagccgactacaacaacgcccgcagcaacagtgccaaatgtgacaacaatttgtccagcgacttcttcaaattgcccgatgctgtcaactctggtcattgccagcactgtgttgattttgtgctctttcttcttcaggtattttttttcattcaaattaaagtttaccccctccccccccccacagcttccctttttgggttgaaggttcgccatgcggtggcaaaccgcttgttgcggcgacagctcgttcgtcagcaacaaaagagtaagtatttatttatttttgttttcataaaaaacctatatttttcttagagctgaaaacgctcagatcgctgcgtcgccagggcgcgcaggagacgccgctggtcgtgttgggcggccgccgcccatttgtggcaccgcaccacgccggcgccccccgggtcgaggtgaagcgatttttgtttgttttttttttcaaatttaaaatttgttcaggcgaat

SEQ ID NO: 13704 - DNA, 2873 bp, Heterodera glycines
  misc_feature (58)..(58): n is a, c, g, or t
  misc_feature (120)..(120): n is a, c, g, or t
atggctgttacgaaggtggagatcgattgccggggggaaaataccgagacgactctcncatcccacgaaaaagcatatttattagaaccagtggtaggatatttgatgtccagacattgncggctcggacatttgcagcccaattttttgttgaattgggcgaagccgcaaatgtccgaatttgtattgggccgcaaaattcaatcggatatttgaaccctgaactacgggtcgaatcccggaaaaaacttgttcccaatcctctcaaatctctgccctttggcattctttcccattaaatcccgggggtttgtgctgctagttttgccatggtccattacaaattgatcaagtcagtctcggcgacacaattggggtcggaacggcgggcacagttgcgcatttgctggacgaagtgctgcgggctgtgccttgcaaaagtgtggcggtccattttcacgacacttatggacaagcattgagcaatgtgcttactgcaatcgatgtacatacaccgcctaattgaacttttattgcccaaattatgcgcattaatttgattagcgtggcattcgcgtggcggacagcagcatcggcggcctcggcgggtgtccctttgccaaaggcgccaccggcaatttggccaccgaagacttggcttatttgctgcacggcatgggcttccacaccgtttgtgaacacgagcgattttaggaaaacatatttaaagccgaaaatcgaaattcaaagggaatggcactgccgcggggcgtgaccggaaaatgcgtcagtgatacaaaattcgtgtccggggttcgaaattgccccttaatggataccggaatcatggtcagtgcccttgaaaacccaaggaacttattttatgacaataaaaatttcattgacgcatgttctactaacgctttttccactgacgctttttccgggcgccccgcgggggcgcaaaaggaaaactttgtgatttttcttcgccattgtcataggataaatggcattctttgctgttgattctctttttaaaaaatgaaattcggcagggcattgacttggacaaactcatcggcacttccgtttggatatgcgcacaaatgggcagaaaaaacgagtcgaaagtgaccaacgcaatgcaaaacagcagaaaatgcggagaggaaaatgacaattaaaaggaagaaggataaatgtatttggaaatgtttattcaaaaatttatttaaaaagaaattctatttaattctttaaaattatgaaccgcaaaaaaataaataaattttcaacacttaaaattaattatcctgtctatttgaaaaaccatgggcggcaactaaacccaaaaatgccaaattgggataattagtgcacggacgggaccgtgattatttctcgcaactggaaagacccgacccaattttagagggcgaggggggggggagttttcctttttccttcgagggacaataggaaacatcaacaaattttggttaaatcaacaaaatttggaccaaattgttgcttaatttttagtcatttctctaagaattgataatatgttgattgattctgaatttgtttgattttttcacatttttgtctcaaaatctcgacaaaattccattagcgtttgaagaaagcttttgcttcttcttcatcctttgcctcccttttgctggtcggcttccgctcggcctcggaattggccgtcccatcatttggccaaatgagatttgactccccagcagacggccaattcaaagcatatttttatatcattttaaagggtgaaaaatgtatatattgctgaaactgaaattaaaaaatttttttatttaaaatatattttatttattttacataaagatttattttatgtcattcattttgttaattatttggccttgcataattatgattaatttctctgcgggtaaaacaacaaaaacaaaatccaaaaaacaataaaaatttgcgaaattttagtgtttggtgccaatgacaaattttgttcgtcccaaaatggcgggtcaaaattgaacgagctgacaagccccggcttcccatcaaaatatccgccaaattccgattgtgttcggataatagatggtcattaccattactttcttaaaatgggtaaaatgccatttttatttttattttagcccccgatggatacgaaatttcaattaaattcagagagatttttgaggtaaaatgcaataaaaattaattgatttgattggcgacagattcagatcgaatcggcttatgaactttatggaagaaggcaaaaacagcaccaacaaaaggagcatttagcagcagattttcacgataacaattgccctaatgattttttggtggaaataattataaaataattaaaactttcattggacaaattattttttatcgaatttctattaattttagttttttagtaaattttaaataattctaaaaaaataaaatttaaattaaatattaagttcattataatttaaaaggtgaaaataaagtcacaaaacgaaactcggcttaaggagctcagagatggtcgcttccccttttctccgcttttggcccatctctgcggcacggcaattccatcaacggaaattcgcgcttcttctggacatttatgggcttggtttcacagcgatgcgctttttgaatatcgcggttttgcgagcgattttacatttattaagcggatgaaagcgcaaaaagaggcgaacgacgaaaggaaaaagggtaaaatgagaaaaaaaataaggggaaaatgggaaaaaataagcaataaaataattaaaaagaaatagttcagagtgccattttcggttcacaaatatcttcga

SEQ ID NO: 13705 - DNA, 2677 bp, Heterodera glycines
  misc_feature (108)..(108): n is a, c, g, or t
  misc_feature (2657)..(2657): n is a, c, g, or t
tgcggactgatgagcacacacattacacggggggaggtgagcagagcgaaatgggcaaaaagtgccgacattggcacggcaatgccatcaaatttggcaatttttgtntaagtcgctcatttacattcgcctttttgtgatggatgaagcgcatttattggcatcgaatttccgaattctcttctcctcctattcaagacgaggtaataaataaatggtcaagcagaaaaaggattgggaaatgagttactttttaagcggctaattgcagtgatcagaatttgtatgattgtggtgatgaaatttgcataccgcgaagtatttaatttgattttatataatgaattatttaaacacatttccaataaaatttagcattaatttgcaacggtcgttcaaattgtctttatcgaagagatgaaatcaactgcgattccaataaatgtaagcaaaattaaactaattaatttataataattaattaatgataatataactcgcacaatttcctctatttttgacagtcgccgacattttgaacaatttgtaccgttctgaccaaattccgttgttaattattttaactgttctttttactgtggtcgttgcgctttgtttctattatcggccgtgtcgaaaaaaggcgacgaatcattgcccaaataaggcggaaaggttgccaaaatatgaggaaaaattaaatttaaattttaaactttgctttatttatattcgctaattacttagaaaattaaattttgaaaacagattaaaacgaaaggagcaatttggacaatgcaaagtcaaaacgaacgccacaaactacacattgaacattggcaaagcagaaaactggaattttaatagcaaaacaatgccaaatttggcaaaaaataaatcggtaattcgtcagttaattaactcattaattacaaaaaaacgcatgatttcggcagagaaattcgttgagcaattggtcattgtccgatttggcacctgttgaaaggcatcacgaaaattgtcagcaaaagttttgcaaaacggtggccaaatcacattaatttgttaatgaacattcaaatttcaataattatgaaatagaaatttggaggcgattttcattttaataaatttttgcaataaaatttatattaaaaaggccgaattaaatttaaaaccaaaaatttaatcattgtttttttccactataaagtataaattttaattattctaaagtgatcactgatcagttcattttctgcctattagaggccatatccgtcccatatttcctccaattgtcgcatcatttggtagtatttttcgatatcttttatccttattgtatttctggtgggatattggatatattccgaaaagtccgtccagccaatggcaccttccaaaagcacctaaaacattgaccaaaaatcatttgaataaatcgctaaaatgtatagtgatgaattgttgaattgtctgccttttatttactctctctgtctgattttttggcattttaataattttcgaatttaatttttccattttaaaatttgctttcaataaaattttattttaactgaattttgggcacaattttgcttactctgatgaatacgatcagtaccggcgcctcgcttccgaaagcgatgaatgccctgtcgatgatgccgtaaaaagggatgtttcggcgtctccttttccctttttgccagtcccaatacattctgagcagttcgaacttctcgtgcagttcgttgtacttctccaactcgacgcctttaaatgcggtgtcttttaatattttgtcctccaatcgttcaaacagttcgaattccttctcaattttctcttgcatttcttccgccacttttttctcttctttttgctccttcggttggctttttcgcgccaattcgttgtccaattcggcacagaatgccatcgccacgtttgggtcggtggcgtcaatgctcggctcgacctttgcgatgaacacaaattcgtccgccgtcgggtcaatgatgggacagtcgcggaacaccaaatgccaaaggaccaatccaacaaagcgcaactgctccttctcgtcagcgccggcaaaagccgaagagccgactctccgcacagactcctaaaaaacaattagtggaaatgatgtccaatcaacatccgccacaattcctcctttaaattgccgattatcattaagggtcggatttgaccaaagattgtgggattttaaagttatttctaatttattagtgaaaaccatgtaaaaccaattttttaataaattaaatgcaaaatatgaaattttgtatttgcttactaatccgatccccaattagtattaaatgttttttcttatttttattttaatcacttttcaaattgcttctcagatccgctcatcacttacatcgcctttatcgagaagtattgcattgttaaattggtcaatttctctgctcattgcatttgcaattattcttatcagctgacttccgctgagaatttgtgtataattacttttaagactttcattgtcaattttgtttagatttcttgagttttccacttctaatttcgccgatttgagtgcgcaaatctcgtaaggaatgattaactaaacacactttttttaaatcaanagtattgaattccttcggca

SEQ ID NO: 13706 - DNA, 2671 bp, Heterodera glycines
  misc_feature (2627)..(2627): n is a, c, g, or t
ttttattttttattttcttattgctataatggggaattcgcctgcaccattttattagcatttaatttctccgacttcccttcaccggtaacacatcgttttgaatcgttacggcgaaagcataaccctctgacgtaaagcaaaccgagaagacttgcggcaacgttcaagccataaaaagcctctgaacgcactgttgtaaggaaagccacatttgggaaagtacaagtcactgcgaccgctgtactcagctcatttgtgcaacttcccatatcaaaggtcgtttattgattttattcactgtgcgtggcgaactctcccaatatttgctggcgataaacattctctctcatttactcattttcattcacacaaacattggtctgactgaaaagcacttaactgatcaaaatggccgctgacattggtcaaattcttcaacaattagttaaaaatcagacggaggcttttcaagcccttctccaaaatgcccaaacaaatcaaaattccaacaaccattccacaatttatgcgactatcaatagccaacttagccaatttacatataatccagaattggatttaacttttcaagcatggctcgaccgttttggcccgtccattcaggtggatggcaaggaccttccagacgcaatgcaagtgcgactgctgcttgggaagctcggtcaggaggagtacgctcgtcatgccgaacgtgtacttccaaaactgccgaccgacttcactctggcacagacaattgataagctcaaaattttgtttggggaaaccaaaagcattttcacacgtcgatatgagtgttttcagttaacaaaatcattttcccaatcaccattagattttgctagccaagtgaatgccatgtgtgaacgctcgaaaatggacttgaccaaagatgaaatcaaggccctcattttcctcactggactctcagatgaagacagagaactgagggaacgatgcttgcggattttggaggaagccaaaaagaaaacaccgccggaagtgatcacttttgagaagcttactgaagagtgccgtgcgtttttgtcattgcgcaacacatctcaatctttggcaactgtttctggaacaaacgccatcactctcaagccgcagaaattgaaggaacagcagctcaaaaagcgcagcacatcacagcgcccgtcgacgaaggcacaaagcaacaacaatcgcagcccttccccttttcagcgccaaccaaaaccgccatcaccgtgcaggttttgtggtcaaatgcattgggtgcgtgattgttcacgggcgccaacttgctcaaagtgcaaccgccgtggtcactacagttccgaatgccgctcatcatcttcatcccggcccaattcacaacgttacaacgcaacaatgtcggtcttcaacattacggacgacgacttatcggaatggataatgatcaactgcagcattaacaacattgatgtggtgttgatggctgactctgggtcccgtctgtcggtcattcagattggtttatgggaaaaattgggtaaacccaaactcataagtggcatcaaaaaggccaaatcttattctggtcactttttcgaaattttggggttttttgtctgttcagttacgtaccagggctgcacgcttcaactcaaatgccatgtcgccccggacggaccaatgaatttgttcggattgccatggatcaaagcgttcgaaatggcattgcagcgaccaatcgctacgacactcaatctcgcacaggcacacgccgtcacagtttgcgacgacccaaacactttggccaaaaatttaaaacaaaaattttcaaaagttttttcctcaagtttgggtctttgtacaaagatgcgggcgcacctccagctcaaaccggacgcacagcccattttctgccggcctcgtccagttccacatgcagccaaagcagctgtcgacgacgaactcgaccgtttgctcgcttgtggtgccataaaatctgtggacttcagcaaatgggcggcgccgattgtggtcgttaagaagaaatgtggcaatgtgcgggtttgtattgattttgcaaccgggcttaataacagtctggaactaaaccgccacccgctcccacgcattgatgatatttttgcctcgctggagggttgcacagtttttagtcaaattgatttccgcgacgcgtacctccaagtcgaattggacgaagagtcaaaggagctggtggacataaacacgcaccgtggtttatttcagtatcaacgtttaccattcggagtcaaaagtgcgccaagcatttttcaaaagttgatggacgagctcaccgctggccttcacggagtgttcgggtatttggacgattttatcgtggccacgcccacgttagaggagcacgatgctcttctaaaacttttctttggtcgcctccaagactgggggctccgtgttcatttaaataagtgcaaatttctttgtccccaaattaagtttcttgggcacattgtttctgccgaaggaattcgtcccgatccggaccgatcagcagcaattgagtcaatgccaccaccacatgactttgcaactctccgatcgttctttaggtgcactanatttattacgacgcttcattaagcaaatgcgtgaactccgtgct

SEQ ID NO: 13707 - DNA, 1316 bp, Heterodera glycines
  misc_feature (124)..(124): n is a, c, g, or t
aaagagcccctttcactaatttttgctgttcaaaaatttcacagaatgatttatggccgacgcttcactctgttgactgatcataagccactcatcgccattttcggttcgaagaatgggatcncaatctacgcggcgtctcgacttcaaagatgggctctcattttggctaattacgattttgaaataaaatatatctcaacgaattgttttgggcaggtagacgttctctcgcggcttgtggcacaacaacgcgagacggtggaggcggaagaacgagtgatcgccaacgtcgacaaaacttcacttcaaatttcagatgattcagcgctcgatgaatctgaaacggccgctgtcgactacatcttcatggccaacattgatcagctgcccgtcaccgcggatgaagtcgccgagcacactcaattggacactacgctcaggaaagttttcgatttttgccgtaatggatggcccaagaaatcgcctagtgatttgtctgcctttttcactcataggcacaaactttccgaagtgaatggttgcctccttttcggttaacgtgtcgtcattccggcagctttgcgtcagcgaattttggccgctcttcatttcactcacccgggaatcgttcgcatgagggcattggcacaacaacatgtttactggccccgcatggaccttgacattgaacgttgggttcgccactgcgttgactgtgcgatggcggcaaaaacaccaacaaaaactacactctctccatggcctaaggtctatgagcgcattcacatggattttccaggcccatgttctgacggcaatctctacctcatcatcgtggacgcattcagtaaatggcccgagacttttcaagtgaaaagcacttctgcggacaatgtcatcgttcaactcgagtggctcttttcgcgatacggttttccacgtgaaatcgttaccgacgatgggccaccctttcattcgaaagatttttcccatttttgcaggattaaaggtatcaagcaaacatttagtccgccgaatcacccacagagcaatgggcaagccgagcgttttgttgacattttcaaaaggcaaatgaagaagtgttcacacggagacaaaaagtggatcaccaattctctgttcgcctaccgcaacacaccaaatgccgcactgaaaggacaaacaccagctgaacttttccttggccgttcacctcgaactcaactgtcactgatcaagcctgacatttcttgctcaaatcgcaatcaaaatagaacccaaacaacatgtcgaagcaattcgatcgcaaacat

SEQ ID NO: 13708 - DNA, 1584 bp, Heterodera glycines
tttcatggcggcgtcaaaagcgcgttctgcctttccactgattttgctttccagcgccgaaacgcggcgactttccggccattcttctgttgccaacagaaatttttggaaaaatttccgaatttggttcggtccttccgttccattcagttcggggagtcgttccattgctatgacgaactctaacgcgccaatttgcagaccttgttgcctctgcggttgttccacaaaattgcctttgtccgatgttttgttttggcgaagttgctgcatgtcgaattgggatttacttttcccggttttgcgagtcagtttttgtcgacggatttactttaccggactgacaaaattgcgtgatttctttcacaatttccttttgaagtagagggatttgcttttcccgttttccaaacaaaaaaattccgccttgttcgtctgctcctcgagtcgtttcccgggtttttgttcaccctttttgtcgacagtccgttgaaagttgggggatgtttcccgtttaccggaatgtcgctttggctcgtctaatcgtgggttttactttacccgtttacaatttttagctgtccacagtcggttgattaggctcttctcttgttgggaatttgttttccctttttccgatttcttcaacacttgtcgagggatttactttcccttttttcaattcgaggccacgtcaaatttcttattgtccactgctgattcaccggtgccaggagcgccaagtcgtaaaaaaacagaagaggatattgttgtcgggggctttattaatgttgttgcactgcccacggcaaaagacaacagcccaaagcaaacacaaaacaatacagcccaatgccgaagatgattatcgtttaattccaaataaaattagggcgaggacaatcaataggaaaactgcgacagcataaactaacaaccaacactccacaaaaatcacaaacaaaaatgaaacaaattaaataacaaaacgccaaatatattttaaaatcacaatattagcacaggtttcagtatatttgaatggcatgtggtattctttttttaaaaaaagatttaaaaaattgaagcgtgcttgaatccaagtatgtacttgaaaatcattcaaccgaaagattaaaaaatattactgttttatacagaataaaaaaaaaatttggcattcagcctacaaatattcacgattttttttcgtaagtttttaattttttgggtcaatctaccaaaaaaaaaaacaaacaagaaagtcacgaaaaaattaattcggaaagaaattttgtttaaaattttttaacacatctttgaaattttttaccaataaaaaacaggcatagaaaatttaaataaactcgcgaatttgctgatagaaaatccaatccattttaatcgattgatcagattaccgtagctcacctttttccattcacagtgatcactcttcgatgttttccatcgtattgaatcagtgttgaaagaagttgatccattttttcaatgttttcagtcccgccaatgaaagtgtcatttttgttgcatgtgctatgaaaatccgggtcacgcttggtc

SEQ ID NO: 13709 - DNA, 3072 bp, Heterodera glycines
agtaaaatttcgaaatttgttttcttgcaaaatttttttaattaaaactaatttttttaacaattcgccactacaatttttaacgctgttaattaaaataattaaaattgttaagatgatccaaaaatgtcaataaaaattccaaaatttgatttctcgccaaaaatttttcataagattttatcaatttttattttatttctttttaacaatgcattaaaattttaacgccggtttaattataaaataattaaacatattctgttgattcaaaaaacgtcacaaaaattggattccatgtcattttttgaatttcaccctttttaattttattagcaatttttgccacaatttaacctcattaattattgtgtaaaataattttaaacttattctaatgacttaaaaaggcagtaaaattacaaaatttgaatgtctttccagaagttttttcataaatattttgaccaatttttatttttttgcaattttgccactaaaatttaactattgattataaaataataaacttgttctggtgaatagtcaatgattggtgtaattccatcattttgagttgtgaccattgtcatcccatgttcaattgttaaatcaaactcataaattccgtccttaaattattaacagagtactaattatcactaattattttgggggaaaaaaagtaataaaatttaacacctcatttggtctggccatttcaagctgtttttcccaaaagctccatgcttttgattgtcgaaatgttaaaaaatgaataacaattattataattattattttgtaaaacattttctttaataaaaaaataaattaatatatttttttttgctttttaatttaaaagtaataattgaagtcccaatttttatcttaattattgtaaatgaataatcaaattgttatcatccattcaccaattaaaaatggcaataaaatttaaaagaaaattatctatctggtatgaaaaatgtcaaacaataattcacagcagtctcatttaaaaaatttataaggaattaaattttttttattggaattgatcgaaaaatgataaaaaataatagaaaatacttgtaaaaaaatacttgcatttaatttacaatagaaaaaaaataaaaatattttagaataatttttcaaaaaataaaccctattaaattttttaaataaaaattataaaactttgaatgttgagaaataagaataatagaaaattgcaagcaaatagagctaaacatataaaattagaatagtaaagtaaattttacgcattttttaattatgctttttaaatgattgttaaaatataaattaggtatgctaatccacaatttgatgacgctttttccaatactgacggattgtccactgacgaatgccaatactgacggattttaacagagattttcaaactaatccatttccagtcacgaaaaaaatacatcccaaaaataacggattgtctaatactaacggagtgtccactgacggattgtccactgacagattgccgacctgtgtattgtcaaatgacggattgtccatctacaatttgccactgacggactgtccaatgatggattttgttgcactgacgaattaaaccgtcacaacgaattgaagcaatgaaataattttataaaatttattttataataattcaatatatatttttttttaatttttaataaatcgatgtatattttacatatgaatatattcatattattgatgtgccacctttttcaaaacatttccggtatctatctctgcccatcatccgcatttttcttcatattgaaagaattattctatatgcctctctctttttttaattatatttttaattggtggcaaattttggcggcgtatgccacgcaaatggcaaaatggcatttatgagtgtatatgtatttgtatgtatatatatatggggaaaatatgcacctatagggcaaatataatagtaaatagcaacatttcagtaatcgagaaaatgcattaaagtgagaatttttatttattaaattaagaattcatctcgagtcccaaattggtttatgccctatcccctaattcccaaaactcatttataaaactactcaactaactttgatagctttgacccgaattcaacagaaattttggctatcccaaccagaatttcgtcatgccaatccaactcccccctgaattctcgacttcgacattaggccccgaattttatagccttgaattttatgatctaatgctaacccgaccactatggcctgacggagtcaccaactctttcaataaatccaacctcaacgtgaaatcccaaaccaattttttttaaattttttgtcctctgacaatttggccccggatgggtcgcaattagagaccggaattttcaaattttcagctccagctctgggattggaactcaaaattttttaataatatattatttataataattattattgacaaattttattaatattgagttttagaaaaaatgcgtctaaatatattccttctcctaattgttcatctcctatttgtgtgtagcgatgttttcggtgacgagcaaagtgccgaaaaacaaagacaaatacaacaaaatggcattgcgagtctgaaaagtatgaattcatacacatcacgtgagtttgaagaaatttttggcattacgccaatcaaaccgggaaagctgaataagaaccagaaaaaagagttgaaaaaactgcgcagaaccgaagaaaagaaggccaaggagttcaaaaaggaccttaaatacttgccatttaacaaaggtaaatttaaattgctcttaaaaatgtcaaaagaaattttttaataatttaattttaaataaaaatagctttttcggattaatgttccgaaaatgtagaaatttcgggattcgaaaacaaatttataaaaaggggaaacatttttttacattttttgcttcagaaagagttaattaaaaattatttaaaaattggtaaatcgctcttaaatgtcctaagaatattttgtaattgagttttaaataaa

SEQ ID NO: 13710 - DNA, 3871 bp, Heterodera glycines
atttcaaaaatacgcccctgagacaatgaaaaattttcaaaaattcatctcatagatttatttatttattttctcgacaagtatttgtgatttagatattatttatctcaatgctgatcagacttatttttttgcctttttgaatgaatttggtcattttacgcccttaaatttgaggatttttagtgcctattttccattttttagagcctattttggggttttttttagagcctaaagcctacctattttgacggtttttagtgcctaaaaattggagcctactaataattgccattaatttttttaaaaacacaaaaatgcggcattatgccaaatttaaaaaatgagccaaaagttgtgttgtaaagaaatttctaaatttaggtacttttcggctttggggcctggaattgattttttttttaaatcaacaaagggtttcaaaaactacgcgccaatttggtgaggctaaatgccacaatttgcgcaattatttcctcaaatactcatttcgttaatttctgcagtgagaacaaatatttgtgcaattttgcgcaccattgtaatcaaaaaaaataataaattaaatccagaccaaaaccgaaaagtacctaaaaactaatcattaattttaattaattgatcaattaaatgaagcattgcttatgccattattacatttggtacgcctccgcctgtctgtggcaaatttatgccgctccatggagacggctgagaaatgcgtggtcgcacaaatcggttcgcctgttgctgaaggcttagagctgctgtgttacacaagttgcaggtgaacgggcactcctgtatcatcagactacggtatatgggcacggtacagtatgccacgcggtcgggacagtccgaccgaccgttgggccccactcggtcgaaacatgctaaagaaatgtttggcagacaattttaacattttatacacaatcccttaatatatttttaattttatactattattcttttaaaaaattaaaaattattccgataatacgcgttaaacgcctgctgacaaatgggaagtaaaatcaaaaaagaggaatttcaagaaacaaataattaggaaaacgaacctaaaaaaacattttgaccgataatttaaatgtgaagtcttcgaaattaaattttattaaaatattaaattttaatttgatcagtcatggttgatgctcagggcatattacgtaatatttgaattttataaatttcataacaccaaattttctcattggttgccggaggagcccttttcccttggaaaaaaaaagttttgcaatttgttctgattttttgacattgaatttgaatttttcgtgaggaatatgtttaatctatttgaaaatcaccgccattcgccgccgccacatttgcattcgcaagaccaagtgccgctcttgcgccacaacggttgcatgtttgtgggcactgaacaaaaaaaaaagaagcaatttttgaatttgttaaacaattgaatacatttctttgcacttaatcttcgaatccgaaatctcggaattacgttatgagtcgggattttgccatgaattcaaaaacttcggtgctgtaggcgccgccgggataaatttttaagattttcatctaaaaatgaccatcattttgcgattttgagccaatttttgtgggtttttggaaaaaatagcgaaatttttttgagacatttgtgtgagagattttgaagggggaaaacaataaggaaaattgcaaaattttcgtcaatttttattttaccttttaggaaataacctccccggccttatagtttttttaattcttccggcaaaatgccatttaatgctctcgtgcctgttgtgtcatcagatctctgtatatcgcatcgttgcacagattcgctctcgacggacagtccgacgggcggcccggcgctgccaagtcgacgcacgcactaagcgcggcgcccggccccgtggtcactcgtgctggcgcaaattttcaataattttgaaatgcgtgaaaaaaaaattgaaaaaatatttgttgaccgtaagttgttgtttcaacatttaagccttatgccttcgtaccaatttttgtttttagagtatgtaaaaatttttaataaaaatagtaattaagaacatttttagtagggtaggtcgggaccggaattttgggcacaaccgggaccgggactttttgggttgaaacccgggaattttagacttggaaaaccgggaaaaaacccgggaatttcgcggtcccggtcaaaactggtgaaaaccgggaccttggtactcagttgtccgtgttttggtcacggtcccgtcctaccctaatttttagaatagaatttctgtaagagtttttaaccaatttctgcaaaaattggcttttattgaaaattttgaaaattaatctgagcttatttgttgcacaactggtaaaatagaacttaaaaagcgcaaataaaaagggtaaatttagaaggaaaaatattttttcattgaaatttttaatttttttcatccccgttcccctgtttggtatccccgtttccgggaatccccggcttcataatcccaactttctccgttcccttttggatttcatcagggattctccctccccagcttcaactcattataaattactaaatttaaataaaatgaataaaatagacctcctaaagcctagtaggatttttttttaaatctctaaaaattaaaatctttcaaattgttaaaaatattattgaaatattcaaattagtcatttgcgttcgtacgtcgagtgatcaggccctgattcccagtaagagacgggggcagctgcacattcggcgaacaacacagctgattgcggccaaccgtactgcaaaatggaacaagaaattcaagaattcattagcacaaaaaaagtgaaaatttgaattacggcacataattaattaccgcagaattaagccggcccgacaacgagccaaaccgctgggaaaacgaagagcacctgtttattaaaaaaaaacaaatttgacgtattttttcggacaaattatcgtattcaataaataaatattgttagtttaacggacgttcgcatccgtccggaattgcgtccggtgagccgggctgtgggagttggtcaaaagtttgttgtattgttccgtttggtatcggttgttggccacagcacagctgtgaataaactaattaagtcagccttttttgtttttattttattcaaattatttaatttttaatgtaaatattttttaattttgagggattaattgttagtgtttttaacttgaacacttggctggtacacaagtgggggcggacaatcatttgctccggttgttatgtcgcggacaacctctacaaaaattaatttttatttaattttaaaaattctttaaaaattgctttcatcatcaaaaattttttatttgagtttattaaaaactttaatattccgaaatgtgtcgtttaggcattataaaagcgaagctaatctcaggaaaagtaaaaaattctcaaaatttaaaaattttcaattgacgcctatcagtttcacacagagaaaattaatttataaattattcaattaataaattaccataacagaaatattgctgcccatcaacaaactgttgtttttgtgtcgtgatgaccaaaaaaatgaaaataaatttgaaaatgtgaaaaagcattttatgacaattggaggaagaaagaatatgaatgaataatggccaaggagagggaaggaagtcggaagaatgaatgccttccgtgggatgaccacggcatttatatacacataattatcattattattaataattattattatt

SEQ ID NO: 13711 - DNA, 1327 bp, Heterodera glycines
ttgaaatgctggtgggttgagtcccagagattggaatgacattgaaatgctggtgggttgagtcccagtgtctggaatgccggagatttgagtcccagagattgaaatgctggtgtgttgagtcccagagattgaaatgctggtgggttgagtctcagagattgaaatgctgctggtgggttgagtcccagagattggaatgccattgaaagttggtgggttgagtcccagtgtctggaatgccggagatttgagtcccagacattgaaatgctggtgtgttgagtcccagagattgaaatgctggtgggttgagtcccagagattggaatgccattgaaagttggtgggttaagtcccagtgtttggaatgccagagatttgagtcccagagattgaaatgctggtgggttgagtcccagcgattggaaagcctgagaattgagtctcagagattgaaatgctggtgggttgagtcccagagattggaatgtcattgaaagttggtgggttgagtcccatttgtttggaatgccggagattttagtcccagagattggaatgccggagaattgagtcccagtattggaatgctggtggcctgattttcagtgatttgaatgtcattgaaagttggtgggttgagtcccagtgtttggaatgctggagatttcattgtttggaatgtcggagaattgagtcccagagattgaaatgctgctgggttgagtcccagtattggaatgctggtggcttgattttcagtgattggaatgtcattgaaagttggtgggttgagtcccagtgtttagaatgccggagatttgagtcccattgtttggaatgccggagatttgagtcccagagattgaaatgcttgtgggttgagtcccagcgattggaaagcctgcgaattgagtctcagagattgaaatgctggtgggttgatttttagtgattggaatgtcattgaaagttggtgggttgagtcccagtgtttggaatgccggagatttgagtcccagcgattggaaagccattgaaagttggtgggttgattcccagtgtctggaatgccggagaattgagtcccagagattgaaatgctggtgtgttgcgtcccagagattgaaatgctggtgggttgagtcccagcgattggaaagctggtgggttgagtcccagagattggaatgtcattgaaagttggtgggttgagtcccatcgtttggaatgccggagattttagtcccagagattggaatgccggagaattgagtccaagtattggaatgctggtggcttgattttcagtgattggaatgtca

SEQ ID NO: 13712 - DNA, 862 bp, Heterodera glycines
acctccaagtttgccaatttcaaaaaaaattctcattaaaaaaagaaaagttcgcaaaaaaatgatgaaaatatttattaaaaaatgccaaaatgacaaccaaaactcaaaattttcgtatttttggggctgtactttttaaaaatttccaaaaagtcgatctttaaggatgtatttttcgctttttttttgcatttttcttgtgaaaatttgccaaaaatggccgaaatatggactaaaaacacaaaaatgccgaaatatggatttattccctaaatcccccaaaatatggatttatatcaggtctggactattacggaaattacggcctttttggagttacggattacggattacgggttacggatttttgtgatttatccgtaattttgacccgtaagtggctttttgattatattattagcatacataaaagggggggggggcgggaggctagcgaagggggaaagaggaaatgccgaaaaaattagctattttttaacataatttgttaaaaattctgaaaatttttcctcggcggcgcttatcggcaccgcccgccccaaaaactcctaattatttttaaatatttttagacagaattttatagaaaattgcataaaattttcaaaaaaattttccggcggcgcctttcggcggtgctaggtcgttgcgcgaaacccgcaaaaatgattacgtcacaaaaaggggggcgttgcgcgaaaaccgcaaatatctaacaaaagagaccgggcctcatcagtacgctgtctctgattgttaaatttaaaaaattaatatgtgtttcggcccttaaccgtatacacacaagccactgcaaacaaccaaagcaaatgaagaa

SEQ ID NO: 13713 - DNA, 1936 bp, Heterodera glycines
  misc_feature (164)..(164): n is a, c, g, or t
  misc_feature (224)..(224): n is a, c, g, or t
tttttttccctttttcccccccaaacccgggaataattttttttaattttgtttaaaagggttttttaaagggtgagattattgataattatgaaaaacttttgaaaatttaggattacgtattacgaattagcttttttgcccctcggtatgggacggatacnggatggccgtaactgaaaaaaattgccgtaattacggattacggatttccgtaatgaaanatcagttacgtccagcccctgatttatatagactaaaaactttcaccaaatcaaaaaattttaacgtagaaatactatttttaagcccctttcttcattgaatatgcgcagaaaaaaatatgttaatccatataatttacaaccctaattattagttaataaattattttcttcgtttaacttttaaaaactacaaagtgtctcattttgttgaacaaattcgcaggaacaagaaaaaaaaatgtgaataataaaagtgaaaaatgttgctataatatcacaagaaataaactgagtgaaaataatagtattgtttcaaagtattattatttaatcctcttttaaaaataaaagtgatagtaattttatagttaacatgtttctaatcagaaaattaaggcgaatgctgtgatcagcagagatacaatcgtatgaatcccaacaaacgggaccgggaccgggacctggtactgaaaaacacgtagaaactgagtacgaagtcccagttttgaccgggacctgaaaagtcccggtttttcccggttttcccacccaaaaagtcccgatttttcaattcaaacgtcccggtccggttttgcccaaaatttaaaaattactttatattgaaatatttatttgaaaaagtgcgataatagaatcaaaaaaataaataaataaaaaaaaaaaataataataataataaacatattcatattcaatacttttttgatatgaaaatattaactgaagacatcgatcgacttaatcaaaaatttaataattaaatttagcaaatcattaactttttaattataataaataataaattctttattaaggtaagaaaatcgaatgttaaaatttacaaaaaaagtaaaataaatcctgaaattataataaaattaagttataataggtaagactatcgtcgatgatataaacataaatatatttaaaataatattctaattatagtttttgcttttttttagaaaagtaatgaaaaacctcaacaggggccacagctgaatctatgaattttcaatggaattttaaaagaaaaataataaaattccatttctgcaaatcaacaaaatttttttaagtctttaatattccaaattattattcgattattaattttacaagaaaaatagtaatccatttaatctttattagtattttagaaaagatatttaaaaaaacatgaaatcttaatgagataaagaagtatattaaaaattttgacaagcacaaggtgtagaagagtcgctgggggtgagaggatggatatcaataatacaattttatttaattaaaacaaatgaaacacgaccattagaacaaaataacgcaattattaaagaaaatgtcagggataaaacaattataaaaaattaaacataatattaaaaaaatatatttgtttatcagacaagaagaaataaaacattctagcaatttactttaataaattatcaaaaaagacaaaatgtaataaaaagatttacattgtatttttttagaacatcgaaaaaaaaattaaagtttttgaaaaataaacaattaactaaattttttgccataacaaaaggaagaaataaaaaataaataaatatattcaatatgtttagcataaattattagtacaaaaaattcgaaataaaaattgtaaattaattaaaaatgatttcaaattcaaaatccccaac

SEQ ID NO: 13714 - DNA, 1602 bp, Heterodera glycines
  misc_feature (30)..(30): n is a, c, g, or t
  misc_feature (106)..(106): n is a, c, g, or t
tcaatatctaatatttttatttgtaatttntagaaagttacattatttcttataagaactgcaaaataattgacatgattaatgatattttcaaacatcttcaaanatatacctattatttaagcgaaatcaaaaaaaaatagaaagtttatcaaagatatattcagattaaacgaatacggagacatattatgaattattccttgttaaattaaaaataaattttatttgaaggtttttaaaacaaaaaaaaaatgaaaatttggaaatgtttttagaggaaatctttttcaaaaacacgaccaaataatttaaataaaatttagctctaatgaaataatttaaataccatggaagataataatttgatgaatgtatcagaaagagataaataaacacaatacatttataatgatcattttttatgaagaagaaataatgactaaattcgattatctaattaataataatttaaaaaacaaatgaatttaaagaaaattaaaaatgagaaaaaaccaaaacaaaaagctcttaatgcgatgcatactcaactctgaacttatcaaccaaagcttgacgagaagaaaataaaggattaataagaaataagagaagaccacaaatttcaaataaatataagtttatgaaaagcaataaatttataaaaactcgaaaaacaatttaaaattagatctataatttcaaaaactaataaatttaaatcttacttaaattattaaattttaaggaagtatggctatgctgaaaagctaacaatacaaaaactatggtagaaaataatattatcaatgcacatgaaaattgataattaaatataacataaatataaatttattttgtttaaattaattaaatagaaaaggataagagaaataaaagagagaaaataatttaaaaataaatttaattaaagtaagttgtataatatttttaatgaaaaattaaagcaaaaatatatgctaacaggtcaattctagcagtatctagtccctggtcagttatgaatcaaaaaataccgtttaataattatgtaaattgaatagaaataattatatataaagaaatgtaataaatttaacaaggaaatattgctaaaaataataattataaattattgataatctttataatccagtgagaaataaacagaattttagtgcctaaaaatacatttagaaaaagcctttaaaaatgctaactttttaaaacaatattccgagtatttatgatatgttaaaaaataacgacgcaaagttaagatttttactgttatcaatctaacaacatatatattgcagttatcaaatgtcaataaattaatttaagaaattatttattattttgttttgaagaaacatttttttaaattaaatatccatacaaaatttagaacaaataaattaaaaaccaaaaaaaaagttgaaaaaacaaataaataaacaaattatttcagaaataaatgattaaaattaatttcttaataatcttcgatttatagtgagtgacctaaatattttaaaaagtaaattaaagaaatatagaaggttacccaattatatttaaatgaattttccccaaaaa

SEQ ID NO: 13715 - DNA, 1238 bp, Heterodera glycines
  misc_feature (9)..(9): n is a, c, g, or t
  misc_feature (72)..(72): n is a, c, g, or t
  misc_feature (112)..(112): n is a, c, g, or t
  misc_feature (127)..(127): n is a, c, g, or t
  misc_feature (166)..(166): n is a, c, g, or t
  misc_feature (183)..(183): n is a, c, g, or t
  misc_feature (188)..(188): n is a, c, g, or t
  misc_feature (1200)..(1200): n is a, c, g, or t
gcttgcacntgcgctgcaggtaaaaataaaaacaatatcccaaatggtttaactgtgaagccttaatggcgncgacggaggacaacattaggaggagaaaccatagcaaagngagggaaaagacgangaaaggggcggaaaaggcgggacatttgccaacagaagnaaagggcatgggaaaanaaaanaaaggaaatgcaggggctaaatgatgaaaaaatgataagcaatcaaatgacaaacgaaacggagaatctgacaacacgtaacgtattgattagagtgtaaggacgatcaaaaagaagcaaaatgggggggggaatgcccaatcacacaaaacaaatcaatctatccatccatccgtccccacattcattattattcgggaagaacaaaaaatgaatggacaattgggtaaaaaatggagggaccgatcaaacaccgacagcagacggaggggaggggcaaaggatggggggaaggggtcctctcaaccgggacggactggaatgactgatgacggaatgcatcccttgcctatccgtttattgaaatgggtaattgaaaaatgtaagcaaaagaatgaatcgcccccattgtcattctgtcatttgtcactcgtccgttggttccgcttccaacttttgcgctctcttcagttgttcctctgttctttcctcctttttcgccgtttcggaaatgccaattaaccgtcggacggtgcacattgtgagtcctgccgggtgatggtccaactcggggttcaatatgtgttccactgtgaagtttgatgagaaatcgggtgcccagctccaatgaaaagtgatggcgccgttgtggggatggccgtccgggtaggaagctcttaaaacatcaaaagagttaactctaagacccatccacccgatggacctaatatcttccgagaagtatcccaagaaagaatcatagaaatttgtgcatcggttttgttgtggtgtgaccccgggcctcggcttcacttcctcttggttgcgctcatttcgagtcagcataaaattcgcttaattttatttggttcatttgactgtcattccgtcgcttttttttgttgtcattttggctcagtctgtgctgtcttctgcccgtagccaacgaaagagtgccgtcactcattttgttttgggcaaggcgtcggcacacattccctgccgatttcangaccccctgcacagtcatcattgccaatcccttgatga

SEQ ID NO: 13716 - DNA, 2869 bp, Heterodera glycines
cggagatgcattatcatttgtgggtttgctgtcttctcataaaagggacacgaaaattccaagcccccgcgacgccctccttttggattcctttcgaaaattgctctccgcacatacaatcggttcactgctgctgcgaatttgtgcgcggctgcgtttctggctttcaagtcgaagttggcgacattgtcctcgttaagtacggccgcgtccaaaacccaaaggcaattgcccagcggatgcatgcttttgccggtgtcttcgaaaagagttgtgcacatggcaagcaaaacggtgcacttcggaaatgtccctttaaccgattgaaaagcttcaaaatttgtgccatttcgtcgatgcatcatcagcatggtcctgttctgaacaagtaattgaattttaaaatgaatcattgcgcaaagaacccccatgacggagaccaacaacacgggaccatcagagtcacacttcggcatcaaaagtgctctcaactcagcagtgtcagagcaccgcctcagcacatcctccgtaaaacgcgcaatttgtcgtttgataggaaaataaagcttctaaatatttgaaaatacaaaagcattagtctcattccgcttcgcatttggtgcttacatctccgctgtatcgcctgaacatttcgttggcagtttccggtcgttggttttggtaaatttgtctctcctcgtccatttgtgccgccgttctcttccgattaaaatatgtagggtcttttggcctttcaatgtccggcaattcccaatatttcaacgcctcctcccgcagtttggcctggtcttggtcgaatgtgcccgggttggccgcgaaatgtttgtatttcctcagatagaacacttgacgtcgagctgtccttgacagaatgaaaaggtcgtcaattccccaatgtttgaatgaatctctcactgttcgatgctttgccgaatgtacgccatgaaagtgtcgtcttcgctgatcacttcatcaggcaccaattccataatgtcctccttttttctgtccatcgattccattcgtttattcacttccatcaaatattttttaacctttgtggagccaaataaattcagattttcacaaaaaatatatctaaaatgagaattaaaagaaatgtggaaaggattgacggaattaccgttcagaattggcgggtcgggaagtgatcggtttatgaagagagacacggtcaaaagagagatacctgcaaaagagggggaatgacgaaggaacggtttaacgaacttcgaaaggcccgctattatttattttcttaaaatatcaattccaaagtttgctgttttttccgccctatcattttgttacagttaaagtatttataagatttaaaagttttgttcacatcaaataaataagacccatcgaaaatggggtgaacacatcgaacagtttgcacagaaagttgccgcccttttccgtcactttagcatttccctctacgttttcctctttgattttacgcctttcggcacggcataaagacagtccgacaatgaattggcacagataaaggcgtttggaaaggacctcctgaaggttttcctggccatcgacagaaaaaccgccatcacacatcaccaaatggacccctaagcgaaaaggatcggaatgcttcaatcttaaaacatgcttccaaccagtgtggatgcggtcattcacaaacttttccaacgattccaaattgttcggatttgtcacgtccccatcctcattgaccccataaaatgtctcaaagtaatcagatgaagcggctttgaatctttccaatttgaaatcgtcctttccttaaatccaatgttgtcatttgatcaaattcgggaaagagtgggacagcaaaaaacatattttttaggctttttcccgtcatttcgacctcccctcccttttcttttagaccaactccctcaatacaaagggatcatttcaaacctgttaaagtaaagccgaatcccttggcgttgtaaaaggctttccgccacaacatatattcgctaaatccgccgggccccgcgcaaacatcggcgaagtaaaaaggaggagaaaaccttaaggttgactcaacaagaaaataacttgaaaacgcacctttcgacgttgtcacgctcattttcgttgagagggtttttagccaatcgcctttcatcgtcaaattcccagctgagacgccaatcgaatattttgtcgaggtttgctgttttcatcgcagctctgcaaaactgggaaattggtgtaataataagtttgaatgcaccaaacaaagccaaaaagcatgcgcaattacctgttttggaagaatcctgccttaactgtttcgtatgggttggctcgtgacctggctgcctccacttccttacggtccattgtatcgaaaacatttttggcttcgatcagttcagcgatcagttcgctgggacaatatttgtcttgtttcatcaactgctcgtcttttgtgataggctaaataaaattttaatgacaataaaacgagaagctttttagagtatggatcgacaaaaacagagaggaaaccgaaaaaattttctttaccacgctttggttttcgaccccgtactcttaaaaattcaaatcagaaatatgacatacagcgcccagcattatccacgagtcactcagttgaccaattaagcagttccgttgctcttcttcacatttcagccattccggcgcttcttccacgggtttattttccaattcgttgttcaaaaatgattcaaattcctaaatatgatataaaaattttcactttttcgtaagactttattggttaattttagggctactcgactctctctctctctga

SEQ ID NO: 13717 - DNA, 1995 bp, Heterodera glycines
  misc_feature (1912)..(1912): n is a, c, g, or t
  misc_feature (1938)..(1938): n is a, c, g, or t
tcaataatgagattttacgaaatattcttgctttatgccttttttttatattttgtgttttcaaattttgaactttttcacgtaaaatttcacgtaacgcacgtaaaatacgttgtagctataactaaacgccagattcatgagcatcaaaaattagcctagaaaaaattttttagaaaaaaaatttcaggggggtagcaaaacccggaagtaccgaattttaattcgtaaataattaaaagggagtagccagaaggtttggaagcgttgattatcatccacatgattttccagggatgatttggtaaatttttcagaaaatttttactattcttaacaaaattcagtaaaaaatcacattttcctctcgtggcgcattcacactagcgctcaaatgtttttcaattttgagcttaaaaaatgtcaaaatttgatttttacataaaatttgcaaccttacgccgaattttcaaaaaaaaaaacggcacccatcggttaaatgtaaattataaatggaaagtttttgaccttaatttgggtgacaaacataaaaagaaatctttatgctttataggacaaataaaaaaattttttttcaattccttttaattatttaaataattattttaaatttagcactaaattacaacacttcgccaactgcagaatgttagctgaatttaaatgaatgaatatttaataaaaatgaatgcttacatatattgacgcttgtgtattgttacataaatgttaattgaaataattagaataaatatttgccttaattaatttgctaataaataattaaattaatttattgaaaccttttaatgctaaattagttataagtagaatatataatgttaaaaaattttaccaaaaaattgtaaattttataataaattttagcgaaaaaaatttaataattttttaatttttccgtctaacaaagaaaaataaattattagttccatccaattattgcaaaattttgatgcttttggaaaaatttatgccgattgttttttatatataatcttttttttgattttaattattttataaatctatttaattattgaattaaaaaaaataaatatatattcaaatttatctaatttttttattcagattaaaattaatttctacatatgttcataaagatgaataactatgcaaaaataaataaatgttaataaaaataagcattttgatgttttccatcattttctaatttatgaaaaaattttccatttttatttctgattttctatctcttttctccaacgaatgattgggtatgatgaaaatgattgttggttgccacacaacgccacaatttttttaaatttattttttgtcaaaaaatattcattccttgccctctctcaacgtctgattggcccacctcggctttatccccgtcccccctacacctgtttttccgcttcacttgctccgacgaccacgacgaccgatgaattgatcatttaatcacttgtcgtgtatcgcctctgaacaccgcctccatccaaaaagcatgcccattttttgatcaccgcctaagggatgggatggacctgtttcggggcgggatgctttctttgtttgatcagcgacagcagatggtgtggcggtggaaaattgcgtaaaaatttttatgaatttcctttttttggatcattgttactattatttggaaaataatttgtacattttatgatcggttttactctgtctgccaagggacgacgggtcgcacaaattgttgcaaaattaaaagtgattggaagcacccggcggaggggaacggatggatgattgagcacacaaataaaatttactaattaatttgatcatggcatatgtgcaataatcaagcggaaaaccttttttgtattaatttaatcancgatgctcaaattgacccggaaatgngtaattaggtttggatgagttgatcacaattatctacaatttggcaattatttgatc

SEQ ID NO: 13718 - DNA, 1554 bp, Heterodera glycines
ttaaagagataattagggggtaattcgcgtaactaacttacgttaatatcacctaacattattttttcatttttccatcaacaaaaaattatttttcaccaagataagcatctcgagcagggattaattaacgcctctattaaatgctcgattggttgttttttgcttttgcaactaatcagcaataataaacgccccgtcgggcatgcaaattaatgtgtgtgcatgcatgcatttgcgggaaaatgttgcccttagggcagaaaaaattattactcgcccaccatttttttatgatcattgtttgtcctttccattttcgcgcaaatcaccatcaccaatcaccagtagcagcagcagcagcagcaggtggtcacagtgcgcgagacaaaattatttatacgcccaccattcgctggacactttcactttcattttcgtcaacaggcaaaagcagttccaacatggcgcctccttcgacttcttcccattgttctctgtcccgttattttccccaaattttggtcgcttgaaaaattcattgggtaaaatggtgatcaaaattggcaacattggactgatcactggtttgattaggcaaaaaaactcaatcatattgggatgataataactgatcaattcttcatcggcaaaataattattaatttcctgctagagatataactgtttccctgtaacctgaaggtgttcggtgccgatcactgtgataacagttcgacagaccagtgatcagcagacaaaatttcattctcagaataatgggaaataacctgattagcatgttcgggttaataaatgagagattaatgcctgatcacttgacaaaaaaaaagaaagaaaaatagtaaaaaaaaattcctttgacaaaaagtgatcaaagcgtaaataacggggcacaatagcgatcaggtaaacttcagtttttgattaataggaaataactcagcagtgattgggaaggtcagttttctgatcatatcattaacctttttattctcctgatcagcagttggtgtcaaatgccattaatcactaggccaaaaaattttcaatttttggaaaaagtatatgcgctgactatttaatagaggaaaatattttcccatttattattgccaattaatatattttaaataaagcattaatatagaggtagataaacgagcataattagtaccataaatgatcatcgatcgacgctcgtcaaatggcaccgatgttgacgacacttcggcacgtgtggccgcttatttggcactttgcatctccacggcgatggtctgcatcactggcatgatgttgacctttttgcacaacgacacggcactgttgttggacgaaatatcaactggcatggacgaatttaatgtaaatttggtggggagtggagaaaattgaaattattttttaaattgattgaattaaatttgaagaaaaatagtttagttaataaaaatacaaaatataaaactaaaaatttgtgaagaagtaaattagattaaaaataggataaatattaaacttgggagttta

SEQ ID NO: 13719 - DNA, 809 bp, Heterodera glycines
catcaatttaaatatttattaatgtaattaaatattatccaaatcattttttagttcttttatttttaagttttttttatttaaaaatatgctttgtataattttaatcattttaataaattaacattttttttcagaatgtgccactgaacatgcgcagaattgtgcgctcagacccacagggacctacaggaaaagagggaatgccaggctgtaagcaaaattattattattttttaaatccagaaatattcaaaaaataaataaatcaaaattatgttcaaaatgccaaaattttaaatcaaaaactcggatgcaataaataaaataatatggcactctttggaatttaatttatacgccatttgccatatatttggggtaatttcagcagaatttccttcaaaatattcgtttgaggcgtcaaaaactcaaaatttttctatagaaactatttagcatttattatttattttgccaaaaaatctttcagtgaacggcgagccgggccttcccgggccacccggcatttccggcgttcaatttggcgagcagatgttcagtcggccatgcattcaatgccggcaaggaccgcccggcaaaatgggccgccgtggcgacgtcggacagagcggaccgcttggcccacccggcgtaccaggcgcgccaggacgcatgggcaacccgggcaaggagggcaaagtgggcgagcaaggtaattttgcaattattatcatcaaataaattgatattgataggtgtgcaaaaagtcggaaattatagtcattaatgatataattaatagtcaa

SEQ ID NO: 13720 - DNA, 3993 bp, Heterodera glycines
  misc_feature (3926)..(3926): n is a, c, g, or t
atggaaattggccaaattcccatagaaaatttaaaatgtacaattaaaatctttcttttgttttaacaatttacaatttttttagttaatggtccaaattgtgatgattttcaaacaaaattgaattttatcgaagatttgagattttattggagcaaaattttggcaaatttttgggatagcgaaaaaataattcgtataaaatttgaacaaatggccaaagaaatgaggggaaacaaattaaaggcacagcaaatgattttggaaagccaaagaaaagagtttgaaattgaaaggcccgaaaatgaaatggtaaaaaaatttttaaattatgtaaaattaaataaaattaaaacaaaaaggaccgtttgttgctgtgggagaacggtcccacggacacttcgcttttgcgcgtcttcgcaatttgcgccagcgaagcgcttgaaaagtatcgaaacgaaagcattaacggaatacggtatatgacgcactcaaaatttattatttgcattggccaaaatttaaaaaatacaacgggaaaagacgaaaaacttatgaatttacacttggaaaaaattgaagaaatattgaacgatgacaacacaaaattaaacgaggattttttgttgcttttgcaatgctacagtaaattaaaaagaaaaaataataataattaatttcatatttaggaaatctgtggaaggaattttttaactctgaaggaattaaaaaacttgaaaatttgatttctaaggtaaactatagaaaaaattactcaaagttcttaaaatgtcattcattggagagtcattttttgcaagaaaatgggtttcaaatagagttgagcgggagaccgggaccggggcgggaaatcccgggtttttcaggtcccggtcccgatcccggtcccggtttttggaaaaacagaaatcccggtcccggttttgccagtcccggtcccggcgggactaaataagcactggtaagaatgggggtctgggtgagaaaagagaagggaattggtgagggatcagaaatttttgataaaaaattaaattatttattttcatttatagcatagttcatatgcataagtggttaagtggctaaacatttttactttcattatttgtctcttcggttcaattccctgatggaacagaaaaaatttttatattttctttaccattattttaattgaatttaattaataaaaaatatcttaatttaaaattattatttttttcatttttagtagcctaaaaacccataaattaaccaaattgtaaatttattttaaaaaatacagaattttgggactcagaaaattccaagaacccccctgaaaacaaaatttttataattttcctcgaactcgtcccccaaaacgtacaaaattttatgggtacatttttgaatattggcaattttcataacaaagtgcagttaaattttcaatttttttcaaaaaaaattttcacttgggaaaagtcccggttggtcccgggttttttcgcggtcccggtcccggtcgaaaaacttggtcccggtcccggtttttgtcaaatttcccggtcccgctcaactctactttaatggctaaccgaattttttattattactttttataaaaacaagcttcatttttaagatactgttacttattgaataaattctacatatttataaggataattttttcatgctttaaattgaatattgaattcatttttgtgcaccgttcgatgtttgtttttggctttctttttggtttcctcttcggtgttctgcttttgctttttattgtcgtcttttttgtcttcaacctttttcaaaatagaccatcatcttctaataatcatcatggctttcaagcgatgtctcctcaaaaaactcgaattcccaatgttagcctcattgacaagcttcaaaaataattatatgatttttaaggagctcaaagcttttttgcattcttgctccgttggtgttggctccgaatgggaaagttgttcctcgttgagtctactcttgcactttcttttccaagagcacaaagatacacgccaattccgcaggtcctatcgaaacagtgcgtttcaattgcggactccaaatttttctctagatggttttacaagaaattacagctagaactgaatgatgtcactgcgcgaagttcgaccgccggtcgaattatccatggcattcagatccgcgacctcgaagcgggcatgaactcgccggtggtaaataatgtgcgagtggaaagtttccaactatctgaggacgatcccgacctcttcgaagaattggtccttcttttggacgtcgattaccgtggcggttttcaaatgtctgttgatgcgaatatggcctttggaaaatttgcacaactctctgttaaggtctttcaagtagtcttctttgtttacgacataaattttattaaagttactccaactgaatggccgcgctcgtttttcaatccgacgccaaccattcgcccattggagtttctcttttgttgaagcccctcagatggatttgaaagtcgattctcagttccaaggacggagtctccgccatttaattccgttgattaattcggcctttcggaaggctatacagctcaaacatgtgtggccaaactacaaattgcgtttcagaccattcttccaaaatcctctctacagtccctcgcccaatacaggtccattttggaccatagatcgaatatccctgtaattctaatttagctgccttcgagcatgttgatctctctggtgccggcttagaggtgactgtcctgtccgcatctcgcctaaacttgtccggctttgagcattctgcaatgcgtctgttctgcatggtttccattggtaagttttgaaagcgataacaaaatccattaccaaatataaattgaatagagaagcgacccatcaatccgtaccaaactagcgaccaaaacacttccgaaaagttgagaagagccgctcatttgctcagtgtccttctgcaatttacaagaaaaggggcgggcggtcctttgggactggcattcaacgccaacggcaaggttatttttgacgaagggaaaatgttttgggtcaaatgtttcctccggaattttttgtactggaatgaattttaaaaatggaattttcgactttttgttcaaattcgggtctggggattcggaaggggcttaaattaatggtggtatatttacgatcattaacaccaaaaagcctcaaattattgtttctttcatgccttgaaaataaaaaattttgctaaaaacgcgcaagtatctgaagtaggtatcaccaaattgaattatcccaggaaacaaaaaaagtagtaaaaatttagtctactcacttttgcttcgtgctttttgtccttttgtacacattaaaactgaaggaaccgaacagtcacgagcttcgggtggccaatgttgagccggggtcgaatgctgataagagcggctttcgggtcggcgacactttggtagcggtgaataatattccggtgagaaatgagcgacaggcgacgcgacttctgacggggacagcgggggatttgctcgttttagtggagagagagcttaacgaaagtgtaaaaggcagcgaagaatcggcgggtgaagagacggaaggtatttaagagggagcaaaacggaaaagcctcgaattgcaatgctatcatcatcatcataaccccattgtttagatctgaattctgcgacaatttcgcgcgaaattcctatgaaagacgtggacttcatttcccccaatcggcgaaacttctctcctctcggcagtcgcccaattgaatattccgccaaggacgaaatttgaggggggacgagccaaagcgaaagtgcagaaaaaaacggaacaaaaacaatgaaattnggggaatttaacctctttaccaacagtgttggcgggaggatcagatacgaaaggaaccttttgaaac

SEQ ID NO: 13721 - DNA, 2958 bp, Heterodera glycines
tgggccgagttccgaatgatgagacacaaatagcagaagaattaattgcgttggataaagcctggatttttagggtttcctattttttacggattgtactttggatgaaagaagcacgaaaatcaattttatccaaaaaatttttgaattttgttcgtcttaaattgttgccaatgggaggcgaaaacccattgacaaaaacggaaggcgcggaaacattttggcataaaatgacgacggattggaagaaaaagggaaccgcaacagaggagaatattttgcaaaatgatgactagggaacggatttttaagcgcgaaaaagtccaaactaaggccttaaataagggcgaaaaaaccaaaatttggccaagaaagaaaataaattacaaaaattttggtcaatgaaaaaataaatttatgtggaaaattttttgaaaatttgcaaaaatgtgatctcgtcaagaaaaattttcgaataaatgcgtcaaaacgaagaatttccgagcgaaaaatgtgtttttcgtgcatttctcgtcgagttaaagccgcagaaaaataagcaaaaacttaaaaatccgatccctaatgatgacatttgccgggcgttttaccttatccccaaatcaatcaattcgatggataatttttatccaactttcatttgtaaaaggttagaaattttctttgtcaaccaaatccaacatttgttggtagcaaaaatggagaaacaagggaagaggagggaaatagcattggggaaggaggagagacggaagagaaagagaggaaaaggaaaaattcgacggaaggaagaggaggatgagagaagaatgaagcagaaaagagaggaacagcagcaaattgacacttttgaaaattttgaggtaggcccaaaaccgaaaagtaccgatattgttagatttggcttacgaagaaaaaagtgaatagttcaaagctccaaaacatgccaactgctgacggattccgatgcattcataagcagcgaaaacaaaacaaaataaacatttagatttttcattttcaaaccaacaaaaaacaaatcgaatcaaaacgaaatcgtgacaaaaaaaggccatttattcaattccaagtctccatccatcgtccgggttggtcgtgttcaaagagaatccggcacttccactccgtgttgatcagtagggtcgggatttctagtgaaaaactttttttttgctcgattgatttgaagaaaggagctcaaaaaacgcatttctgcattaaaatttttccctttggacgtcatttttcgtcactagaaatcactattttggcgtttcgtcacttaaaatagtgaaaattcacttttttggcattttgtcactattttttcactttttcgacatttttaggaaaatttgttaacaaaaatgccataaaatcaaaaaatacaccccctaagaatcgaccaaaaaattttttttaaatagaccactaagaattggaaaattttttcaaaaattcttctcccaaattttttttcttgacaaaatttttgatttaaaaaatgtcaatatttgctaagagaattttataaaggaaatgtagctcatttgcaactgcaatcagtgaataaaaattattttttgctcaatttttggctgaaaattatgtcactattcgtcattattttagttaactatttcgggatttttcgtcactaaaagtcgcgtcactattcatcagatctaagcgacagtgacgactcagcgtttattggggcaagtccgacggtgccgataggcgccgccgggaaatttttttgaaattttggctatatttaacggattatcaataaaaaattattatttttatcaaaaaaaactcaattcttaccagtgtattttactcccgttttttgggtaaaatttccgggagcgggagttcaaaattttccgggatgggagtcccgaacggggaatcccgtaaaaagcccgttgggcaaaaaagttcgggagcgggactcccgtaaactcccgcgggagtcccgatcccgccggtctctaccaaaaacactccccacttttgacacagaatcgctgaacaaatttttggaccatctctttttttctcaaccaaattaaacatattttgtgaaatactctattaacctgcataatgaatgacatttcgactactaagccaaaatcggacgtattaatttgctggcttattgtgacaagtacatacggccatttttacacatccaatttatttacatatatttgagaggattttcttcataaaatgaatttgatcactatgatgaattatgatcggtcggtcattcttaatattaattcatttcttctgcggctgatcactgtttttgttgttttgtccatcactcattttgtcagcagaagacggcccttttgtgatgctttgtccggattcttctgcgaatggtggaggagacaatggcctaaattaggcggaattttaattatttaaacaaaattaaatgcctttttttaattgctcacccaatgcaattattgcaaatgtaaagccaaatgaacacattgttacaattgttgccccaattttcatctttcttttgctgctgaaccgccgcggtctccccaataattttgcatcgtttcattatccatcggttgcccaattcctttgctttggccaatgtcagcttttcctttgtccattcgttaagaaattcaaatggcaccatttgtattgacggcgcaggaacagaaaaatgaatttggtaactgacggaagaaatggcattggcacggagaaaatgctaaacaatttgattggaaaaacaaaaatcacaaaaatgttggggcacacctcccttgaattggtgatccaatcagaggtctcttggtcgttgaaatatttgcaatgcaatcgctttggttggccatcttttctccgggtgggcaaccattt

SEQ ID NO: 13722 - DNA, 1064 bp, Heterodera glycines
ccccaataattttgcatcgtttcattatccatcggttgcccaattcctttgctttggccaatgtcagcttttcctttgtccattcgttaagaaattcaaatggcaccatttgtattgacggcgcatgaataggaaaatgaatttcgtaagtgacggaagaaatggcattggcacggagaaaatgctaaacaatttgattggaaaaacaaaaatcacaaaaatgttgggccacacctccttgaaattgttgatccaatcgaagttcgtttgttctttaatgtctttgcaatgcaatcgcttgggttggccatcttttctcggtgtgtgcaaccatttggacaatgcttggccagcagaaattgtttcatttggcacattaaaacaatcaccaatcgcagcgggcaacaaagcaccggaatggattgaagtcaactgatcaagatcggtgagaattgtcggcgaagtgcgacgaagcaaattgtccaaatgatcaccaccggtaaagcgcaaacagcgaatgtttgtcgaaaaaattggccaaatttcacgaccaaaaatgtcccaaatccggtggccatccgtggtgtttgaataaggaatacacaaatgtaaatcgatgcctcttttgtcaaaaatttggtgatttgaacgaagaaaagcgatgacggagtgatcgatgtacctgaaaatgggatgaatgcttttattgtcataaagctttgatttttaattactcaatccgaaggcgcttaaaacggattttgctgggcaacagacggtcgggcaatggaaatggcacaaatttgtaatcgaaccatacaaacagcttcgtttctggtcctttgtccttgcgacgaatttcgattggtctccaaattgtcaattcgcttttgccatcgaaatgtttgtccaccaacgcatcgaaacgtggcgaaagaagtgccaatttgaggccgagttgaggacggtcaaaacaaggcaaaatgtccatccaaacgtcgttgcaaatccaactgaaattataaaaacagtttattgttagtgaaataaatgaagaatttgtg

SEQ ID NO: 13723 - DNA, 1525 bp, Heterodera glycines
aatcaatgaaatcattcatagattgttacttcatcattttcccaatgttttttgtcctccaaaatgtccatcaaaaaccattttttcgccaccgtcgacaaaacattggcacccaatttttggaattcgttaattatttccgtttcgtccatttcaacagacaaaaggcccaactgctgcaaatattccattttcatttcaatatcgaagttcatcaagtgttccttcaaattttcgttgccattcgctggtattttaatgccaaaaagccaaactttgccaaaattaatgctaaaatttgaacaaattaattttttaaaattttaaattgaaaaaaatgaaggataataaattttttcgggcgagcgacatttttttgttttgtatttgcattaatcacttcaaaggtcaaaatttctcgggataaggtaattatagggtttatttaatttattgatgacccgctcccctccctcaacgttatttcatgtcaattcaaccccgattaattaattaattaattactcccgcccaatttgtcacctgaatccccggttaaccaattcgtccacaattttgagtgttacttctctgttcgcctccgtgtccattacaccaatttcaattttttttatattttttatttcaattttgtccattaattttgttctaatttttcctttaaggaatttgcataaattgtcataaacatttttctgctccgccacgcaatttatcacaataaaattactatactaaaaatgaagaaaattttaaatcaaaatcaaattatttctttgaattcacgacaaacaaacatcgtccaaattttaaattcagactctggtccaaaatcccgaggagggggagaaggcggtgccgacaggcgcctcgggataatttaggtgagatttactaacagtttttgtacaaaaaataaccaaatttgctcgcgatttttgagtcaattttttcgaatcagggagctttttaggtctgctggcggtgccgataagcgccgccgggaaaattcaaaaaaattgcctgcttcttaaattttgatcgctaaatgcagtgcaaatctaaaatgagtacactcgagggcactgattaatttaaaacaatttaaaagaaaagaagatttaccctttccacaaatgccattaggttttcgtgctccaacaaaacataatttaaattgctgttgcctttttcgtgcgcatcttcttccattttttgttcattttttgactcctctttaccacttctcttatcacttatcaaattgctgtcttccttttcttcctctgtctgctcctttttgtcttctttttcctcttccttttcctcctccttctcctttttgtcttccttttcctcctccttcttctccttttcctcttccttttcttcccctgtctgttcttttttatactccttttccttttcttttgtctccttttcctcttccttttcttcctctatctgctcctttttgtcctcctcttttttcttccttttttgc

SEQ ID NO: 13724 - DNA, 1404 bp, Heterodera glycines
tttttcgaatcagggagctttttaggtctgctggcgctgtcgataagcgccgccgggaaaattcaaaaaaattgcctgcttcttaaattttgatcgctaaatgcagtgcaaatctaaaatgagtacactcgagggcactgattaatttaaaacaatttaaaagaagatttaccctttccacaaatgccattaggttttcgtgctccaacaaaacataatttaaattgctgttgcctttttcgtgcgcatcttcttccattttttgttcattttttgactcctctttaccacttctcttatcacttatcaaattgctgtcttccttttcttcctctgtctgctcctttttgtcttctttttcctcttccttttcctcctccttcttctccttttcctcttccttttcttcccctgtctgttcttttttatactccttttccttttcttttggtctccttttcctcttccttttcttcctctgtctgctcctttttgtcctcctcttttttcttccttttttgcatttttctttttttgttcttttttccgtttgtttcatttcgtcccatactcttctcttttccttcagttttattcatcacaaattcattttcattaaatgttattccattcatttcaaataatttttttatgttttccattttcaaaaattgcagtaaatcttttcgataatattttttctcatcttaaataaaaaatatatttaaattacctaattaaatatttaatatattttttaatttcattggcttacaatttttttcatcacaaatttcattgcccgcttttgacgaaatttgcagaaaaatacttccaatttggagcaaatttggacaacctagaaattcctttttaaaattatttctcatttaaattatttaatatttttacccaaaaatatttctctcatttctctgccgatctcttcgtcgtacaaatgctttttcaccgtctcaaaatgcatttgctgcaccaattccaacggttgcgcaattgtttcgccctcctcctccacccaatccaattccgaaattgtctgcacaaaattctggcattgattccattttttcacggcattttttgaccgttttttgatttcattttgaatgaatttgtgaagctctaaaatttaactccgaatttcccaaatgtgctactttttaggtcaaagtcacattctggcatttttaaagagaacattttgggttttgcccaaaatttcttaaaaaaataaaacgaaaaatgtaccccttaaaatgtcaccccactcatcatggcaatgctttaatcctttaaaccatcgtggcactttttctcgacgaaagcgcaaaaaatgcggcacttacccgaaaaatatttgctttgataaaggctcaaccgatt

SEQ ID NO: 13725 - DNA, 837 bp, Heterodera glycines
ccatttgactttcggccgatttttggccatttcactcaaaaattggacgtactgtccaagtggacaaagcatccgacccacgggccattctttggaggggcaaaaagtttcggaaagtgccatcatcgtaaaagtatgcgctttggcatttcgagtttcttccacaatctttgggttttttaacagattctcctccttttcttttgcaattccaattaattgtttcattgccaatttcgtctccgcttcgcgcgacgttttttcatcagaatcaaaaatcaaattgtacagctcaatttgttcgtccgcattgagtgtcacttaattgggggggggggggtatttaaaaagggtaaatgattttaaaataaatttaaaaaataaattaccaaaattacgcaattttggcaaggaccaagcatttgtggcgaagaatttggttaattcgggaaacttctcagacaaacttattatcagcgaaaagtgaaactcgcaacttgactctgtaaaatcttgcatcattttttgatggaccaattcattttcacaattcttttcggaccatttcaaatccttttctgctaatggttttaattgcgcaatttgctcctaaaaataagaaaagataattaataaatcaaattaaatggctatgataaaatcaaaaaataggaggaacaaaaaatttaaaagactaaatccaaaaatttagattaaatattgcatatttctttccactaaaacaggactaattcttcaaaaaattgcaataatttctaaattatggcttatagtatctgttaaaaatgccaaattttatagaattaactaagaaat

SEQ ID NO: 13726 - DNA, 1279 bp, Heterodera glycines
aaatttgtaccacattttactgtggaatgtcccagtaccttaattggacaattacttgtcaaccaacacagtcgcctctggcctcttatggaacagaaaagggtgaatatcagatggggtgcgtcccttcctaaaaatttctcttttcgtctaaccatccctccctttttgtgcactatttcattttcaaaattgggaacatttttttgtttgtttctttgaaactaaaatgtaaaaaatttaatacattatttttgattttaaataatgcttctgtttcgaatcttttggctttaagtaattaaattgtaaaaattcaaatctaaaaattctcctctgaagttttgaacttggcttcaccctgcttttaagtcccaccgtgaggcgggacagttccaaaatttgtaccacattttctgtggaaagtccaagtaccttaaggactacagaagagtcaatgacgcagtcacctttggacagttattaaaaagaaataaggaaatattcgatggggtgcgatcctttcaaaaaattactctcgtcttctaccccccccccccccctctctttttgtgcactgtttcgttttaaaaattggttccgaaattttttgactctaagaaattaaactataacaaataattctctgaagtttttcacttggcttttaccatgtttttaagtcccaccgtgaggcgggacagttccaaaatttgtaccacattttctgtggaatgtccaagtaccttaattggactactacttgtcaatgacacagtcacctttggcctcttatggaaaagaaaagaggaaatatcagatggggtgcgatccttcctaaaaattactcttttcttctacccccccccccctctttttgtgcactgtttcattttaaaaattgggaacatttttttgtttgactctttgaaactaaaatataaaaaatttaatacattatttttgattttaaataatgcttctgtttcgaatcttttggctttaagtaattaaattgtaaaaattcaaatctaaaaattctcctctgaagttttgaacttggcttcaccctgcttttaagtcccaccgtgaggcgggacagttccaaaatttgtaccacatattctgtggaaagtccaagtaccttaaggactacagaagagtcaatgacgcagtcacctttggacagctattaaaaagaaataaggaaatatacgatgaggtgcgatcctttcaaaaaatactctcgtcttctacccccccccccccctctcttttt

SEQ ID NO: 13727 - DNA, 1143 bp, Heterodera glycines
  misc_feature (91)..(91): n is a, c, g, or t
  misc_feature (97)..(97): n is a, c, g, or t
gcagtcacctttgggacagtattaaaaagaaaatagggaaatattcgatggggtgcgatcttttaaaaaattactctcgtcttctaccccncgcccncctctctttttgtgcactgtttcgttttaaaaattggttccgaaattttttgactctaagaaattaaactataacaaataattctctgaagtttttcacttggcttttaccatgtttttaagtccaaccgtgaggcgggacagttccaaaatttgtaccacattttactgtggaatgtcaaagtaccttaattggacaattacttgtcaaccaacacagtcgtctctggcctcttatggaacagaaaagggtgaatatcagatggggtgcgtcccttcctaaaaatttctcttttcgtctaaccatccctccctttttgtgcactatttcattttcaaaattgggaacatttttttgtttgtttctttgaaactaaaatgtaaaaaatttaatacattatttttgattttaaataatgcttctgtttcgaatcttttggctttaagtaattaaattgtaaaaattcaaatctaaaaattctcctctgaagttttgaacttggcttcaccctgcttttaagtcccaccgtgaggcgggacagttccaaaatttgtaccacattttctgtggaaagtccaagtaccttaaggactacagaagagccaatgacgcagtcacctttggacagttattaaaaagaaataaggaaatattcgatggggtgcgatcctttcaaaaaattactctcgtcttctacccccccccccccctctctttttgtgcactgtttcgttttaaaaattggttccgaaattttttgactctaagaaattaaactataacaaataattctctgaagtttttcacctggctttaccatgtttttaagtcccacagtgaggcgggacagttccaaaatttgtaccacattttactgtggaatgtcccagtaccttaattggacaattacttgtcaaccaacacagtcgcctctggcctcttatggaacagaaaagggtgaatatcagatggggtgcgtcccttcctaaaaatttctcttttcgtctaaccatccctccctttttgtgcactatttcatttcaaaa

SEQ ID NO: 13728 - DNA, 2140 bp, Heterodera glycines
  misc_feature (189)..(189): n is a, c, g, or t
  misc_feature (2066)..(2066): n is a, c, g, or t
  misc_feature (2080)..(2081): n is a, c, g, or t
  misc_feature (2095)..(2095): n is a, c, g, or t
  misc_feature (2099)..(2099): n is a, c, g, or t
tgtcatcggattacttgaaaaactcgacaccaaattcttggtcgtccatcctgggtttcttttttggaatgcgaaagtttccattgaaaagccctgaagaactaattttcatagcattgaaaatatgcagtttcgttgatcaaataatagcatttagaagaaattggtgcattgaagaacagaccgacngggtccgacatttgtctgtgttttctcggcaccgtccatctgatccgctggttgtgaggtgtgctctccagtggcttggactgtgccttcgtgttcattctgaactccgtccgattcgagtcttccatgtttgaccatgccaacctgttgttcggatgggtcgttgttgtcttcggaaatactgttgctgttatcgtcattctaaagtgaccgcttgaaaacgtactagtatctttttttggttttctttaccctattccgtttattggtgtgtggcctttgtttgaatacatctttttgaggcttgcaactgaacaccaatttgccatctgccgcagcttttcgaacttccactgtcctcgtttcaccgtcttgaaaggcttaagcagttttgagagattaattaaattgcaattgatctttttttacattcattcattgctagtacggaagcaaaactaaaattaaattaacattacacaccctgcgcaattatcacttcgcccttagcattttttgttgcttcaactttgacaccctttcgcttgttaatttgttcccgtatttgtttgagcttgtcgaaagcctggtccaattccttttcttctctggtaagaaaagtcgaaaaactcattgacataattaaatctaaaaaaattgagggtaacagtttagaaagatggtattgatgcttatttggtgtcaacgctctcaattagaaatattatggtgaaaacgaagacacaaccagattaaatgtaaaaggaccaatcatccgatcaaacaaaactttatcaatgctgcctttaaacaataacatatttgttttgggtattaaactgctaatttatacgatcacaaaatgcgccaaaccaactttaaattaataatgagatcaagttttgttttattacaataccgcttcagtaaattaaatagcattgagctgttttcatataccgttgtcagaataagcaaacaatttagcgccaataaagtgatacccaaattacgaatgagcggacagtaaaatgacaggcaaacacagaattaacaaaacaaaaaatccatcacacaaacggctcgttaggtcatcttagcccccaaccactttcggcattgctcataggtcaagtaggaaatggaaacggcgggcagcaccttcatgaaattgggcgccagtcctcggtataagccacggtacccttcgtgtttcactatgtacgcaacctaagaaagcgacattaaagaacactcgcagtttggtacctgtcctgttattgtcgaaggctgatttggatcactcgaaattactgaaaataatgtaatttgcaagattatacggcgaaaatttgtttgtgtttagtgagtaaagtaatttttggctctattacagttcgttcctactttttgttcaattaaaatttttcgtcagctgacctctggcttgtaattttgtccgtatgagtgcaattggatatgttatgacttgtccgactgagcttgagacaagaccacagccgagaattacgaccacacctgataaaaactcctcaaaatagattagttagttgccgaaacccaatttggcctcttattttaaatataaatccaacccgggtccgtcccaggcgaattcttccgtctaatccacaaattctttagcgtctcataaacagccaaatcgatgccggcgtatggaataatcccaatacaattggcggcatatccctataatattgttttatttgtcaaaaagaaattgagaaaaaactctgtaaagacaggtgaagccctcacggtggtacatttctctagcaaaatggcacagcccacgattgagttcgcctgttctaaaacaaaagtacaagaattanataattgcgactannaaagaacatatgtnttgngagaccttcgaagagccaatctcgtcttcagcacttctaac

SEQ ID NO: 13729 - DNA, 942 bp, Heterodera glycines
ctaacaataatcgactgcggatggcaaagtgtgtggagtcttatggttggcgttaacctacaaattacactaaaaaaacaaagcgagaaaagcaaaaatatttacctgaaggaaaacttttagccggtcgagcggtgccgtcactgatcggctgacacaaccagcagtggcacctgcgacaaaatgcctccaccaaccccagtgcttaattgcatcttcggaaccggaagttgctgacaatgagccagaagcttcttgaaaatgatcagaatgcgaacgtgaaatgaccgaattggatttgatgaccatttcttgcaggtgttctgtgtgttgatgagttttagctaaatgatgtgctgttgccatttaggtaatctataaatgcttttcaaaatgttacgacatggttaatttgaatgagacaacacttactagcgtggtaaccaccagatttgtccttatttctaagacttgtcctggtttgaaggggaaattcacaaatccttttttcaaagattcgtccttttttggcctttcatcattatttttatttaatatttgactttgatatgtacagtaaaattacaaaaaatatttattttagtaaattcctctcataaatttgcatgtttttcatgcgatatgttcttattatcacttgttttagaataccacttcaaaactctgacttttcataatggctgcacgttctaatactaataaagaaactctaaagaaccatcaaacgagtaaaacaattgcaaccaagaagctggtggttcaagactacaaaaatcgattgaaggacagtataaaatcgttaaatgataattttgaatgtatattgggcgcttcgaaggtcctgttattgctgattcgtggatttgtcggcatcgtaaagaatgggggtcacaaatataaaattactatttatttgagtca

SEQ ID NO: 13730 - DNA, 1414 bp, Heterodera glycines
cgaaaacccccggaaactgattttaagcctaaaataaaaagttaaattagggaccctcattctttacgattgccgctttgtcattgtgtatgtacatatgctaaaggtaaattgcgatgatgcgacacatcgatcaaacagtgccggaaaattaggagagcattatgcaatcagaaacgaagcaattgcgagggctgcgcttctcgtcaaggcaacaaatgagttaaaaatgctgacaaagtaagtttttatttattatgaatttcaattaattagtaatttagtgaaatccgagaatttctcactattcgcgacttcaattttataagcaactcaatttccaagtcagcattcgttcgcttagctatttacccgacgataaaagcaatcaaagaaattcagagcagaagaagatttcaaaaagcgattgaaacaatatgaaaatgattacagtgcacttcggatgagcataagcacaatggcatcagagattgatcgagaattggtggaaaattctttgtatagattctgagttatttttgttttaaattatgaacaaacatttccttacattcagacattggaaattaagtccgtcattttcctgtcggttttttattcgcgcacttttttaaaatatttcagtaggaatgagtgagtcaattaacgttagagacttatggagggaattcaatgagataaagtcagcgcttcagaaaaaaatgcttaaaaaaccgaatttccacgaagcaattgtgcagtgtcgtcgtattgctactttattggagtgagtgaaatgcattcttattaagtaggagtttgggtttttggaacatccattgctttagggacaatgaacaattcgatcagtcggcagtatgtcatcgagaaattgcagcattttgtgcaaagattggaaatcattttatggagcgacggcatttgctgaaggcggcaaaattatattattatgcgcagatgatgatccaacgaacgaattcggaatgtatcttgggaaaggactaattgttgcaatgggtggatagaaggattttctccgcttgattttttgctaatttctcgccattttaggctctgctgagtttggcaaactcatggagcagtgctatttggaagtgatccatggtttgctgaggtcggagtcttccttcaattatttctcaatcgttggcttggttcattttgaacttgcaattcaactgatttcgctaaaagaaccgttcaaagcattcatttatttgaggagaggtcagaagaaaaattgggcaaaaaaggggccaaataaatcgaattcatttcctttagcaaatcgatttgtgcagggaaatttgcctttacaaattcaaatcattgagaatttatgcaatttggtgctaacaatggaaaggaacat

SEQ ID NO: 13731 - DNA, 1017 bp, Heterodera glycines
gaccggggacctctagagtctcttcactctctctctctcactctctttccactctcactcttcactttcttccactctctctctctcgctcttcccactctctctcctcactctcttccactctcactcctcactttcttccactctctctctctcgctcttcccactctctctcctcactctctttccactctctctcctcactttctttccactctctcactctctttccactctctctcctcactctctctttcttctctctctctctctttccactctctctcactctctctcactttcttccactctctctctctcactctctttccactctcactcctcactttcttccactctctctctctcgctcttcccactctctctcctcactctcttccactctcactcctcactttcttccactcgctctctctcactctctttccactctctctctctctttccactctctctcctcactctctctttcttctctctctctctctttccactctctctcactctctctcactttcttccactctctctctctctctctctttccactctcactcctcactttcttccactcgctctctctcactcttcccactctctctcctcactctcttccactctctctcctcactctctctttcttctctctctctctctttccactctctctcacgctcgctcactttcttccactctctctctctcactgtctttccactctcactcctcactttcttccactcgctctctctcactctctttccacgctctctctctctttccacgctctctcctcactctctgtttcttctctatctctctctttccagtctctctcactctctctgcactttcttcgactctctctcgcgcagtctctttccactctgcactcctcactttcttgcactcgggtctctctcactctctttgcactctgtcaatctctgcccactctctgtcctcactctctttccactctctatgtctctttcc

SEQ ID NO: 13732 - DNA, 2072 bp, Heterodera glycines
  misc_feature (1994)..(1994): n is a, c, g, or t
ctctctcactctctttccactctttctcctcactctctttcccctctctctctctctcgctcttcacactctctctcctcactctcttccactctcactcctcactatcttccactcgctctctctcactctctttacactctctctctctctttccactctctctcctcactctctctttcttctctctctcgctcttcccactctctctcctcactctctttccactctctctcctcactttcttccactctctctctctctcactctctttccactctctctctctctttccactctctctcctcactctctctttcttctctctctcgctcttcccactctctctcctcactctcttccactctcactctctctcgcctttgttttgacccctctcccaccccctatttaagcttgccgtcagaaacattcttcgctatgttcctaatcgcttccatcactttcttggccctgaatttgccgatgaactcgtccattgcgggcacatttatgccttccgttttatgccctactttgtgctaaaggttagggcgtatgagcggagataattgggacacataattaatactagagactgaagtttttcgagtcgagacaaagcgaccgtttgtaaggtttaggcaccgccgttggacaaaattgagacgcggagcagacaagcagctgcaataattctgatgctgttgaacaacttggacccagaagttgcccaatttccgcaggtcactgcgattaaatggcaattagctaattaccatttgacgtatttccgccattcccataaatcgtcttcctttttttattgtcaattgaccatttttgttttgtttgaaggaattggtcacttacggcggcaatggccaagtcttttccaattggatccaattccgactgacccttcgtttgttggcccaaatgacagacgaacagactttggccatgtattcgggccacccgctcggtccttctcctcccgataattagctgaatgccgcccttcccttctttagggcttttcccctcccacaaagatgcgccgcgaatggtgatcaccaacggaatggttctcgacattcaccaatgactgcataatgaatcaaagcaattccttcccctcagatgatccctaattactccaccaagtcactctatgacaaattttttgctctcggagtcacaatttatggccaaatgaccgccgggagttattgttacattggaccgcaaggaatcgttcacggaacaacggcagacaaaatttgaacatccaaagcaatttgtttttcctggcacagattacactgatgagtgccattcggaagtatctcggaaaggggataagtccagcggggaaagtgttcgtcacttctggtctgggagggatgagcggagcacaggcgaaggccgcagtgatcgccggtgggtcgaagggattttattcggcaaatatttgccacttttaaaggctgtgtcggagtgattgctgaggtgaattgttaacggaaatacaaagtgatcagaaaagatactcttggcaaaggtcagcgaaagtgcgctgaagaagagacatggccaagggtggctggacacattcagcgccgacttggaagtgatcgtccgatgggtcagagaaagtcggagcaatcgaagggtaatcaaagacggacaaattcatttataaaacgaatgaaggcgataagcatcggatacttgggcaatgtcgtggaattgtggtaaacactgcacaataacccctgctaattgaaaggatcaaatgtttaaaatgccagggaaagactggcggaagagcccgagttgatcgtggaactgggctcagaccaaacctcgtgtcacaacgcttttaggagggggctattgcccggtaggactaagttttgacgaggcaaatcgaatgctaacggaggacaagccaaattttgatcggatggtgcggcagaggttgggattanagcgaacacccctacacatttgtccattctgaagcttattgcgacatattgccgctatcgaaaaactgttcgctcgcg

SEQ ID NO: 13733 - DNA, 1461 bp, Heterodera glycines
  misc_feature (1436)..(1436): n is a, c, g, or t
cagacagactgtgagtagaattacagactttcaatggtcttttggcaaaatgcctttgtcagtgagtgaatggaggcgggagcagtacgaagacaatttgttgtggatcaaaaatgcggagaagcaccaattggtggtgggatcggaggcacgcattttatattcggacggaatgggaagggtcgaattggcacgggcattcaatgcggcaattagggaacgaaagttggaggtcgaaagggatggttggattgtgtattatgttaaaacacgtgaattgttgtgcgggacagggaccaattgtgatcagtcgagaccatcatgacgtcagcggcaccgattcgcccttccgcgaaacgtcggacatcggcgacggatcggcgtacacagccgacatggccattcaggtgccaatggccgagaattaggcgacattgccttaccttcagaatgtaatcggcgattcctttcggggggcgacttgggtgtccattcacaacggagggggcgtcgggtggggagacgccataaacggaggcttcggcatgttcctcgatgggtccgcagtgagttacgtaagacagagaacagtgaacaaaggaaatcccatgaaggaagcggaccaaagactgagttcgatgttggcatgggacgtggcgaatggcgtggcccggagatgttgggcagggaatgagaaggcaatggaaacggtgaagagaatggaagggatggacccggtactgaaagtggtggtcccggaaagggtggacgaagaacttttggacggactgaaattcagtgactgacagtgccggaagggacaattagtgagtggtcaattaattaatgacattttcggaattgctgtattcctctaatgatatgatgtataatccaagaattgtctgttattcacaacaaattcaatcgatttgtttcgtcgtttttcctttcattgcaaatgcctcgccatccctgcgactaattcctcaaagaattcatctttgattaacgaatagccatcaaacacttcaattatttgtttttcacttgccgactcgaaaaaaatgtcatctgaaaagggaaaagcagaattatttacttaaaaccgaaggattaaagtgaccaaccgtaaattgggataagccccgccagttccaaactcgccggaataaatgagtcacaatttgagtcgagcccaacttattttagattttattgatgcaaaaatcagataaatttaccgtaagtctttcgtctcggaaacaaataaacagtaggggtgaaatgattcattgctgctgttgtcatttccgattttaattttttggcgcgcgcaaaaaacaaattgtaagaaaaatcattgctggtcagaaaaaacgcggctttctcaattcgtctaaatgtgtatttatttgtcaattcttttaaacaanaggattgatggacaggcctggccaa

SEQ ID NO: 13734 - DNA, 1371 bp, Heterodera glycines
cctccgccttcacctgctcttggtactttggcggttccaaattcttccggatgttctccaactcttccaactctttgcggccccattccggcggcggtcgtccgctgccgtgcgcaatttttggctccggcttcggcggaggctgaaattgttttacaaaattcaatccggcgcaggctgtcctacgtgttcgaatttgttgcgtctctccccatagccgcgtctgtccgtctgccgatcaaatttggacgccacgcgcactttgggcggaagcgatgaattctcctccatttcgctcgggtccattccgctttccaaggccttctgacgcgcgaattgcttctgacgttcgcccaattctttcaactgaattaaaagagggggcccaaatctgttggcatttatttgtgtgccaatgccaacatcgtattgttggcgctcgttctgcttctccaagtcgtacttttcgccctccaatttgacaatgcgcgcgtgcaactgcttgatctttgccttgatgtcattgggcaacatgttcgacacgtccaccggtcggttcacaatggacatgtaattgcgctgaattggatgtcctcctcatggtaatcccatatatcccttgcttatccccacccctccctccccttacccaccttggcctcttgctgctgcgctttgtttgggcctccgcgcagctttggccccccgcccgactccgcgttctgtcccaatgcgtcgctgccctcctcccttttttgaacgacgaaattgcgtcccgacggcttttcttcgccgaaccctccgacaaacgcacccgccatcatattctgccgcttgcgcttctcctcttcgcgctttgccttattcgcttccgacttggcctttcgctcctcctgagttgttggcattttgcattaatttgtaattatccgccgtttaaattcaacatttcctaattgaattccgatccctttatcatttttccgctcccttccgtccgatcactactgatcggcttttgattccctcgacctcttcttggcgtcttcgttcttcatcttggcgtctccgtgctgccatctccgcctccatctgcttctgctcttctttgcgcttcacttgtcgctctctcagctccaccaactctctgtccatttggtctttctcctggcgccgcttttcctcaaagtccaacagtttggccgcctcctcctcctcgtgccgcttcttcgccgccagcattgccttctccgcttccgtttgctcttccggttccgcttccttttgctggggcggtgggacgtgtcgcaacctttgataaaagcgcatgattaaaaaaagatgatcattttggtcgatcgtcccctttca

SEQ ID NO: 13735 - DNA, 2860 bp, Heterodera glycines
cctttccgatcagtcactgatccctttctttccgcggttgaccctttcctttccgtttgtgctttttcttccacttttataggggccacttcttcctcttcttcctcgtcctcctccacctcttcgtcagtgtattcttcttcttcggacatttttaagtgtgctgacgatggactgaaaaaaaggaaaaatgtgcgatggttttaaaagtttaaaaataaagaaattgttttaattaactaaatcgaataaatggaaaataaagtggacgatgtgaaaagatgggagcgaatgattggaagagttttgacttaatggagggaatcggccgatggtaagcaaaagcaaagcaaagcaatgggagggggggggggaaggggcaggctgtgagtgtgtgcagtttcactttacacattccaaacgatggccaatcggccaatagccaattgaaacaatatgctgagccgaggatggccaagaagaataggcagcaaatggaccacgaaaagacgctcgccatatgataggaaggaaaagcaaggaaaagcggaggaaaagcagaggaaaagcaaaggaaaagcggaggaaaagcagaggaaaagtaaaggaaaatccgagcattaaatgaaggttgggcaaatggtagaccttgaaagggatcgaaccctcgtctccggtgcggcgatcggcttctcacccaaatcactgttcttaccgtctctttatgtctccgttttaaagcgatttaactgcccgctggctcaatccatacatttgtcaattaaaaatcattttgaattcgtattcgagatttgggagcaatcgaaattatgtaatattttgggttaataatcttaatacataaagaataatgtcttccaaaattagcatttaaatttttgttatttttaggtgtaccgtaaactttaaaagtacccaccttcaatcagctgatccatcccttcattcattaatcaaataataatttgaattaaacttggcattatgttttttcgggaaaattatttcgcttactcggaaacttttttcattttctgtccacacttaggtaactcttttcggaaggttctcctttcttgcatttcatattttcgagattttattcttgggcattattgttcagtcactcaaattaaataaatttaaaacaaatttttgtaaccgtttttagatttttattctcgccttttcattttcataatgtctggccaaataaagactccgactaatcagaaattgctcacaaatgttgcaattgtgcggatgaaaaagtgtggcaaacgctttgaaattgcatgttacaaaaacaaagttttgaattggcgcaacaaaacgttagtttttttatttgggcagaataaagcacatcattttgttcagtgagaaggacattgacgaagtgctgcagacgcaaacagtttttgtcaatgtttcaaagggacaattggcaaaaagggacgacctccaagcatcatttggcactgaagaccaattggaaatttgtaaattggtcagtccttaattgggaaaatgaaaattttaaacagtttttagatactcgaaaagggcgatttgcaaatttcagacaaagagagacaagtgacctcggagagctcttttaaggtaatgataatttcttctaatttccgctcactttcaatccaaataccagtccttttttccattttaggaggttgccaatctgatcacggatatgtgcgtcaattccgagacacagcgacccttttcacttgctgtaagatttgattgttttaattatgctaatcgaattgactaatttgctgtttcagacaattgagaaggcattgcatgatgcgcacttctcattgaaaagcaatcggtccacgaaacaacaggtgaccgttttatttaaaccttttttattgaaattttaaaggccctcgaaatgataccgaaattgcgcgagtcgttgaaaattgaccgtgcgaaaatgcgaattcgagtgtctgtgcctgccaaaaatgcgaaaatgttgcacccaaagctaaaggcattttttgacaccaccgaagtcgaagattgggacaaaggcgacctcgaaatggttattattttatgtgtggaataaacccagataatgtattgtgcttttaggtgggtctgattgagcccggcagttacaaaacaatcgttgaacttgtgaaaggtgacaaaaaggagaaagttgaacagattggactggaactgctgagtctgaaggttattggagagaatgaggtggaaataagctgaaaagtgaaaacattcgaatgatttcgttttttattgtgatttgacccattctcaacatttgacaatgaattttttgcatttgagtcaatttgctgccccgcaggtgcattattcacaacttaaaatgaattgaataaatatcagaaatttcgactttcatttgtcgtgccttcgccatttaattattcttattttgttggcgacatgaaaatccccttcagcagctgcacaaatggctaactctcacccccccccccaacaaacagctgtccccccctttccctttcctctctttttgccgctctgtccctttcaaaaatttgctcgtcggtcctcaacttttcccctccctccgtttgcctttgacaattttcattacttgtggtccgttggttgcccgggaacatgcaatggaaaagagagagaggagagaaagggcgaggcaatgcatggaaagaaaaaatttggaaggagtgaaattccctcactgtttccaacaacaaaagcatttaattgatatatttacaattgactttttaaatctatttttaaaagccatttgact

SEQ ID NO: 13736 - DNA, 1087 bp, Heterodera glycines
gatacctagcgaaagtgaacgagaaaacgaccccccgcccacaatggactcggatcatcactccaacaatgtttggtaaaaaagtgataattaagataaaaacaagtaaatgagaatctcttgactatataggaagtaaacataaaaagtttaattcagaaaaacgctttttcacagtaagcgactcatttaatgtatttctccatgaatttgcgatggaactccgatcgaattgcgtcatttatgaatgaaggcgttttcttcctttcgtcaattcctcgtgcacaattcttgaagacgacatcgtcatcccaacggcgtttgaccttaaactccgacgatgcggggttcagcagcggattcccatggagaatgttctcttctcgaatgcgttcctgggagttcaatttctttttgaggttatttgtgtctcacctgttcttcgcgttctttcgcctcttttgaggccctttccgcagctctttctttgcgaatgcgctcgagttccgccataagttcggcctcgttatcagagtcttcgtccaagtcggtgtcgtcctcgttgagctcatcaaatggttcatcagcgtcaagattacgtgcagatgaagtgtcctcaacgctaaaagaaattttggttaaaaatgaataaatctggaaacgataagcaccgccaaaggaaatcttgcaaattttaatgttatttgggtaatactggagaatctgggctccacccaaaaaaaaaattttcttgtgaaaaaatgaacccggggttttcggtgcttctgatcacgaatatgatatcaaaatttgcaaaataattgactttatcatttattttgaaaatcatagattttagaaattttgaccaacatggcagggtaataaatgttgattgtttatgttttcgattgttctatgatcatttcattggttaataaatagtgctgatcatatatggttacctcactcgaaaaaatgcagcatttgatcatgttggtcaaaatttaggaaaatctaatattttcaaaatcaggataaaaatctataatgatacaaatctgatatcatattcgtgatcagaagc

SEQ ID NO: 13737 - DNA, 2721 bp, Heterodera glycines
aagtgaattattttttaattacctattttgcaaataaatcaattttaaaaacttattttacaattaagtccaaacgaggagctattctcatcgggaagtggctaggaaattttatccgcagctgcctatccgctacccatagcattattaaatatcaagttcagtgttccatgcctatccgtcccaaacactgtttcacgaaattgaaagttagagaaaaatagcaaaaggaaacgggggataaaaaatgatgggattggggaataaaataaatctatggacgtaatgaattgagggaactgaacaactgacgaaaatgattcaacttaggttgatatctgtgtatgttttttcatgcaacaacagagataaacaaagtctaccaactttctttttccttatttgtatcatatatataattgaattagtttatttgtttgaaaaacttgcttagtttgttaattcagttcttctaccttcgaatttggagtgccaagctttgtttagttgaacatgtcatccgtttctgctggtggcgatggaaaaacacctgctggccatacaattccaccaccaaaaacatcgggagcagcgacgggcggtcagcagctgagcgcaagtgcgaatcaattcgtcgataaaatcgacccattctcaaaacgaggaaattcacgccgcagacgacgcttgatcggcagcagtcgttaccacgcggacaatgagccggacttgacacaattaccgctgatcaagggtactttccatgttgattaataaataggaaactcaattagaatgccattgcattgtttttgtttttcaaaatgtaagtttagatgccggtcaggctgaccagacttatctcgcaattcaaaaactccagcaatgtcagaaaatcttcgatttttatgatcccgtatcgcaactgaagagtaaagaggttgacatttcttcggagtgcaaaatttggtttattaattgtgtttaattaagataaagcgggcggcgcttaacgagctgattgactacatcacggcaaccaaaggagctgtgtgtgagccgctttacccagaaataatcaaaatggtgtcgaaaaacattttccgtgttcttcccccaagtgacaattcggaatttgacccagaggaggacgaacccacgcttgaagtgtcatggcctcacttacaggtactccaataaaaaatagaaatactctgtgcaacctatacaactaaattctttgcatagtattgccaaagttttgataactaaattcgattattttagctcgtttacgaattgtttttgcgttttctcgagtcaacagattttcaagcatctattggcaagaaatatattgaccagcgatttgttcttcaactgctcgaacttttcgattcggaagatccccgtgaaagggattttctaaagacaattttgcaccgtatttacggaaaatttttggggcttcgtgcgttcattcgaaagcagatcaactacatgtttttgtctttcgtatttgagactgagtcattcaacggagtgggagaacttctggaaatccttggaaggtgtttttatgtagccgaatataatggaaactaaaccaattaatttaagcatcatcaatggatttgcgcttcctttgaagcaagagcacaaagtttttctcgtaaaagtattgttgccactgcacaaaccccgttgtctgaacctctatcatgcgcaggtcagttccgcttgggttctcttaaaaaccaagttttatgcaaaaaataaagacgaacagtttattttatttttattttccgttgacctaaagtattactagtgtgaatgcagtaaagtaaacgcactctatgattgttttcggctctcttttagctcgcttattgtgtcgtgcaattcattgaaaaggattcgtctcttactcctcaagtgttcgattcgctgctcaaattttggccaaaaacatacagttcaaaagaggttagttgtatttgtattcccattgcaaaatttagttttgtttttgcttttaggttatgtttttgggcgaagttgaggagattttggatataattgagccggaacagttcaagaagatcatcgaccctctttttaagcagctcgccaattgcgtgtcgagtcctcattttcaagtatcaaattaaacattttcaaatcatttgctattgtttgaggttgccgaaagagcgctttacttttggaacaacgaatacattctgtcgctgattgaggactgcagtgcccaagtgatgcccattatgttccctgctctttatcgtatcagcaaagagcattggaacccaaccatcgtggctctcgtttacaatgtgctcaagacttttatggaaatgaatgggaagctgttcgacgaattgaccacgaattacaaattggagagacaaaagtaaagaaaaattaaatcaccttttacttgagtcaataaaaaacgcaatttttttataaaaaggaacccatttagggagaagaagcgggaaaaggaccgggaagaattgtggaagagaatggacaccttggacatctgcaatttgatttcacagattgaggagggcaaggcactgcccgaaccgaacattctcgcgaaaactccactgactcatttcattgaaaaggcgacttctgtgttggcgagtgccatcgtctcggcatccgaagggtaacgcaatcgtccaa

SEQ ID NO: 13738 - DNA, 2876 bp, Heterodera glycines
  misc_feature (2833)..(2833): n is a, c, g, or t
atataataatcgtatccttgtagaaaatagatatttgaagagaaaaagtaaatttaatttcgagtagtaaaaaatactaataaactataatttctgtgaataattcaaagagagaaatttcattatatcattagaaattaaaatgctccaaatttctatggtttatattttaaaaagcagaaaacaatagagaaaatatacgtaattagtattttgatagaaaaattaaaatttaagaaactacaataatcgtatccttgtacaaagaaaaaaatccaattcaatagaaaaaaaataaataaaagaaataaaaatagacaatattatcttttttgaaaatgaataacctaaaatggggtctacctcagttgggctctggatttttaacttattttgtctaaataaccaagattttcggctattttttttaagtaaagataggtttttgggggccggcggtgccgataggcgccgccggggaaaatttttaaagaattcttaataaattttgttaagaaaatggccaaatgatttttgataaaagtcggtcggttgtttcggttttttgattatttcggtcggtcggttttggttaaaaaccgaaaaaaaccgaaaccgaaaaactttgatttcttcctttcttttgacaattcgaatatttttcagtcgtatgacctaatttgatgatttttatttatatatattaaaatccttcataatatttttttctattttcttatttttaaatttgcgtgcccatgcgagtttttaatcttaacttaaacaattagagaattcattgtaatttttcgaatattaattgaaaaattttttgtaaaaaaataaaggattgaaatgtttatttttaatttgcgacttttatatattcattaaatattgaataaggccaaaattattttcgtttaaatattgaaactttatcgtagcttttgcggttcttattgagaccatttagctaaacagtttttattttgctgatggcattccgaattaatttctgtttcttattttggtgccggcacattcttgtcaattcttttcgataattacgattttcaattgataatttgttcgttaagtttatagtagggtaggccaggtaggggttatttgggcaaaaattgggtccgggtattgccgggttcagaaaaagccgggtaaaaaacacgaaaaatataaatgttacaaataaatgctttattatttgtcctattttttttttgctattcaaacaagttttttgcggtcgataaagaatttgtacaaaaaatattcaagttttaaaaaaatataaagttaattcttcaaaatagtgatattgtaaaaaaattaagaaattatttgtaaaattctcataaaacaagaatagttaaaatcagattttaacaatttttgcggcgaatttttccaacaaacttcttctgggaatgcgaggggaggtagttatattatgccattaaatttcaatattatgaatatgtttaagaaatcagaacaaacttgggtcactacctccaaatcaggacaaatctgataaatcaggacagacccgagccctggttttaaacaaaaatttaaaaaaaatgttaaacagaactggtgagagaaggaattggacctgagcaaaaaaggagacgaatccaagacaataaccactaggccaagtggcaaactgtaagaaaattataatagaaaatatgaattaatttttaaaaagtttgtcttccctccaattttgcggaaaaatttgaccaagacccctattcttaccagtgtatttttggacacggttggatccggcctaccgggtcgggtaccgggtatgttttttcgaaaaaccgggtccgggttgtgctttattttttgtttttagtttacttttcatttcaatatttatttattaaaaaaaaactttatgcaattaccatcaaaaatatatcttaattaaatattcaacaaaatacatatgtttctgtactaatttagatagaaaaatttcttttaatatcaattcgggaccgtctcaataaataaaaattttttatcgtctcattaaattcttttgagcaattttcaaataggggagaatatcatgatacatttcctcaattcagaattgtttttagttcccgtaattacgactttaccggtccagaaaattaacgctgccatgcttttaccccgcttgaaatttaaaccgcaaaatatttccggttcataaaatgcacgacgattttttcgaaactcgttcagttcaatttcacgtccgaatttaaaggtcgaaacaatattttcaaccgtgtgtccggtgtaagaagcccccggacaccccgagctcttaattatttctataaattttttaatagcattttcacagtctatcagacttttcgtccccagacatatcattttcccggattcccataataatgccgtggctttgatggggcttgtacatttgataaccgcggcattgaattttctagggttatacttaaattcgaattcggtgatcgtcagagagtttagtttaattccggtaccgagattagtgagagcaattatatttacgattatcggtttttgaatttttgatacaatgtaccaatcaaatggtcctttcactccctttatataccccttctataaatagcaaccaaaaataaaattaaattgaaaaaatgaactgtccacataaaattaagtgttgtcattactgcccctgtcattacgagatttgtaagaggtgtaaaaagcacagtcttttgcatttcggtacatcattttgtgataatttctggctatgccccanatgcgcgaaacatgttccctatgaaaatataaagcgtttaaac

SEQ ID NO: 13739 - DNA, 1550 bp, Heterodera glycines
  misc_feature (89)..(89): n is a, c, g, or t
  misc_feature (103)..(103): n is a, c, g, or t
attaaccaatttattttggtgaagatttgaattatggagtaatactataaaaaggaagttgtatattcataagttaatgaatgaacatntaaaacaaaatatntaaaaaatcacacataaattaaatttggtttgctatttttattttttatttctatttctaaattaatttttttatgctgccttttattgaatttttttaatttgaaattgtggcccaagaacaaaaaatgcccatatttttacaaacctcctatttgttgcttttttttctaaacgataaaacaataagaaaactgagataattaatgaattgtttgatatataaataacgcttaaactttagtaaaaatttgaaaaccgaccttagtccgttatatgactgaccaaaataaaaataaaaactaacaaattgtttagttgcgaacccttatttattttaatttatatagttataaatttaatgaatattttttaaagaaatggcatgtaaaatgaaaataattaagtgaaaaatttacaaaaagaatgaattttcaaaaaaataattgaaaactaatacattgtttgaataaagaattaaatataaataaagattaattgaataatgttgacgaagtttctagcgcaaattatttaaataaaaatgatagtttggatattaattaaaatatgtagaatagcaatttcagttacagcagctagcacaggaactaaagcaaagatagttttattttagaattgaaaaataataatgttcaaataaaactataattataagagttaataccgaaaaatcagagattataaataatttaaccccgaacataaacaaattgatcacaaatattacaaagtaattattaatttcctagggaatagttgaaaaattttccttaaatttatcaaaaatgtttatttataattttactactccaatgtaagccaattgataaattttttcgtttttttcttattttctcgacaatcaatatgtaaaacggaatatttaataacaacagaagtcttaaataatttaaattaaatatttttaaaatctaaagaaaaatccgttgttatgaagatgtcaaataaaataattatcaattgaagaagaacatttatgctcgaataacattttttgcatgaaaattaaaaaaatgtctcaaggcatatcgcaacggtttaaaaaatataacaacttgagaacatattgttactgatttttggtattgaagtaactataatattaaaaaaatttctaatctacagttattgaaattaatattaatactaaggaataatatttttaaacaataactttttcgagaatatgcaacgtctttgtaaggaataatatttttattcaataatatacaaataaatcaataaaatcaatttgctacaataataaaaaaatatatgatgcattatttgaattatgttaaaaagtgagtggagtttatatgttaatattgaaataaaaagcatacgtaattatcatctctaattataactggggtcattaaatgtggatgtctacatagccc

SEQ ID NO: 13740 - DNA, 4367 bp, Heterodera glycines
  misc_feature (11)..(11): n is a, c, g, or t
  misc_feature (114)..(114): n is a, c, g, or t
  misc_feature (4181)..(4182): n is a, c, g, or t
aattaatcatnaatttagaaattcatggcataaaatgcgccgtaaaaaatttgttaaaaatttgattttttagataaaaattgcactgaatttgctaattttctccccaaagtntaagctattttgagaaatgttcttattttagaccctaaaatctttttttttttggacttgatgttcttattttgaaaaattttcgatggaagccctatgttatcgcccttatttaaaatgcgacttggcaaataccatttaatctttttcagcatcgatgtgcccaacctttttaacgcgacggtcaattggccgttcaatcttcaatctgctcacgtcacggatgttgccaaaataaaaacggacgacaaatgacggagattgttgtgacttttttggttttgcattgttcacaattttaaattgaatacttacaacaattgcagaaaaataaacaaattaaaccagatacaatatttttccccagaactttcaaaacccgggtatccgggtctgggacccggtcgggtacccggaagattcaggaaaacctgtagaaactaaagtggtaaattaaattttccaatttttcacgatagaataaatttcatgtaagcacatatttttcctgtatttattccgtgaccggaaaatcgttagtggaaaatgcgtcagtgctacaaatattctatattaaagttctgtagcattaagtatggtagtataaaaataaaattcttgacaaatatcgttctgaatttcgaaccccgggcgcgaattcgaacaaaaagtcgaaagtcataattttcgaaattagagttttggacaaaattggtttaaacacacggaaacaaattgaaaaccatcaatccttcaataagagattatttatgcaatttttgaactagaaataccaatttcgaaaattcgtacatattcgcaatttttcgtacatcgattaattcataatttaataacaaaagaaaatgccgttgccgcaccaaattcagtgggcacttaaataaaagtaaacattgtttaaattttcttcattctgccaaactgtcgcctcttccccaattgggcatcgcttcagccaccaaatataaaaattgtttgtttttttactcatcaatgtcagcttttcccccgttcgttcgttcaccaattcgaatggttcaattggcattgacccaaacagtgcaaagctaattatgtaactggttgaagttgtggcatggagaaatgcctaaacaattaacgagtaaaaacaagtcttgaaagtatttttttccaaaataagggcaaacgaggttaaacggttaaaaaaaagattttgaccccaaaaataaagatttttgaacaaaaggctttacattgtagagacaattaaaaactaggctgtctaaaattttcaaaaccagcatttggccgacgaaaatcatctcaaaaatcaacactttggaaattttagtcaaaatgaaaacaaaaaattttttgcgacgcgttttttccaaaaaacaaaacaaactttttggaaacagagggccgtggaaaatttttctttgaaaatttgagttcattttatcaacagattttcaccaaaaaggctcaagttttgcgatttcgaaccaatttttaagaacataaggcttttgggggccggcagtgccgatagacgcctgcgggaaaatttgaaaattgagagtttttggtagcatttttttataaaaaggccattttaaaggattttttaaatcaaaaaccagcaaaaaaaaatataattaagcagaataaatttaaaaagtttaggggaagcctgaaaataagaaaaatcttaaaataaggacatttgcgagcccattagtaaattgcatgccgaaacagcgccaattagcagggacgactcaatgccatttcaaaaatcccggcattagcttgtttttcaaggcaaaaaaacacgcgtaagaatcattaaaatttaatattttcttttccacaaagttgttttatttgcaggattcattttctttttgaaaaaatagatagcaaaatgaacgaaaataaattgtccaaatttagagtttttggggctaacatgaaaaaatccccgaaatattgtaacctccttgaaatcgttgacccaatctttaggtgtattcataattctgcaacgcaatcgcctcggttggccatcttttctcggcgtgtgcaaccatttggacaacgcttggccagcagttgcatttggcccatcatcagcgatcaaatcgggcaacagattaccagaatgcattgaattcaggttgagatcggtgagaattgttgtggagatgagacgacgcaaattgtccaggttgtcagcattgagaaattgaaaacggcgaatatttggtacaaaaattggccaaatttgacgggcccaaatatcccaaatcggctgggaatcagttccggttttgtgtgaacaacgcacattcaaaaccaatttggtcccattgtcccaaattttttgattggaacggagaaaagtgataactgaatggtcgatacacctgaaatggaactgatttgttggcccaaattattttaggagttttcagggtcgggaaacccaataattacagccgtttcaacaaattcctaatccggacttgatttctataatatttttttgcggtttgtgtataaatctgaattttgttcaaaaatggggtttcgattttttgtttgagtcagtgttcggaattggtcgaaacggatgtagaatcgattttatattatgtatgtttttgtcgaaaattcttttggaaaaaggtacaaatcgtccgtccaggagagaacccgcgatttgaaaaaaattactcaatggaaagtaaataaaagcgaattttgttaggcagcggactgtcgggccaaggtaattccacgaattcggcattcctagtcaacatgcgaattttttgtccttccgcgccagtttccgcaaatttggcattgatggcaagcacacaaagcttgggttcttccgcaccaaactttttttgaattttgattgtttttcgaattatcaattttgttgtgctggcattgaaatgcgtgtccaccaacgcatcgaaacggggcgaaatcagtaccaatttgaggccaagttcaggacggtcaaaaagtgggaaaatgtccatccaaatgtcgttacacacccagctgaaattttcagtttacgcgcccaattcatcatgaccatcctaattttcggacgacacccaacttattaatattttaatgaaaaagtctactacttttgatcctcccccattaaattggcaatttttaattgcgtttcgtcagtgttaccaatgccgtcgacttccaaaaaatgttttcacaagtgaactcggcgattgctgctgattttcactaattgttgcagaagaattgacggcgccggaaaatgcttttctttttttgatgggcggcgacattaaattattttcgcttgtaatattgaagaaagaattgcagaatttcttataaaaattagaatataaacagcaacaaaacgtaaaataataaactcaatatatggaaatgctatagaaatttgttatagaaatggttaaataaaaccaaacttgcaaagctgtaaaatccaaacacagaagcatttttccatttcaaaataaaataaaatattcagccatttttttcaaaaatttagtaattaattataaaaaatttaaaaatttaattatttacttttaaagttgtttgtccctaaaggtggttattaaattaaccgattcttgttgctgctgcccctgccggtgaccttggcaatccgtctcagatgcggattgcgaactaacattgtcacctcctctaagagacaaatgaacatcagcaccaccactaacaacaacattgatattgctgttttgtctctaaaaaattattgaacaaaagtacttttatttgacacatacttttatttgacacaaactgattattattataattaccatatcatggggccccgctgcttcaaaaagtccaccaaactcttcatttccttctgcaattgtaccaaattaaacaaaattttttattattaccttgattttctcgccctgcctgcaaatcagaattgaaaaaaatatcttcggcaggttcatcttgtcaaaaannatcgtatgggttgtttgtgttgttcatttcttagtaaaaaaagaataaatttcttttacacaaaaaaacaatattttcaataagttgctgttcgacaaataaaataacatcacattattaaaatttaaaaatttttaatattaaaatgtaaatgaaaaaattaatattaatacaattatattcat

SEQ ID NO: 13741 - DNA, 1670 bp, Heterodera glycines
gaatttaattttgaaaaaaattattttttaaattccgtatagattaaaaggccactcatttttgactgttttttttaccatgctaattgtacatattgctagcattgttttgcttccttcctttaggcaatcaaacggatggtggacagtgactttgaagaggaggaggagtatccgatggataatcaccaccaccaccacaaacaacgggcgtgcatgcagaacaatcaccgtcaccagccaaacaacctaaaaaatggtgacatttccgctgctgtgccgtcctcattctcctcaacaacaacggcaccaccggttggagcaacgagtgcaaacgcctcctcttcttccgtttctcataaacgggcaccgcgtcggctgaacgcggacggcacgccggcggagcgattgaagccgggccgcaaatcggtggacgaattgcgggagaaatttgcgcaaaagttgaccgccgtttggcaggacgtgcacaatttgaaggttggaaatgcttttttagatccatggatgtataatcaaatcgaacatcatactcgcgcagtacttcaaattattgtaaaatttagacattttaaaaattcgccaagctattaaattattctaccaaagcgcaacttatttcttgtatttttcaaaaactaccatgtcattttttcgcacaatttcttaacaacaccaattattattttttatttcacttgatacttcttacaattagcattggcagaccaagaattagttagaatcgtctgaaaaacaggaaaatttgtcctaaatcaaaaaaggagacaattttaagtattcatttgttaccaaggtgttcttttcgtcaacagatattccaaaaatcactgtttttaaatgataataacaacaatttttaagatgggcgaccgtgcgttggccgagccgttcgagtacttgccatgtgacaagacattccccgactactaccgcaccatcaccaagcccatctcgttgatgtgcattcagcgcaaaatcaaggagcagcggtacgcggactcggacgaactgctcgcggacctgcgccagatgtttgccaacgcgcgcatcttcaacaaaccggacgcacaaatctgtgcggatgtgactattttggagtcggtggcggttggctcaatgcgcacccataccgagggggtcacactgttctacccgtacagacgcactgacaagggctggtcggagaaggcgtccattgagtgagaccattgctttcataaaaataatatttttccggttttcaatcttgtcacgccgttgtaaactagccatcctacatcttttgggcgggggtcgcaaattttaaaaatttttttttttcataaattcatttaaaaatccaaataaattttcggaggtgcctatttgcagcgccggctcccaaaaacttccaacttttcataaaaaaattggcacaaaatcgcaaaaattggtcattttggtgaaaatctgtacacaaccacacctaattgtccacctcttttttaaatttatgttatgcatgacagtttcaaatgcttagttcatcttttcaggagaagaccgttgaaaatgaagaggaagggtgccatactatccactgctccaccgacagccacttcatcttcgtcctcattgtccacaaatgc

SEQ ID NO: 13742 - DNA, 919 bp, Heterodera glycines
ctcattgtccacaaatgcggacggcacaaatttgtcgtcagtgccatcaaccaccgctgcaactgcacaacagctggcggcacatcatcaacggcaacaacaacaatctcttccgcaactgcaacaaccgactcacaatcagcaacaacaccacccctcagcaatatgtgcacaacaacagcgctcattggccgccgcttcgtcttccgccgtttatgttgcaccgccgctgccgccgtcctcggtgtgccagacactgaacaacaacaacaacaataatgccattgccagcacaagcggtgccgtttattatgccgctggtggtggctatttggtgccacagcagcagcaacaattcattttacatcaccacaacgtcatgcctatggcacaagcgcaaccgccgcaacaatttgccgctccccattcggttgtccatgttcagcaacagcagaaataccttcatcaacaacaacaacaaccgatggcattagcaacatctgtcaaacacttgcagcagcaacaacagtgccatcaatcgcaacagcagcagcagtatttctcgtcaacttcggcactgatcaacggcggtggcataccgccaaatgcggctttgcagcaagcgctgcacaatgggccaattgctgcaggtgatttttgcggacgagggagtaggggcctagtaaactttcgtacaattcgtatactgaaaattgggccaacatggaatgggacataaattggggagcagctcgtttctccccaccatttctccccgcatcgttctcgccccccgataattttttttaaattgctaacttagaaatttttcaagaaaaaatcttataaagttttttcataagaaaattctacgaaggaagaattttcgagaaatttttatggggaattactaagattt

SEQ ID NO: 13743 - DNA, 2547 bp, Heterodera glycines
tatttgccatttatttgcccattcgaataaattatgctttgatttatgcataatttccgtgtcggctcttgctttatatcaaatatataatttaacatcatcagcatataattttattttcactcctgatggcaaagcatcaggaagatcgttaatataaatcaaaaataataaagggcccaggacagagccctgggggacgccagaggtaacttttttacttgaggataaagaatccccaattttaactcgaaaagtcctattactcaaaaagccctttatccgcatcaaaagtttgccccttatacctattttttccaatttgtataaaagtaaattatggggcactgagtcaaatgctttttgaaaatcaatataaatacagtcaacattttttccatttataattgcctcgtaccaatcttccacaactgttattagttgacttgtcgtagacctatttctaacaaaaccaaattggtattccgaaattttattgttttttaagagaaagttgtaaatattttggctaagaattctttccataaccctgcaaagtgagcagtattttcttgggcctattcaattcaattaaaaaaaatgaattttttttacatttattttctaaaaatttaaattttctttctcaagaattggatttttatatttttttaaaatttatctctgggattttatttgacaattttccatgatgacaaaattaataattgatgatcaatatttatttgtcaatattacctgtcaggttgaagtgaacccgggccaaattggcggccccggcgcggcaactgccgtttcaaagtgccaccgtaaaatgctggacaaggtggagattatgcatgtcaagaaattgccaattttggcgaaggcatttgtgcctgaaaatcgcccagggccaggaattgcgcggaccctttaccaagcctggtaaacaaaattcaaaaatgcttttaaaatcgattaaagtcaattagcacattcattagtatggacatactcaacaattaatgccaatgaaaaaaaaagatttctttgatagggtagcgacaaaatttcaaggacagataaacgtgcaaatcaagatacttagaaatatatatattagttcgtcaatttttttgacaggaaaatgttcggcgacccaaacgcaatcattttgtacgtcaatcagcccgacctgttcccggtgtgccacttagagcagctccaatttgtgatgttccaagtggaaaagcttgccaagcaggacggtaaccatgtgctggtccgtcgggcgtcatttattgaactgcgcaaaagatgaacaaatttgggaatgtctaaaattggcatccatgtgccattcgagacaaggtgccatgcgtagtttaaagagtcaacaactttgaaagattgggatcaattattggaattaatctggacctgattttgaattgaacctattttttgtggttttgtgatcggatcaggatcatggaaaaatattttcaggatctttctaaactgtggcccaaacttatttaaaacgaaaaaaaccctgattcgctgattactgatctggggaccgaaaaatccatgtgaaatccgtatgcatgaagattgttttggcgatctccgatgcacacgatccattgttctgctgatccgatccttggatcaattttatttttttcgaaaataaaaaattttttttcgattctttcaaaacccaaaaatcctattaattctaagcctaatttttagacttagccttgacgaggccggcgactattcactgtattttgacggtaccaagcgtgttgcattagttcacatggcctacggttatttgcctgaacattaccctgagaaggactttgacctgcgcgtgatgatggagcgttcaacagctattgtacaaatttaaattcattgaaaatataaataaatttatatagttattagttcaaaattaattaacattaatccgaaaaaagagtttaaatccaagaaaattttttgagactaatagataaacgccaataaaaaaatgaacttttatagcacacaaattgcttttaaagatatatgcaaaaaatgggttttttggtagaaattaattaattttttttatatataaaattctaaataaaatataaaattatattaattcattcttttttattgcataaatatcattaagctgtcgcctaatcttcgtcttcaacttgccggaacaaaaaaaattcaacaggtgggcgttggaaaatgataccaaaatttaaattcaatttttttttaagattttgagcaaacccggcacattggaacacttcttccccaacgaccctcaacaagtggccaaaattcgaaacacattcaccgaactgtggggcctcgaggagaatgatgacatcaccaaggcggtgattgcggtaaaaaaaattagaaaaatttaaaaaaaattcgaaatgcttaaggatgccatgaaaaatggccatgactatgtgaagaaatcgcaaatggacggcggacatggcatttatt

SEQ ID NO: 13744 - DNA, 2356 bp, Heterodera glycines
  misc_feature (35)..(35): n is a, c, g, or t
aaaaaatattaaataatatttttcagaccaaaatntatcaaataatatatttttaaaccaaaaaaattattaaaccaaaaaattattaaaagatttatttttagacaaaaaaattattaaaagatttatttttagacaaaaaaattattaaaagatatattttaaatattgtaactaaacctggtaaaaacagtcattatattcgcccaatttaataataaaatatttttttccgaataaaaacacaatttaaattccaaaaaataaacaattcccgaaaaataaaatattaatttttatcatatgattttaattctcaaaaaatatatatttatttttgaattcttgacaataaatttaaaattatcatgtcttttaatttagaaaattttttacatatttttccaaatttttgctccttaagaacttcatggttcgcccgttcgagaagccgcaccaagaggaagtgaacagtgagatgggcatctatggctcactgatcggtgatcagagtacgggaaaagtgctggtcaactcggtgaacgggcatttggtgcgaagcaaagtcagaatttgaacacaataaaaaataacttaaattaaattaattttttaatatattagcaaatgcgtgttaattctgcgttgtctttccattagtttaaagttcattagcatttttatacatttttatattgttaataaagataattatttaaaaccaaaaatccttacagagcgttgccctatgattatcctttttttgcggcgcttgtaatactttttgggatttaaaaaaaatcttttccgggaggaggtgggggtaatgcttttccctttccttaatggacaaaatgaccttaattaggtgataattcggcgttgaatatgaaagcccatcaaatcggctgggaccacaattaatagaatttattgacatttaattaactttttaattaaaaatttaactaatgaccctttattaatgatggtcctaaacgttcacacacatttaggccgcctcacagaaccacggcggcgtgtgcagtggcggtgtcgtgatcgactccgtgttactgttcccgtcaagcgaattccgttgaatatcataccaaaaacacacaccaaataaataatcaatcatttcttaacaagaacagcagctaattatgtcaattaaatttaattgattataattaatttaaaaaatatgacatttttagttttaaacattgattaaaaatccgtgtacaattagcagcatttctcacatgttcttctaaatgttaacaattcgtcaaaatatagccaattttttcactgaaaaatgattttttttttaaatttaattttccatttaaacaacaattattcacattaattcaccacaacaattgaattgtctgccatacatttttaattattaaaatattttaccggaataaacatttcttgctaatttttatttatttccattataattttacgtcaaattgactttttttttatacaaaaatggttacttttaagcttttacatggacttgtctaactcaaaagtgaattcgctatccttttgaattttaataatttaaactcacgaaaaacctaaaaattatttaattttcaaaatttttttaactctcagaatatctttaaggccaatttgtttttattgaccaaaaacaattatcaatttaaatacagtaagaacggaaccatttttttaattatgttttgttagactttcgtgctaacaaatacaagtaattattcaaatttattatttttacaaatcaacaaaagaataaattgggcaagcaattcatttaccgctttttcaataaatatttatttgttttcctaaatgtttttgcttctggttggatcgtgattagaagcaagcacgaagggtttttaatacaaataatacattgaaaacactactcacaattaaaattttaattatatctctttgaatgttgaaattttaatgattttctaagttttcgtaattagttcatcataccaaattgtttcttccatttgaaaatgttcgaccgatcaattttcaaagtttttgcaattttctgatcactaatttttggattcttcaatttaatttcccaataaattttcattttttccattttttctttttccgttctttttttagtgagaattccaaattgtttcttccattttttaattgttccccaagaaactccaattttcttacaaatttctttataattttgttgccattcattatgtgaatattttcttttttgtttaaattcatttgctattgaaatgaatttttgcacaatttctaatttttcttcatcagtttttga

SEQ ID NO: 13745 - DNA, 889 bp, Heterodera glycines
tataaatggcacaaaatgccaaaacatatgatggacaatatggaaaaaggagagagattttgttgagttggggggacaatggacaaatttggggccgaatttgaataaaaaagagaaaatgttgcttattttaaagaagcagtttgaatttattaatcaacattttttatttttggaatcagaatattgaaatgaaaaatgctataaataaaaaaattaaaataaaaagaaaataatgctacttcagatttcatcaattatatatgaaaatcaaaaaaaaaaatcaaatttcaaatgaaacaattatttttaattaatcgaaatcatattaagtttatttttttaattacttgaacgagataatgactagagaccgcaaaaaaaggcaccaaaaatcgcaaaaaggcactataataagcaccaaaaaattgaaaaaaaaggcatgaaaagtcacgaaacccctaaaaaaggcatgatgattaattaaatgttttaagaatagttattcgaataaggaaaatttttaaataaaaaattttttatcaagaaaaaaatatgaaattttggcgatcaatttttaagaaaattttcaattcttagggggtatattttctgaaaatttttcaggtcatttcttcggggtgtattttccgctttcattgcatttaatggaattttcccgaaaaaaaccaaaaaaggcaccaaaacggcaaagtgccaaaaaaggcatttaaggcatgaaaatcccgaaaaaggcaaaaaaaaagggcataataaaagttaacgtagaagcctcaaaccaagtggaaacagcgttttttatgcttaatatatcgaaattatttcttttattcaaaaagatagataatttgtatttaaaatcttattg

SEQ ID NO: 13746 - DNA, 2397 bp, Heterodera glycines
gtattacagaaaaatattcaaataatcttattaatattcgaaatttgagaaaagatttttgcgaaaaaataagcacaattgtattaataataaaaaaaaaatgcgaaatatattcatttagcttggtctataaatatataaattatttttaaaaaataataaaagttatataattaaattttatccaaaaatgctttttaagaacacgatagaatttgtgattaaaacaaaaacttcaaaaaatcttataaaaattagaaaattagagaaaaacaaaaaatgtaaaaataataaaatataatataagaagaaggaaataaagtttattgaaaatcatattaaaagctctctcttcattccttatgacaaaacattttaatatgatatcagcaaatttttgtttgtcattattattcatgaaaattttattcataaaatgcaaatttgtcccaatttggactctccaaaactttgccatcgctttaattgtttttggcgcgggttcgacaaccagcgccaatctcacaagaatttattggcaccaattccacacaaatgccagcccaccattgtacaattcaatgtggcgaggacaccgttgttgtttatgccactccagagagacattcccatcccccctcaggggagcctcactaaaagttcccagcccttaatgtcgagactcttgagaaaattggacaggatagagggaggggagagtgggggcaaaggcttccaattgacaaccatagccaggcattaatgtaataagcttcatcgacttagtgccggaagcgaggtgaaaacaggcaaaaaggagacagacgaaatttggcacgagagggtgagtgtgggccaatgccaatacaaatgggaactgattttttaaattctaatcatgccatgaatgattatttaaaatgatttattttaaaatgtaaattaattatttagcttatacgaggtagggaaggttgtgcaagaaatgcgataatgagctcgagagttgttcacaagagttcttgaatgtaggaatatggacattttcagggatcggaggattaggccaaaatatgggagagaattcgaggttgaggaatcagcaacggaccgtaattcgtacaaaatccggaatctgcattatactgtaaatcaaggtttctgattgaacccagatttctgcaattgcgaaaattttggcagatttaagtagatttaatcaaaaggtttgccattatttttcaagggccgttatccgtcacatttgtaatgatgggctcataataggcaccggatgatatgccatgaaatgggcaaatccctaattatgccatcaacacaatgaaatcattttttcataactgaccttgggcctaaaacggtctgtccctaacaaataaggttggctggtgtggcaccaatcaacggggggcgggaattcgaatgatgaaaatgctaatgggtggtgccaaattaaatgttgccctcattcatgctggcacgcggcagactgtgagcctaattggaagggaccgaccgcttctgcttgctttgctgatgatgatgatgacgcggcggttacggacgcggcgacgccggaggtggcggtgttggtgggtaaagaggagcataatttgtgccaaagaaaggatggcacgacgatgccaccaccaccaccaccaacatccaccagcctaagagaacggagaaagcatcacattgggctaattgcaaacgaaaaagtggtggtagtgcttttaaaaaacgaatgctaatgggtgggggcggtatttgaaagcggaagcaaaaaaaaaaattcagagaataattactagtagcaattttatattttaactaaatcccctaaagtttcattaagaaacacaagtgccatgtaattaggagtattatgatttaattaattgataagtaaatacttcctaattagtatttacatatattcaaaaattttggtttagtggcgaaaacaaatttaattatttttaaataaaaaaatatttaaaaattaaaaaaaatatattcctggtattacatagtttttttcaaacattttcatttttgagcaaatttagacaatgccaaaataatgcggaacttttgacagtatctaaaattattttagaatcataaaaaaattttgcaaaatttataaaattgtaaatgaaaagatacacttgccattcattgtttcggtgtaaattttcaattttggacaaattcaaattgtgccgaaactatgctgggctttttgacgacggaccatcaacatcatcccaccattgtatgctgtgtcccgtgaccttttcaatcgtatcgccgccggggcgggggcggggggggggtgaggcggagaggcagcggcggctggcagcagca

SEQ ID NO: 13747 - DNA, 2795 bp, Heterodera glycines
gaatatcccaattagaaaataaaaacaaagcgaaaccttcagtttggcaccgcctttttatagcttcaggcaaagtaaaccctaatttttttttcattcaacgggcttttgcttgtttatatccaactgttttccgcttcatcaacacaattcgatatgagaaaagtcaattgatgcagacatcgcacgatgcatcgctggtgaagtccctcttcaaaaaacgcgaaaatatcgtgccgcagggttacaataccatcaacaacattaaccctgctcaccaaaatgatcaaaattaccatgccaatgttaatcctgataatatcatcaattttctcgttggtatttctcgaaattatgaaatatgcccgtattcatttttcaatgttttgttatttttttgttgttaacacattgataaatctgttatggtgttaattttaaagaattttcgagaaacaaatcagaattggatcaatgtaggacaaaaacagcttgcctcgactaaaccgaccctctgactaaaccgaccctctgactaaaccgaccctctgactaaaacgaccctctgactaaaacgaccctctgactaaaccgaccctctgactaaaccgaccctctgactaaaacgaccctctgactaaaccgaccctctgactaaaccgaccctctgactaaaccgaccctctgactaaaccgaccctctgactaaaacgaccctctgactaaaccgaccctctgactaaaccgaccctctgactaaaacgaccctctgactaaaccgaccctctgactaaaccgaccctctgactaaaccgaccctctgactaaaccgaccctctgactaaaccgaccctctgactaaaccgaccctctgactaaaacgaccctctgactaaaccgaccctctgactaaaacgaccctctgactaaaacgaccctctgactaaaacgaccctctgactaaaacgaccctctgactaaaacgaccctctgactaaaccgaccctctgactaaaccgaccctctgactaaaacgaccctctgactaaaccgaccctctgactaaaacgaccctctgactaaaacgaccctctgactaaaacgaccctctgactaaaacgaccctctgactaaaccgaccctctgactaaaccgaccctctgactaaaacgaccctctgactaaaccgaccctctgactaaaccgaccctctgactaaaccgaccctctgactaaaacgaccctctgactaaaccgaccctctgactaaaccgaccctctgactaaaacgaccctctgactaaaccggccagactaaaacggccagactaaaacggccagatgattcttggtcttttcttttcattaaagcaaatgctaataccacccattcggcacgatcatttttttcatactaaaaaattcctaataaacttataaaaacgaggtataccaagccatgaatcaaccaaatttggcggaatccttttgacgcaatttcaaacgttgcatccgcaaccataatttcacaatttctagcggcttttaattgcacgtttgatgcaaataaaagtactctaatttacatttctgtatcttagccattcagttccttctaatggtttcccaagcttaagtttgatagaaccggtttttgtcaattgtaaacgttcaggtatgtcaaactaattcttccatagggtcttcttgtgcatcaatttcacgcactttagcagctctgtcgccaatctttaattgcgccacgagcttgggggttggggtgggccaagctgaggcgggattggttcccgctcctcttcaccgctctcgtcccttctctttctgctcactccgctcgctgtgccgtaaagggaatggcaccctttttgccgttcgttttgatgggtctgatgctgctgaccgatccgatcagcgccaaagggggacgagaatgggaggggggaggggtgacaaagttggactggtgcttgatggaattgtgcagcgatttgctgcttgcttaacggcaccaccgacaaggtttggagaagggcttgtcggacccctttgaactgctgcttcgttctcgactcgacgatcacgggtttcgactcccgcccactgcgcgcttctccggctggtgggagttgcgctgacgaacggccctgtccttcgttggacgatttggcaccgcccggctcttccttccctcactaccctgctcggacttgacgacgacgggagttcacacccgtctcttcggctgctccgactggtgggagaccgaactgctcgaatttgccgctgcttcgggcactcccgaacttcccccaattgcgacgggaagggaatttgatcgggagggttggggaagacgacgtaggccgccgggaaaggaatggatcaggacaggaatgggcgccctcgtttggccccgcacgataatttgccgaccgtgatggagtgaggagggtctttttccctccttctagtgtcccccgaaaacgaatccgagactccgattccgacacaaaatttattaacgaagcgatcgacgaattaaaaatgcgtaaatggtgaaaaattgatcgaaaagtccagcaaacgaataaacgcgaatggttggggggtgaggaagcgaagagagcgaccccttgggcagggccgcttaaatagacattcgaaaaaatgggcggagtgacagacggcccgataatgcgatgagaaaaatgggacaaaaaaaatgggcagaaattgtgatgtgaaaagtgtgaacaaagaaatggcgcataaaa

SEQ ID NO: 13748 - DNA, 2271 bp, Heterodera glycines
tttatgagtccaatcaatgggtttttatacaataactttgtttatgctcgaacaaaccctatctttttggtatcattcgaaagtacgaagtctaaataatgtaataatacgagaaaacaagaaaattctaacatttcaagaaagttacaaacgaaaataataagtatttacttaaataatcaaatcttttttggtaattgcctaaacgctgcgattttatatattttagcttcgttagactttgtactttcaaatgataccaaaaagataggtttagctcgaacatgaacaaagttattgtataaaaaccgagtattttcaattgattggactcataaaagtcgattggactcataaagtgcactagagccatcgttttttgcgtaccaaatcccgacccagaattcaggtcggactcgaccctaatccgacctactatgttaaattccatttcttatccaggttcttataacaaatctattggccttgattcctattaaatttttctagtttcaatttcgtgccaacgtttcgtgccagagaactcaaaatttttaaactttttttgaagttttttgttacaacttttgacaatgtttttaaatgcttagaaatatcttaaaatggccttctttgtcgatataaatcaaatttataaaattggtcaactgagaaaaaattaaggattcttcatccgcaatggcacggaaacagtggcaccgaactatgttggtcaacaaaattttcattcaagaatttaccttgattttgtggataaggaatacgtcgttctccgcgccgagtgtagcgtagatcaagagatgtcggaaagtcattttctagaatattgagttgatattagataatatattttttgggttttttttaaataaatttgaaattaccgtggtcggccaattcggaaagcattgttataccatatatgaataatggaaaaattaaattaatcataatggctgataattttaaaattataattaccaaatattaaattaattttaaagaatcaaataaaatttaattatatttttatattgtctttattaaaatattaaaattaatttagtttatttgaattagggattgccaatggtcagcttaatttaaatggactgataagtgctttcaaaagcacaaatgaattaaaaaaacaattacttatgtcaacccaacttataagcaatatgcaaaacaattttaattttaaatgaatataaaaatgtccaaaaatgaaaataatttaaaatttccgtcacataacgctaggcgcaaattgttaatttggatattatttgtctttaaaacagccttccctagcttttttgaaataagataaaaatgaacttcaaatcgaagattttgaccttaaaaaactttcgggaaaacgaataaatcctgcggtgccggtatacgccttcgggggaattattttttattgttaaatgaatatttttcagtttaaaaattgctcataattctcagcgaactgacatatttaaggggtgtgtttttaaaatcaaaaaaccaaataccaaaaaattggtaccgctggttttcggtattttcagttcggttaaacgaccgtgactaaccctagtttaagttaattatctattcattactattattattattttattgcatttttatcattatttaaatgatttttttttgaaattatatacatatattaattagcgttattttttaaaaaatattaatttatgaataatcaaatggaattaaaaagaaacgaatttttaacacagtcaaagtgattttatcattaatattaatttgttaaccaattgtcaaaataataacattcattaatttctgtgtcaatcatcgctttgataaattaaaatgaattttcatgtggacaattgaatgtaaagtgattatgttgaaaattttattgtttaatcaacgattgctgaaacgaaatggcgctttaaaataaatatttaaataatggcaaaaacctgtatgcgagtgaatgggaggatttaaatgtccccatcgaaaattcaatgtttacaaatatattggtcattttgttgagttcaattttgatgatgtcatgcctttgttgtgccttgcgcaaggaatgtgcaactttggatttatttatggatttttctgtctggataaatgggaatggattttccggacacaactaacggcaaaaattgaaaacaaataatcaaaaagttatgtagtgtattatcaaaaattgactgatttggc

SEQ ID NO: 13749 - DNA, 1085 bp, Heterodera glycines
cccttcccacaattagcgctgtttctgctgactctttctgttcagttcgtctccgtttcgttatttctgctcttggcactgctgtacgccttcagttgcattcagttgaccgtccttttctgcacgttcactcaaaagggacaattggtccaattgatggttcgtccgtccctttggcattccgtccctttttaaattcgaattctccccgaaaggacggtctgtccttccaattgctcggcctgctcagttggaagtacagtccgcccctgcacagtgtcggccgttgtctgttcgcttcacttaatcccgtggctgcctttggtctcggcgtccaaatggcgtgcactttcgaaactcgaagtcggttttaaaaatgagatgacctcggaccagggatggcacggaattccgatttccttcatttttggggtcagaactacgatttccgacttccgaaaaatttttgggcctcggaattgcaatttccgaaaaattcttgaccctcggattggccaattcagaagtgtgcttcttgtgccatttgcccttttgtacttacaattacctaattaacactgactaattgcccattagtgtttctgctcgattggccccatctcttctccggctcctcccatcagttctccgtcggcttggccatgcttatgctgctgttcgactccgctctcttctctctgctcactttttactttgactccgtttggcccaccgatgaaagcccccggaggcatccgctctttttcctccaggcattttttgattgtttcccaatttgaattaaaacaccctgtgaaaattagcactttggcatcggtctgtccaattatgagaaagtgacaccgtacggagaggacgaagacggggagggatcggctacggtggccaactccgagaacaccgaagtcgagacaacggagaatcggacggcggacatcgaagtgcgcgggatgagcaaagtgtgggagtccaccggactgatggcagtgaacgcgctgagtttccgcgcttaccggggaaaggtaagcgatgcgatgccacggggggcggggggaggggggggg

SEQ ID NO: 13750 - DNA, 1570 bp, Heterodera glycines
ttatggccaaagtacacatgtggcctggttttttgaattcttctagtcataatttttttgagcattaacgaaattttttgaaacttagcagactaatagagaacacttagagctttcgaatgataccaataatgttagatttggttgacaaagaaaaaagttatagtccaaaaactgggctggcgccgaaacgagcggcgccgaaacgagggtgtccccattccccaccccttttttaggttttcgttttgcttggccacaacggcgcgggcaagtccaccacttttgctgtgctcaccggctccgtgcgcgcctcgggcggcgatgttctgatctgcgggcaacagttggagcacaatttgcgcgactgtcagcgtcgcattggcttctgtccccagtacaatccgttgttcgacaaattgacagtgcgcgagcatttgctgttttacggacgaatgaaactgagccaaggggagggcgcggaagaattgagacggcaattggacgtcgaagttgccgaattggtcgcagaagttggcattgcggcgcaattggacacggcaagttgacgcgagagggagcggggaaagtggggaggggcgtgcgagaagtgagaaggggtggagagaaaagggcgggcgggggaagacgggagacagacgcgagagaaagtggggaggagaagagggcggcagaacgtgtagagcaagggcggaaggacgggagggagttaattctgctgctaaaaattcgtccataattttttcagttggctaaaaatttgagcggtggacagaagcgcaaattgtgtcttgcgatggctttggtgggccgaagtccggtcgttttgctggacgaacccaccgcagggatggacccgggggcgcggaacgaggccggcaaagtgttggagaggataaagcgcgatcggtgattatttttttgggcgtgagagaaatagccggggaatggctaactcgccccttgctatcactctctgccaaactacaacccgtttcattcgttgatcactaccatccgccgtttgagtacgattcgcttggccacccaaacgctttccatttcagtaccattctgttgaccacccattacatggaggaggccaacacgttgggcgatcgcattggcattatggtccaaggccgcatggtgtgcaacgggtcgcccgagtttctgaagcagcgctttggcgtcggctacgttttgtccgtcgttgtccgtgcgggtgccgactttccccgcgcagtcggcaaagtgttcgacgcaattaccaaacattcgcccggcgcaaaacttgaacagaaccaaaaaccacccgagttttccatcgtcctcccgctgggcgacaagcgaaagttcggcgacattttcgcggagttggagcagtgcacggacgaatttggagttgactcattcggagtgtcttcaaacacgctggagcaagtgttcctcaagtgggcacaaaccaaaaaaataagacagttttgggacacattggcataacaaatttagagtcggtgaacaaagcgcggaagagaaaaaaggggaa

SEQ ID NO: 13751 - DNA, 2317 bp, Heterodera glycines
  misc_feature (818)..(818): n is a, c, g, or t
tggcatgacaaagggcccacaaccaatgaacgctcttttggattggacaaaatcggtcaggagatgacaattccgctccaagtactgctcgacaatgacgacaacggtaacccaccaagacggcttactgttcaatccggcaaaaaacacctttaagcgacttggctttcaaagacaataacggacatggcaaaggcacatccctccattaaactgctccaaattgacggcgacaaacaaatggacaagacacttttggacacattttaccattggccccctctcggcgttggggcgatcatttcgcgcaaccaaagcaacggcaaactgaatgtccaattgttgttcaacggagccacttaccacgggccggaaattgcgctgaatttgttgggaagcgccatgttgggaaatgccacaagtattggacatcagcaggactttggcttacaattagaggaatttttttggatatttcgacgggcattctttgtccccaatgaattgactaattttggctaatttgtttaattgcccgcagcgatcattcagccgagcatcgaattgtacggggaggacgagaaccccttcggcatgctgaaggatctgttcaaagatgtgatgggcaacatgggcgccgcaatgtccgtgatcaccgccttctccataatgactgccacaatggtgatgccgttggtggaggagcgaggaagccgcttcaaacaccaggtgagggacgggcggaggacgaacggacggggaatgggcggacaattcggcggatggacggaaacttattggaaaagaatgaaagttgngagaccggtgatcaatacgtcattcctatcgaatgtctgatcaaatttaaacaagacaatcttgctcaaattgccaaatgccattgtccataatatttgccttggcaaatgccattcttccgatcgctttgatcactttctattttcctattttcttcctcttttcttccttaatcttccctaatctccccccccctccctctgctgcagttgttgctgacccatctccacccctttgtctattgggcttccgttctgttgtggaacttcgttctgtacgccgtgttctgttccgtcatcggtgtctctctgttcttcttcaattggatgcgtccctttctcggctccatcgttctcctttggcttctttacttttgggccaccgttccaatggtcggctgcgcgtctttcctttttgaaaaggtataaatattatttatttattttttatttcaatttgatttcttcactttttgctccaggcgacgaaggcattcagtgcgcttatgtgttggtttatggtcggctccatgctttccaccattggcaccgctcttttgaaactgaatgccggtgccatcggcgaacgtaccgcccttctgctgaacatgctgcttggcattgtgttgcccaccaaagcgttaagcggcggcattctcaacctggcactgattgccacttatcagcaactgattggccaacatttcgacgacgggtccgacaacagtttcttcggcactgccgggcccatcggcgagctgtggaaggaattccgacgggaactgttcgccatgggcatcgccgggctcatcttctgggttctgttggcactgctccaatcgcgccgcgtcgcctgggcatggcacaaaatgagcaacaacatcgccgtgagggacaatgcttttggagtcccttctcctgataatgcgacagcattcagatggtcatctacggcaatcggtcgctgtctgaggaggacgaagacgaagacgtacgggaagagcgggacagaatgttacgggagaccaacgagagccacgcccttgccgtgatgggtctcaccaaattttatcgccggttttgtgctgtccgagaaattacctttggtgtcaaagcggaggaatgttttggattactcggtaaacgatcgatggcacgattattgtatctgagtacaagggcataacaatgaaaacttaggaaattgaaggctcacggcttcggccatccctttaggggtaaatggtgccggcaaaacgaccaccttcgaccttttggccggcgtacagtacgccagcggtggaagtgccaccgttgccggccgcgatgtgaagaaatgcccgcgtataggctactgtccccaatttgacgcgctgcccggcgaactgacagggcgcgaggtgctcactctgctgatgcgactgaacggattccgcgacagtggtgaacgagccaggaaaacgttgtgggcaattcggatggagggcaacgcggacaag

SEQ ID NO: 13752 - DNA, 3135 bp, Heterodera glycines
  misc_feature (3007)..(3007): n is a, c, g, or t
  misc_feature (3081)..(3081): n is a, c, g, or t
tccaaggagacttccttcgattcgaattcatttatctcctcttttgacttcggcacttgtcgattcttgtgcctgtgtctcttactgtcgggaaaatacagtacacagagcgggactgaaaattttagagttagagggagaaaattcagaactgacagcagcaaatgattcaaacataaaaattgttgggaaaataaaagcgaaaattcgaattgaagactcagtgacgggtaaatttggagaatgggaagcgacactgcttgtttcacccgacaagcactgtcctggaccagtattgcttggtttaccttttcttatggatttgaaaggagttattgcacttggggaaaagaaagttcgattgggtgaaatttggacaagcatagtatcagtgataggcacggaaccaccaaaaccaccaagagtaattttaccaaaaaatgacacgtttgaaccacggacggaaaatattcttaatgcgagagttgatataatttttccaactggacaaaatttcttggtaaggggtatacagcatcagtaccctgggattatcattggaaggacattggttgccccaggcgcgaccaaagaagtgataataagacttatgaatgcgggaaacgcaccaattaaaatttacgggaactcacatttggcagatttggagccattacaaattaatgcattacctggcgatgagattgcggctaaagattttattccacctgaaactcgtgaagtgaaaatttgcctaaattacccgtaaatcacatgaatcggcctccttcagaaagaatagatttggaagagacaagactaagtgaaaaggcacagcgagaattttttagaccttatcgcacccccggagactcagaaagaaattgagagacaaattaaaatgatgcttgaccagaatattattcgtgagtcggaatccgagttcgcttctcctattgtgatggtcccgaaagcggacaaaaaatcatggagatttgcggttgattacagggcgttgaataaaatgaccaaaaagagagtttttcatcttccgaatattcaagagcttttggatttaatgggagccaaaaaatattacacatgcatggacatgcagcaagggtttatgcaaatccccatggcaaaggaggacattgaaaagacagcttttatttctcatttgggcatttatgaatttatcacgatgccttttggtttaacggcagcaccggacacatttcagagggtaatgaaatgagactaattacccatcgattgagcgagaagctttggcattagtctattcagtgaaagaattttcaccttatattgttggatcaggaataagtaagatcatcacagattgtatgggaaatcgtgagaactgagattgtgaaagcacaagaaagaaacaaagagggaaatgatgccataagaagggccacagaaagagagttcgaaattggggatttagttttggttaaaaaggaagtgatgaaacataaatttgatcaaaggtggggtggaccattaagatgtgttggaattgaggcagaaagaaaaaatttgattttacagtcattagatggaaaaggaaaatataaaaaagtacatcaagaaaaagtgaagaaattccatggtccagcaactttgcctttgagagaggcggatgagccgataaattgggaaaaatatgtgcatgatccaaatttggaacaggaggaggcagaagaaagtgaagaagaaggctttgagattgtcttgagtaaagagaaagaaatgagcggggaaatgattggcaaaagcaaaaaattttcaaaatttggttttgaaagcagtgaagaggaggagaatggtaatactattgcttttgttcaaaatcaggaagaaataagtgacgatgagggtcccgaaattttctttgaaaacagaaattttgtgttcgaaaatgacgagacaccaactttgttggcagttatgttgaacggtaaaatggttacggtgtgtacagggtggttaaatcccaccataattccccttacttcatcggtccctgagaaccaagtggaagaaaattgggaaatttatagtaatgaagacggtgagagatatgtgacgtgttggatttttggagagagttttgaaatgtacattagcagtattacggacaaaattgttttgggcatggatgtccaatttctttttgcagaaaaatggtcattaaaaacggaaaatgaacgggaatcatattgggaaataatttcgggaataaatggagtaatgtatgaaataaaccagattccagaaattttcataagtgaaaaagaaaattatgacgaccaaaacgagttcagaatgagtataaatgtcataagaagtgaaaaaaatgaagaaatgggacaatttatgaaaaataaggagcgaaataagcagcttttaggcctaatcgagaacatgaacaagaaaggcagattaaacgagcccaaagaaaagaacgggaaaatttacgaaagccattcatttttcaagatggaattgttatcgaaagaggaggaagaatctctgaagaggttgaagagaaagctcgaacatcaacttctgaaggtccagcaaagtctgaccgaaagcgaaaaatggaaatccggaacgtcggacgatgatccagtgggaccacaggagcgagaagaaaatgaggaagaaacgacgaaaaagggcaaaggaatggagaaaaaagaggaggaggagaagaaaggaagagaggaaaaagaaaaagagacggaaaagaagaaggaagagatgaagcagaaggacgagacggaaaccaaacgaagcctcagcgtcggaacaacgaaagacgatgaaatctcgattgtggattctgaagaaaaagaaagagatgccttcgaaaacccgccgaagccgacaaacgagcgaatggcattttgggagtcgactttgaacaatgaggcaaaaaaggatttgcgagaggacaaagagaaagccttanaaaacacaggccaaggtattgtcgtaagctccagaaaacgaacgataaacgaagtcgacccgccaactctgtcnaatgaagccgccacgaaattcggggaaaaatgcggcaagcattgaacaggatca

SEQ ID NO: 13753 - DNA, 608 bp, Heterodera glycines
cccccaatctctctcccgctaatatcccgagaccgaactgggagtcccttcccccatcccatatatactcatcatatatatttgtattgtgcgcacatttactcaataaaaggacataatcaactgccgccgctgggataattgggaagggacccgtcgcctatttcaggtttaaataaaatattaaattaaaaattaataaaggaaaaattattacaaattgttgtataaattcttaaagaaaattctacatcgtttataatcaagaaaaataaataaattttttaaatttaattcgagtcattaattcaaaaccaaatataatttactgcgttttaggtaaactccggaattaaggaggccctaaagcaatttgtaaatttaatgcaaaaatataaagtaaaaatgcaaatttatatcaaacgagggactaatgacattcatcttgcgaattaatattaaaattaaaaaataaaaaacttttaaatttaaatattaattattttgatattttttattcattgtatcaacatacaatatgaattccgagatatttgaattatgacatatgtcaaaaaactaaaggtattaatttgtttaaattaaaa

SEQ ID NO: 13754 - DNA, 2093 bp, Heterodera glycines
  misc_feature (35)..(35): n is a, c, g, or t
  misc_feature (48)..(48): n is a, c, g, or t
  misc_feature (88)..(88): n is a, c, g, or t
tttttctcaggctaatagtgaattaaagagatatntcataacactacnttagttaatatcaaaaatttattgctaacaacgcagaaanttattggcgccgaaatggggttgattaatttatttttaatggtagaaatctataaaaaaattttaaaaatatttacagaaagaaacatttaacaaaagttttaaaacagaaattttcacgaattattataaatggtttatttcaaacaaaaatatttccataatttcaagcgttaaaaaaacacaaattaaaaaatttaacagagtttttaaaacaaaataaaattattttttgacgaaaactctgttgataattcattttaacacgaattattttaaaggatgtgaatatattatggatattcaatttctgttaattcataagtaattgttttatcgttgtgtcggaccagtgcagactcgtcataagaagtcaatgtcaaaactccagctgcaaagaaattaaaagggatttatttaaattcacgcatgcatttttttaataaaaatattattaacatagcctttttcaaaccctcattagtgtccgcattcactgcattcgctgtaaattcatcgcccacttcaaatttgatcgaattgggaaaaacaaattgggttttgttgataccatcggtacaaattgttccatccaatctttttgtaagattgtatgctgtcggctttcgtgccacgcataaacggatacaaccttgtgttttaaaattattaaatcaatttactattagtaaggatggaaatttcaggcataaaaatcgcgaaattgctactttaaattacaaaaaaatcactcaatcaaaatttctatcaacaaaaaaattttgtagaaatttttgagaaatgtttccaattactaatagttttttgttggtgtttttttcaaaaaatccaaaaaatacgttcctaggtattaaatacaaaacaaaagtaataataaaaaatattaaaaatcattgtagacatcctaagcaaagtgtaaacctgtttttcgtgtttaactgtgcatattaagtacgtaaaaaatttaggattttgccaaaatatccatccctactaaataaagttttttaaaaggtttttcataaaaaacaaacaatcttgcttgtgttcacaaaaacgaacacaatctcgtcttttccaaggccttctttaactttgacattttgaagtttaatagtgcatccctaaaaaaatttttaatggctttttaatgcttttcatacttctttgccactcaataaaaaattcaaaaaatccgccaatattccatgcagttatttttgttttggttttttctgaaataaccaaaaaataacaatgcactaacatattaatattatttaattttttaatattattttaaatggctttaattacacaaaattttctcctttccgaattttttaaattggtattgggctgaaatcaccggcgaaggaaaacttgtggctcaaaaatgtaaaaaaggctttttcttcattgctcggtttcgcttttggaagcgcttcaattaacgccacagttgaactttcttgagcccgtagttcaaaatcaacacttccataattataaggtgcataaactttccgggctgcaaaagttttgagcataaatcttcttgccttaagcaagatcaagatttttatttcccaaaataattaaactttgaaatcagtgccaatgtcacgaatcaaacgttccatatttttttcacaaaatgtaatgatgagaaaatcatttctgtagaaaattagtttaattcattttcgtttttttggtaacccacccgtctgtaccaacgacagtccaaacttttttgtcttggaccaaacgaacagcgtccgccgtgacaaacgttagttctatgtcactaaaaaccatcgtattatgagtctataaactttgttttattaaattaataaaataatttttaataaaaaataaaagcttacaccattgtttctccaaattttattgcttgtatcggagaacgtttagcctttttcagtggcgttttttcggaagacatttcaattattattaat

SEQ ID NO: 13755 - DNA, 1985 bp, Heterodera glycines
tggcacccgtgagcagttggaacccgagggcttggcgaatgggcatgcgtggcacgcgtgagcagttggaacccgagggcttggcgaatgggcatgcgtggcacccgtgaacagttggaacccgagggtttggcgaatgggcatgcgtggcacccgtgagcagttggaaagggcatgcgtggcacgcgtgagcagttggaacccgagggcttggcgaatgagcatgcgtggcacccgtgagcagttggaaagggcatgcgtggcacccgtgagcagtcggaacacgagggcttggcgaatgagcatgcgtggcacccgtaaacagttggaacccgagggcttggggaatgggcatgcgtggcacccgtgagcagttggaacccgagggcttggcgaatgggcatgcgtggcacccgtgagcagttgaaaccagagggcttggcgaatgggcatgcgtggcacccgtgagcagtcggaacacgagggcttggcgaatgagcatgcgtggcacccgtgagcaatgccaagaaaagaaaattgtctaatggccagtggatgtcaagaaaagaaaaggccagtggatggcaataaaagaaacattataaaatggccagtggatgccaagaaaagaaaattgtctaatggccagcggaagctaataaaagaaaattgtctaatggccagtggaagccaataaaagaaaattgtcaaatggccagtggatgccaataaaagtaattatcaaatggttactggaagccaataaatgaaaattgtctaaatgtccagtggaagccaataaaagaaatattatacaaaggccagtagatgacagacagacatcgcgtcgacccactgtcccggggtagacactttgtccttgtggtgaccaaatggtctaaaatagacagtcatgcacttgccactgccctacacgcacaaaaaacacggtgtcgacactttgtcccagcaagtgtgtagacactttgtccgttttgagtgtcgacactttgtccgttttgaccaaatttgcgaaaaatgtgctttttacgtctgcgcccatcctttttgactcaaaaaaacaccgcttcccgcgaaaataccgactttgcattttgcaccccccagcggctaaagggggttcgacccttcagacttgtcgaatcgggtcgaactttcttttaaaatgctccccatggcgcggcgcaactttcgccaagcgacggcaagacagctacgcttcagcgccaggcgctagacgccattctagaaaagttagcaaaaacaggttagcatatctcggcgcaaagcgcccggcgagagacggcaatttgttttcccagcctttcagggtgcgggacgcgcggggaaaaaaattctgactctccagcatcgctggcccaaaagattgctgtctatggcgcaaagctggtcaacaaaaagacagcaatctcggcgccaagtttttgcctaaatctattatttgcaaccttgtcccattgcacaatcctttattaacattcaaattacgcaataacataatcatcgcacccttttttaattttaattcatggtttggcatacttgaacatttaaacgaattaagaatttctggagtggaagcattatttttcctttcgtccgtttcatctatgcttaaataaaccttacagtcccctggaagtaaatctaaaatttcttcattatatttgtcaacaacagcattatacggagataagattgcgacttcactaataaaatcataatccatgttgtttaaaatattgccaaaaatttcatcaattaaatttcctttacttatacaattatttggaacttttatatatccattttctcccattgttccatttccaatcatgatcaaatcttcactgaattgtttttcgtttatattttctcgcatgttttgtgttaattttaatgttttaaataatttccacattggtgaattttttattaacaaa

SEQ ID NO: 13756 - DNA, 3077 bp, Heterodera glycines
tgcaggtcgtgggcataaataatacaaatggtcgaatataaaataatccataaggcataaataaataaatataaaagtaaattaaaaaataagcaagataaattggaaacattatagaatttaatccaagataaatgaaaaacaggttggaaaatcattgtaatcaatttaattgaaattcactacaaattacgattagtttttatgaaaattagcttaatatttaaaatatgaccaatatattaattctagataaaaaattaatagaataaaataaataaattcttcattcatcataatatgttatgcggcaaaataaaagcattgttttttcctttattgtaaaaaaggagagtttaattaaaaaaatttattattaaaaggttgattttgttttttaaataaaaataaaataatctgtttcgaataaacaaaaaagaaattaaaatattcattaggcaagccattagaattaagaagctaaaaattttgcttttgcgctacataaatttattaaatttaaaaaatctataatctaaggacatattgccattacggtaactacacacggctcaaatcgaacggtatttccatgtaaaaatattttcagccataatgtcttgaataattaacagaatatgaaaaagcacaaatgcaaattttaacaaaatttgaaaattaaaaaaaagttacagtatgcgggaaagaatcttcaaccgacattgagtcggaagaatacattattacaattatataaaccaatgaaattctaaaaaagctcaaaaaataatttccatgaagaataatgattaaatatatatatatatatatatgaataataaaagtgtaacaagtagaactttggggccccaaaaaaataccaattaaaataaaatatttaatattggtttcataattaataatcttcgtaaatttttaaagaactttattgcaaattattaatgttgtataaaataaataattattcaaaattacggcaaacaaattaataaaaactttataatatataaaatttaccatttaattcaaaaattgttcaaatttattgtaattttttttataaagtcattttgcctttggtcaaaatttatttttattgaaaaaatcataaattaatataattaaaaaacaagtagcgattatgatgataaacaaataataaaataatgcaatggaaacttcagtacccgtatgcataaagatcaggatcggatccccggatcgtgatccacgaatcactgattcgaggatcgaaaaatccgtggatcaaaatccgtatgcataaagatcggattgggtgatccatggatctcgatccgtggattgtattccttttcttttcctcagtagttctcatcaaatccaacgctattttcctttcctctaaatcgacctgatccgcggatcactttatttaccatgaatattaaatatttgggttttttgcatttttgttgttgcataatttatggattaacctagatgatcaataactgaaagattgtttacccaaactatgtttttgatggcggtgaatttacatcaaaacaatttcttttgccattctttcttatttttcccaaatcaatttccccaaaaaattaaaattattaatggcggcgcgattcaatgaagccatggtggctcgcttgatcgaacttgttcaatcgcgtcaagatgatttgaaccctccaactcgaactgcaaaagcaaacgaaaagcaaaaagaggcgtggaaatttgtcactgattctatgaatcgtgagtttcctcaggaagtgccccagggcggcttaacgattgcacaaatccaaacaaaattcaaaaatctaaaacaaagggccaaggacgaacgacaaaccgaaaaaaagttaatcatatgtgcgcctgtgctgggtttcagcattttctttaggcatcagcgtgccacaggcggtggaaagaaattcgaaatgactgaagtttcgcgcaatgttcaagatgatttgaaccctccaactcgaactgcaaaagcaaacgaaaagcaaaaagaggcgtggaaatttgtcactgattctatgaatcgtgagtttcctcaggaagtgccccagggcggcttaacgattgcacaaatccaaacaaaattcaaaaatctaaaacaaagggccaaggacgaacgacaaaccgaaaaaaagttaatcatatgtgcgcctgtgctgggtttcagcattttctttaggcatcagcgtgccacaggcggtggaaagaaattcgaaatgactgaagtttcgcgcaatgtttcccaattgtttgctgattcaccggcatttgagggtagatatgtgttcgagctaatgtgtaagtagatgtttgttaaaggagtgcccggcggcgtacagaccggtctcaacatcggcgacaccattttctttgaaggcaaagaacaagaggaaagtgccgaattttcctcacagcaagttgttgttgaagaaggaaagtcctatgccgttcttggcactgtgccacgcggagaggcggtgaaaactccaaaatttgaatcaagcacctctcgcgtgccattccgatctcgtgccggaactgcttcaactgttacagctgctgatgtaatggaactgcagcggagtgttctcgagatgcaatttgaagaaatgacaaaaaaacaagaaatttttaaaaaatttgaggatgttcttgacgatgctaagacattttttactgagggtcgcgaattttttcgtggaaagcattcaaatgagaaagaaacttaaataatgctacattcatttattaattggtgcgttttagcactttgtatttttttcagtttattttaataaacttttttgtctgcagcaatgtgtgccgcgttttttccaattgagacacaaacagcggtaaaaatttaccgaaagagggcagaaattctcgcccaaatgtctgatcaagatctctataagagatttcgatttgacagggaagggatagaggtaccatttttataaattcatttagaaaagctaaaaaggtacattactaatttggtgcgtgaagaagtt

SEQ ID NO: 13757 - DNA, 762 bp, Heterodera glycines
ttttcttagaaagaatttttctaagacttttttcttgtatttttccaagtttgaaatttaaaaaaaaaaaaaaatttttttcttggcggagttttgtcctgctccgtttttttaaatatttaattttaaaaatttcgtctctgccctccccacccactcacaatataattttttatctcttcatatttattgccgttcgccgtcttctccccctccaccctaacatttttttaaatttatttaattataaatattttttttctttaatttcttgccgacttttgacttttgtcttcctctcaccctccctcacaattttaattcatttaaattttaaaaaatttcttgccgatttttggttttgtctgtgcctccccctcccttcaccctcacacttcttaattttattaattattttttttaattttaatccatttccgccttttctttacccgcccgccccctctctccccaccctcagaatttaattttacttaataatttttttttattttaatttattgccaactttagactttttgacgacttttaatttttgtcttcccctcccgcaccctcacatttttatttgattttaattattaattttttatttaaattatgcctatggcgataatttttttatatttattgccgacttttgtctgcccccccccctcccctctaattcattttccatttaaatatgtttttatttttatttatatttatgcatttattgccgccttttgtctgcccccc

SEQ ID NO: 13758 - DNA, 1955 bp, Heterodera glycines
ctccacaaatgcgctgcccttgagatctttccataccatagtctcacgcaatttcgctttgagttcacttctcaaatcgcattcgctgctctgaaggcattacgtgtcccttttctgtttccacaaattgcccacttcatcgccgtggacagtgaaaaagatcggcggccgatcagttaaagagaaagaaaataaatttaaatgtacaaatataaataaaaaatatttattaatgtttagctgatcagtctccgatggaaaccattcaaaaagggaaggcgaaaaaagggacctcggcctccgtccccccccccccccaaatgtgaacgatgacaccgggccactgaggccaaattttgtgcataaaattagacgcggtgctttcaattggctgggaaagaggaggcccgggcagcgggctctttatgcgcgcacccatttaaatttggtagtttttattcgcaaaaaatcaatttttacatttctttatccttaaaaattgaattggagtatttaatttgtgactgttaacaatttcacaaaagttgagaaattttcggttttttttttggggggggggggtccttcctggttatagttttcaagttagtcgagaaatcctcggtttttttttggatgaggggggggggagtctttgttgttgttttcaagttgtttgagtcaccatttattaatctcgctttttacaaccaccatgcgtcatttctcggtcactattctcggtaaaaatcatttttctcgcacatccctgtcaaaggtttcaaaaatggccttcttagtccacgaggccattatgttataatcaaaattgcctctattgcagttcacgcgttcaatcaatgggccatcttcagttttttaggcctcaacttttttcatacttggtaaatgcctacattccttggtaccaattgaaaagttgaagtttatagaagcttttgtattgctaaaagacaacagagaaaaaattattcttgaataaacccgaaagatgaataaactgaggatgaatgactaattgattggaagcctaaagtgaggtagagcctcaaatcaaaattccaactccttaacgttttttatttgctgtttgcttctgctgctggttaattaaaccccattaaacaaaaggcatttttggaatttgtggttatttcaggcacgtacatttctttcattcttcgtcttaattgaattgctgtttaaaattaaacgtcttccaattttttgcttttggttgtgctctctttttcactctgttcatcagaaaccaattgctctttattgataaattcaccttttctccatagattgggtttagtcgattaacttactcaaaaataaaaagattttttatgtatttttacaattttctgggcgagtttcccaaaaaaaaattatgtgaaggggctaactttcaaaacaaaactcttgccggttttctgtcactaaaataaattacggaattttcaaatccctgaaattccatactgaacacattcccaaatcctgactgatttggcctttctgcggcttgttgaaagaaaatgtgtagtaaccacaatgccaaaaattaattacgcaaaaataaaattttctttacctaggagctaatctaattgtaagcctgtggcaggatttagcccgatttccatgttcctatcattaagcataactattttgccccaacgactggatttcaggcttaaaaatcctgtttttcaggtctaatccgggtcaattttcaagaatttacccggaaaggagtacggaaaaatcctgacagaatccggtcctgtctggtctctctctacttgtgaatgtccaaatacgggatgacaaattaattttgttgctttaataaatgaaattttcaaaagttgaacaatctctttccgaatcacagaaatttacattgtgtgcacattcttttt

SEQ ID NO: 13759 - DNA, 1534 bp, Heterodera glycines
  misc_feature (104)..(104): n is a, c, g, or t
ttttgcttctgcttccttcgctttctttcttcaggtgatgtcggcacttccgcagcttctcttcctgcttcagcttttcttttgtctcttctgccttcttctgnttcggccactagtgctttggcttctgcaggtgcgcggggctttccctcgggctttgccttttgtttcttcatttcttcctcctttttctttgcttctgcctcttttttggccttttcttcggcatctctcttcgcttttgcttctgcttcctttctcttcttttcttcaggtgaggtcggcacttccgcagctttctcttcctgcttctgcttttcctttgtctcttctgccttcttctgttccggcactagtgctttgggcttctgcaggtgccgcgggcttttcctcggcctttgcctttgtttcttcatttctttcctcctttttctttgcttctgcctcttttttgggccttttcttcggcatctctcttcgcttttgcttctgcttcctttcgcttcttttcttcaggtgaggtcggcacttccgcagctttctcttcctgcttcagcttttcctttgtctcttctgccttcttctgttccggcactagtgctttggcttctgcaggtgccgcgggcttttcctcgggctttgccttttgtttcttcatttcttcctcctttttctttgcttctgcctcttttttggccttttcttcggcatctctcttcgcttttgcttctgcttcctttctcttcttttcttcaggtgaggtcggcacttccgcagctttctcttcctgcttcagcttttcctttgtctcttctgccttcttctgttccggcactagtgctttggcttctgcaggtgccgcgggcttttcctcgggctttgccttttgtttcttcatttcttcctcctttttctttgcttctgcctcttttttggccttttcttcggcatctctcttcgcttttgcttctgcttcctttctcttcttttcttcaggtgaggtcggcacttccgcagctttctcttcctgcttcagcttttcctttgtctcttctgccttcttctgttccggcactagtgctttggcttctgcaggtgccgcgggcttttcctcgggctttgccttttgtttcttcatttcttcctcctttttctttgcttctgcctcttttttggccttttcttcggcatctctcttcccatttgcttctgcttcctttcgctccttttcttcattcacttcggcacttccgcagctttctcttcctgcttcggctttttcgtttatctcttctgcctttttctttctctcgctgtttcttcttctgctatttcttcaaacatttctaattgctttgctaattatttcttcactaatacctcctttttatttgctaattacctctaatacagctgtcacttgcccatttgagtctttttgttgcacattaattgcaattcgtatctcttcttctctttccaatgagatactctcttccctaacacattctacttttatctccattctcattcc

SEQ ID NO: 13760 - DNA, 1300 bp, Heterodera glycines
  misc_feature (54)..(54): n is a, c, g, or t
  misc_feature (61)..(61): n is a, c, g, or t
  misc_feature (63)..(64): n is a, c, g, or t
  misc_feature (73)..(73): n is a, c, g, or t
  misc_feature (75)..(75): n is a, c, g, or t
cggctccccttttcctcctctttggtcagtttctgttccaaaagagtcctcgantttcgtntnnttttggggntncccctttcctcttcttcccttcctgcttttccttccgtttgcttttgctcctctttgtcttttgctgctcctttcgccttctcttcctctcccttcgcttccattcgcttttgccttttttcccttacgctttcatttgccaatgcttcttcgaatgtctaaattatgtgcctcttcttcccattgccaaatttatgaattatttttcttcctagatcagatcaattcttagtccccccccctatgggctaaattcaaaatgcatttactgtaataactcgttctgttgtcccgtgtcccaaattacctcaacctttgcttggacttcttccttctgttcctcatcccttcccagtcgcacttccatttccagctgctcttcctcctcctcctttcccctcctcaattgctcctcctcctcccattttaattcctccgctgcttcttccatggcatttacaattatttttagcatcatttgctctgccacactctccgccactttcactaacactgcgtatctttctgaaaaacaaattttacctccaaaatttcatggcacattttcaccttcttccttctctatgctgatcaagtctgccttttgctgttgcttttcctccgcttcacttgctttttctgtgcctttctccgcttcttttactattaccgtatcctttatcttaccgtcctctctttctaccgtatcctttattctaccgtcttccccttctaccgtgtcctccatcatactgttcccactttctaccgtaccctcctccaccatttctttgcccttccccgttttggtgtccttctgctgctgttcctccacaactccgtcctcatagtcaacgatcactttcgtcccttggctgtccttgcccaatttgttcaccgcgtgcacttccactgaatttgtccttccatttaatttctgttggcttctctttcccttcacctcttccttcgattggctttttgaatgttatttgttcatgattctcgaccatctgtttgatctcgacgtttttgccatctttcacttcgaaattattaaccatccattggaattcggctaaatttggcattttcatctcaatttgcgtcttttcgcctttcgcttgccttttggcctcgactcggcccgcacttccaaggccaaaggctttccctgcccgataaaaggtgccttttcaaaattcgaaatgattttcggtgccat

SEQ ID NO: 13761 - DNA, 2997 bp, Heterodera glycines
  misc_feature (2862)..(2862): n is a, c, g, or t
  misc_feature (2874)..(2874): n is a, c, g, or t
  misc_feature (2909)..(2909): n is a, c, g, or t
  misc_feature (2938)..(2938): n is a, c, g, or t
ttcttaagattttcaaaagaatatcttacaaaaaaacatttcttatttcaaaaaactccctttttaagaaacattttcggcgtgctagggctgggacttttgctgacattctaaaattcatatgattatcatttctgtaaactaaaaagatagaaaaaattttcattttaatttatggtctcaggcggcgcggctccaggacaatcgggcagtaaaatacacaaaaagataagaaaatgccatcgccgaaggggacagattgtgccatatcagaaaaaaggaaaataggcaaagaaaaaaattcaaaagctcttaacaatctttaccagctaaccaaaattaacaatgcttcgcatagaaataaaacaataaaaaatgacaaaaattctgaattttctgcaattttcacgctttaactttttatgggttgcttaatcgcttcgaaaaagcttacaaatatattcgaaacacttagagctttcgaatgaagtaaaatataaaatttgcttcatttgactaacaaagaaaaatttatggcaattgtaactcttctgttcagacgtagttgacacctcaaaaaccgaaaacgttttcgaaattttcgaagaacgaggccaaaattgttcaatttattcaatacaataaatttagattaaaaatcggatttagcattagcagaacggcgagagattaactaaaattatttttctcaattttattagcgctttattatttttacatttgttttcatattttgtaatttttttatccatgtttatgcatttttatccatatattaaatacatttgactattcatcattaaaactattaaaaaaacccattttaaagataattcaaatttatcagtgccaatattttctcatttggtccgttcagtgtttctcttcgtctgatgagacaatccaaagcttgtccatgtcttcagtatgttcctcaagatttgatggcccggatctttgactttcaagccgttgatcatttttctccacggttggcaaatgttgcgatggcgtgttaagagcatctgattgaataatcgaatgttgcgatggcatgttaagagcatctgattgaataatcgacatgccaaatagctacataatttcaatccaattattattccctcgatttcaaagtccataaaagcttttccaatacttaaatcgcactattatcccacctctttgatggggcggatgacgttgtccaggatgggccactgtgtttcggcgtcccatttgtgccgatgccatgccataaattggcattttgccgttcccatactgctgcccaactaccgtggttgttgctgtctgtggaacgatgctgtttttgttcagcactaatttatgagagtggtgatcagctgctgttgctgttgattgccggccttgtgaggatgcaactgctaattaaaggaaaaaaaattaattaattaattatgtatataattcattacccaagccatttgtcagacagttaaataggagaattatgtgttactgacaataaaatattatcagaccaggaaaatggttccatgatcagatcacatcatgttaattattgctttgatcgggtctcatccttttgccgaagaagtttcgaaaaatttgataactgcaaaattacaacgccaaattttttcggaaaatgttctccgttcattcttattccattttaaatattccgttactgcccggagatgtttaactgagaatcgaacaatattttatcaactcaattttcggttatattttttgtatatgtcaaaataataatttaaacaattagtaattgggagagtaaatccgttcacttttaaattttttgcaatttgttaacaaagtttttcgtgacgtgcttatctgtgcgtatcaaatgcgcagaaattttaggcaattgcctaaaaaacgcatccctactaattggttcagatgtgaccattccgatgtgccaatgtcgagcaaatgtgccgataaaaaaactctcaccaacagataatccttcttcgtgcaattgttttcgctgttgttccatcatctgcttctctttgatctcaaaagtcacattccaagcagtgattttggtttcaagtgcttccatgcgcttcgcaaggctttcaatgcgtttctcgagctgtgccaagacttggtcggcattttcgaatttcaaaagtgggccaagcatttgctcaatctttttcaatcgctgatcaaactcagcggcagaaatagttggcctattatccgctgaagtctctaaaatattggcccatttatatggccattctcgaaatttcgaccaattttcgtgaggttttgagggattatgttgtccttttcaacgggatcgtgcgagatctggcattggcccatgtccaggcctgatccaggcctttaggagcctgggtttttcctggatccaggcccaggccatttttcggcaaccaagatttttcatggacctggattttcctggatttttttccaggaaatccaggtctttggttccgatttttttaaataattttttgaaattttgcggagttaaaaattctcttctttaatttacaaatttacctgttgatgaagcgattggcttttttcgaagtttggacaaaaaattgatattgataccgccgccaggagcacagcttcccaatgtttcacattcgcagtgcaatatcacgaaaatgatgaaaaatttgaagagcaaattcatttgttacaaaaattgcctttttaatttgcgtttattttaaatttaatttaacttaattactgataacaattaagatggaaaattgaaaaaatttagctaaataacataatttctanaaatattagtanaaaaataaatcctataatttttgaattaatctttnaaatcattgtaaaaagatatttttatctnttacaataatatttgagaaatagtaaatgctatacatctatgcaaattgaagtcataat

SEQ ID NO: 13762 - DNA, 782 bp, Heterodera glycines
aaaaaaaataatttggtaaatttttttttgaaaaattttaaaaaaaaaaccattaaatttttcataaaatttcaaaaaaaaattgctgaaaaattttttcaccaatttttttattttaatttttcttataaaaaaatttttctaagaattttttccttgaaaaatttgtaagtaggaagattttttttttgaaatttctacggcgagatttcgaccggcgagatttcggcggcgatattttgtctcggcgagattgcgcccggcgagattccggcggcgagattttggcggcgagatttcggcggcgagattttggggtgcaccccaaatttgtccgggtttgaccatttaaaaggttggagtgtcccccattttgttcatttttccgaattttaactaaatctttgcatatttttttttatatcgttttcagcgactatgaaaacctaaaaaagtggttttgagtgttttttggctctgtgccttatgataaatatttacctacaacaaaaagtcatgtacttattgaaattggttccaatgtcttacaattagtgtaccgtttacgaggaattttttggttttaaaatatatttctatttgttttttcaattttaaatggggcaaatttgcagaccaaagacactgcacggcacaatttggcttcatcttttgtgaatggtttcgtcaactgtggctttggaagcgattcgctgttcaagacggacaaaggcatcaacgattggctggcaaagcacaaagaatggagtgggaaaattttt

SEQ ID NO: 13763 - DNA, 2397 bp, Heterodera glycines
attttttcaacgagtacgaaccaatcgcacaattttcaccgccaaaaagctcttatcgaaaaattcttcatcggccgacgatcagtttcgatcgagcggcttcgtggaattaggcctattacatcggtagacgtacatccatttacgaaaaattttagggttttcgttaaaaatatcgttggaaaagccattttttggtatcgagtatagaaaatgctcgaaacccagtgcaaacactccaacaattttttaaataaattttcggctcactcccgaattttctcaggcgaaattgaatgagtgcccacgggatcgcgtcgttgtgaccatcagcttcagtcagctgtggtgccatgatgcaaatgacttatgaattgacaaaatttggaaagcggaagaagtaagcaaaatctaataatgcctgcacccagaaaataaattatcgggaaagtttagaaatttaatcaagggatgccaaacggcggtcggatgggtgctttctaagggaataccaaaaaaggggcggacgatttggcacgacccgatttaagttttctcccttcctcattaaaattattagattttgtgaacattttctgggtacgggcctaattaatacactcaatctcctccaacatcatgactcatgacaaattccaaattctagcattggccggcctgaacatgaggatgtgcaccgcaagtgcttctgattgagcggcggcccgcagggaggcgaaagaaggaggaaaatgttggaaagatcaaatttgatttctttttttttgctgttcgtcattggcatatttaatttaaaaatgataatatatagaggcggatttaattttatgaattgcttggagtaattaggaaaatcttattccttggcgtgtgaggagtttgacagtgatttgatttttttaaatttgaggcaggcgggtaatacctctgcatgtccctcctattttctgaaaaaaataaattttttagaaaatcaaacgcctttcctgggtcttcagggtctgattgactgacacccattctagggcaatggtgtggaattgtggtcccgacggaaaaaatagtaaaatttcaaaaagcattttttctagggtaaaaaaggttctagtcggttttacgcgtcccatgacattttacgcgtcccaacaacagtttacgcgtcccatgacattttgtgtccatggcacggatggcattccgagaccccaaaaattttcggaaatcggaattccgtgccatccctggtctcatggtattatagttgtcctaataactaagagaaaaactttttttgtcaggtattcagtaaagtttttaactataaatttcgttgttaaacctaaggttatcatgacaacttatacacaggcaactcgaacaatggcttattgttagactaggcctaagtttaggcttttgtaaattttttttcttatattagttgaatttctgttgacatcaataagtgtgcttagagttgcttttgcacttctcttttatatacaaccacgcgaaaacggccacgcgaaaacgtcctgctggcccgaatttaacaacccttgtgctcaaaaatttcgaagttcttgaaaattgaaaaatttttatatggaaacctggccatggacggtaaaaaagaaaaaaaagcgacaataaatctttttatggataattatgggaaaaaattggcgttctgtcacatttactttttatctttatttctctcacttttacgtactatctcttcattcttaataatgtaaagaacaacatttacttcatcctgtttaactttttttctgtttgttaaatccacaccaaattttgcatatcgattgagaaaaaaattctgcatcgaatgttctataaagttttaatgaatttctatcctattttaaagttaagggatgatgaaaattttgcatttcttttcctctaattttggcgtactattttcatgtctctaacacatgaaaaaacatcaaattcgctaattctaacaattttggtttataggctacaaaatcactttgaacgcttagaatcaatagaaaatgattagttttcgcattttggttgaaatcagcagtttaggacttgagttataacgtgatgaacatttgaaactctcacaacttttttctgagatgtcaaattgcttagcatttacttagaaaaagattctccttttcaaatctttttttagataccaaatttgttcatttttgttgggaatgaagcgtattatggctgatcaaaataaaaaaatacaaaaaaggcatttaacagtgtaagtgcatatactttgtttttgcgtgtgttggcgttttgtttttgccattatttttttggaaatttttttcgttttttaccgtccat

SEQ ID NO: 13764 - DNA, 705 bp, Heterodera glycines
ccttgatcggatgatttgtattctttttccccctttactttttgtgccaacaacattttagttaaaggtacatgagaagagaagggtctctcttaagggagtcttaaggtagccaaatgcctcgtcaccattaagtcaggtagccaaatgcctcgtcaccattaagtcaggtagccaaatgcctcgtcaacattaagtcaggtagccaaatgcctcgttgctaccacaaagtcaggtagccaaatgcctcgtcaccattaagtcaggtagccaaatgcctcgttgctaccacaaagtcaggtagcaaaatgccttgtcaccattaagtcaggtagccaaatgcctcgtcaccattaagtcaggtagccaaatgcctcgtcaccataaagtcaggtagccaaatgcctcgtcaccattaagtcaggtagccaaatgcctcgtcaacattaagtcaggtagccaaatgcctcgttgctaccacaaagtcaggtagccaaatgcctcgtcaccattaagtcaggtagccaaatgcctcgtcaccattaagtcaggtagccaaatgcctcgtcgcgaggttgactggcagcggccggcgcaggcaagggagccgagcgaggtggactggtagcggcaggcgaagggagcgatggctcctttgtgttgagggctggcagcggacggctcaggcaagggagccgggcgagg

SEQ ID NO: 13765 - DNA, 2861 bp, Heterodera glycines
caatcgactagtgtttaaggttttgactttgacttgctttttttccatttattccaatcgattagtgctttaaggtttagtctttgatttgcttttttttcattttttccaatcgactagtgctttaaggttttgactttgactttgctttttttccatttatttcaatcgactagtgctttaaggtttagtctttgattttgctttatttttcattattccaatcgcctagtgctttaaggttttgtctttgattttgctttttttccatttattccaatcgactagtgctttaaggtttgactttgactttgctttatttttcattttttccaatcgactagtgctttaaggttttgactttgactttgctttatttttcattttttccaatcgactagtgctttaaggttttgactttgactttgctttatttttcatttattccaatcgcctagtgctttaaggttttgactttgactttgctttatttttcatttattacaatcgcctagtgctttaagcttttgtctttgattttgctttatttttcattttttccaatcgactagtgctttaaggttttgactttgactttgctttatttttcatttattccaatcgactagtgctttaaggttttgactttgactttactttatttttcatttattccaatccactagtgctttaaggttttgactttgactttgctttatttttcattttttccaatcgactagtgctttattttccaatttgggatttttttgtaatttcgctcttttggtcatgaccgtcaggggcaagtgctggctagcgctttgttccttccggtatgcggcagcacaaaatgcccgtctgccgcttgcggacgccagaccgttcgagggggtctgtggcgctggggataactgtttttggaatctgttgagcttgacatagttaattaaagagtttgaagaatacgcttggtggagcgttagtgcatggaatcaaatggtggtagtagcaaatattatacgagcgattagccatgcaatgattgcaggtctaagaggtgtcaggagtccaagcctctggactttaaactctgaggttggctccaccgagcagttgccgacgtacactaaaggtggaatttacgtggtgccacccgtcgcttaaggcaatcccacaggtgacaataagtcccgttggcgtccattgacgtcccgctggcatacacctgttggttaccacattcggtggtcaagggccggtcttgactttgcttttttttcatttattcaaatcgactagtgctttaaggttttgactttgactttgctttttttccatttattccaatcgcctagtgctttaaggttttgactttgactttgcatttttccatttattccaatcgcctagtgctttaaggttttgactttgactttgctttttttccatttatttcaatcgactagtgctttaaggttttgactttgactttgctttatttttcatttattccaattaactagtgctttaaggttttgactttgactttgcttttttttcatttttccaatcgcctagtgctttaaggtttgactttgcttttttttcatttattcaaatcgcctagtgctttaaggttttgactttgactttgctttttttccatttattccaatcgcctagtgctttaaggttttaactttgactttgctttatttttcatttattccaatcgactagtgctttaaggttttgactttgactttgctttatttttcatttattccaatcgactagtgctttaaggttttgactttgactttgctttatttttcatttattccaatcgactagtgctttaaggttttgactttgactttgctttatttttcatttattccaatcgactagtgctttaagctttgtctttgccttttatattaaatttaaaaaaaaaattttaaatttcttttttaaaatttgtaacaaataatttttttaaaattagaattttaaaaaaaaatttttctgttgtgaaagtgcggaatttaaaaattttaagaacaaaaaaatttcaataactaatttaaaaaatttcattattaaaaaaagttaaataataattccagaatccggattctgacttttcaaatccggaattccggaattctgagcctcgcgttccaactgagcacgggtgccacgcatgcccattcgccaagcctcgcgttccaactgagcacgggtgccacgcatgcccatttcaactgagcacgggtggccactcatgcccattccaactgctcacgggttccaactgagcacgggtgccacgcatgcccattccaactgctcacaggttccaactgagcacgggcgccacgcatgctcattcaactgagcacgggtgccacgcgcatgtgccggtagctgctgctgcacgaacatccagacacgcatctttcgtcagctgctactgcactaacaaccgcaacggtgcacaccttacgcatctacacctcgaacggctagggcgcggctggctaaactgaaccgcgcatgccctcagagcggctagttatctatatataaaaaaatggggggggctctttgcaaatgtggcccgcacattgcgaattctgcacctatcgacccaattctttttgcgttagccaactgatctccccttactccaacttcaccgtgcaaaaaaatttgggaggccctcggcgctgagcaacgctaacctgttttcgctaagtgttgcgcagcgccccggcgcgcacagctagcggttgggcgccgcttggcgaaatgcgtgccatgccgtgggggagcattttaaaaaaaatttggcc

SEQ ID NO: 13766 - DNA, 1642 bp, Heterodera glycines
gcgaggccaccaagccaattttggaaagaatctcgctgaaggaatcaattttgagtccgggaggaatgataaaattgaggcaaatcacaaattatttgtttttttattattttatttttctatttcttttgttcgccaatttgtcctttttttctcgctctgccttatgccatttccacccatttttgccttgcgcagggcgccggacttttcgacagtggatttttcgacagaggacttttcgacagaagttcttttcgacagcaaaggacatttcgacagaaatattataaaaatgggcgccggacttttcgacagtggatttttcgacagaggacttttcgacagaaggacttttcgacagcaaaggacatttcgacagaaatattataaaattcaggaggggacttttcgacagtagatttttcgacagtaaaaagtaattaaatttcacatttagttgtgtaaaagcgtaaaattttttccaaaaatcaacaattaagccaaatcagtattgagatacataatatttaaactcttaattaacaaaaaaataaataaataatttttggtgattatttttagaaaattttttaattcttattgatgtatttttgaaaattttaaggatcgattcttaggggtttaatttttgtttttattacatttttattcataaattttgagcaaaaacaaaaaaggtcaaaataggttttgttaaacttcttagggttcaaagaaaataaaaacgataaaataagtgctaataactcgaagagttgcttaacaatcaccaaaaaacatattttccatgctttagggccactggaagttcagaaaaaataagtaaaatctaaaaaacttatttctatgtagtaatattatttagcaatacacattaatatgttaattaaaaagaaatttagtaaaactgacaaacaataacttgtttttatgattactgtcgaaaagtccattattttttatttttctgtcgaaaaatccttcactgtcgaaatgtcctttgctgtcgaaaagtcctctgtcgaaaaatccactgtcgaaaagtccgggagccctaggaatcggctaacaacaaaaagccgtggaaagggaattcatctaacaataggcaggcacattaagaaataacaattagctaattggcctgggattaggctagttgaaacaatgaggtttcagttgcaaatagcttaaagttagtaaaacacagccaatctctataatttgaatgaaatttaaattaaatttttttttggtcaaaaccgacaaggcttgtttcacgaatcttccaaaatctcagaaaaaacgccacgaatcgcggtccgctccacccctgctgatgtcagattagtgttcagcaccccggaaaaccctaacatacaaattttccaccaaaaaaattaaatcagaaacccccattctcaggattgtctaaaaccacggaagcgcggctttgtgccatgtagaaggaaattagtgtttatgaatggacaaatattgccttttctcgttttatcgtataattacagtaattagcacaaggaatgtaagataaagtgaagtggaaaatagggtcatcacttggaatggaataaaggacactaacaacaataacaat

SEQ ID NO: 13767 - DNA, 1580 bp, Heterodera glycines
  misc_feature (1546)..(1546): n is a, c, g, or t
ttgccgcgttcatccaccgcgtgacccttcagaaattcgaaagtgccgaaacgaaacgcggacttggggatggaaccgtagctgaacaaaacgagggcaaataaatggaaacagtttggcaaaacgtacagcagaacggacagtccgcggtaaaagccggaaagtccgtgacttcggtacgtttgtttgacacaatcggcggggccctggaaaaggaatggacaaaacttcaaaaagaacaattagtcattaatcatcaccttaaattttggagttgccgacctttcatccaactgaagttgcgttttgacgtactcagtggggtaagtgatgcaaatttcgatgcctcccgtaatccctccgatcacaactcctttcattgtcctctctgaaggagcaaacctaaaaggaaatgcgaaaacaaattccccttgaacacaccttcgccatggagaaacagcttccttttctatgttcggagaagtgaccacttcagtcattgggcaattatgtcaagaaatttttaaattgtaccaaatggaaaagagtcaaaaacaatttgtttagctaaaagagaatttaaaaattacgattcatagggcaaatgaaaaatgggaggaccaatctttcaatgggtggggcggtgaacaaaacaatgcatgtgcatattacaacactttaaaatggaaagaattgatgaatgcaaagataaagggaaagaaatttgaaaaaggaaatgcaaaaaattaagcgttcttcgaaaatggtatgatcaattaagggggattgtaattaatttgaaaaagaacattatgtcattgcataggatatttggggctcagaaaattgagtacagaaggaaaattgggatattaaaatgaaatcttactttcaaaatatttcaactaattaaaaaagcattgcatagcttgagattgtcaagttttgcattttgagcataagaagtttttaaagaaagcctgtgccataattatacgttgtgccatataaggacaaaatcacaacgtaaatcaaagaatgtcttcaaatcctgtagaagggactgaaaacttgggccaactacgccaaacggcaccacaacaaacggtgaacatatttttacttgctgaaatttcttgctaataattccaacaattgcttgtattttgagactgccgcggatccgtcgtcattgaattcttcgaattccgctgccgttgaatcaatggattcggagggtgtttatctttttgctgaccgtacccaatcctccaactcgctcacccccgaacaggccttcgtccacatggtcaaggcaatgcttggcaccggacttctctctctcccttatgcgttttcccattctggtctttatgtgagccatttctccacactttaatcatttgcctcttttcagcttggtttaatccttttggtcttaatttgtcttgtttgtatgttttgcatgcggcaaattgtttttgcggcccattacatttgtacaaagttagtcttttttaaatacattcttgattaatgttttctncatttacaggaatggtcgtgagattattgactat

SEQ ID NO: 13768 - DNA, 1005 bp, Heterodera glycines
aaaaaactataatttaaaattaaatctcagagttcctgaaaagtaaagtgctcactaattgatttggcgctattccattttacgctgtccaaaagagcaaaaagactaaattaaaaaagaaaaaaactttgagaacatgaaattcagcttttttcgagtatatcccaaaataattttgtatcagttgtctttatcccagaatttcgacataaaaaattctttaggctttaagccttcctttgaccttgttaaaataaatggctccataaaccaacgggatcatatagcccatattccttgtgacatgcacacaaatttgtgcccaaatcatcagatcggtgaaaatggctttgtatggaattttttgtcgcactttttcagcattgtttaaggctaattctgtttgttcaattaatgccaattccgctttcgacacatttctaaaaatatgtttttttgagtgatttatttattcaaatcacttttgttggcgtggtgtatcacggtaaaaaagcaaaaaaattgccgaaaataataatgtgctggtgcctaaaacgtagtaaactgttggccatccaaatttttcagaggtacacaaagcggctgctaatggcattgttatgacagggccaaactgtaattaaataaaaaaatttaaataaattaagtataattaatatttttttcttgcctgaaaatttagtgtaagcacagaaagaaatattccataggtatctggtggactccaagatgaactgattacacctaaaaaatgggatttaaaattttttttaaaatattttttaatcgtaccagctcctgaccagccaattgaaattgcaatacccttaaaaatatttaaaataaattagaaaaaaattcaggtaaaaacacctgcaaaaattgtagaaaaagcaatgggaaaaaaccaccaaattttactgtcattggtgtaaataatgtggaaagagtgcttatcaaaccataaactagcatagtgtagct

SEQ ID NO: 13769 - DNA, 3146 bp, Heterodera glycines
aagggcactgccattttgtgcatcattttcatttgaatcattttcttaattttttttttgttgttttttaccagcaatatgaaaataatttataaaaatattcgaaattttgttcaaaaaataaaatttaaaaaagtatttatattttcaatttttacggaaattttataattttgtgagtattttcgagcttattattcctttttttttgtttaaatttatatatataatttgagtgtttatttaaatttttgtgcttgaaaatactaacatttaatttaattatacataaataggtaaataattttttctaataatttttccaccttttaccatgcaaatgacggtgaaattaaaagccaaccaactgctgaaaataaaattccatgtaaattaataaattaaatcaaattaaataaataaataaaaattatgaaaatgacctggcgatcagcgacaaacagattgtgctcaacactagcacaacatatcgtgtgatgccaaaacaatgttggaatggtagacaatcatttttagtctcattgtcaggcaaaatttttgtaactttgcacatgccaacgcttttaattgaattaaaaaataaaacaaattaaaaataatataaaaaaattggaaaagatttctcaaggaatttgtccccactctctgcaaatgctaataaatgaaaagcattttcttccccgagcgcatccttcccgaccgaattgatttgtttgctttgcttttgtaagcgactgtctggaaaaggttggacgatgtgtggtgacagaacataccaaccgcgagccgaggcgatttccattttttcatctttttttttttgtgtgcttaaaatgttctttgctttattggaaaaatcgatcgatgggatgaggacatccccaccacaaagtcgggatctcgacataatataaacaatttttatggaatttttgttgttttatgtgagaaattgggcacggattttaaacatgaaagtttgatgaagtttgaagaaattattaaatgttaaattagaagaaatacaaaaaaaaaatattataaaagtaaaacggaagatctcaagttaaaccaaagagaaattaatctgtttttgaattattaaatttttaatgaatcatgtgtgtgcgaaacaattttcaataattcgatttaattaaaggtaaataaattcgggatctcaagaattaacaaaaaattaatttattggtgtaacatggatagaaaaattaaaaaaaaccaattttagaaaaccggtataaaataaggagatgattttttaaattttagtgaacaagaatactccattgcttacacagctgtcgaaaattaatgtgtatgaagaacaaaaatgggagcaacagctgctggctggtcaaaagagtcttcattttcaagaaaattttaaaaatttaaattatttaactatcattcttaaatatttaaaaatttaaattatttcattattatatatttttaaatatatttatgaaaatattttgctgcttaaataaattaggtggtataaacaagttaatatggagaatttctttgtttccatggctacaaagtcgaaaataggttttgattagaaaatgtaattgaaaagttggaatttttggtgtttgatcaaatttctccgcatactcgaataaatagtgccatggttctcgaccaacttttgctattagtaaaattggtcattttttgtagtcaaatgagccatattaaatttaaaaagtgcttgctgccctaccttataagttaattacttgggctgggatttttaagcaaaaaaaaaaaaaatagcaacgattcattttttatctaataaaataatttctatagcatatcaatcaacaaatgatgacatcatcggaatcgtcgcaatgcacttaaatgcgcttgtgagacccgctggtgccagggttactaagcacactctcagagtcatgcacttgcggatggtctcctgaaaaaaaaaatttattaaaattaattaacttttaataaaaatttaattacccttgagagtgcccaagctgatttgcccaacatgaatgcccagcgcagcacagttggtgtcaattgtgccaacttgttctcggaactggacagccaaattggccaattcggcgttggcaccgacatgggaagcggcggaagcggcaatttcgaacatggcacggacgaagccgagagagcgagcacactcatctaattaggaaccaaattaatagaaattgaatttcaattaaaaaataatagatgattttaaagggatttaattgtccattggtaccagatgatgattgagctgcgttgatctcgttgatgagtgtttgaccaccattgccagggcaccaaattgttttcagttggttttccaccgcagcggcgactctttcggcactcagacaaagcgaagactttggcatcgaagcggagaatgtgccggtgtgatctttcatcatcgaaacaacatgttggctgccaggacagcatggatctttttaaataaaaatgattttaaataaaaaatttttaattaatacggggtgctgaaaagcagcatttgcacagcaaacagacaattgcgacgatggaaatgagtgaagagcagaaagatgaagcaattttctgagaggatttgaattcttagaggatgagtgaatgtgatttgaatgatggttttttggcattttcttctgcgtttaaatatgcaatgaatgaaaggttagctaatgccacttttaagacgtggatttcctccgacaaaaaaattatattaaaatattattttgttataatgttttgcttatttgtaatatatccgcatgaaagtgaaacatttgagttcataaatttttgtaataaataggaaattgctggctggaacttcctcttaatagtattcatgtgaattataaaagatctttctcaattataaagataatcaatttcttctaatgaaaataaaatttctgaattttattttaagacttatttgttaatgatattgaaaagatcttttattatcacatgaatcaccataaaaaaattctagcaatttcctatttattaccagaatatttatttcattaaaggaaatcgaatatctcact

SEQ ID NO: 13770 - DNA, 1430 bp, Heterodera glycines
  misc_feature (1403)..(1403): n is a, c, g, or t
ttataatacttaccaatacgagaaagtcatcatcatcttctaaactatcaaattaagatttgttcaaaaaattacgtaaactaaaaaaattatggacctgagaactaaaaaaatggttttttcgaatatatttgacaataactttgtttaaacgtaatgaaattttttgaaataattcagaaaaattagaaattttattgtaccgagtgatttcaacaattcaatagatacccttaagtaaaagtaataatatgcttatattttacagttaaattttttagttaaatagcttcatagaagtaattttttaaattatttttgtatgaaagataattaataatgtaattaaattagaaaacatgaaaaaaactagacacataaaggaactttctaatatatttatatacattaatttaattgaatataaaagcttttcataaaactttacatatttaaaaaaaaattttcgataagactctaacacatttatttatcgcaaagtcggttttacatattttttagaaatattcaaattatttcttgatttttttttacttttaaataaataaaatagaatatattataaactaaaaaattgagaaattataattcatttatttaccattatttttgtaaatatttttttatttgatgcaatacataatacgaaagaaatttagcatttgtcagattttattttatattaaataaaaataattataattattgctttagttattttgatttaaattattatataattacctaaatcattatttcacattataaaatatttaatattttattacatattttcttgagatatttcgattataaccaatgtgtatgcatattcctttttatgctaattaacacttttggaaactcaaagaatggctagcaaagtttcattcactcgtacaagtgccggacatcctattgcacaggctggcccaaaatctggcacatgttcagataatgaaaaatatataattattttatttattttattttttatcttggaacatttataaaattctgtcttatcacttattcaattggataaaatggatttattttgttttgttttttgttataatacaataaataattaaattttaaaagaattaaaaaattgatgattttatataaaaattttgtttttttcaatatattaatgtttaattatattcgttagaatttacttaatatttttattttttagcatgcaaatggaactttttttaataacaaatcgtttccttttatacccttttaaaattaacatattcgcgttatgttgtttggttaaattttggtccaagaattatgttcgttaatattaagaaggttaatttgttatataaagataaaattttcatgggaatatttttgtttaaacnaagaatttgcatatttgatcatgcaac

SEQ ID NO: 13771 - DNA, 2310 bp, Heterodera glycines
acaggtttttattttgcattgttagataactaaagcatttggatatcgtcgagtgtattccataaaaaacattttaattttgtttttacctttttagctgtttgagggctcaactgaaattatgggaaaaggctaaagcgtttatcgtacgggaaaatgtgagcattcctcgcttttacttcgctattcgccgaacttgaggacttcatcaactgtcaatgggaggacaaagaaggaagaaaagtttgctcaattttcacccacctgtaatacacacgccgggaaaaattttgtaattttggatgcgatttgttaacagattttgtccaaaaaaaccaaaattttttagcgattttgagcaaaattttcaggaaaataaggattttagagtccggcgctgcagatatgcaccgaaggaaaaatacgtggacaacaatttctaatctaattttttcacaaaattcttagaaattgttgtgtcataatattacctaaaagttttaaaataatattttaggaattaaaaaattttttgataattcttttttgaaaaaaataaaagtcacaaaatgaccaacttttacgttaaactttgaaaatttaattggaattttggagatctgtggaaatttttgggatttttacggattttttaagaaaaattagcaaatgataatattttttaatttaaaattcaagatattaattaaaaaatggagatttttcgaaaaattatcatgacttcaatcccgcgggatcccgcgggattggtaaaatggtcgggagggatcccggttcgggatcccgatgaaatcccgatcccgatcaatcccgatgaatttaaaaaatccttctggacggatcccgaggtcgggatcccgaatttaatcccgcgggatcccgtagaaatcctgcgggatccctatcccgtccggtctctagttaataacaaaagtgcttaagattataatattaaaaaattaaaataattccatgatgcttaagtaattattaaagtttccttgcaaaaaaaagagcaaatgtaatttattcaggtaattaaacaaaattaaataagtattaaatgcaaacaacaaaataataaaaaacaaaaattcaatttaaagattaattaaaattgaaagcatcatattttattaaggacaataatgattatattaattaaaacaaatgttgtaaaaaatgtaaaaaccataaattattttattgtttttaacttctgtatattttcgatttttattagtcagttttccatattttatattttgtttgattataattatggttctaattcatttatttctttgttatgattccaattaatcaaggttatttcacgtagcttatagattgtgtaaaatcctccagtagtgctaggaaatcgaatcattaaattttttgtttcttttttcaattatatttcattcattaattaaattaagttctatatttcatactaactgtttatacaaaactacattttttttctctttttttttcatttaaagtttatattcttttataatatttttatgttttacgcattttgtttttgtcttatttcaatcaacaaaacacaattttttttcaagtatccatctgtttcaaattgtggcgaaatttaacaaaaattagtatttcatcgcgcattacaacccaagaatttgagtatttaaagagaccaaaatttttattatcttataaatttttgacttcaaacattaaaattatggcgatttaaccatggcgacaactttttggtttatgagtcctcagtaagctttaccattagcataggatgctcctgctggataaaatttatgaaattaagtagtccatattttatttctgtttatgttatcaattttcaaataaattaattcattacaacttttataaaaaatgtttattcaaaatctatttttttatcaagccccaaattcaaaatctatgaatacagaacagtcttgaagcaaaaaatctaaatttagttttcatcatataattattattttttaacttttaatcattaatctatttttctgtatggatattgattatcgttttttaaataaattatttttcaaatgactttgatttttatttacttaaattttgattgcttgataaatttcagattctgtttaaaaattaaaaaagtatattttattataatattaaataagttattagcaatttttaaaataaatagcaaaatttacgttaataataggcatcgcctgattgagcgcgcatgtgggctttctgaagattggacggaaaattttt

SEQ ID NO: 13772 - DNA, 2870 bp, Heterodera glycines
ttcatttaagcaaataaatgtttatggatgtaaagggggacacattaagcaacaataatcggacatttgagagatgtggggaaataggacacaaacaatcaatcaattagcgaagaaaagtgttggaattggagggaatatcaaataaattaattagttttccaccacaaaagccgtgatttaaatcgaaacaacaaaaactcaaacattcagagagagatggaaagaaaaggacggtttatttccttgaccatgtttatgatcagaatggtggtcaaccacctaaaaaattaaaacatagcccacacaaaaaacaaatgactccgccattggtgaattatttatggtaattttgatcactttacacaatttcttgaagccgtggtgacggttggcgctgctgttgaacatttgttgtcgctgctgccgccgtttccgcgttttgttgcggcgcaaaattcctcttcaacatctgcaaaaaatggggggattttaaaaatatggcaattggaatggttagaaaaatcaccgagaaaaaggcccatcgcgtgatgtggttggtcatctcctgcgtactgctccatttgcatcgcaaatacccgtacagattggtgaaggtcatgcctggagaaagatggaaatgggaaatgtttaaagaattggagcgtaaattacgattttttcggcgataaaaacgaaaaatcgctgattttttccgaaacgagaagttatggtcaaaaatgttgggaaaccaacgaacttagagattttgcaggctaatttagaacacataggtatttgccgcctgtttctccccaacaaacagaaaaaacgaggacatcaaaccaaacggtcggatcattaccaagatagaaactgtccctaaaatttttgggccgacaaagtcccgaaaacgttaaaatggttgctgttttggcactgacctgctccaattgctgcgaccaccatccattgccagtggagcgtgaggaaagcggtgcacaccaacagagtccagaagaatggggccaccaccaggccggcccagaaaattttgcgctcaaacgtgtcgtaattgtcgggttccttggaaaggagaaaatttatgggatgacactcattttttgaggtggtaaggcatttaaaacacgaagaaaatgagagaatatggaaaaaatagtggaaaaaacctgggaaacttcaaatttccaatggtttttgccgtccgcgtccaccaaactccaccagcgaaggccggccaacagacgacccgtcacatttttgacggcccacaaatccgcggaatgaagtgccaactgaaaacgcaaagaatacgctaaatcaaaagggaatggtcacgaatttggcaaatttcgttcaaaagtgagtcgaaaacttggaaaattggcaaagcggtgcctatttttaaattttttaaatcgcgctacaattttttatgaattgagggccgttacaaaaacaggcatcagccgaaaaagtgtcgtttgatattcaaattccaaataaaattaagcggagcccaagtcgatgtcaaaaaaaacgtatcgtaaaataatttaccaaaatcagaaactgaatgatgaacgaactgaagaagaaatcggccaacacataaaagacaattgcgccaattcgaaagcccaaatgggccaacacaacgaagggatgtctggcaaaaagaaaagaaaattaaaggtaaaacaacaattggggggggggaaattcggtattttttgcttagattgaataatttcttttttccacgcatttaaataattgaaaagcataattaaacatgtgaaatgggcccttaatttgagcacataacccacttcagtgctcgaagcccagtcagaggcttttcttcaccaaaatccatttgtgtctcgaaattataggccatacattaaagctaaaatgtggaattaataaaaattaattttaagtaataaaataagcaaacttttaagcgtataaatcataaataagccaacaaaagcatcaattaagtaaaagtgttaaagccaaagagccaacgcaaaatttattttttttctttggtttatttttaaaaatttatttgtcataagaacataatgccatagagggttattttaaactttcattgaatctcttaaaataatatacggtatttcatgttgagaattactttaatttcaaatatttgttttattttcttccttttccaatttctttgtttgcatttgctaaaatgaccaaagatgcaaaaattttgctgcatttttataaaattctgtccaatatgttcagccaaattttgtttttccgctcttatcacaaaagagacaaaaatcggagaattcatttcggggaatccctccggcggcggcggggagtccctctccccccccccccccccccacaaatatttgttttaatttttggtcacattttaaggcaataaaaatataatggacaaattggtgcctgacaaattcagtctctaaaaataggaaaatgccggatcagcgtttgatcaatgatcagggtatagggaaaatttttggctatgttccaatttaggcgtccaatcagtggcctatttttgggttcaagaatgatcaaaattcattgatcagatcactactaaacgatttcatttggctaaattagctttagaaaatttcaatcgggctatattttaaaaaggagtttgaaatttttgatcatacatttgctcaattcaatgatcatgatcagcggcgggtgttctttgatctgccccactgatctttggttttccctggaaaacttagaaatataaaaaattcctttctttaaatgggaaaattgaaagtgttaaaagg

SEQ ID NO: 13773 - DNA, 1994 bp, Heterodera glycines
  misc_feature (24)..(24): n is a, c, g, or t
  misc_feature (1704)..(1704): n is a, c, g, or t
ttatcagttttatcaccccaattntggtgaatttcccttccgttttttgttttcaaatttgtccattgaaccgatcgattctaaattcggtcccggactgaattggcgacgtttgttttgtccttttcccgctggagggtcacggcacaccaacggacgctgcttatcattagcgtcaaatcatgggacacaatacacacacatacacattaataaattggtcggtcgcctctccaatttgggacaacaccccccggggtccaataaacattccctgccccacccctcggggggtattaattgcatttcaatgataggacaattaaatcaaagggaaatgggctccccctatcctcactgtttgctgctcctcattaagctgtcagtttcattaaagttcaaaacataaatgcacttcttgtgaggctcgagaatgggagaattcccatttggcccgaaaaaaatctcgaaacttttgtcgacgccgaactctcgagctccgtgaacattaaaacacttaggatgaaatcaggttaattagtataagccgaagtcaaaaggacataattttttgagggtggcgggcactcactgatcactttcccatccataaatccctgatcaaacttcaactggaatgaatggccaacagtaatcctaatcagtctctgatcatagcgagactatttaaatgatcgcgaattttctctcaattccaaaccttttaatcagttttggatttgatcgatcagccagtagatgatcaatttttctatctcatttcaactttatctttactttcggcattttcatttatttttccccggcattttcccagatttttcttcaaatttccgcattttttcccgccattaatgagttgtggcttatcttttcccccggctttttcttgcctcttctgtactttgctttttaattttcgttttttcagatttactttccaacaacatcccaatccttctttttcttcctcttcctcaccctttatcccgttcatttgtccaatttctttcccctaattaatcccctcaaaaagtgtgtgccacggcccgtgagttcctttccatgcttttccccgtgtgcccctgagggggcgattagcgggtgccgtcgtcgggcgcccgactaattgcttgcccgggggacacatttccgccactttttgcgcccaatggaatgaaaatgcccccgcggggcgaaactcaactcggcacagcccccgggaagaacacattaacacttactgctcaaaaagcttcttcctccgcactcgccgcgccagcttaacagaatataaatttgaggattttccagccaaatttaaatgaaatttaaactttgattaaaacttcaaatttttaatcttacggggtaaattttatcaaattaaatttcttccccgactgtaacctaatcggattttatttcggtttatttcattttttcggtacgcaacattcgtttcccatggcattcgcttcttttcatcttcaccgacggaatggtggtatccgaatttagcacttcatctattttcattagctgccccgaggcacaatgtgagaatgagtgaatgaatatggaactccgagccgcgggaggagggtaattggacggagaggagagagagagagatagagagagagagagagggagggagggagagagagatagagagagagnagagggagggagagagagagggagggagatagataaaaagggaaagaggaagacaaagagagagagagaggagagagagagtaaatgaaatagtggcctagagaaaagaggagagaagagtgagaagtaaagaaagaagaggcacagaaaagatagagcgagagagagagagaggggagagaaaaggagagagagaaatgagtgtgtgcacatcagagaaacaaagaaggtacacagaagagggacacagaagagagaatattcgaaaaaatgcatgacacacaagaaaa

SEQ ID NO: 13774 - DNA, 458 bp, Heterodera glycines
caaaaactgccaatttttgcgatttttaacaagtggacgactttttttgtttataaaaaaacgtttttttcgcggcgcggtttattaaaaaaacttttaggggacaggggggttcggcggtgccgataggcgccgccggaaaatttttttgtaattttaatgctatttgtaagcagattttgtctaaaaaatgaccaaattttgagatttttggccaatttttaaggaaaaaataatattttttgggggccggcggtgccgataggcgccgccggggaaaattttaagaatttttaatgaattttgttaagaaaatagccaaaattttcagaaatttccctcttttccccttcggcggcggcgaccccccccccacctctcacctcttttacaccccccccccccctcggtgcgaaatgggcggacattttgggccctttgcgggggaaatggggggt

SEQ ID NO: 13775 - DNA, 2611 bp, Heterodera glycines
  misc_feature (2567)..(2567): n is a, c, g, or t
gatgacggcaaaggtcgacttttgccgtcccttcagaattgaattattaaaacaaaaattgttcaactgattcttagaaaatcaattaatattttttatcaaaaagttttagaagttacaaaaattaaatattcaaatttttaaaaaattatttgaaattttattttttcaaataattattttcatggaatcaagaggtcaatttaaaaaaataccttctaaataatattttaagattttttttgctagatttatttatagtttttatccaaaataaatttttagattttaacaaaaatcttatggagatataatattaatcgcgatgagacggaattgaacatgagcagagggataagagagggattgtctagtttacagggccaatttcacataattttaaagaaatttttttatgttttaaaaattattgaaaataaatttcaagggttttagagattgctgatcacgaaaatagcatccatttcaaccagttccgtatccctgatccaaactcgaacaaaaagtcgaaaaattaaaattattgaatttgagtttttgggtcgaaccatattaaaatataaaaaaaaaagaatttagtcaaattcgttataaaattagtacatttgttgaattggaaggaagagaaaattagaaggaaaaaccaaaaataaaattttttagtaattttttaagataaaggctttttaaaatcccagagagaaattccaaagtttttcatttttatacttgagatggaagcgaaccctagaccttttttgttcaacagcaatcggcttatcacccaaaccattcccttttgttctctatgcctctgctttaacgcgtttaatcgttcactggcccaatccttacaatattttagttttttttaaattttcgtgggtttcaaattactgccgccaatgggagagtattctaaccagtcagaaatttgcaacacgaattaataaaagatcctagaaattgcctgcgatatctccaccatcacattgccccggtcgcacatttgactgatctcaggcatagctaaaattgaaaaaaaaatcgaaatttctcaaatttctattatatatttattaatatttgctcaaatttcaattaaaattaattaattatttattatcttttatggttaatattatcaaattgttttattttaattctttttattttttgtataaatttatttattaatcttaaaaaaactgaattaaagcgcaacaaattccaaacgattaaaatttgaaggatttgaaagttaatttgtgaattttagatttaaaattttgcatatatagcaaaagtaattcaaattaattaccatgaataaaaaaaaattatagattcaattcatttgttaccattttccgaaaagtttgccgctgttttttgctgactccggccacaaaattagctttaggcctgcttggtactaggcttaggctttttttgtaaaatttgttacagtacatttagctctattgcactttaggagcccaagcgacttttatgagtccaaaagtattttatgagtccaatcaaataacaatacctgatttttataccgtaactttgttcatgtttgaacaaaccctaatttttggtatcattcgaaagaacaaagtctgaacaaggtaatataatacgagaaattaagagaatgctaacatttaaagaaagttacaaacgaaaataatcaacaattacttgattaaacatttgctattgcctaaatgctgagcttttatatattttagcttctttaggctttatgctttcgaattatatcaaaaagatgggcttgttggatatgaacaacattattgtataaaaaccaagtattgtcaattgattggacacataaaatacctttggacatcataaaagtcgattggactcataaaaccgtaccttttgacttttgtacgaattgactattctacgagttgctttttgtacgaattgtcttatacgagttgcaattgaaccgagtttgaacaatgctaggtaccaggactggctctcccacgaatgcgcatttttctcaaaaaattaataattggccctaaggctaacagaaagaagcaatcaaatgttctactattaaattcgtacttggcaattcagcgacggttcttggccctggtacactggacgacacgcggcctgggcgcctgaaaaaaattcactaattagcagtaagcagtatttggtacaattgcactccaatttgccaaagttttattttccttttttatgctataattatttttaaaattaacaatttgacattttacccatggagatgacgggatgaatgagcccgcccagccgcagtgcttccacgaaggagttggccaaactggcccaaaaaaggacggattgccaatgagtgactaaagattgtttgtatacatttttggcattatgttttccgcgtattttaaaaagccacaaattcataatttattttttgtaaaaatatttaaatttctttcattcattttttgagctattgattcttcttctttttaattttccgnaaattgatctatgtgcttcgagttttttgtgttagcaccatttt

SEQ ID NO: 13776 - DNA, 1324 bp, Heterodera glycines
aaattcacgtatttttcagcagccgccccacaaatcggcctccgactcacgcgttgcagcactatccgccgacgcggcacagcaacaacaaaaccaacaaggacaggaaggcgcgacaaacggtggccgaacgggtggtggtaatggccgaagacgacaacaaagccaaccgcagcatggtttgcaaaaatgaatttatttaaaaattggcaattttacactgggggggggagtttgcttattaaaaaaaattgcggggtttttcggggtcgctgaaaatgaagaatttagatattttttttggaaatttcttattaaaaaatttctaataataagatttttcttaagattttttcttgaaaaattctaattttgaaaaatttttagaaaaaaatttggcggcaaaatttcgtcctgtttcgctgtgaaacacatttgggaaaaccaaaaattaaaaccaaaacgcgacccctatttttgaccactttttaattagcgccaaaaaacacgtttctatgggtttccaaagcctaaataaattcaacaaatttatgcataaataaaacaattgactcttaaaattttgtcttttcattttcaagaggaggaatacgcagcgctcaaatacggtgcttcccacgtcattctcctgttcgtgccgggtaagcacttttttggcacttccatgccatcgcatttttgcggcgtcctttttcggttttaattcccctttttatatgcccggttccctgattacgaatattacatccctttttggtaattctgaacccaaattctcggctttattgtagtttagacgcccaattgactttcggcatccaatcaatgactttctttagtttcatagatagttccataaattgttttcttttggtcaatgcctaacaatttcttggtatcaatcgaatggttaaatctcgagaatttataaatgcaagaaagagccaataatgacattaagaaagtgttacaatgagaaagaaattctgtagactaagatttcaattgataccaaaatttaggcatttaccaagtaagaaaaaaagttattgtctaagaaactgagaatgatcattgattggacgcctaaagcgcaatagagccaaaatcgttagggctgctgaaatattttcgttttacatccattttatatttttagtatccatttgtatggccgtggtcacaatgacagttgcgtcggttggcttctactccaaaaatgatggcctctacttgtaagtgtattctgtggcggtttgcaattgagagacagcaaaccgaaattttgaaatgcattttaagt

SEQ ID NO: 13777 - DNA, 1047 bp, Heterodera glycines
ctaaaaatgggcaaaatttactcatttatcaacaaaatatgtcttttccaatcgctttccaaaattgttccaccggcggcactccccatgttccacaaaatttttgaaaaaagtgtttcaatctcccattgtattggcctgcgagacatcccttgaatatgtttggattttttttttgtctaagaaataccagttttgaaggtctaagggaattgaagggacccctcttggggaacaccaaaaattaccgttacaattttccattttttttgctggtgggtaatgtgcatgtctagaagcgtaagaatttctttgttgggctaacaaaactgaactaacgaaattttatgtttaaattgccaaaaaatccccccccccccctctctctttttagttctatttgatcgtcgtttccgctttgatggcattgcttttcatcaaatatttgccggattggaccgtttggacagtgttggcaattctgtcaatttgggtatttttttcactggcattttttggctgcatgacaataactcagtttttgtttggcaccatttaaaagttcaaattctgcatcgaaaaaccgagtgctgaatttaattaaaaaaaaaaaaaatttcgtttaattgcaggatttggtggccgtcctcagcccaaaaggtccgctgcgaattcttgtggagaccacgcaggagcgaaatgagccaattttgcccgctctcatttattcatgtaaaaatttttttcgtgttataaaaaaattactaggatttctgaaaaattttgtttgaaaattaacaaaaaaattcaaagggcggggggagcagtaatttatccaatgtaataaataaatatttaaatatataatatttttaataaaattcagcaaccgtcactgtcctctactcatatgtgctccatggcgttgtttcttccgcttttattgtcgccgccggggtgggcacaaatggcgatgatgaagacgaacagcaacaacggcaaccacaaccgaatgatggtaggcagcagggatggccaaatcggaaa

SEQ ID NO: 13778 - DNA, 893 bp, Heterodera glycines
  misc_feature (23)..(23): n is a, c, g, or t
  misc_feature (867)..(867): n is a, c, g, or t
ttgtaagtttttaaaattatctntaaaggactttcgaggattttttcaaatttctaattttctttttgaaacaaaatttcaagaaaatttaaaaatagttttagtttttttgaaaacctaagtgttaataaaaactaaacttgctgaatctccggggaaaaaacttggaaaaatttttttatttccttgaatttttttaataagaacttttaatttttctagaatttttttcgtattaggccagtaaattaattttgataatttttcttgtgcggcgagttttgtccggatattttattgcgtctcatcacagatggcagtgccaacacattgttgaccaccgtgttgaccaccagcggcgggagcaccgagtcgcgtacgcaaaccctcgtcgcctcctcttcgtccgcttccgttgacggtgatcgtcgcactggcggtgccgccgccggcgtcaaccgcgcgacgcgtacagcagcacaaccagcggtagcagcagcgtcacgcgcttcggcgcgcagccgctcgccgcgccatccggcatccgaacgtgccgtgcctgtgactgctgcagcagaaaccggtgctcatcatagtggcggcggccacggcggcacgtcggaagaacaacgtgggggggggacatttatttgggtttttcaattggcgtagatccatagatatacaaaacagtgttcggcatgatcaaaatttagcgcggtgaattatcattaccagtcgattttttgggggagggggagaaagaatggtaaaacttgttcaatttatcatttaccgctcgatctctggaaaacccgggagcagctcggttccccccccccccccgagaaatttttttaaaaaaanaaattactaacttagaaatttttaag

SEQ ID NO: 13779 - DNA, 2539 bp, Heterodera glycines
caaaaattcttcatttgtcttttaatagaatgttcaaaataaaaaatatataaatctaattgaggaaaaatttgttgaaattttgtacattaaaaatgcttaccataatgtgtgttttgaaactgttcattattgtctactgtaattggcatttgttgggctggcataatattttgggatggaaattcaacaaaaatttcgccattgggttgttgttgttgttgttgttgttgttgttgttgttgttgattttgtgatggtgtgacttgattttgtgatggtgtgacaatgttgacaatttgggccacatttaacaaatttggcaacaccgaattgacaaccattacgcttaaaagtgaaattgaaaaatttgttaaatttagtaataaaatgaaaaaatttaaaatgaactaacggcgaggtaatttttttcttattcaaaaaaagtatcgcaatgttttaaaatcaaattcatatttaaatgtgaaaaattaaaaataaaataaaatattaaattacattttaattaatggaaagaaatgctaaaattttcttcttattcgaaataaaaaatcacaaattaaatcacatccagaaaataaagttaattttagaatataacacccaggaaaataaatgtacttaaatgaactaaaaaattataaaataaactaaaaattacaaaaaaaggcaaaataaaactttcaaaattttgtttgtgaattcgatggcataaataaagtcaaccctttagcatcatcattttgtgaactgatgaagcaaatggacaaattgaataaacccaataaaatgaatgggcttttacattcttctgtactcaaatggcttgacaaatttgattttgttttatttgtttttatttctattcagctaaatttaatttttattttgtctaaatcagaaatctcaagtaagaaattttctaaaatagccaaaaattgggcaacaaataaaaatttgatggcattaaattttcgaaataatgtactgtatatagatatttttaaatattaattagttttatgatgtttattatataaaataaaaattattatataaacacattaagaactcaggcattaggcatatcattcatttgtttcccacattatattagatgcatattatcatttttttttgataatttttcgtcatcttgagggtgtccttacaaattagtatctttgcccctctacccccccccacatttataaattttgtacgattggcaaatgatttgtcgcttttgctcatttgcctcggttccattatgcccaaaaggcatatttttagttcaccaatttcatcgcaaaattctgaacaattatgctttttcgcactttcgttttccacttaatgtaatgtcgatttgcttgtcataattagtctagtttaattaaaattagaaattttatttgttaaaaaagttaataattcatatttgtcttttaattaaaatgtttttgtatttaaaaaatttttataataaaagcataaaagccattaattatttaaatattaatttatataaatttcttaattaatctaactttttcaaatattgacaagataaaatttagtacaccaatgacgatttttggtcatttgagatcatcaacagattccgcaaatccttgaccgcgattttttacggaagataaaataatgggtcaaagcgtccgaccgtcgtaagctatttttgaacggtgaatgaacgaaattttggtaattaattaattgatgcgattacacacatttgttccaatttttgcaaataaatacgcactgaaaaccgatgagattattcagtgtcatttcattcagttaattaattttcttttaattaatttaaaattttttttttcgaaaatttttcgagttaatttattttgaagataaaataaaataaaagaaattgaatttgtttttgtttttttaagaattatttaacataatgaattcaatttcagcaacataaactgcatttaataacacatttaaaaatatttaattttgccaaaaccgttatccgaaatttcgataaaaattatctttttcctaataagattctctttaaatacaaaactaattattcaccaataattaatatttcttagaaaacattttccagaccaaaaaaaagcatggccaaattcctttctggcattatgttttgcgcattgttggcactgctggacaccaccagtgcatggaagcgcgagtttttgcgcatgccgaaaagcaatgaaatcggcacggcggacgacagcagcgaaagtggcaaaaatttgaaaagccaatcggaactgatcgcttcaatgctgccaaaaagaaaaagtaggaaaattggtaaaatataaattacttaaagaaatgaaaatgaaaatgggaaatattaatattaaattattattatttggaaataaaaataattttttagtattaatttttttttaattctaaaactaaaaaaatacaagaaaaaattaataatgaaatcttttttattcctttaata

SEQ ID NO: 13780 - DNA, 1667 bp, Heterodera glycines
  misc_feature (69)..(69): n is a, c, g, or t
taagctttgcaatgctactacggcgttgacatgttccgcaccacacggggcactgaaggtggtgccttngaggaggtcaaatgcgatgacgaagactatgaccgctgtttaattggcaaatgcaagggtaaaaaaatggcaaaaaatatataaaaatttcaaaaaaaattccaggacaaaattttgtcgaggtccgcaaattctgtgccaccaaagatggatgtgccgcgtttggatgtgccgttgaggaggaacttgaatgcaaaacgtgctttggcgaactgtgcaacttgtaaaaatggatcgagaaattattttcggattttcaaagatttcatgacatttttcggaccaatttgttcatggacatacaattaattttgtatatttaataaattaatttattttcaatttaatttaattgataattgttaactttttttaaagaatttatttaatattaattaaaaacatttaggaagtttgaacaaaaatttttcataaatttattgctttctttaaaaatttaaattcatttaattaggtattttaagcaaaaaaaataaggaaaaaagttattaacaatatttgctgacaaccttcgcataaaataaaaagcaatgattaaattttagacaattttttcttattaccaatgttttattaaaattgtttttttttctaattatcaattttattttttcaattaaaatttctctttttgttttttaaattatttcttcaatcgattaatcccatcaacaaatttgcctccgtaaatccgtaaatatgctttacgacaaacagctgttaaagtgggcggatattggcgtttattttcgaaagaaaatgctttttgtttataggaatattcaataaaataatttaatgatttcatttttccattaaattaaaatatttattttaaattaaatttgattatttctaaaaatgtttcccgcgggcccaaagaagaaattttgttcaatatgccgggccacaattgaagtgtttgatgaaaaagtgatgacagaaagacatataggttaatttttttaattatttttaaaattttgcgattttaatttaaattttgcggattttttatttatatttattaattaaaataaatttagtacacaaaaaatgcttcaactgcggcatttgtaacactccattgttgattggacgatgtgcaatggatgatgtgctttaccatcaatttggtcatatttttgcttattttgtgggattagaatggaaccccatggggttggaaatgtcggctcccggacaatccatcagtgatggacaatccgtcagtggacagacaattcgtcagtgaaaaagcgatattttatataaaattatgtgaaaatgaatttaaattgaaacaaaaaaacttcctccccccccccctcccccctcgaggggaagtgagtgagtgtaagtgaactcgttttcggagaggggaccccgcactgcattatcagcaagtttggcgcgcgccatgttccgcagctgtttccggcgcccccttcgactgggcaattttgtccatttttgatttgggtgggcaaaaaaggaaaactgttgaaaatttaaaaaaagaagttcttggcaaaatgtttaagttttaagagcattttaaaatgcgcaaattaaat

SEQ ID NO: 13781 - DNA, 1086 bp, Heterodera glycines
ataaaattaaatgcatttaatacaaatgggatggaatcatttgcggaaaatcacactgaaaagcacagtgtcatcgcgaatcagaaaggcacagaacggacggtcggcgacaaaacggtattctttgctcgaaccacaatccgacacttctccttctgtgactgccgcagcgacggtgccctcctcattcacctaaatttcgttgtttaaattagttttttctttgagaattgagctaaaactggtcaaaaatgtataatttttctctggaccggctggtgactttttttaaattttgcacatcgatggtggcaaatttgtttaatgatggacaaaaaaggatgaatagaaacgcatcttacaaacttaaaataggctaaaagataccattattgtatttggatttttcgttcaaaataagtgcgaaaataaatggaatccacaaaaataagggcactaattgtgggcaatcaccgtacctcaatgaccgccttctgcatcacttcgctgagcagcaacgttttcttgccggaaatgccctcaaaattggcgttgtcggtgaacgcggtgggcatgcccatgttggtcaacggtttgttcaatccgtgcgtggcctccaatttgaacttgggcaacaccacctgggaaaagaaggggctcggctgggatagggaccaacaatttctccctttttcattctcattccctgatggaaaggatcacagattagggccgactgctgagagttacagaaaaaatatacaaaaatataatcatggtaaatattcgttgataaattggcagacggtttagaggtaaaacaaggaataaaatcatttcatttgccacatctaaagaaggctttcttattcataatccttggaaaaaaataaataaagtcgcccagttgacccccactgttttcttccccctcccgccaaatcaacttccccatatcgtttcacggattaagaaaggttttttttaattttcgtgggtatacatgcctaacgaacaattgtaacacaatgtcaactttcgccgtttcagggtcaccgacctaagccatggcacattggcactgat

SEQ ID NO: 13782 - DNA, 2639 bp, Heterodera glycines
  misc_feature (2540)..(2540): n is a, c, g, or t
  misc_feature (2554)..(2555): n is a, c, g, or t
  misc_feature (2570)..(2570): n is a, c, g, or t
  misc_feature (2598)..(2600): n is a, c, g, or t
tcatgggtaaataattcgttgataaattggcagacggttttgaggtgaatcgcaaaaaacaaggaataaaatcatttcatctgccacatctaaagaaggctttcttatttataatacttggaaaaaaataaataaagtcgctcagttgacccccactgttttcttccccctcccgccaaatcaacttccccatatcgtttcacggattaagaaaggttttttttaattttcgtgggtatacatgcctaacgaacaattgtaacacaatgtcaactttcgccgttgcagggtcaccgacctaagccatggcacattggcactgattggcatttgttcgtttggcatacccacgctaactcttgaattagattaagccatgaataaaattacgtcgacgttctgtcctgctccagggttttttaccttaacggtctctttgtcccgctttttgatcagtttcatcagctttttgccgtccaattgagccaacaattcggtcagtccaaagcgttccttgggcaacagcacgaacatgaactcttctccacctttgtatggcatgccgaggagtttgagctgtacaagcaagcaaaaaattggcaaatcgatcgaaacaaaaattcatgaaaatgtctaaacgacctgatcgttcttgtagtaaatgaaataggcctccaaatgcatcatttccagctaaaaaattggtcgtttacggacaaaatgaaaatgaagctaggattttaaaatgtgtttgtctccgccacctctttgaagtttttcgcgtccacatgaaatttcgcttttttggtgaattttgagtcgaatttgtccgcccatgtgcctttgaagtaaagcgcgttgatcagcaccaaactgcaaaaaataaataactattttcaaacttttacaatttttttttttgctatttccatcaaataacatttaaaaaaaaaaataaatattcggacttttgaaattgccgcaaaaggccgaagacagcctaattcaaaaactttatgattttttttttacgtttttttcttttttttagtatttttttgcggaacgatgttttgtccggcgacgtttttgggccaaaagtatgttatccattgaataagattagatttgccacagaattttagaaacaaaatttaaaaacttttaccgagtgttcccgtcaaaattgtcgggcgtgaccaaatcgcggattttcttatgagtcgcttctttcacgaacttgttgattttctgaaggcgaaaaataatgtttcccaacttttaatgaaacaaaaaatttttgcaccaaaaggattcaccactgtccgtatgctttttaagaaaaaaaaccccaaaatttgacttttatgaagagttattattctaacggaatggaatggcttaaaaatgaagcaatttttgacatttttagctgatattttcctatttttgggcctgctttcgcattacgccaataaaacatttcccacctccgccgtccctttgccgtccaaaaagtccaccgtctcaaactgtcccccgtaatttccctcaatttgctctttgaacgcgtccttcactttgctgcctttcctcacgtacaatttgttggccgtctccaaagtgttgctgctgttcgttccacttgtgatcgatttgagcaaagcgccgaagtatttgtgcacctccgactcgggcgcacctaaacaaaaagagagggggcaattagcaataagggggcaattaggaatagggaggattggtgggggagggtaattaaaaggggaaggggatgattattgtccctcattactttaggtgaggcatttttcaagggcactgaaaagaagagaaattgttgttttcaaaagtaggaggataatgtttctgggggttttctaagtttttgataacgaatctgccatttattccggccaaattcgaattcaagacccaaattcgaacaaaaaaccgaaattctaaaaatgatttacataattttcagtttatgaaatttcgaaactttccaccatttgccagcagttggcccatttcttcgccggtcttttccttggcgcccgcgtaaaccatggacaaagtgacggcggcagaaaacggcgaaacaatgcacgaacggtcgtccgtggacacttcgcgcagcaatttcaacgcaaaatcggcctgtgcctccaaaatgagcgaggcttttggcgaggggggagaagacattaattaatggcggataatggggcaatttgaaggaggaaatagaagagactaaagcgaaaatgagataaaagctaaaaaaataaaatatgcgtgacagccatcaatcatatatgaagacttgacgaaaagatggcttttttatgattttttcgtgagttttttaggaattcagtaatttctagagctcgacctggacctggatccaggtccaggccatttttcggaacctggaatttttcctgggactgtggatttttgtccaggaaatccaggtccagatcaatttagaaatccaggtccaggcatgaaanaacctggatttccnntggataattttttanaatctttttatatgtgaaatgtatttannnatgtaatttttttcacctttttatatgcgaaatgtattt

SEQ ID NO: 13783 - DNA, 958 bp, Heterodera glycines
caccatttgccagcagttggcccatttcttcgccggtcttttccttggcgcccgcgtaaaccttggacaaagtgacggcggcagaagtagttagtcgccggtacccgttgccgtttaaggtgtgaaatttcacaccttaaacggtccccggttttttgcccttttttaccgcaaaaacccaagggtattggctgttttttcgcgcatttttggggaaggggagggaggtcgacggtccctggttttcacacctcgacggtccccggttttaccgcaaaaacccaagggtactggttttttcggtaataaaatttaaatatttttgggtttgatttaagatttataaattttttcaactttaattttggtaatacaaaaaaaaagtctaattttgaatgccgttgccattgccaccatcaaatgccgaagtcgtcgccgaaccaaatgccacaacttcaataacaacagcagcaaaagtcatcgccagccgaaataccggctgctctacatcatccaccgcattgacaatggtcacgcgcagtgcacaacgacgtgcagcggaggaggaagcggttccggcacttgcaattcgtgagtttaatttttaaaaaattaataaaaaaattttaaaattgattataaattcattgtatttcctttattaaaattttttgaaatttaagcgccgccgccacctgccggctgctcatcatcatcatcaacagcagcaaatgttcctcagccgtcgtcgtcgtcactttccgccgaagaaatcacacgacaaaaaaagagggataaaaacaacaaaaacaaattcaacaaaaaacaggcaagctttaataaaaagtttaaatttcatagcatttaaataattaaaaatattaacctttcatagtcttttaaaattattataaaaagggttttaataattatttttaaaaatatcttccaaatttct

SEQ ID NO: 13784 - DNA, 1812 bp, Heterodera glycines
  misc_feature (89)..(89): n is a, c, g, or t
  misc_feature (126)..(126): n is a, c, g, or t
aagggggggggggaagctagcaaaggggaaagagggaaatgctaaaaatttggctatttttacaaaaaatcgtttaaattctgaaaaanaattatcctcggcggcgcttatcggcaccgcccgccncaaaaattcataattatttttaaatattagctccaaaatcttagtcatttttttgcaggatattggtttttgtttttacgctcttattttaatatgaaaataggtgaaggaaaatttcctaaatcatcttcctgtgcttaattatcaaccaaggtaatgagttaagttttcgtatgtatctgtttttcagatgaattttacagatttaatatgctgcaattttgatttaaatctaagccattaattaattctttcaacaaatttcactaacttttgataattgttggaagtaattattccaaagcaattataaaattagaagaaaacaaattttttctacgaaggcattttataaacattatttgtgaaagtgaaatttcagaaacagattcccatacataattcactccctttgaaatgggtaaatttttcggtcatattattttgcaggatattggtttttgtttttacgctcttattttaatatgaaaataggtgaaggaaaatttcctaaatcatcttcctgtgcttaaatatcaaccaaggtaatgagttaagttttcgtaagtatctgtttttcagatgaattttacagatttaatatgctgcaattttgatttaaatctaagccattaattaattctttcaacaaatttcactaacttttgataattgttggaagtaattattccaaagcaattataaaattagaagaaaacaaattttttctacgaaggcattttataaacattatttgtgaaagtgaaatttcagaaacagattcccatacataattcactccctttgaaatgggtaaatttttcggtcatattattttgcaggatattggtttttgtttttacgctcttattttaatatgaaaataggtgaaggaaaatttcctaaatcatcttcctgtgcttaaatatcaaccaaggtaatgagttaagttttcgtatgtatctgtttttcagatgaattttacagatttaatatgctgcaattttgatttaaatctaagccattaattaattctttcaacaaatttcactaacttttgataattgttggaagtaattattccaaagcaattataaaattagaagaaaacaaattttttctacgaaggcattttataaacattatttgtgaaagtgaaatttcagaaacagattcccatacataattcactcactttgaaatgggtaaatttttcggtcatattattttgcaggatattggtttttgtttttacgctcttattttaatatgaaaataggtgaaggaaaatttcttaaatcatcttcctgtgcttaaatatcaaccaaggtaatgagttaagttttcgtatgtatctgtttttcagatgaattttacagatttaatatgctgcaattttgatttaaatctaagccattaattaattctttcaacaaatttcactaacttttgataattgttggaagtaattattccaaagcaattataaaattagaagaaaacaaattttttctacgaaggcattttataaacattatttgtgaaagtgaaatttcagaaacagattcccatacataattcactcccttttgaaatgggtaaatttttcggtcatattattttgcaggaaattgttttttgtttttaccctcttatttaatatgaaaaaaagtgaaggaaaatttc

SEQ ID NO: 13785 - DNA, 3868 bp, Heterodera glycines
aatataaccggaaatgtgtttttgtgataatttattccaatcaaaaatacattcttaaaatgcgtattttttatgataaatataaccggaaatgtgtttttgtgataattaattccaaataaaaacacatttttaaaatgggtatttttcataataatatagtcggaaatgtgtttttgtgataattaattccaaataaaaacacattctaaaaatgcgtatttttcataataatataaccggaaatgtgtttttgtgataatttattcaaatcaaaaatacatttttaaaatgcgtattttttatgataaatataaccggaaatgtgtttttgtgataattaattccaaataaaaacacatttttaaaatgggtatttttcataataatatagtcggaaatgtgtttttgtgataattaattccaaataaaaacacattctaaaaatgcgtatttttcataataatataaccggaaatgtgtttttgtgataatttattccaattaaaaatacattcttaaaatgcgtattttttatgataaatataaccggaaatttgtttttgtgataattaattccaaataaaaacacatttttaaaatgggtatttttcatgataaatatagccggaaatgtgtttttgtgataatttattccaaataaaaacacattctaaaatgggtatttttcatgataaatataaccggaaatgtgtttttgtgataatttattccaaataaaaacacattcttaaaatgcgtatttttcaagctaaaataacaggaaatgtgtttttgtgataatttattccaaataaaaacacattcttaaaatgcgtatttttcatgataaatataaccgcaaatgtgtttttgtgataatttttttgtgattatcattttaatttcattttaacaattttttatttatccaattaaaaaataaaatcaaatttcgactattcattttttactgtcggaaatcattgaattatgctaaattaacatattcgaccaaatatgtgaagcaaaaagcaaaaacaattttttcccattaacttatttattatgcacaatgggaattaatttcatttgctttactaatttttattccatttttatttgaatattattttttacgaatttttattattactaattttaaaaaattcaaattttacgccatttataattttaaacaaatttataggaggaaagattttaacggcactacttttgccagattaacagtttattgtcagattgaccgatgggattgaagaatggagcttggaacattcttttttgctgtttattttttcagcttttaggccaatgctttggtaaaaataataattatttttatgataaaatttatatattttttaattcaatagttcaaaaatttcacacataaaatattaaatcggacttatctatttttttatccacatcatcaacaaaataattttatttaaaaagaaaattattttttaagcatacagagaattgaaatgcaaagttggccgtgctcaggcacagacaaacagtaaaaaattagaagaagtcaaaactggaaaatgcgcgtttgaacagtatttttgcctgatgatcacctgtgttgttggtaaattaattactaatttgaactcagcacggcaaaaaattatagactttatgtcatagaaatattactaattcaaaatttttatgatttatagagcaatttgaaaattttatttgacataataagaatttatcaaaaattccaaaatacattagttacgaaaatagtgagcgaaacgcaaaattattgacacattttttaaattaataaatgctataaatcgttaaaatgaagagtatccgagattaaaacattgctttcgtacttcccaaacaaaaaaaaattaataaaaatccctactcattagacataagccaagactgatctgaaaggtcttaacacattaaaatgccagaaaataggtttaaatttttgcagttggaaatccgtcgtacgctttcactgattggcaatgctcttacagcaacaatgccgaggtgtgtgccgaaagaactgaacaaaaattgcgagaactaaaccaattcaaaaacccgcgctgcaaatgcgaatttggcaaattcaacgaggaaatggccaatgaaaagccggcggcacaactcccgacaacgccattgccaagtgcacttttcactagaccttgtcgggactttacagaatactaggccgggtcaatacctagtacctctgttggggtcctagtatgcgtttttcaagattcccgccacgtttgggcatcacggttgggcaccaacatgtttttgcactataacttttttctttttcaactaaatctaacatttttggtatcattcgaaagcttaacatacttagacgctatttctaagctattgtttcgcggttagacaattgcaaaaaaaattataacatgaaaattgcaacaaaaaaagtctaattttctgaaattttttctaaaaaatttttgtaagactaattagagcacatccaaagagctttcgaatgataccaatcaatgttggatttggatgacaaagaaaaaagttatactgcaaaaacatgatggggcccaaccgtgccggctcaactgagtgaatccgaaccggcggcaatagataaactcagatattagctaattttaacgggttttttaaagacttgttctgcttgcggggagcatacgattacaaaggctatggcatcgttgaagaccgtgaatgtgcccgagaagatcggcattgctttatcgcaaattgcaagacaggtaaaatggttggaattgagtaataaaaaaatatatttaaacaaatatataataaaatatttaaaaatgtttaaacaaatatttaacaaaatatttaagcaaataccgtatttccttcaattatatgcccgtctccaattatctccccctttctgaggaggttgaaaaataatatacccgggcatacaattagagaaaataaggtattttaatggatttccagataaattatagaaaaaccttgaaactgctcgtaaccacaaaaagtttcatattatttaactgaatataatatatattttccattccatcagttccgtttgaattaaaatatgggattaaatgattttctgaataatttatttcccggcatttaattttggccaatgccgccgaacccctcatttttggcattctcccattttttcagcagacagtaaagatggcatcatggcttggggttgtgcggaaagcgataattgtacggcaattacggaaaagttgtccacaaacaagcacaaaaattacgaatgccgttgtgcatttggcggttttggcggcaatatgaccaacgaaaacatgacaattccgtcgtggattccaccgcccacgcttccgtaattttggggaaaatctcggtagaaacacggacctagggccaatcttagaaaggattttggtttgaattacgtaaataatgattagaaaaaataaatagttcatctaagcgaataacttgcttttttttctttattccgctaaacggaaatggaaaaacaattaataaatttttataggaaattattaaatttttaatcaccaaattagtgacgaaaattcgttcaattattccaagctttttttattcaattaaataatttaatgcatttaattgtgtattattttgcttattttaagtacgaccacggcttcaccaccaattgaagcgcaagtgtggagttgtctgctgaaaactgcttgcgaaccgtttgaaaattatttttcataggatttggggcagtttttaattgctaaaaact

SEQ ID NO: 13786 - DNA, 1157 bp, Heterodera glycines
  misc_feature (18)..(18): n is a, c, g, or t
atgaaaaaaattaatatnagaaaaaacaaaacaaataatctttatttagttaatattgatgactttaaaaaagctgtaacacatgtttcttattgtaatgaacacaagtaatgaacacaaccttccgtcaacataatcatatgaaaatcatgaatttttaggagattgtatattaaactttttaacatgtgaatttatatttcaaatttcctaattataacgagggtaaaatgagtaaattaaaacagctattgattcaagaaaaaacattagcttttattagtaaagagataaaactaacaaattattataaaactcaactacaagagtattgtcaatcaaaaaaaaatctggttatatatgaaactataaactagagtgccacgggaccgggaatttttgccaaaaccgggacttgccgggacctgagaagccgggaccgggacctcgattttttttcgggaccgggaccgggaccgcaagaaaaaccgggaaccgggaccaaccgggaaattttaaaaattcaaaaaaattttaaaaatttaaaaaaaactatgaggaatcatattttttttataggaaacccacgagtatacaaaaaaaaaattgaaaataatctaatttctgtagagggattgaaccaggggaaagaagaagggaaagtcaaggagactagccattaggccatttgcacacttaggcagtgttacttttaaagaatatattacaaacctattctttttttcttttcttttataagaaccccttcatatatctgagcaatcttagttgtcttatctatagaaaaacctaatacatattttgattcagttaataatgtagaggtagtaaaaggaggcttagagataacaaacccatcctctgtcttaatatcttttatttttaatgtaagacctaaattagaaataacatctaaaacagtatctttatctttataaatttttatctctttgcttttattcacctctttagttttatatgttcaatatatttttgtttttctaactctataataaaagatgtcttcttaaataaaaagttaatctctttttttatattaatttgatactttaaaataaaatctcctaataatttttcaatttctgtcataacatcctcttcgttagattctataa

SEQ ID NO: 13787 - DNA, 3945 bp, Heterodera glycines
  misc_feature (3708)..(3708): n is a, c, g, or t
ggacgagcccagctcggacatggcggtaatgcataatgaacccagttgaggaccagtccaagacaaggggtaccactatttttttctattatttatttctttgcttttttatttaaatgttcataatgtttttttgcagatattatattatatttctttttatcatattctattttaattgaatattttttcttttgttatatttggcatcactattttcatcattatcattttttatctacaaattattttttattaaaattccttgcagatattatattactttttaccagattttattttctattttcattttgtataagctttttgctacatttggcattactatttttaatctttattatcgttatctttttttgttatttggaaaataataaaaatttcttaatctttttgttatttgtaaaaagaattaaactttcatttaaccaattctttggtctcccgttttcccctttttcgcattaaacattttttgctttcccttaaaatatttctcaatttttattaacaattaacaaatagaaaaaaacaaaacggaaccatcaaacaaatcatttatcaccaccgcccgatgcggccaccgaatatcttccagcttcgactgcgagctcaccattcccaacgtaggtccgcagagtctttttaactcggggattgacctaaacaaattaaataatatttaaataaaatatataaaaattgtcattattacatgctttttcgaattcagtttgtaggtctccaatttttttttaaccagttcgtgcttttgaagcggcctgcatcatgcagaatcgattttatcatctaaatttagaaattacccctaaaaattaaatggttaataaacagaaacgcacaaatatatatggttcaggttcgagacgggccattgattttaaacaatttaaaagacaaaatacctgaaatttacgataatttttattgaaaaagaaattaaatttgcacatttgtaaaaaaggtatttgtaaaaaacgatatgaaaaataagtcaaaaatttaaaaggtcaaataaaatacatattctaagtataaacaaggggtacaaatttttaaattaaatttgaattttatgaaaaatattaatactggtaaaataatgatagagccgtgcaggaataagaaagacaactcaaattaacgattttaaaataacacgaaaaaagaaatgtgcgaaccaaccgaagcgatctaatcgtagataaagaatggacgaacaacgaattttataaacataaacgaaaaaaaataattgatcaaagatattttaaataatactttcaatttccgaagaaattctatttaaaatacgatttaaggataaaaaattacgtatccgaatgaaaatatattattacagtaatttaatcccaaataaaacctaaacattctggtcgcgggagtcgcatggaaataattatgtaccattgttaaaaaagggaaaagtaattagctgtgtgattaatgaacggattattatctgctaaaaaatcgagaaattgtggttaaaaaattgtaaaaatagccgaaaataactgctaaaaatcgctcaaaccgaaaatagtccttagaaaatgtgtttttttgtgttttttctcatcaagtactacggtaaaaatataccgcaaatttaaagaatattaactaatttattggataaaaccatatattcgacaaataaaatataagtattcaaaaactccggtcgcggttgcgaaacagatttgcacagaaataattatttaccattgtaaaaaagggcaaaaataatcggcggtgattaatgaacagattattatttgctaaaaatcgggaaatagtgattgaaaattgtaaaaattgtaaataactgcaaaatacgctcaaaccgaaaaggtgcttagaaaacacgttttctgtactgttatcatcaatactttactactgtaaaaacagattaaaaatatagatatgtcatataattcggccatagtaggactacagatttatattgaactttagaattttaaaaaaaactaccacaaatttagatttttatcaataaatttgaatttgttaaaaattacttttatttatatttcaaaaatgcaaaatgtataaaattgttattcaatatcgaaaatgggtttttattttttctaagtaagaactgtcagtcggcatgcgggcgatggtgggcgggggatgaagtgccgtcaccgagagcgctcaagagcgctcagggccaagcatttacttcgccaaaaatggctgcaccataaattcgaccgcaactttattcagttgcaattggactcattttcaccatttttagtgtttaaattacaaaaaaaaataattttttatttttgaaatgccttccaattttctcgaaaaccatatgatggacttttaaaagttaaagtcataccgccgaaaaagttgcggtaccctttattgccttttcatgccgtaggttatttatttttatgcaaaatcgttttaatgtttagggtggttttttactttttccgacttgtggagagtgtgcacgtaagtctaaaccggattttgttagggcagaatgtttcaagaagtgcagacactcagcagaaagacggggtttagttggggttttcacttctattgaactccgaaaagcgttagaactcggctacaaaataacgaaattttatcgagcataccattatgagaattttgacacaaatcttttcaaaaattatgtaagaatgtttttgaaaattaaaatcgaatcgtcgggctggccggataatacgactactgaaaagcaaaaaaacgagtttatgagtatgtacaagcgtaaatatgatatagagcttgatcctaataatataaataaaaatccaggattacttttaatagcaaaattggtgagaatcaaattcatttaaatatgtatgtaaaattttagggtctaaactccttatggggtaaattttcaatgagaaactccctttgtcagaccaaagtgattgatagttcggctgagtggtataatcttttgcttgatgattctatagagctttctagcccaataataataaatgatgagatgattcgtgtgatctatagaaagaaggatagttttatcaaagaacacggagtctcgaacataatcatttctctatagtgagactgtaaattatacggtgttttattttatttttaggacaactagtgctgcatgtttagttttatataaaaatatggaaagggtatttaatacgccgggctgtcgtcttttttattgcgataccgatatgtcaaaatacaaatttagttgatttttattttgttcagattcattagttattgcccaccctccgaactcatgtcctcttaaagaaggaaaatttttggggaaaatgactagagaatatgcagattccgatattattgagtttagggtggtcctaaacagtatgcattgaaattaaaaagacgggaaactggagaaatttggtataaaaccaaaatacgcgggataactttagatcgtaataataaatttgattatgaaacttttaagaaaatgattttaaaatatagagacggagctaatttcaaatttacatacccggaagttttaggtagtgttaaaaaaatttctgaattgaatttcttttattaaggcccggccgngacagtttaatcattaatcgtgaggttaagaaagactataaaccgatacagaagaagggcattattgataccaattttaaacgtactgccttttggatatttttgagtaaaataaacattatctttttgtcgttacttaaatcaaggtgtcgttttttccaccttaatgtttccaaatcaatataaaaatacccgggttttatgtatctttgcaacaattatacgcttgatggagaa

SEQ ID NO: 13788 - DNA, 3926 bp, Heterodera glycines
ccttttccctttttcgcgttaatttaccttcggaatggtgatgttttgccatgagatgtgaattggcaactttttgcaccgttccagcagcaaattctcacaaaacccgggccttttcacacaacgactgacaaaatttggttagtttttgttgttaaacaaaaacacttttggcacggcaaaaggaattaatgaaagaaaaggcgaactttttgtaatttctgtcgggaaaataatttcgtggacattcgattcgctggcagcgataattgcccaataaattaatgcacaaatgcccaggggcgcaaatgttctccgattggcactcgtcgatgtctcaaggggagagacccgaataaatttcaaaattagcaattatttttagtgcctttgcaagtgatgccatccgccattatttcgtagccaagcggacacgtgcaggcgaaagagccgggcaaattgacgcattggcccatgcacaaatcattgcctgaaatgccaaaaaatggttgaactaatacagggaatggcatggcacggcacctgactttgcccaaattgcgcactcgtcgatgtcctcgcaggtgacctcgtcaatgcccagctgaaagcccctctcgcaaatgcattggtaggagccgggcgaattaatgcactaattgagagaggcaccgattgggactgagttggaaagggccgaattgcagcccttcgctcactttttgctgacatcgagcgacccccgaggcgcactcgtcgatgtctgaaaaggcactcaaagggtaaaaatgcacaaaaacaaaaaaacagcaaaaacgggccgactaaaagcggatctttttgagtgctttgccatttaacactttcacagaccgtcgcagctgcgattgtcggcgcccaacttaaagccgggcccacaaaggcactcatgcgacccgaaagtgttcacacattgcgcctggagggagcacgcgtgcgctccgaacttgacgcattcgtccacgtcctcacaacgcctggcaaaagagcggtcctcgggggggaacgaacccgcccttccctccccccctccccgaaacgcctcccctccaccgcccttcgcccgttttgctaatctatggcaaatgcgtatttgctgctgcgatacagtaggctgtctgtcccttacagtatctgtctctgcctaccgttcgacccaccgttccctcctcacattgtcaactcattgaattcgaaacccgccccacaattgcagcgatatgtgcccgggagattcgtgcactgttcgtccgtttcgcacgagtgcgttttccgtgcgcattcgtcggtgtcttccatttttgtgttcggttcggtttaattttcgaatgcttttcgttttacctaagcaaaagccgctgtccttgtccatgtggtacccatttgaccacacattgccctgctcttggcaccggaaactgcccggggtgttgacacctgcgcggttcatttaaaccatgccattatcctcccctttccccacactcttcgaagatggcacaatggcgtgtctcctcccggcactcgtcgatgtcttcgcagcgtccgtcgatggctttgtacccgaccgggcaattcaccgactgaatatttccgaaccctttcctcggctttccctttgctccgtcactttgcattctccgctgttcgggtccatcgcttcgtccgctgcgcatcgcttcggcacacaacggaagctgccctgggtgttacggcattggtacatcggtccacagtcgtgtgccccgagggcgcactcgtcgacatctgaaccgaccaggacaaatgggacaatcgccgggggggggagtaaaatggtaaatgcaatgtcaacaattgatagggggacaatacccgaggtgccgaaattttttatatgataaagacacaccgacgcattgctccgtttcgctgtccatggcatagcccgtgccgcctcaaaatttaaaatcaccgaaacaatgcatttggttatttacatgactgagtcctaatacatttgaatcctccgggctaaatgcaactttaaaatccaataacaaaaactgtcctaccgtattcagacaccgttgcgtctcggcacagtcgtcaacgaggagaagacactcgtcaacatctgatacggtagcgggaaaacggtacaaaagaacggacgggcacgactgggccccgccgactgggccccgccaactgggccccaagggacaataatttttccaccattattgtataatattatttatatatttttcattacatacacataggtatgtgtgtttcgtttacaataatctaatttgtgtttatatttttttcgttcagtgcctaactacaataccttttcttcagctattttttaaatttaactatcatttcatggcaaataatatattatcgcagaataaccacaaaaaaaattgagcatgaagggcatctttatgttttcgctaacttagtgcggatggttttatcaaattttggaggtgtgagaacaaaaacaataaggacattttgcacgaaagaactgttcacgagcaggatcggacgaacaactttgcggaagcagcacaccggcgattgcaacgcgccttttcgtgtcatcatccatcagtgtggcggttcatttagagaccggcgcgggacgggatcccgcgcgggattttgcgggatcccagtccgcaatcccgcattttttggaaaatgcgggatttgcgggattaatctcgcgggatcccgtcccgcaaagaattttgagttccaatcccgcagcgggatccgcaaatttgattttttgtgcgggattatgcgggattttattgatttttttgaaaatttttctaagacagaatgccaaatatttttaaataaattaaataataaatttaattaaagttaactcatttttcatcgcaaatttcattcaaaatttgtgaaattttcccggcggcgcctatcggcaccgccggataggcttttacttaataatcctgtagaaattgagtcaaaaactgcgtcatttggtcaattttagacaaaatctgttaacaaatcgtattaaatttcataaaatttctcgcagatgtcgataggcaccaggtatggcacggaaagacttccggtttccgacatttttggggtcggaattccgacttccgaaatttttgatgaaaagtcggaaatttttttaatttttttttcaaaaaactagtaagttttctacaatttctgttatttttaaaaatttcccggcggcgcctatcggcaccgccggaccctaaaaataactatttttcttgcaaaatttgctcaaaatcgcaaaattttgtaattttttggacaaatctgttaacaaaattttctcggcggcgcctatcggcaccgccgtaccctcctccaagtcccaaaaagtttttgaaaaaatcgcgctgtaaaaaacgtgtaaatagtcactccttttcccaaaaatgttctaaaataatgaaaaatgacaaaaaaagattttgataaaataattgaataattttttcaagcgaatatactaaaaacatttgtgaaataccttttatttggttaagaattaaaaaatttagcctattaaaatatttagaaattttttttattatattgtatattttttcaaaaatttccgatttccgacgtttttggggtcggaaatccgatttccgacactttcgaaaaatttttgggcctcggaatgccatccctgataaggaccgccggaccccctgttcctagttttttgaaaaaatgcaccgcaaaaaagtggttttgaaaagaaaaaaatagacaaatttatgaaccgttaataatttgatttccgatccagtggggaccgtcggatccaatcgaaaaatcttagtcgaccc

SEQ ID NO: 13789 - DNA, 1707 bp, Heterodera glycines
ctgaacaataaatggggacgggttttattgaaaggggatgaacacattttggcaatgcgtaaaaaatgaaaaaaaaaaatccaaaaaatctcattaattggtgatttattgacacttaggtcaaattaaaaaaatcacatgtaagcaaaaaattaattagtacaaataaattgaaagtgaataattgggagaaccttaaaaattaattagttacctaattaatggtaattaggtctaatttaaaaaaataaaaaataaatcaaagccattatgtagtaaatttaaatttaaggataattgagcacacttagtcctccacctcccccccccccccctcataaaaaacagaaaaaaaaaattataatatcaaaaattaggaaaacgatcacttatcactctacaattggaaattaaaaactttcgaattttgactttttatttgaatttaggtaagggatttgttttgaaatgtattgtatgtcagaattcatgttcagctatcccaaaaaatttccaggaaaacattttagaccagattcattcaacctaaacaacctgagaaaaaattgtgcttattagaattcacgagagaaaattttgaaccaaaatttaattttttcagggaattaattttgaaaaaaattaaaaataaaaagttatcaaattttctcactttgtcctgcgcaaatttggatgtcaacgcctttttgtcgggcaacaagaaaaagccgccctcgtacagcttcacagtgacatcacccatcggcaaatgcgactgatggtcatcatagtggaagaagcattgttggctggacgtggtgtgcttaatcggcgagaagaattaaaattgaaatggaaaattaaaaaaaaaattacgaaaaaattaattaacccgcaaaaataaatgcattaattatgattaataaataatgataaaggtgcaaaaataattgatgaattaattcaattaattaaggatatggcgaaaaataatgactttaatgaattaaaattgtttaaagaaattaagttaataaaatttaaatccaagggaaaaaaaattttaaaatgaaaatattcaaaaaagaaataaagaaaatttaaaatgaaaaaaaccaagattattttttatgtattaagatgataatttaggactctaaaagatttttcaaataaatatttttttaccaattgtgccattttcatcattttgaccaatgagaagctcatgccgccaagcagttcaggccttaataaatcaaccaaaatttttaaccagaaaaatttttttttggggaaaaatttttaaaaacaaaaaaattcgtttaagattgtaataatttatttccggtggcatctttcggcaccataggaaactctcggatttgagtttttagctaggccctaggtgattagatcaaatttcagcaaaactaaactgttatctttccttgtcatcccaaatgccattgatcaggcaagaaaaatcttggccctttgatcactcccaggaatactaattaccaaatatggcatggaaatcaaccgtgccatgactccgcccagctgtacccctctgatctgatcattcccaaatatgtcccactgatcagaacagtaatcatcccaaatatgccacggatcagattagaaaatcttgccacgggaaaccaattgtgccatgattcgtcctgctgtgcccatctg

SEQ ID NO: 13790 - DNA, 1183 bp, Heterodera glycines
  misc_feature (1040)..(1040): n is a, c, g, or t
  misc_feature (1064)..(1064): n is a, c, g, or t
  misc_feature (1076)..(1076): n is a, c, g, or t
  misc_feature (1127)..(1128): n is a, c, g, or t
aaccgactccaacaatattggtataattcgataggcctgaggcgttctctattagctttacaaagatttggaaaaatttcgttaagcttcaaaaaagttatggtcagaagagttcaactaaccaaattttccaactttttttggctcgaactttttttatactgaacgaaatttttttggaattttgcaggctaatagtgcatctgaagggctatcgaatgataccaagaatgttgaatttggttggcaaagaaaaaagttatagtccaaaaactccgccccacgcgaaaacggcctggcccggaaaaacaaaaacccactgaattagagccacctttgaaaaaaccccttgaaaaaaagagcgcctctgggggcactaatccaataaatatggtaaatcgtgattcattttttacaacaaaatttgagttggcgaacgcgtataaaaaagggaaaaatcaatgggaggaaggattatcccgtcccccctaggacgttctgaggccccccgcaaaaaaaattccaaaaattttcaatgtttgatcccgaggttgccccaacagggaggtccaaggagtaaggaaggaattttgagctgaggtagggggaggggtataacaatgaaaattttttttttgcaaaatttggagaggggttccctacccactagaattgtctatggaccctcaaaaaaatttaaaatttttaaaatttttcataattggttggttgcccatagccgataattttgttttgttgaccttgacaaatgaagagattggcaaactcttcaggaaataggcgccgtttcggatctgcactttcagtacggagtcgccactgacgcacaattggaggaacaaaatgcctgtgtgagaattaatgaacaaaatcaaaaatttatttttaaataaaactttattaagaaaagctgaaatttaaaataaaatccatttttaaattaaaatattttttaatttattaaaaatacaaaattttttcttttaaataaaaaaaacatatttaaaactgaaaattanaataaaattttcttcattctttanattaataataanaaaaaagctgtttaaaatattcacttttcttttaaatcttcgattaaaggnntgtaacaattttttttttaatatctataaaaataatattttaataaaaaaaatta

SEQ ID NO: 13791 - DNA, 995 bp, Heterodera glycines
  misc_feature (909)..(909): n is a, c, g, or t
tttttaatgatgtataaaaatattaatttttcatataaatttaacaattaatttattatttttaattgtttattttttaaatttacatgttactttgtgctgtagatgaacaacttcatcagtgccttttacgacgctgtgttgctgtatgcgattgcactgaacgaaacactggcggaggggttggacccgcgcaacggacaaagtatcacaaggtgtaacaatttcaactttttattttttaataattaaataaataatgaataagattctctattttttgtaacattttccaatttcagcaaaatgtggaaccgcacatttgtgggcatcaccggcaatgttagcattgataacaacggggaccgctactcggactactcattgttggacctggacccggatcaggacaaatttgtggtccgtttaatataaaatgattacacaatgacaatgattcatcctctattaaagcggcccttgacctctaagcactgaaaatttttcaaaaactttattttctgtgatattttctcgaaatattgctaaaaatgtactttttaagaattggaaatttatgccaaaaataagtcaaataatgaaaaattgttttcctttttactcagttttcttcaaaatgaataaattttatctatactttgtattatttcttctaaatgatttttcataaacttatttagctattttcgcgatttttagctttaaatttaacgaacttgaagaatttttaaaagtttgcgctcaatttataaaaatttatgtgcatatatttttcactttttgtgcattttttgcaatttttaatgcatattttgcggttttatgtgcatgttttttgcagccctagctatgccctattaatttaaaaaacaacaatttcaattttgngcgccggaaactggtcattgaagattgatcactaagcaattgaacaaatctttctcccccctcagcatcggatccggatataattt

SEQ ID NO: 13792 - DNA, 2802 bp, Heterodera glycines
atattatggtaggctttaaattaaaaagaaccccgtccctacccagcccggcttgccattacgaacccgattccaaatatggaaaccggggaagggggggggggggggacagcggcagaaaaatgcgaaaatgaagatggataaaccaaatattccaactttatacctgtagcatgaaaatgtcttaaactttctttttttcaatttaatactacatacaagaccagcaaatgaaagaacttattaattaaaatttatggcgttaattataggttttttgataattagtattaaaaaaaactgaaaatacaatcaaaattgaaaaatttatgtgtagaacacataaatatttccccaatttattcaggaagttgcctattattcgggtgcatcgaacgagctgaaaaagatgaccgacttccactgggtgggcgggaagcctccaaaagacaaaccgtaattatattttaaataaatttatccaaaaaaattaaaatggttctcccctcagggtatgcggttgggaccgttcaaaatgctcggaaggttacccggcccatgtgtatgctttgatgggccttggcattgtggtggttatcatgatgatcggcttcatcatcttttacaggtcactcctctccgcacagctcattaaaaagaatttgttaaaaaattaaggcgttaccgtgccgaggcggagttggccaaaatgacatggaaggtaaatcttctgaaacaaaaacaaaaaaaattttctagtcatttctaaagaattctttcacatatttttccttttttacattttcaaagaaaaaatttttcaaaatctaaagctttatttattttttattttttgattttcctaaaaaacctaagaaattaggaagctaaaaatttcggtttattaaagaattttgtatatatattttaaaattatatataaatattttcaaaaatcattaaaataaaaaagatgcaaggtttacctaatcaaaaaggaacatttatatgaaaataaataaaacaaaataagaaataaataaaaaattaaaaaaaacttcactggcagatcaaatgggaagagcttgacggcgaagatgttcgacgggagaagaagaaaaagcgacaacagaacagctcgacaaagttggcccgcttcgatgccgcggaacagtccgaggcgttgctgcgctgcaacagtcgcatgtccgtcggctcggacaaggtacagtaccgtctcgcattggaacttacgataaaatgaaactgtatgcatactgacgaaacccaactcttactgcaccgactcatattttttaagacatttgtcaaagttgaccaaattaaaccttcttagtgtaattcaatagcccttaaggttctctctatttccttacgaaaaatttgatgtttttgaaaaaaaaaatagtgaaaaattttttttacaattttttgtcataaattttagaaaaagtttcttgttttttcatggagataaagaaccttaaaggctatttctcgaaacatctcgaactccactacatagtttaacttctatacttgtctgggtcctctacagtaactgatattctctagactattatgagcataaattatattattagcgcagctttttttccaactgctggcccactacagtatacataatacctaatcggattccttccttctaccataacccaatacttgcttgagctttcaaacccagtatacagtagctttacagtttgctgatgagttgttagacgagtttgctgtggtgcgattatcgcaaagggaccgcctggtgagaacacatacacacgcactcgcacaatttggcaatctgcttttttttaaatttttggtgtgctttttgtgcgtgtacattgccatctacggtatgggttactttggcgcgtcgccaatcttagaagccattagcttgcaaaatttaaaaagatttcttttgttccaaaaaagaaatggcgctcggcgccaaaaagctaaaaaagtcaattttttaactataacatttttggacagcaacgaaattttcgaaatgcaaactaatgaaaattggctggcgccaaaatgacctaccggcttgccgatcgcaccacaacacagaaaaccattgtaattttagcatttcctactctttttattgtaattgtcgccatgcactttttgctattatgcaactaacgctattttcccccagtttttttcagaatgtctaacaaacaaaattacttataaaaaaaatttcactgatttatcctcattttattgtttctgaaggggttaaagaggtttttttttgaaaatgctgttttgcgactttttgtgcaagaggaaccaagtgcagcttacatatgcatatgtcatacatatcttaaatgcaaaattaattcgcactcatttgtctgctttacctcattatcattcacttcttgttaaataaataaatatatcaaatattctctagtaagtaaatttatttaagccccccccccctctttccccgattataaaaattttcaaactgaaggttttcaaaaaaactttttatatgaaaaatcaagaaaaaacattttgaaatttttttagccattttatcaaaatttatgatgggttactgcattttccaaaatttctaaaaaaaaatcgctaaaaaatttcaaagtttttttgcaaactctttatgaaaatttttttttaatttcagggctgggaaacgattcgtgagggggaggtaaatatttgcaccccttttatcctatttctggttcttttgat

SEQ ID NO: 13793 - DNA, 2169 bp, Heterodera glycines
tgtaaaaatgaatttgttgtatttaatatttattcttattttctttatttttgtaattgactccgacaaaatgcgaccaaattttgatgaaatatttggcaacggatgggacaaaaaagaaagtgaacaaacagtgaaaattgaacaaaatgaacgaaatgagaattcacaatcagcagcagttgatcaaatgggtgaagaaatgggaaatgaccgaaatgatcaaatgaaaaatgatcacaaaaagagagaaataattcgaaaatttgaagcaattaaagaaaagttgaagcaaaaaggaaaatacgaaaacaaaaaccgaaccaaaattgagagaaaaattgcaaaattattaggagcaaagataacattaataagtaaatggaaaaatgaattaaatctaaataaaaataaaataaaaaaggaattttatgagatgaaaaagagtgaattcattgaacgatttgatgaatttaaagaattatatggccaaggcaaacagaaagaatttgcgaaggaattgggcatttctgaagacacatttcgaagatggaaaaaagaaatgctaccaaaataccataaaagtcaaagtaagaattattttagtgaaattaaattgtactttttctttaagaacaccataccaatgatgataaattgatgaagatgaagcaatattatgaaataaaagaagcaaacccaaaagtgactgacaaaataattgccaagaaattggggattggatggacaactctgaaaagatggaaaaaggaatgctctcatccaattgatcagtgatttttatttgatcatgattgttgatgaccatgaatagttttcgaaatttacaatatcatttagttgagactctaacctttttttagtttctttttatgtcatggtaaaaagattgtttttcaaaatgctggttcttacaaatgattaaacgatttgtgaaatcgaattaaaggaaaattattcttaaaattggttttcatttataaataaataaaaccattaaacttagtaatatatactaattctactttggtttatgaaattcctgaaaaaatttggcggaaattctgggcgaaattcttagaagggatgaaaattgaaataatttgacaaaatcgtttaaattattaattataatcactcttattgggtaattaatggaatgacgaaagcaatgatgaaaaaataactcttaattgaaaaaaaacagaactcacatgtcccccctcttttgatcaattattgaaaatgaaagatgatgaatgatggtaaaattaaataataaatcaaaaatagttacacaaattaaaatacgaaatgggcaacttaaattgttcaaaacttcaatatttaatatatttttaaaataaatttgtcaattatgtaaataaaacaaaaacctacaagtgtttttttttataaatctaatattagaaaaaattctgggattttggctatagccatttgatctgccatgttttaaaaagcttaatccctactcagaaatgaaattcagaatgactacgagagtaaagaatcttgatgatatgtgtgaagcagaagtggtcgttgaggtccaaaaattcgggaattctcgccccaacaaaaaaaactggaattcggggcaacccctgatacaataagcaacaagcagaaaaaattcgggaggtggcttatggaaaaaacactttttttagtcagggtattcttcattttacatcaatatttgtcactaaaatttttttattatggatttatcatagctattcttaattaaaaaaattaaaattaaaaattccttttaatttttcggaaccttccaaataaaaatagcccatttatctcttaaacaagtttccttttagcatctcggcgctatccccctgtgaattttaaagaaaaattttttaattcgggcaaaacgcgatactaatttgttttgtctctttttattccaaaaacaggggatgctcgggatggcatggcatttcgtccacatttgtcgtccagcagcaagcaaacacaaattgtggggggggggaggaggctttagtccgcttctccgtttgtcgagaagcggccttaggcataaaaaagcctcgggggataaatgtgcggcgaggagagggggggggggaatgtttttttttt

SEQ ID NO: 13794 - DNA, 1815 bp, Heterodera glycines
gacgaggaggaggagtaccaaaatcttgtggtggaccagcaggcacatatcccacacaagcccaccaccactctcatccaatcccaatttaatgccctcatcggaattgccaatcaatgggaggaaacggagaccgcggacgagcgtacgacggtcggaagatgtaccccgggggaggggcacaaggtcaatacagcccctgaaggggtgggaggacgaaaggggaagaaatccctcgggggggggggggggaatggggcaaaacagtgaaaggaggaggaggaagagggagaaattgaggtttcattcaatgtgggagctggggggagcggagggaatgatgggcattttgcccgagaggaatgaggggagagaggcagagaggggagagcagagacataaagtgttatttgtgtgagtatgtgtagaatggaaggaagcagagaaaacagaaaaaaaattgaaaggaaacagtggggacagagaagcgaaaagggagagagagagagagagagaaagacagagaatggaagagacaatttgcgagaagagaaaaacaagcagagaaattgaggagaagaaaatggcattaaagaagagagagaaaaaagcatatccaaaagagaagaaaaaaaaagcataagagatagattgagagagagggagataaatggagcgaaagagagagagagagagagaggagggaaagagagagggtagagaaaaaaacggagtgcagagaaaatgcattattaattgagaaagaagcttagcaacgaattttatgcttcaaaatcactctgatcaaagtaaaatcagtgatcaaatggataagcatttctttttccatctgatcagtgttgtaattccaattctcaattccttggcaattatttcgtcagtcacttttgggttggcttcttttatttcaaaataatgcttcatcttttctaattggtcctcattggaatatttattaggtgcttaaataataaaaatgattaaactaattaaaaatttaattattccttattcctttacttttgtggtaatttggcatcaattcttttttccatttaataaatgttttttcagaaatgcccaattccttcacaaattctttctgtttgccttggccatataatcttttaaattcatctaaacgttcattgaattcgctcttttttcatcataaaaactctttttcattctataggttttctttttgtttaaatttaattcctttttccatttgtaaattttttttgcgatttacgcctaataattttccaaattttctctcaattttgactctgtttttccattgataatttcttttttctcttaacttttctctaattgcatcaaatttttgaacaatttctctcttttgctgatcatttggttcttctataatattctgatcacttttcgaatggttctgatcggtataatttctcatttgatcaattggaccatttgccatttcttcacccaattgatcaacttcactgttttcattttgttcaatttttatcataatttcttttctctcttttttgttccatccgttgccaaatatttcttcgaaattcggtcggattttgccggattcaattacaaaaataaagaaaaatataataaataataaatgccacaaatttatttttacatataatggaaatatttgtttgaaatattctttaatattgcaatttcatttcatcaaatattgcccaatttttctcaatttattggcattaatttacaaatcgataattcactgatttttaaatattaaaaattgtttaattt

SEQ ID NO: 13795 - DNA, 2870 bp, Heterodera glycines
ttaaaaaactaaattttatttcaaaatttattcaaataacgaaaagccgtcgcaacaaaaaactcagtaaagaaatgcttttttaagggcatctttaaaatggcacatgaaagcttgtcttatcggaaaaagtgcttggttgttttgcttttttaatgatttcggatgaatgctcacatttcacagtatttagggctccatgggatcaaaatcaaacataaaaacatttaaaagttaaaattttcactaactccccaatggttaggaaggcccagtttttcaatgaaaaataaaatagttttattttttcaccgcttaatacgagacggattttcatatttttaattataaattaaaaatgatgaataagcaatatattttgaaatttaaattgaacaacgaaggaacgaaaatttctataggcatttgaaaaattttttaattaaaattaacgaatacaaaaatgattttttgaatattgaacaccggcaaatacaaagcaaaaaaaagaaaagtgcaaaatgggcaaagaaggaaaagtgaaaataatatttttttaaattaatttcatcggatttttataccatttttaaaattaaacgaataaaaaaattctctttttaaatatttaaatttaatattaattatgttaattaatttaaacaatcaatgcacaataaaactccgtttgtcaaaattttgcaataaatttttccataatttcaaattattaacatatttgtctaaatccgatgaattgacagaaacagtaaaatgattgatttagtaatcggcacaaaaccggtaattcatcaaaaaaattgacgacatcatcagagttcggcacagatatttatgcttaaacggagtctcaaattattatttcggtaatttattgaaaaaaattaacatgtgtgaaatataattaaggtatttttaccgaatcaaatattgcattttctcatttttattgataaataatttagtaattattcttcaatctccgcaattcgaagcctgtttatacagtagcaatttcgtaaaaaatttaggtttttgttttttaaataatggttacttgggccgggaaataaattgtggaagattttgccggtagatcaagtctataggctaaagaacgctgaaccctaaattatgaatgatcccgcgtgagaagtaaatgattaatgaatcatacagtaattttttaacttttatttttgtgttaagccttggaaaagctaaattgtaattaaataaaaattatagaaattaaacgaacaatttgctaaaattacaagtgaaatttgccgaggtaattagtggtaatactaattatttaattaaattagtaatttaattgttcctttccaccacttttcgaactcgaaatgacgatgagttgctccgccgtcttcaagcagaacaatttgatgttgtacttgccgaactttacaaccagtgtccctcggcacttttccatcggattggcgccaaaacaaaacttggcactttagcggtgccgttgtatcaaacggttgtccgtccctttggcatcccaacgctgagcagttacgtgacaaatgagtgaatgtgccaacaaagggggaaggcatttaattaattaatttaatcaatttggttaattataatttagaaaatagagaaggtctatttcgataatttcaatgttttcatatattcaattttaaaaatcataagaaaaaaaagtatttttatgaaattattaaaaaactaaaatacttttatttaaaaatatttcataaaaaaagtacaaaaaaaaacaaaacaaattttttgttttaaagcgatcgtggacaattccagggatggcacagtgatcgtttccttcggcacttttgccgatattaactcaatgaaaagggaaatgaaaatgaaaatggcatttttggaagcatttgcccgcttttcgtactatgaatttatatggaaagttaaattgtcttatgaagatgccaaagtgtttgccaagtacaaaaatgtgaacccggtcaaatggatggaccaaaaatcgttgctaagtgagttaaaaaacgaaaaagtttgaaaattcagttaatcattgatcacttagtaataagttcactaaaattaattacccttaatttcggaggctttaaattttttcatattcggtcaatgcccaaattcttggtatcaaacgaaagctcaaagtctacagaaattttttatttagcgaattgcggaataaatgtttaacagacaaaaataaattgtcttgaatatacacgaaaatggtgaattcctgatttctattgcatactttttcttaatattaacatgctattttcttgtattttcgaaattccagaaacattgcgctttcgttgttacgaagaattttttttttaattttaacaacaaaaagcactaaaatttcaaaaatgttacatgtcggctcctatcggcaccgacgggtcaccattttagctgtttttttttttttgaaatttagacctaaaaatggcaaaagcagtttttttttgacgataaacggctagaaattcttgtttttgttccccggcgctgaaatttttaaaataacactggacaatggacaagtaagaaaaaattatatgccaagaaatttaggatggtcacttaatggacacgtaattggactagagccaaatttgttaatatttatataaattagtaaaaagtgcactatattaattatcctcgtagaaattttctttttagccaattttttccattccgctgcttgccgaccaactgtacaatgccattatggcacgtgtgaaaggcgttgctgcccaattggatgttggacaactcaactggga

SEQ ID NO: 13796 - DNA, 1426 bp, Heterodera glycines
cgaaatttgaccaaaaaagatctattttaagtcaataccttccactaaatacaaatcaaagatgcatttttcgaggctacaatttttttttcttcttaaaatcagaattaccgaccataaattgataggaaatcggaattccgtgtcttcctgacccatatatcgcatataagtttgaatatttagaatttcttgtaatattttttcattttttcgtcccacatctgaagggtattcatgtatctttttaagacacataggatggaattccgaggccctaaaactttgaatgtcagcggaatctaggagacctccaaaaattttttggaaatttgatttcaaatttccatccctgtaactatgtatatatcagtatccgttttttaaacaagaaaattcactttccactgtgcaaacaatgcaaattctccaacaaaaaactgggcctgagcccgccaatgtcgagctggtgttgacggaagatctgagcaacggtgcggaaccgtgcaaagtgcgtgtgctcaaccaggtcaatgcggagcagccgaaaccgttcgagtacatcaccagcagggagaatgcttcggatttggtaaaaaaaaatgagtttattacagtaggattgggcaaattttaaactaaattttcctaaaaatttcaaattttaacatctgttcattcaaggaagacgattgtgcgcacaagctttccaacattgcacgtccagacagcttctttcaggtggtaaatcggacaagcgatgtcatcatttatcaaaaaattttcattaccattaatatgcaatcgtaaaataaattaaaataatttttcgataattaaataaccgtttcgccacaatttaaaaaaaagaaaataatcatttttttcaaataagcaaaaaaaatagaaataaatacacttggaatctcggcttaatcgaataatcaaatttttataaccccgaacgggagaaacgggcttttttctcgaactcaatatctctcaatgaaaaattttcgaaaaaataacacaaattttttcccgcatctcggccttacaatttaatttcgaattaaaacaaccgggtgggcaacggcaccgtcaagccccgtttttgccaaattcgaacgcccaacaggctttttcgtaataatttttctttcaaaaggatcaggttttaaccaagcattaacgtgaaccaaagagatattcgagaaatttattttttcgaattttttcattgagactttttcgagttaaataaaaagctcgttttaataccagtgagcccgttccgggctctacaaattttaattaaatctatatgtttaaatacataaaactggtataccagggatgcgatcgaaaatttttcaaaatcaggacattcgggcccaaaaaatcagattttgggggtcaaaaatca

SEQ ID NO: 13797 - DNA, 2267 bp, Heterodera glycines
  misc_feature (2161)..(2161): n is a, c, g, or t
agagagtgtagagaacaaattaagagatttgagaacagacggttagagggacggacgcatgcattacgttgccgcccctcccccccaccctccttttaccaaaaatttttaaatgtaaaaatgtatttaattttttttttcttggcacttttatatggggatgatgcttttattcggggggggggggtgattaaaaaaaatcaatttttattttcttttttacaatattcaaattgataatctcatgttcggtgaattacaattttgccacagaatggcgaaaactatgtgctggacgcttttcgcaagggcaatttggcacgcttcatcaaccattgttgtcggcccaattgtcgcgcaatgttggccacaattagtaatggcggtgatgatcggcatgtgccgcgtgtgctgatctatgcactccgtgacatcagacctggcgaggaactgactatggattacggtacatacagtatattatgttccccagcagggaggcaattcggaggaacaaaaaatttttcgaactcggaattccaagacccgaaaaaatataggggattgagatttttttaaaatttttatttgcgccaaatcaataattctgggcttctgaaatttttctttttttatttctccagtttatgtatataacaatcatcttaatattggtgtgtgtgaattctgttaacaaattcaatatttgaaaattttaggaatcttcataacaagctgcattagaatttacaaaaaaaaaaaaaaaattttaccggcggcttcttacggcaccgcctgacctttattttaccatattttttgaaaaatttttacaaatttattcaaaaaaacaacaacaattctttaaagaaaaatgagcgtccgcgttcatgccgcctattggcgttgccgtgaaaatattctaaatttttgtgaaactaactcaatcaatttcaatattacttaatccaggtcaacagtggtggaatgccaaagcaggcacggttaaatgcacatgcaaaaacagaatgtgcaagtacggcgagcaattgagcaaccaaatgaatgagagcatccaattgctgaatggtgtgttgtgtgtttatcggatccattcactcccccctttttaaaaaaacaatttcttaaagcttttttctagtaaaaaaactggttttttttgaaaggttcaaaaatttttaaagttcttagcttttgaaattttttgaaaagaagggttttaatagttttttttaattaaaattttttttaactttatttgaaagaatctcaataaatgttagaaaataaaaaaatttaatttctttaaaaaattaatggagaaacgatacggggcgagagaaacagcggagggcgaagggaaacgggcatttcccatgtttattagtagagatcggtattttgaaaaaagcctggacctggacctggacctggattccatgttggacctggacctggatttcctggacaaaaatccaggaaaatccaggtccaggaaaaatccaggctcttcgagacctggatccaggcctggacctggattttttgaaactcatcttaaaaatcaaaaaaaggtttgaaaaaattaattaattgcttagaaacatctaaaaatatctacttaataataataatgtatttttaaattaatttaatctttttttgaaaattaaaaaaatcggtcacttgaaataataaattctaaaattttgtccaggaaaatccaggtttttcgtgttttgcctggacctggacctggattttttttcacattggacctggaacctggattaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttgnggacgaaatgtccttaacctattctcaaactctaaatgggtatgaagccagggttgcttgactctgaaacccagcgttgaatgtttgagctccaagtgggccattt

SEQ ID NO: 13798 - DNA, 1316 bp, Heterodera glycines
gatcattatgatggcatgcgcgacatccaccccacaaatcgagcaatgcacaatttcgccaattcgtaacgacggatggacggcgaacaccacgcagggctgacgacactcgcgggaaaagggcccatggagagagtcgtagacacgaatgcgaccagtgcgggcgagctgacaaggggcaaacgggtgaataaaagatgtacaagcaatcgatggcaaatttaatcaaggggggctatattagggaggcgcagtgcgtaaatttggccaaatgattcactgccacggaaattgtctcgagtgttgccacctctgagtgaaagaagggttcttccggcttgtaaactctgctgcttttgtcttcggataaccattcgggaaaaatctgcgcaaattgcagcgaactttcggccacggtggagacgaagtaaatgggaatgttgcgggacacattttgctgttttaattaatgatagaattgccaaccaaaccccgaccatcgctcaccaattcgattgttttcagcacacattcgaacatgtcgtagaccaacccagtgggagtgaccggaatcagcacatttcctcccattttcaatgtttcaatcaccgcagaagagaacttgtacacctttaagcagaacggagccctaaaaggggtctcaaagtgatcaaaatacggtcaaatcgggcgtctgatcggccgtagacagggaagtgatcagcagagagtcgagctgtccgaaagcagtcaattccatcggtttggtgtgcgaatggcgcagagaggaaggcgccaaatagccgatgcggtggtgctccgtctgtaacagccaattgctggagccgatggcgtagccgctgctgaaggcggacacgcgcagctccccgttgaccacctcaacggagaattgggcaatatgtccaaatgtgcactaaacaaagccgcacaatttcttcgcggaagaacactctccgaatgcgtgccaaactcttctccatcgtttcgcgtgtgtaaaatgtcctccattcgtttgggtcactgagcggtgcgtttggaaacgatcggcacagcgtcttccacgcccatgaaacgtcttcagccggtcggtcgacgcgctcaaacatgtcgcacaagtcttccatgaccagtttgccaagttggtaggtggggtcggtggcgtaaactgtgccagtgaagccggtgccctcggtgtaaaaaggcagcgcgacgagagaggccgtgttggacaccaaaatggcatcgacggcggacaggtccaaatcacgcgactgacaacaaattggcacagtttt

SEQ ID NO: 13799 - DNA, 2059 bp, Heterodera glycines
  misc_feature (17)..(17): n is a, c, g, or t
  misc_feature (1118)..(1118): n is a, c, g, or t
atccccttaatttaaantcccttctaaaaatataaaatctccactttaaataattattataaaatctttacatcacacaccctccaaaatcatcttttactcttctcattcgtcctctttcttctcgtcctcactgtaaaattgcgaaaaatcggttaaataaataattatttgaaaatcttacagaacatagggggctctttcttgtacagtttatgctccacaaaaattcgggtcaggggttcgaaattggtcgaaaaggatgcaggattcgtacttaatgaccccgaaaacctatattggtattggcatattttttgtttgttaaataaaaaatattgtaaaaaaaatttatgggaacctaaactgtacaagagcccacagctgacttctaccacacctttggtgtcaagacaactcgtacaaaaggtagtaagctaggccgaagcttacggtttaactttaacttatgcctaagctttattttgtaaattttttatcaaaattttcaaacctacgccccctctcacattttttcaaagtgccgaagagcaataaaaggataatttccggagaaaaactaggcgcaaatataattaaaaaatttggtcccaaaacaggtgcggttagccccccctgctgtcccatggttcttctcggtcgtatggcacaagggcgaccggaaaatgcgtcagtgataaaaaatattaagtttcctggtggttcggggtcgctgatcgtgaatccggcacccatttcggcatattccgcactgaacccgaatttgaacaaaattcaaaagtcaaatttttcgaatttagctattttggttaaaaatgcttaaatgatctcttatgaaggattgatggctttcagtttgtttccatgtatttaaaccgattttgaacccaaagatactaattgcgaaatttaggctttcgattttttgttcgaattcgggtccagggttcggaattcagaacgattttcttatgaattttactttaatactacaatacttaatgccagtgaactttatttaaaaatttgaatcactgacgcattttccggtcacgggcccaagacctcctttatgtatgcaagttgtgtatgtttanattttattgctcaattaatagtttaaatttgattgccaattaattgtccttacataaatgccctgatgaagtccgccaagaacaatgggtcatttgccttgtcactgttttttgtattcgtcgtaaatctttttcgccttgtcttcccccatcgaattccacactctctcgttgtacacgttctcgcacttttgcccaatcgcaaaacgtcgtgaaaactttgctgccccaggcctacaagacgcagcagcccttgagaaaaacaaaagttcaaatttagtgggtgtaaatttttggcgttatgtatagccccccccccccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaattttattcatctcccttttcgatagaaaaagcatcagagtgcctaacataacatgtaaataaaatttggtgcgtttcagagcattttctgaaaaaatatttatgaattaattatgcaaaaataaataaaaatttaataaaaatttgatcgtgctataaataatcttgtaattgatcaggggctcgccaaattttgcagggatacgtatcggatcagtacaaatgttttataattttttctagattttttaaactcggtgaaaatttatagcagacaccacctcttttgcacttaaaaaaatttcaaaaaactttaacaattcatagaaaatttaaattcataggtactgctattaaatcaacgcagagacgcctttccttgacctatataggcccctgcaaaa

SEQ ID NO: 13800 - DNA, 1700 bp, Heterodera glycines
atattcttggcattgctcttgcttcctctcaaattgtttccatttttgtgcaattttcgtttcttcgtgccaaaaaaatttgaacaggatggcaatttggccatctcccaacgaaattctcgacttttttttcttcatgatggaatgccccattttaaacattctctagtctctcttcaatttgaggtcaccaaaactttatgaaactcggatttctgttaccatattataaaattttcatatttccctcattttccatgccattgtaaattttcctcaaagatatgtgtataaatgtgccattgaataagtgtgttgtgtgtgcataaaaaatagtgccaaatttatttatttccaaattctcaaaattgaaaaatacaatttaccattaaatctttaagattacgataaataatattataatttttgcgattttgaagtgatatatcttgggatatggaaatggtggggggggggggggggaatcagtcaaaattatattaatcggtcataatatctgacaggtttacataagatgatggaaggaaatccaacgcattctgacaccgtttgaaatgccatctttgcctcttcggagacatggacgcttattattattattattattgtttctgttggtatgagtacggcggtggtggtgcaccaccagctgctccttgtccgtatccgtagccgccgccgggtgccggccctcctgcagggaaatgtgccaaatatttttacaaaaaactttaattaaacaaaaccgatacaatggagacatcaaaattacgccattaatttttataggctataatttttgaaattgccttgctagagggaataacacatttaaaatttgccgagtgctctaccccaagacttaaatagttcatattattggattttttggatggattttcagttgaattttttttaaattgctagaaatggtgacaactcgccaagtcttcagtttcaccctattaacacacacaggaggaggaaagggtaattactgataattggcataattaattatttgttttacccgccgctgggtacgggggcgctccgctcgcgccgccgggaggcgcttgccatccgtagcctcctccgccgcccatcggcatctgctgctgcggttgctggtcgtatttgggtggcccagtcatgttcaagttacggacacgcaaaatgcgcacgtgcgtcccctggggcggcatgccgggcaacggttggtcaaaatcaccccacacatagacattgcctgaaacgggaggggggggggggggggtaacaaaagttgtgaaatttatttgataaattttttgaaagagttgttgctttttttaacgatttcaaatccggccacaaaaccgaaagtacccaccacgacatttctaaaccaaaaagtggcctaattattacggtttgttagtttttttcgactcgctttagcccttgattttcgaaatttttgagaaatgtaaagtgatagtgcagcacacccgtgttggtctgtcatcccgttctacctgagttggcggtggttagccggggttcgatcaatggcaccggcatttgggcggccacttggtgccacgtgaagttggtaaggtcgagcgtccattagtccaccaggcgtgccacgttgccgttgccgtaatcaatttcaccgccggccaacagaataaagc

SEQ ID NO: 13801 - DNA, 1481 bp, Heterodera glycines
  misc_feature (92)..(92): n is a, c, g, or t
  misc_feature (98)..(98): n is a, c, g, or t
  misc_feature (104)..(104): n is a, c, g, or t
  misc_feature (107)..(107): n is a, c, g, or t
  misc_feature (111)..(113): n is a, c, g, or t
  misc_feature (132)..(132): n is a, c, g, or t
  misc_feature (139)..(139): n is a, c, g, or t
  misc_feature (155)..(156): n is a, c, g, or t
  misc_feature (177)..(177): n is a, c, g, or t
  misc_feature (196)..(196): n is a, c, g, or t
  misc_feature (201)..(201): n is a, c, g, or t
  misc_feature (208)..(208): n is a, c, g, or t
  misc_feature (215)..(218): n is a, c, g, or t
  misc_feature (228)..(228): n is a, c, g, or t
  misc_feature (231)..(231): n is a, c, g, or t
  misc_feature (233)..(233): n is a, c, g, or t
  misc_feature (244)..(244): n is a, c, g, or t
  misc_feature (249)..(249): n is a, c, g, or t
  misc_feature (323)..(323): n is a, c, g, or t
  misc_feature (325)..(325): n is a, c, g, or t
  misc_feature (329)..(329): n is a, c, g, or t
  misc_feature (335)..(335): n is a, c, g, or t
  misc_feature (342)..(342): n is a, c, g, or t
  misc_feature (348)..(348): n is a, c, g, or t
  misc_feature (360)..(360): n is a, c, g, or t
ggttcgatctatggcaccggcatttgggcgggcttacactaggacgtgaagttggtaaggtcgagcggcaatacttaccaggcgagccacgnagccgnagccgnaancaannncaccgccggccaacagaanaaagccnaaaccgaacgaaaaannggggcaccacaacccccccanaacgggaacgggacccggncgggnccccgancccggcnnnnagggaaaacnagngnccgcaaccggncgccnccccgcaaaacccgcacccgaaaccgagacgagagccgcccgccagcgcgcggcagggaagccacgcagagggncngggngcaaanagagcgnagcgancggaccacgagnatccaggttcagtgcatggatacggctgtggccaaaatggccgtccggtgaagcggacacaaagtaaatacttctgaacacaaagccgggtgatgaaagaattttttttaattaccctcggctgagaaatccgtcataaaaatgggacagctgcgatccgggcacactgaagcggtcaatcggttgttggggcccataggcatcggcatgcactcgcaccacattcagtccggggccatggacaacctcacaaaagtttgtttttttttagaaaattgaggtgggaggggtggttttcgacttttgggctctcggaattccgttccaaaaaaatttcagggaaaaataaagaaaaaaaatgcttcttttttttggctcaccaccaactcgggcgcgtcctcgcgcatcgtgcaaatccattcctcgtcaatgacaagcggtgcctgcagcagcgaggccggctcggacgccatttgcattccatccgcgctcaaattcaaccgccacacatgcatctgtgaattattgagaaatacggtattaaaatacaaaaaacaaaaaatttcgtttcgccccatgcacgaaaagaaattatgggagcgaccagaattttgcattttcatttttaagttttttggggcttgtttttgaccttatgacaagtatatgaagcataaataaaaaactcagaaattttaggaaagggttagtaattataaaaaaaatttaaaattttaggggaggagacaaagcgattaatttaccccggataaattatttttttatctagccacccaccacatattggccgtagtcctcggattgggagaccaatgcaaatgcggttccgccggcttggctctgcactttcaacgcgaacaaaaatttgacacgtcctacacaatggaaattcatttttaatgaaaatttgtgccttattgttaggtcaaaaatgggtactttttcactttacgccacataaaaaaaaattttttttttggggggggggggggtttcggggtcactgatcacgaatatgacattcatatcgaacaattccgaaaccgggacccgaattcgaacaaaaagttgaaaattcaattttcgaatttcgcattttt

SEQ ID NO: 13802 - DNA, 2018 bp, Heterodera glycines
  misc_feature (1950)..(1950): n is a, c, g, or t
cgttccaccttactgtggctgatcggttgtacggtcttctcactgtattgggctgtgttcattcagcctgctgcgtacagtagttgtataatgcttggtttttctacccatttattggctaccgtaacgatgaccaacatgaggtgggagggaccaaaccattttaatgtcaaatggcaagaactgtccttgaaaagtgattattaatgaggcaaaatgtaaaataatggggtaaatagacaaaaacccagtctctgttttttaattacagttctcagctttggcgttttgttcaattttttgaaaaattttcaaggtttttgttcgctgaaaagttttctactcttgaaattctgtccaatttccaaaataaaaaatttagggcgtcaaaattcaactgaaactctcacttagaccaaaaatttccgaatttttcagtttgatgtttggcaacacaatgcacacaaccttttggtggccattctaagcccgggcatttatttgatcttcgctgtcacactttcgctgagaataagagaaagtccggctgtcatttcgcaattaaattcattgcagataaaggtcaattttttaattgcttttatgggtaataattaatctcgggtaattaattcaagaaaatcagccaaaaataagaaataaaatcaactcaaaatataactgaaatatgaaataataagattattgagttaaaaatcaatttttttttttttttggaaaaatctaaaacgaaattttattttcgtcaacctataagatcggtataacaattttgttgagtatttctcgttttttgtttaaatattggaacctattttctgtctaatttcacgataaaatgtattaaattgttttgctgatgagataacaaatttttttggctaagagaaaaatgaggcgccctggcctcaaaattaaaaattttttcagccttttggcctggtctcactatgcttttttcagacatttttgcaagtgttttttgtctcggcactgaacacattggccagctcaatttacgtttacctacagtacaacgagtcgcatcaatggctgatcactgtggcccaatttgcatggttcaaaaattatcgaaaatttaacttatactttttgtaattttacaggttacacgttcatggtaagacattttaattttcaattaataattaaacaatttttttgcctccttcaaaaggatttccacctgtcatttatttggcccttaacaaaacgatacgcgacgattgtcgcttactgtacatgaaactgttccagcggcaccgtatcgaaaagaagaatggtgttactgtacttgttaaagctgttcctacttgtccacaaaacattgcttcttcaccattgtagtatacaaattttgtttttcactggtcataaagtcggagagaagagatgggacaaatttcgagttcgaaaatttttggatctcctgagttccggtttctgaaattttttaagctaacttcgggattttttggaattcgatttggtttatttatttttttaatttaaaagcactgccaaattaaaaatgcttttcaatgtttcttgagcaaatgaatatttgttgccaattttattaaggaatataaaatcatttatcttttttttagtaaaattacttttccaaaaattgaattttaaattgttcttaaatttttcattgttttctttcatgatttcaaatttaagtttttatggaaagttcaatgtttttcctgtttatattaaaagggttgaaagcaactttcaataatgtctcaatattcattaatttaagccaaaaatttaaaccccaagtttctaaataattaaataattaatttaatatttgaaaaagcgaatttattatcttttttccctccctgctcccgcggcaatttattgcgtctccatatttcttatgcncgttaatggtccaccatttttgggcaagccattcattctaggcacgccaaacgctcatcatttctctc

SEQ ID NO: 13803 - DNA, 2084 bp, Heterodera glycines
ttattaagaaatataaaatcatttatctttttttttgccatattacttttccaaaaaattggaattttaaattgttctttaatttttcactattttaaacacaacattgaattagatgaacaaattttgaagcgaaagaaggaaatagaaaccggcgaaagcgattttagagcgatttggcctttaaggtggtgaaattaattttgaaaatattgtaaaattattaattagaaattagatttttttagttttttaaatattattaataaatatatgatataatgataaggaaaaaaatcaaataaactaaaatttattaatttaaacaaaattgatttttggactctccattttttaatgtttgaattttttttaattaatttccactttaattgatttttttgaaaaattttaggtatttagtgtttaatttttaattgttttttcaattcatttttagttcatcaccagtggtttcaaaactggcattgatagacgaatgaagcgtgcagatattctcgcatgcttactgattctcgtatgttattctatgcgaataaggccaaagattcggcattaatcgcatattttttcatattttattaggtttatgcccaacaagccttaatctaaatgaacaaaatattctcaacagaaaaaatatgtgaaatgatgtatgaaatgacaaaaaaaaacatttggagaccgagtgaaacctgggttggttttccattattttgttggcacaacattccaccgtttagacattcaaaaatatgcatattatatataatgaacggatttccatttacaaattttatatttttacatttttacgttttttctatttacattatctaattataaaatgctcttatctagaaaaaaattgtaaaagggtaaatgtaaaaaagtcaatcaataatttgctataatttgttattaatcatatgcttacactggccatttaattcacgagtaatgtatagcatttctagatattttttttatattaaattattttgaaggaattagacgtgccaaattggcatggcatcaacccttaatcagaaggggaaagattttacagccaaatttggcatggcacccaccttaaacagggggacgggggtggcatttgacgtgcaaaaatttggcttggcatcaatgatttggcatatcatgctattgattgaaatggttgtttaaatgtagcgaatgttcacaaaagcaaagcattaattttaggcaaatcaacgaaagacaccccaagaaatattcaaatctttaacaagtattttgcagggagctgagccgttaaaaccatcaaatgaaaaatttcaacaaaaaaatgcctataacttttgtcaaagtcaactaaattaaacattcttgatatcattcgatagctaaaagagttctctaatagccggaaaatttcaaaaaatttcgttaaggttcaaaaaagttatgaccaaaactgtctgaaaacctggttgttttagtacttttggccctaactttgtttcagaagaagaaaataaaatgtttttattccaattttcgccaatcatcatgatatttatgtttttgttgtgcccaagtgatcaaatgatgcaaggacgtaacggaataaacggtattgatattttaatgaatgcattgcaattaaaagaataaatttaaatatttattaaagatagttatgatacgggcccggatttatcttttttaaatgtttttttttgagaatattttatatgtatgaaaaactcataaatagcattgttaccagttttattttgaatcaaagcaagttattcgcaaaaaaataataatttttttttagacttttgtcttatactaaactattttgatgtattttttgcgatttttttttaattaggtcttttaaaaaaattggcactcaaatcttggaaaaatgaccaataattttcaaaatttttattttttgcattttttcccctttcataacttttccgcgttttaaggcaaaatttgaattttagctaagaaaattccgaaaaagaagttaatcttagaaagcgagaaaaagatttacg

SEQ ID NO: 13804 - DNA, 1275 bp, Heterodera glycines
  misc_feature (103)..(103): n is a, c, g, or t
ttcaagaaatttcgtaaattaaaaatgctatggccaaaaacgtttgaaacccagattttttttatttctttggccatatctttttctaaagtttacaggaatntaaaaaaaatagggatatcgaataatatcaggaacaaaaaaaaagaataatttatacaagattttatgaataatttcactagcattgttttgatcaaatcgaaaaagaaaaaaaacgcaaacagacccacaaatccgaaaaatgcttgagttcagaatcgaaaccgggactttttctaatatttttagccccaataatattatccgactaatcataaaaattattattaataatcagtttaacattccaattgttcacaaacttggaatcgctagaggagttcaaaatattggcctatgtaaaattttaagaaaattaaacaataggaaaaatttttttacaagggcaaacatttcaataattttaattcttttttagccaagtccacaatttaaggccaaaccaaataaaatttacaatattctccagaattttcccttcaaaatgagcataaaatggttttatttgctctagtattcaccaagttataagctaaaaaaaattcataaaattgtcgatgttgtacgtaaccaacgctttttgaatatgattttttattgccacgaaaacttttattaatgaaaaaataattctgccttcttctttaaaagaagaaattgaaattaacacacaacatagggaggacttgaacctgggacgccccttttggtgactaactcacagaccactaagacgaaaaatccagcataattgtacttggagcccaaaattgggccgctgtgtataatgagaagaaaaaaaaattccaaataaattaaaatttattaattaaacaaaattaattttggactctccaataaagttagaatttttattagagatcggaccgggcggttttttcgatttttttcggtatattcgattttcggtttcggtttttgaccgaaaaaaccgaccgaagtttttaagtttcggtttttttggttatttaaccaaaaccgactgaccgaattaatcaaaaaccgaaataatcgaccgactttttataaaaaatcggaaaaaacctaatggcgaattggagcgactgttaaaacaatattttagtgctttttttgtcatttgaggaattttctaaaatattttcatctattttaaaaaaatttataaacaaaagtgcaaaaaaaaacaacaaaaaatgcacccctgagaat

SEQ ID NO: 13805 - DNA, 1953 bp, Heterodera glycines
cccccccccccctatgatacggtggaccaaattgggttaattgggataattaatacttacaacacacacaaattgggtgagtgaatgaaaatgcgaatttggcgggaaagaaaaggagaaaagaagtgcaaattgttgatactcattaggcacgtgcaaatgcgggatcaaaactgtcactccctccatttctcttctcttttgcgcctgattttcccgcatttgaatgagtggcgaaacgtttacaaattgagaaaataaaagagaaaacacaaaaggcccattgtttcccaagacaatgctaatttttggtggtcataaaacaatcaaacaaaagcccctcccaaaacattttccactcaattcaaacattccttttccatcttttgaaagcaaaacgataagaaaaagggcagaatttgttgtgttgtgagaggaaatggcagaagaaaatttattcactgttcagaggagacaaaatgttggcaagtgatgagctaaagaaaagaacaaaggttaaatactgggaaagaaaagaaaagaaacagcaattaatcaattcgaatgggaaatgacgaatgaaaagcacacgggtcaaaagcatttgatgctgctgtttgtttgtggtcagcctcactcctccaacttgaggtcgggctcgttgaagcattccgtcgccagccttttcagctccgctttgtgtctggacagcgtggacagcacgtgcggtgccttccccgagtgtttctccttctgatgggtgtccaccgtcgctttgtcgtgggtggaggtgaacaagcagtacttgcacttgtagatgggcttcttcagatgcttctccagcaaatgcagcagacgacgcttcttactgatagtctgagatgggcaaaagtttaatttggaaaaatgagtctcggggcgggggctttgaactcaaaagaatggatggaaacggaaatgccattttctcattccttggaaacgccccaatttccctttccccatcaaatggcaatttgtcccccctccctcactgtctctcacctgagcacatcctcggcactttgcccttctgctttcgtccgcaattgtaatgttggacaaccgttttggtctgcccgggaagcattggttgtgcaactccgagaattcggctctgtgcttctccacgttggcgatgggttccatgcccttaaatttcgtctgtccctttgtcttttttaccctttcgtctgtccgttctcttgcctcacattccttcagcgtgtgattgttgcgcatgtgtcgttgcacaagccgtgcctcggccgcgccgtactcgcacaatggacactggtgcagcgggatgttcaggtggtactccgcaatgtgccgcgatgtttgccgtacgtccaaaccgcagaggcggcaccggttgaagtcctccgtgacactggcgggcaggcgccgattgatccatccggggaagcatcgctcgttccattccgcgatttcgcgggagaaacgcagcaaattcgcccgcggcaacagcgtcggttggcttttgtgggctcggaggatgtgattacgcacgtcggaagagcaggcgtagtgagagaagtcgcagacggggcactcgtacagacgcggctcccgcaaatggtgacggtacacgtggatctgttgaggggcgaaggggtgtaaatggaaacatggggaggtcaatggacaaaatgtgccaaaaaagcgaaggaagtcccattatccatgcaaatggacgccttcctcacctgtctgtcctccgtcttcatctcttgcccacactctctgcacctcactctcgtctcgtcaatgttcgtctgtctcggcaccactgctgctgctgctgccgtggtttcttggctgccgcagcgatcgctgccgccggctttgaattccttgcgcggaaagcaacgtctgtatattatttcgatt

SEQ ID NO: 13806 - DNA, 2061 bp, Heterodera glycines
  misc_feature (1238)..(1238): n is a, c, g, or t
cgtcattttgtcggtcgtccgtcgtcccatcctctgcccaattcgccgtccccgcgcatccctccgaacggcgttcgtccgatgttcgcagcgtcgacggcgattcgctcgtccgttccgtgccatcggccgcattcaaatggcgtttgcgctgccatcccgggaaacatttgtcgttcagtgcgtcaatttcgtcgcgataaatcgcctcgtgggaaatcggctccaaatgaacgccgcccgaggcgtccacaaagtctttgtggtcccatctgaacaaatggaaatgggcgaatcaaagaccaacactaaggcttaatcaactcacttaatgtgccatttgacccgatggatgtcgtaatttgaggaaaagtcgcaaagtgggcattcgaatatctgcaaactcagtgcccttctcgcaagtacaaacagtgccaaccccggttgcttctcacctttcccttgcgcaagtgtttgtggaacacgtgccgctgtctgtccgactgggccacgtccgcggcacacagtccgcactggtgtcgctcgcggggccgtgcctttgccggattattggcgggacggaccaatttcatttgtcggttggggaagcagcgaatctgtagaaagtgtcaagtgaatgggtgaggaaatggcatgccattaatttagtcagtgcctgcaattctctgatttcgtccgcgtatttctccaaattgcttattggcatcgcattcttcgcctccttcgggtgcactttgttgatgtgtttgctcactgtgcaactttcgtagctgccgaatttggcacaaattgggcattcgtagagcggtctcttcagatggcgctgggcaatgtgccgtcccgggtatttggactcttccctgcacaatttttcataattattcgatggttttcgctttgagtcatcgtaaattcctttcttccctttcccacgctttcaaaatgccatcccccattttggcgttttgtttcggtcggcaatttccatggcaccactcacatgcacaggtggcaaagtctgtcgttgcctgcagcgcattcgtcggccgccgttgtcggcgctttgtcacttggtgacgcgttgtcccgccattcgtcctcctccgtctgctcctccgttgttccgctttcctgctgctgttcgtcctcctcttctccctcctcctccgctattggtccgtgtttttcgcttcgttttgctgctgcaaaatgtgccncaacagttcgccaaatccctccaacaagtcgtccacttcagcgccgccttcgccctctctgcgccgtttcagcgctgtctcctcttccgtcgagtcgccgtgctcaattttccgtttctgtttccattcggggaaacaaagttggctccacatcttaagatgggacaccaaaacagcgattgaggcttgattcgcttcattgtcacctgaatttccaacttgtgcttctcctcctgactgatcggtcgcgcgtctttgccgtgctgcacgcggctgtgcttttgcacttcccacacggaattcgaatttgtgtattcgcagtgggggcatttgaacaaatctgtaaattgctattttcccaaaatccaaaaatgcttccaccccatggagcagttcagagttaacccttttccccacaacaaatccctcccgtgccacattcgccactttcccggcccacctttcttcttcagatggaccatataaacgtgtcgctgtcgtgcggttgaacaaatgtccaaattgcacaccttaactttgctgtctgtttgtccctttcgttttcattttgccgttttctccgtctctcacctgacagtgcgcctttcgaattgcttttgagtcgaccatcgaagcgcggcacgtcggcgtagggccattgggagaagaggaaccgtcgctgagaggcgactcgaccgagacggagaagagaagggactgcagggcattgccaaaggggtcccccaattgctgctgaaaagggcaaaatcacacggcgtttatactttggcggatccgccgctctttgcctcccttttctcat

SEQ ID NO: 13807 - DNA, 916 bp, Heterodera glycines
aaagtgtaaacaataaaagaatgcaagaataatggaaattgaaaatgtaggtgaaaagtatcctttcaacttaaataagtaccggatttaatgataatggtaattttattaaatatttatttattgtgcagaaaattggtcttgtaaaagttcggcaacacttcgaattgtttcacaaaagaatggcacggaggatttaattggaagaattggtgatcgcatttttaataaggaatggagcatttatggatttaattatttcattagttttgcggtgagtgggattcaaataaatttaataaacttcatattttaaaattaaaatttttaaaattttaaaaaagaaagtgacaaaaaattgaatagaattttttgaaattttttggttataactctttgtaaatttttttctagatcatcgtttaatttaatttaactaaatttaagctaagttatggtttcttattagcaataaattaaaactaataataaatttaaatgtttctatcattgacacttttgtaactttggctcaccatgattttatattacataattgatttaaaattaaagttataatcgtaaacattgctgattttcatgttaaaaaaaaataattacaatatttgtcaaatttttgcatctccaaataaatcactaaaaattaaggaattgttggatccgggcaaaggattttacgacaaagatgaggacaaagtcacattggccattgatgtcaacgatgcaacgccgatttggggttggaacgatttcatttcatttttggtgagtggaaattaattagtaaatttacattttaatattgtaatggcaaattaaggaattaatggacccaagcaaagggttgtacaacaaagacgaggacaacgtcaccttggcaattgattttacatgt

SEQ ID NO: 13808 - DNA, 2451 bp, Heterodera glycines
  misc_feature (18)..(18): n is a, c, g, or t
  misc_feature (78)..(78): n is a, c, g, or t
  misc_feature (199)..(199): n is a, c, g, or t
  misc_feature (2384)..(2384): n is a, c, g, or t
  misc_feature (2399)..(2399): n is a, c, g, or t
ttgcccaaattacgacanaatgcataaaacgaaaaatacacctctagaatagacataaactttttcaaaaaatgcacnttagaatcgacccgaaaatttcaaaaatcatctccaaaattatttctttatttcttaacaagaatttttgatttaaaaattatttatctcaataatgatttggccttattttttacttttntgaatacattttgtcattttacacccctaaatttgaggatttttagagcctagtttctttttttagtgcctattttttggttttttagaacctggacttggacttttgatctacaattcttaaataataaaattcatttaaaaagtaggaatttttataatctttagctttactttaaaaagaaaaaaaatcaaaaataataaaattggttgtaatttcttgatatttgagttgccttttatattgatagtctgctacttctgaaataataaattttccacgcaaaaattttacatccctataaaaatttatatagcattagcaactatagctaatataaaatttataatttattatatctctcatccgtggaaattgcctattttgtaaatatattttattatacaacattacatcccatataaaaatagcaactatagctaatataaaatttataatttactttatctatcgtccattgacattgcctactttttatttacatttaaaatagataattcactaaatgataattattaatgatcactatttcccattgcgccaccagtaggattttatattgtaaatttgtaaaaaatcaatgtttaactaaaatgatcaaaattaatattatacatcattacatcccctgtaaaaattctctttatgtatacagcagattcacttctacgttcacttccctcggtttctcttgcaaattccgaaaatttccaatgaaaatgtgccgttggatttgttcggatcggaaataattttccccgtttttggttcgaacacaattaaatcaattgccaatttcactttatcctcctttttgttgtacaagccatttctcggaaatgaataaatgcagaatagacgcaaaaaccattaataaattggttaagtaagcatcgatttttttcttaatgataaagaataattcaaatcatttccatagttaaagatcgatttatttttatataatattaaataataaatatttttaatatcctttggttaaacattgatttaaaaatcagaataaaaggcaaagcaactactgtgaatgtagtattaatatcttcacaacttaaatttccatttattgtttttttttaattcttactttattattatctttaaaatattttattaattttattgcaaaaataataatcattaggcatttttggtgatccattttacgaattattcacttccgatcacccggaaacggacgcccatctgaaaagaaaagaaatcttttaaacaacaactcatcatttgttctatgcgctaccaattttaatgaaaatgctacaaaaatacgcaaattctaagattttaactaaaaataagatttttctaaaaaactagccaacgatattttttgtttttcacacagattttttgcatgcgtttattccaaaaagcttcttgggaacaggacgggtctgagggtaccgatgggcgatgccatggaagaagttgaaaactttgacatactttagctactgattttcatttgatttttttttgcggctattaaattactcaaaaaaatggaaatttagcattgaaggaagacaaaaagtttcagcacaggttatttacactttttccattgcatcattaaaagaatacactatatttatttattttttaaaaacataaatgtcaatcgcttatttgttagctgacggtgccagcggcgtcattcgctttgacctcaaagcacgcctcaaattagccaaatcatttttaatttttggcggatttccaaacatattttttgtgaaaattttaatctttagataagttttccaaatgattaggccaccactttgttggacaagccttttctttgtccatcattccttaattctgacaattttattcgtttttttcttattgttggcttttattgagcaaacaaatttatttaaatttccattcaccgtaaaactaaaataatgaaatccaaaaaatgtgatattatcgaaagctttaaatgagaattatttatctaggaactgtttaatattctgatttaagttgtcaaaatgaattacatattttattattttgctatattatcaatcttggccaatttatatttgaaaatagtaaatgcagctcctccaaaaaatgaaacaggtaattctgtaattaatttatttanattactgtaggtttnaaggtcattagggataggcaagatcaaagaaaacaaatcccataaagcaatt

SEQ ID NO: 13809 - DNA, 2176 bp, Heterodera glycines
ggatttggccaaaccatccatttttcgaatcccgaacccgaattcggacaaatttcttgactttttaatttttttatttcttgcggctagtattttctacaataatttgtcagtttggtcggatgtgcatcaaacggaaaaaataattaaaattttataaaaatataacaaaaaataacaaatttcagaacaaactaaggtcgcatttcatagtttcgggaaacaccagtgagaaaattgataatgttttcgggattcacattggcattggcataattgtgatcattttgagggaggtgaatgttattgatttcgttataacggtggacgagtcggagaatccgtgcgtcggcttcgcgatacttctttttcttttgtggagcggattctcccatgacacaacgtgaaatgtccgcgtcaattgccttctgctcacatctgatcgtgtcaatgaagcgccaaattgttggatgagtgcagctaaattgccgctgaagtttgcgatggaatgcctcggcgaagttgttggtacgatcagcaccatctaaggtgcgctgatgaacattccattcgtgcgggtggaacagaggcgccgccattggaacattgaaacgcattcggcccatgtagttgtccaaaaacctagaaaaataaaaaaatcataaaattcgccttcggacttaaccaattgaaaacgccgttaagttgtggtggaatttgtgctcgaagaacattaaggccattttgaaggtggtgcacaggcagaaaggccaatgaagtgatcatcttagacttctcggcgaaagcaggatcagtgttgtaagcctaaactactaagaaaaaaatttatcatctgaaaaattcaattgacatgtgtgaggccaaggattctgatctgcctcttcatgttgcggacaaggtgaaaaaaacagtagcggacactgcatgccggaagcactgtgcggaccgcaccgaccattgccaactcgaagtccatcgaaattgtctgcggcgcgaaattcggccatcgttccaaaagaagctgtaacatgcgcgtataaattgcggcacacttcgatgttaaaagacagtagcaaattggaaatacccaaccatctctcctaaaaagattgaacattgtgataacacaattaactttactttgccaacaacacataaatttggctgaaaagcggtggcgtcaatgaaaacgtgccgtccgcgtaaatgtcactcatctgatgggcccaatccgccgtagaaactcttccaaaaatgagaatccttaataccggttcaatgatcagcatttaatgtataaatgatgtctcaccgttgaggtccattttgtccttgaatttgaaaaacgccggtgtccgccaatagaaattgttcctcgtcaatttcagttcgcttgtaaatacgataggtatttggaatttccaactgctccaaattgagaggttcggtccgcggtgcattttcatcacggcgcaatcgtttgattacctaaaaaacaaaaaaataacaaaattgtttttggatataaacccacttttttgtggcgcttttgctcggaaaagctgctagcacaggtgtgcatgtgttttgcagcacttgagcacgaatagtcgcaggtgcctcgcacgtctcagcagcacgtcgcttgagtccagttacaagtcgctgacattccacatgcgcagcattcatgtcgctcgaatgaactccgaccaacttctgcacaacgttatttaaatccgtgtgcaaacgccctgaattttaaaagatttgcaaaattcaaaataatatattaacatacccttgcatttgtctgacgggccatgaaactcacatcgccaaaatttcttaagtccatctgcgctcaattggtcgaaaacatagagcgcgccgtcatgttccaacttaactttgtttcgttttgttttaatttgttgctgctggttcatattgtaataatttaaaaagtcttaataaatttatcaaattcacttaattataaaataaattaaaactcgaaagaaaataaaagtcgaacaaattttggtaaaatatagtgtgtgtctgtgtgtctgtgtgtgtgagttatgaattctcttttatatgcaaccacgcgaaaatggccacgcgaaaacggccacgcgaaaacgtcctg

SEQ ID NO: 13810 - DNA, 1382 bp, Heterodera glycines
aggaagaagcatttgccacaatgtccactttattgtgcttggcactcactttcatgccggtgtcttggccttgcgcatggaacgaaagttcgcccattgaaatgtcaatgagacagccgatctgaaagggaaggcaccgactgatcagacgtaattgtacaaatggtaattaatggatggccaaacggcggaatgcctttggcatttcatgcaaaaggcttttatcattgggctgattgcattcccactgatattcaatcacctgcagcccggacactttggtgttgctcacgtccgccaccgcattgagcagttccaccgcgttaagcatgtaacagttgcgatattcggtgctgaacagcaaaaatgttttgtttcccttttcatttttcttcttttggtcactcccaaaagtgccgaattaaaaaacactttgcccttcccccactaattgtgccatttttagacctttccgccgtgattccgtgctggtccaattccgcgtaccggcacttgcgcaccgatgcatttgcgtcgaataatttgtcataagcgtggaattggggcgtcacccaaccgacccaaacattggaaaggtcctggccagggaaaatccgcacgccgtagtaatactcgtcgatctgaaattgcaggaaatattggccccgccctttgttcggttgcttttccccattgttcccattttccatttccgatctgcctgtttcgtcacccccccccccctctttgtccatcagttccctcccttcccccgcccatttggcaccgccttccccttcgctttatcccttcctccgctgttgcctcctcctccttcgctttacctggtctcccatctcttgcatggcctgcacatcgtccagcaccggccccccctcctcccccgtgcccaatgaaagcctttggccaatgcctccgctgtcgctcatttgttgctgttccaactgctgcataaaagcgcttgagctcattggagcaagcactgattgagtgcgcgcaatttgggcggcggaaaggccggaattggccgattccaacgggtgacgcttctttgagctgataaaacgctttttgagaggcgacggaccgcgtttaatggtcggctgacggccggggccggaggagggcataacgggcactttaaacggcattttgggaagtgaaagtccgtcgggattgaccagtcccccggcgtaccctcaatgccttcgatttgtccctccgcccggctgatccctccgactgacgtcgagtcaaagcttctcattgctttcattgcgctaaaatccccatgaaagtcctccgtggtccgctgatgtcgtcgtccttcgtccctaatatattatgccaattgtctcatt

SEQ ID NO: 13811 - DNA, 2403 bp, Heterodera glycines
aagaaatagttactcacaagcagggattaattgttgaaattaattaattaaatgtaagtgcagcgcataaaggaaaaaattaattatctttttcaaagtgcgacgattagtgaattggtggagggacaaacgaaaacaaaacaatgaccgcaattaaatgatcaattagctggcaaatggacgacaaagcaacagaaagaaatgcacactttttatcacggacacacaaaagtaatgaacaaaaaaaagaacagaattcgtaaatgtgctcctatttattctttcgttcgttcgtttttctttttgcctgaaatggtcggcccaaaagttggcattgtccgattcaccggccgatagccacgcgagaatggaatcgttgaaagagcacaggccgaacttcatcagagtcagcactcgacggcgttggctaacacaaattttgatagcaaagaatggattttagcgaaggttaaacactgcagagaaggaaattagcaaaagcgaagggattggttagactggcggcggggtcaattagggggggggggggtaattaatgagtgtaattaacggtaaacataaaaatgccaaaagcgaattatcgagtgggggggcattattcagttggataggccattatttttaatggcttacgctaacgctgctgccgccccgtccggcatcagctcgtggcttgagtcgaaggacgacgttttgtgcgttcgttggtcgtcggccatcgaattgccaacggcggggaaaacggcgggggactgctgctgattgcgcatggacgacagaaaggtctttgatcttcgagactaaatgaatgaccaatgtgctggactttattctcacagagagaaacgaaaggggccaaaaaatgaggaaaaagagaggcattccttaggcagcctcccccgaaatgaggcacccctaatagaaacccattataaatgaggaatgctcctaaatgaggcacatccctaatggacacccctcaaaatgtggcacaattccatactcaaatcagcccccctcgccccggtcttcccaactttttccccgccctctgctgctaacgaaccctcggccgttcttcctccggctctttcccctttaaaattgaggacaaagatgcatttcggcgttgttggagttcctccatccgtgaacgcaatgcctccttctccctgaagtgatcaatcgattgaccaaccaattaatcactaattggttaagccatcaatgactaagcaattaatctctaatttgtcaatcaatcagtgagtgattaattgctttttagcctcgtatttcgctttctcaaattgcctttactcacttattcttcacaaacactctgttgcagttcaccggaagggacagccgaatgaattccatgcgcgtcttttcctgttgtccccccgtgccatcgttgctccccgtcttttggcacaattttaaacatggcggcatcgtcgccgttgccggcaatcgctgcacgtccaatttcgatcgttcatcgatttcctcgaagcgtggcaatcgtttggcgtaccaaaagggcatcgtgcggaacatgttcacgcaaaagggctcatagccctcctgaaggccgcacgtggtgaagaacttcagagagtttgagtcttggccaaaattgaatttgccgcgttggccggcggccaaagtcattgcggggacgtaactgaacagaaaaagacggattaagcataaaatgaataaataaaatgaaaagccaatccaaaagactgacttggcctaatcaatgaaaccacccacttaatgaccctgctattattggttttggccaattaattgcccacccattgattggttgcacattgtcaaaggccatttcactgccggaaggatccaacagaagctcgccgttcaacgagaaagagatggtccggtcgctcaagtccaaaaagcatcccaccacgtctcccacctgtccaatggatcagtgcgttcggatcagtctcgactttcacccggctaccttccattctcgaccgtaatgctccgacccctggtgccattttttcgacaaatgcccgtcaaatccgaagctgaattcgtccgaacccagatttgtgcccggcggtgccgacacgtccatccaaccgactttcatgaacccatcagtgagcaccttaagcattgtgccgttctcttttgtccgcaacacttgcctgctgttcacctcaaattcgtagtaccatttgccggccatcactttgtaagttgcctccgcgcgaagagtgcgcgtcaacgcccgcagcgacttcatctctttctctgccgctaaagtaacgaatgacttccatttttgtagtattaattgtccatttgctgtcattatgatactaatta

SEQ ID NO: 13812 - DNA, 2155 bp, Heterodera glycines
tgcttagtattagtcactcttttttgttgttgatcgttctgtctaaattgctccacctccgcttttcctctctatttaaacacgcacgtttttcgcttcaacacattcttttcatctgacatcttattatatttaccaaataaaacttcttttatttattcggtatttatccccccttattcaccccgccctctctccctcgcgccttcccatttttgcccccctttgccgcccgagtcaacacctttttttaaaaatacaccactaagaattggaaaattttttcaaaaattcttcccccaaattttttttcttgacaaaatttttgatttaaaaaatgtcaatatttgctaagagaattttataaaggaaatgcagctcatttgcaactgcaaccagtgaataaaaattattttttgctcaatttttggctaaaaattatgtcactattcatcactatttcggacttttttcactattttgtcacttttttggcactattttagttaactatttcgggatttttcgtcactaaaagtcgcgtccctagcagggctgcacgcaattacggattacggattgcggattacggaaattacggggttttgggagttacggattacgggttacggatttttgggatttttccgtaattttgatccgtaatttgacttttggattattttttcgagacgatttcttgtaagattatttttataaaaaacaaatttttctattttttatttaaagggctacccgtatttcgatttatttaagaattaaaatagatttataattttttatttgttgttgttaaggctatttgggtagttcgcctagaaaatagaggcatcacttttttgtcacacctatttttcacgcattttatgaaaattcataaaaccttagccaggtgaggggaggaattccccccttcccccgcccgaaatgaaaaattaaaaatttttacaggaaaaattgggacttttaaatttttttttgtcgatttttcttaataaaatcattaaaatttaaaaaatttgcccggcggcacctatcggcaccgccggaccacgatttactcgattttaccttatttttttaaattttgactacaaaatggcaaaaattagtctttttttggctaaaaatggttacaattcctgtttttgctgtccagcgctgaacttttttaaataacactaaataaattttaccaaaaaaaattcttcggattcccccccccccctccgtaatttttttctggctattaaaatgttgaaataattatatacataaatccgattataatgatcagactttcaaaaaattttcaaaaatcaacccataaattcaaaaagaatgatttaatcagacacaaaattataaattatttgtaaaatttaaataaaaaatgaagaaactccatcaagaaaatcagttttttgatttttattaatcactatttaaaaatttttttctaaaattctgacaaaaattgatttttaaaaattacggattacggattgcggattacgggaaattacggggtttttggacccccgtaattacggattacggagttccgtaactgagaaaatcgccgtaattacggattacggatttccgtaattgcaaatccagttgcgtgcagccctggtccctaggtattacctttttttgcacgaaagtttttaaaaatagaaaattgttcgtttactcttcaaattttgaaaatttggtacttatctagtttaggggacatttcgaagttcacataaatattcttaatgagtttaaataatcttttattgctgtttatatgattttaagatcactttatgtatttgaatttggttcgacccaaaaactcgaaatttgaaaaatttaaattttcgaatttttgttcgagtaatgtgtttaaaagttgaaccaatgactttagttggacaaaaattttttaaaagtttcagggggttttcggggtcactggtcacgagtccggtagccatttcgaccaatttcggacccagaaccggattcgaacaatttttgattttgcatatgctttatatatattatatatcaatcgattcctctaatttgtcagtagaaagtaattcatgatttgtgaaagacaaatttttttttggac

SEQ ID NO: 13813 - DNA, 2633 bp, Heterodera glycines
caaattatatggaaatccatattttttcctggattgtgggaggcctgaaacgcacgaaaaacatgttagcttgatcagaagcttctaggatggatttctagatccgtattttccatatttttccatatttcgcgatttatgtccatatttccatattttggcatgtttatccatattttatgtccatattttggcatttttccaaaaaatctctattagaacggccccagcagctaaattggcccttttgagcccaaaaaccggaaaatttttcaaaaaaatcattttttcgtcgaattttctcgagaatattgaataaatttaaattttctcaaaaatgcaagatgcccatgaggatagcatccatacaaattttcgaagttcacataaatattcttaatgagtttaaataatctttctgtttagatgattttaagatcactttatgtatttgaatttggttcgacccaaaaactcgaaatttgaaaaatttaaattttcgaatttttgttcgagtaatgtgtttaaaagttgaaccaatgactttagttggacaaaaatttttttaaagtttcagggggttttaggggtcactggtcacgagtccggtagccatttcgaccaatttcggacccagaaccggattcgaacaatttttgattttgcatatgctttatatatattatatatcaatcgattcctctaattgtcagttagaagttaaattcatgatttgtgaacagacaaatttttttttggacgacaacgtctcaacagacagacgaacccaaatgaaggcagcgaaccaaaaatggaagtgtgttgaaactacaaaatattcagccttttatacccttttgagactcataaagctatttttgcaaatttgtagtttttgcgggaaatgtatgtataaaagggcgtgcgtttttccttttgctgtcatttctcatccccattgtcttcctttccctctattttgcgctgcatattcatcgtcaaattgtgctgccgacattttctttgactcccaatggtgcatttttttgttcattttgtctgtgtattgtttttgtttgtttttcaattcgttttccccaattaattaagtctgatgatgttgctcttcccgctccttccggtgccgtcgatgactttgcgcagcgcatcagccaattcttcgacttcatccacggcggaaacatcgaccgattgcgtgcgctgatcgactcgctgagcgccgatgagctgaacaccttgctgcagatgaacgacccgcgcaacggacaacaatttgcactgctgatcgcaattatgaaaggacacacagaaattgctgcacttttggtgggcacaattttcgggaccaacaactcaacaataataaattttgcacatttttcagttggagaaaggcgcggacgtgcatcagaccaccgttcgccaagtgaaccatgtgaacatgggtgagaaatgcgttttgcggacccaattgttgctgatgcctaattcatccctttttcgccccattttcagccgttacgcccctgtgggttgctgtcaatatgcgccagttggagatgtgccgtgtgctgatcgctcatggtgccaacgtggacttgggaagtgacgcctccttgacgccgctactgctcgcatgtgacaaaggcagcacagaaatcggtgaatcaatcgtccggaataatttctcatcagcactttttcaccattttcagtcacccttctcgtggagaatggcgccgacgtcaatctcggggacagcgaaggaatgatgccgttaatggtcatttgccgtgccggaagggtgaaaaaaagcaaaacttggaaaaacttggcatttttcatttgttcagatcgaacttgcgcgcttcttactttctcacggtgcaaacgttgaacagatggataacagcggtgggtgcccgtttttaaataattattgcactaattaatatgtctttttcaatttcagggatgcgatttgctcttttgtacgccgcctctaagggccatttggaggtgtgccgtttactggtggaagaatgggcagctgacgtcaatcagcaagcgaccgacggcatcaccgctttgatgggcgcgtgcatccgcggacgcttggacattagtaagaagcaattggtacaaaagccgattcattctctctcccaattttcagccgtttttctcatcgaacatggcgcccacattgaccacgctgacatggacgggtacaacgcgttgatgtgggcagtgaagcaaaaaaagactgaagtggcgcgtcatttgctggcaatcggcgcgaacgcagaccaagtgggaattgacggtgggtgggcccaaaaagggcttaattgtgatgcttcaattgactgctctcccccgccccctttttaaggcaaaagagcgagggatttggcccgagaaagcagacgtgccgaattgattgacctttttcgcaccacagctaacaatgagcagcgggaggatggcaatgcgtaagaaaaaaaaggaatttctgttcaaaaattatttatgatttttcaggcagcaggacgagcaaccgcagcagcagaaagaaatgccatgtaattgagagggaatcgaatgcaaaa

SEQ ID NO: 13814 - DNA, 5895 bp, Heterodera glycines
  misc_feature (808)..(808): n is a, c, g, or t
ttatggggtttaaataattaattaaaatttaaaaaacaaacaaattaatttagtaatagagataaaaaatgggaaaaagaaactgtttgaaaacaaaagaaagagaacagtgaaatatttaaagatcaatgacgtggacaaccccaaagagacaggtgcgaaaacggaaaattaagcaaatgtccaattaattaatttacataatttgaggtttttcttcattaaaaattgcagctccgttaattgccaataatcaaatgccaactcaatcaaagggaaagagttctttgttaaaacgttatttggagaacaaggaaaaatttccaagacgaactctgagaggacacgcgaaagatttgtgtgtgaaattgaaaacattgaaaaatgtgaggaataaattgaagaacaaaacgcactgtgagttaaaatatttgtcaaaaatcatttaattgtgctattaactgttttcactttcattaattagtcagggctcccattcgccaagaaattctaagtcgtcaagaaaaattgacctttttgctaaattcttcaaaatttctaggcagcatttgagtatcgcaggaaccaaaattttctgttttaataaatagatccaaaaatcctataataatcttttggccaaaatttcttagcaattgggcataaattttcaaaagtccggcggaacttgccggcaacgctctctgttcgcccttaaaacaaaaaaaaaagtgcggcaaaaatttaaaactctttgaaactaagaaaggttctaaatgcaaaatgtttgccacatatattttatganagcattacttcttctttaagcgactttttgagggtaaaaatgtttttattgggggccaaattcttagatttaaacccttttaatgcttatatatttttttaagaaacaacctttaattgttgcattattcagacacaaaagaagaaatttgcaaaaaagaggcatttgtgatagaggatttttgagagtgaaaaaggaatattttgaaaggaaaccgaatggcacaataaaaatagcggaccgagcaggtgccagaaaagtggggataaaagcggcaacgataaaacaatggataaaagagatggacaaaagagcagcagcagcagcagaagcagaaattgaaatgaaaagcgaaaatgataagcaaagtgaaaatggaaatgaggaaaatgaaatgatggacgataagtaaggacgaattaaataaatctttattattattacatttaaaaatataataattaataattattctaggaaaatgatgagcaaacgctaaaagaaaaggaaaagaatttgcgtaaataattaaggcgatatttattatttacttttttcactattttttgctgtcctggtgataatgtttcaagaatcttatctaggaaatttgttgtgtttttgagtgaacaataaatgtttgtatagaaaaagtgaaaacgatatatattttgacaaaaattatcatttaattcattattacttaaattataaatttcgtttatacaaattatatttaaatattaattcatatgtacagtaaattatatagaaaaaagaatttaaaactactgtcgaaaccaatcactgtcaaaatcaactactgtcgaaaacacctggtacgttaataaatgacccaaaaatttcagaaaatacaccccaagaattgaaaagaaaattccaaatatgattccctaaaatatttttttcttcataaaaatttgtccttattcaaaaaaacttttaaaatatttaataatttcatttacaattaaaatataacaaaaattaagatttttggaaaagaaatattgtacatcgtattacaaggaaattgggggttttttattagtgattttctgcctcaaaaactaaattttgaaaaagagcaataaatcacttactgttttattcaattcatcaaaaatacacatacgttagagagaactacgtaatataagcagtagagaccggaattttgaaattgccgggaccgggagcgggacttggaaaatggacccgtacgggacccccgggactcccggtcccggtggtttgcccaaaaaacccgggaccgggggtcccggaaaaatcccggcggggccccggtcccgtccggtctctaataagcacagtaacaaattgtacaaaatgatagattttttacgaaaaaataaaattcaaagaaatctctcagtcatgtgaacgatttgtttcgcaccacttggattgcttcaagccgtggtggtggcttgcgctgcattccgctgatcggccgatttacgcccaccgcgggcgaagcatcgctggtgccggcctttgaagtcccatttctttgatgattactcggcattttggactgttttgtgccattttgttgttgccaattctcttaaaaataaatgcatttttgggcgaaatgcaaatttaaaagaatttacatttttaatattttaatctttaaattttacataaataatttggcttatagcttaggtttcaagaaattaatcgtccattgacggtgagcaaaataagccgatttaataaaaaattataaaatattaaaataatatgtaaaaattatgacttttttgcaattaaagccttaattttttatgagtaggaaacaatctgttcctcttactaatttagcaaatgctttactatatttatttttttaccatttccgtagagtgcgtctgtgtaaacaactcccgacgcaaattgattccgctttttgaattcggcaactttcttcgcttctaaaatgctcgacaaaatattaaaatattttttatcggtgttgtgctctcttgcacatttttctttgttttaaaatttcttattaaaaaaaattagctttttattcaaaatgtaaaagttcagaaagatctataataatgggcgatattttatgaaacttattaaaaattgggattttacaaattttcgaaaactgtaaaaacagttgctaaaagaccaaatagatctccttattaatagtaattgatatttttattgcaattccttccacctaacatccggtgcttctccgggtcgtatttgtccaaaatgttttgtcggctgattggcttaaagtacctttgcacaaagtcattgtccatgctttcattcaatcgctaaatttaaagaaaaaatatttttcaaatttcttggttattttgtcaattttaccttctttagcctcgattcctcctcctctggttcgttctgaagttcactcttttccatttgtccatttttcagcccattttttgcattttgtgacactaaaataaaattttaattattttatgctccaaataattaatggcaaagaatgctgatatattgtgatgataagaaattgccgagattcaaaaccaaagtctaaatcccgagagtttcccgggctaagactcttgagaagaagcacaaagtcagccacccgcacccttttcgctgtgccaatgctttttcttccgttgttgtgccctcttccgtcccacctgcgcttgcgctcggcagcgcttggcgaaacgtcagctcgggcagtgtccattgctccgcctcgatgttccacgccgcttcgcgcttcacccgctcaatgttcgcgtagttgctgtccttgtgaatggcgggctgaattctctccaaaatctgatggaacagtttcagctgctggtcctgcttgcgaatggtctccaagtagtccagtctgttcagctcgaactcgctggataggtcgtgcatgtcgctttccaacgcttgcacctttttgagaaaggtaattaaccattttttgtataaggtacaaaataaatatcccgcctcctcctgaacttattttctcaaaaaccattcttgaaatctttgctactccttttttcattaaatgttttatggggcatctttagacgaaatttaggagtcctccgctattttgcttttgaataaatgttcataattttccatgtttattagtgtcttttcgtccgtttggcccaccttctgcttctcctggttgtattgctgcaccaatgcgtccagcttctcctgcgtggacgtgtacacgtgcagcaatgggtcctccttgtccttgtacatttcgagcgcttcttaataataattatcaaacaatacagaggaaatcattacaacttaattattgaaagtttaatcatcaaagctgggatttttatgtaaatattgtgtttgggaacaaaacttgggacttttatttgcatatttttggcttttctacatacatatgcgtacatatcttcataaaatttcgcattttttgtaaatattaatttatttttacatattttctaaagaattttttgtccaaaaattataaataaaatgtttttgtaattttttctatgataaaaatcccggctttattaattattatttggtaattgacggcagaatgacgacttttggcactatatatcaaattctttttaaatcccatccattttccaatattcttccacattttcacctgccagccgcttcatctttttctccgcttctttgattttccgtgccctcttttgtttcagcgcttcgttgcccgcttgttctccccccaccatttgctgctgtaattgttcaatgcggcgctttgcgctctccgcactttcctccgattgtttggcctgctcaatttcgttgttggccttttcgtactgttcacgcaatctgtgaaaaataccgttttaaattcactctccatgccattttcaacaaattaataaataattaatcataatttgacccctccctaaatatgggaaaagattctcgcggtttttgaaattgaaattcgtatgaacaaaattggtttgtgtaggtgagcaatttgtgccgtttcttatgttaatttgtctacattattttattattctctttgaaattaaaattaatggctaattaatattttaatgattttttttattttgcatttccaaatataattaaatcgttaaacttggccaagtcgctctgcagtttctccttgtttttctgttctcgctcgtagctcgtcttcagttccttcattgctagttcaaattcgacccgcaatttctgcttttcctgctcaaactcggacagtgcctgatgatgcacgtccgggtgaattccaactgaaccaagtgacgttaattaaatattattttttgaaaatatacatagaaatgaaattttaaggaaaaaattaataaataaaaaaaaagtatgcagaattaaaaaacttaattgccttttcgcacgatgagcgtgcaatttaacagtactgatttctgcatgcaaaaattaatgcttaaattaacagcaggagagaaaacccattgctacggtgttggaacttcgacagggcttctataggatagacaaatttcaattattgccgaggaacaccgtgacaataattcccgtaaaagggcatttaaacgctggcaaatcccggtatttcccaaatctcgatttttaatgatattgaaaatcattgaatttttggcctggtgctacctggtgctgttgttgaaactgctgctggctgttggacgagctgtttgagccgttcaatttcggcctggtactctctgagcagtgcgtccttgggatcctcgttgatgtgcggcttgttcttgatgttcttggcccggttcgcgtaccgaagcgtggacaatgtctcgtcataattgttgtcggacggagagacgcaggcaatctgttttcggcggttaaattacgagtcgaattaatttttaaattgcctttctaaattttatttattttaaatcagaataccttttctatttaaaagttacttttttattatcaaatat

SEQ ID NO: 13815 - DNA, 1428 bp, Heterodera glycines
ttaacaattcatccttaatgagataactctgtgttaattgcctataaaaaaaatttttttctaatatattatataaacataatcgcttgaattttgtgttttttaaataaatcaaaaataaattctgaattgtgaattgtttttttttaatatttttattaacaatacaaatgaaaaactgtcaaattgatcgttaatccaataattaaataactatttcaaataatttaaaataaaaatttaaaaaagctctccttacgataatggcatccacccacccatctcagcagcgttcgtatcatccgtaaaaatatgtgtgccgtcgttgacggcacatttgttcccaaggtccgtgtcaaacaaagcaaaaagcagggccgagggggtggtgggcggggggggggggacaacggcgacaatgatgccgctttgacgggacccacttccgtacatataagccatgccctactcctctttcaactccttttggccgatggaataataaaattggagtgccaccaccaccaccaccagcagcagctagctcctcgtggtgaaaaagacttttctttggtgccaatgttgggcttggttggtgcccaaaggggggttaggcaacaaaaattaataattcgtcccctccggcggggggcgaagggggtgagaaaattgttctcgttgcccttcgcccccgggggcgacaagggcgaggggggaaacaagcacaggtggttcgaaggtgagccatgatgcctaagcaggtgttgacgtggctgacaaatggcaaccaagaaaattctggcatttaatgtttataataaagttttcttgaaaataaatgtttttaaaaattttttatgaatttttcggaagggaggggaaatgccagtttttaagcaatgcgcacgccactattactagactaaaaagcctgtggcccgaggcacatttaccaggtaatattctgtcatacaaatagaacaagcaaaaaaaaactatcatgattaaatgtaataataataataagcatgcttttacttagctaggaatgcagaagtgtaaggaatgccgaaatttaaggtaaggtgctcgagagcgtgcctgagagaaaattagaatattctaaagaaacatttctggaattttactttcataaagaaaagttgcttgaaaaatattattcaaaaataacaaatttttgagaatttcacaaaattacatttcatagaaatttacgatcgtctaaattttaaatagtgaatcagtctcacaatttacgtaattattgcaaaaagtgaattgtgttagtaattaatggctttgtactatcattcgccatcatttgttgacatttacgaagcaaaagaacgcaaattaaataagaatgacttgttaagccgttaattaccgttgctttttgtgacagtt

SEQ ID NO: 13816 - DNA, 2550 bp, Heterodera glycines
tttaagtttttttatgcaaataccaaacttagttcatcttcctatgatcagttaaaaagggagatcattaaaataagaacattaagattataaattacaaagtgaagcataaaaaagcagttcaatgatcgatcataaatgttttggtctttcaattcaagcaaatgctttttattgatcactcttcgtctaatcattcaacgaccttaatgagcgaaaatctttttaaattgattaatttaataaataaaccaatctttaatatttttagagtcgggattttgaaaaaccgagtcaggtgggctatgtatgaaaaataaaaagggtctggttttcaatttttgtgacaattcaatgattgttattaattcttttttagttttctggggcgtccgaaaatggccatttatgtgtccatatttcaaaaactgtctttattttattttctagtgctgaaagtacttttttgtaaattttgtcaatttctcgaaaaaagttaattttataaaaaaaattttgatggtttttttaaattttgtgagcctttagccaccctaaaatttttttcctgactaaaaatctgcaaaactttgtcatatttcattttaaaaaactttgtaactcacccaacatctcgatctccgtagagggccacgttgatcatcccattttggtggtcctcccagccgcatttcaacaccacccgatcggaatcgcacgcactctccgcccgtcccattgggccacgctcaaacagccacaaatcctcgaaaaagcggcgcaataccaacacttcacgggtccaacggttttccagctcaaacggctcaatgtccaccagagtggcctccaaacggataatgtaactgatcggagaagagcgattgttgaggaatgcctataataataagtgaattcaggcacttgaatcaattactaattaatgcagtggatttattttttgaactattaaaatagtttaaataagtgatcacgattatgaatttgaccaatttcgaaatccaaaataaaagcagtaatttaaatttttcgaatatcgacttttgttccgaattctgggttgtggttgtcatttttttgttgtttaaatatgcattataatgtatcttctttaggcatttaggccttaaaaatacatttaaaaatatataaaattttgattaaaatttgttaaaacgcagtaaaaagccacaaaaagccatggttgtgccgattccgttatttttctaaatatgcctgacgacttcaaaagctaaaataagaagcggggaggaaatttcccgacaaaatttgtcgggaatggctgaataaaatgtaggggagcaagtccctcatcgagtaggaaatttttagaaaatatcaaatctaaaacaaaaaaaggtaagtaactcatttaaagaaattctcatccgatttggagtgcgacagacgaaattcacaattccccgcatcggaccggggcccaaccttatctaatacacctggcacttatgtgtcatatcaagaaaatcaattttggatcaaattggttcaaatgaggcgacctccttgagtggagccaagtcagccggggttacatgacccctttcgatatatttgagcagtttaggctgcccgtcctcgcgccccttgtgcaaccattggtacaatgcacggcacggccacaagggttcatcttcatccatctcgaccggctggtactgatcaacagccatgtgttcctgatcctcatgaccatcatcatcatttgcaattacgcccaatccattaatccaattttcggcaccaaatgcgccgccggaattgttgccgccaaaattggccataatgccaatgaattgctgatcaatttcctccgccaattcgtcgtcattattgtcttcaatcacataaatgtgttcaccaccacctccatcaccgtccatcatctcaatgtcgctgtcaaattcatccatgatttcgccgagataaggcaatctgtgaaattcgatgccgcgcaggttggcacagtcacgcaacactgtggttgaggtgacaaattgtagtccattaagttgctgattgttcagtgtcacgaaactgcaaaaagcgaaatgttgaaaaaaaagaatttccagaaaatgccactttccataaataatttttactctccccctaaatttcttttgaaattatgagaagtgcatgatgggcatttttcgaaaaattcagtattagaacggccctccaaataaaagccgccgggtgataaagtctgaaaaattaaaaaaatgcttttgggggatttctctagaaatcaataaaaaatataattttatatgagccaaaaataagtcaatctaactttattttgtatttttgaaagtgctacaaatttggcctaatcagcctgatttattagttaatcaatcataaatctgagcacctgatcgactggcccagcataggccaaatcactttcaaagcgtgccacccgcgtattctgctgaaattaaagagagttgataaaaatttacaatatacatattt

SEQ ID NO: 13817 - DNA, 2000 bp, Heterodera glycines
  misc_feature (1942)..(1942): n is a, c, g, or t
gatggcagatagtacacacacaagtcaatcaatgaatgaattgtcaatttagcaattaattgatatgaatttcaaaaaataagcagcatgtggtgcattttatcggacaattttatttatatttgtcttgtaaggttttttttgttaattactcagtcaatttgtcgagattgcctttttgggtgcaaaagaggtaatttataagaatggaaataaagaagatgaaaagtggagggtgatggacgaaaagagagaaggaagaggacgaaaatagatgatgagagagagagtgggatagagaaagagggagagagaaagagcgatggaggttagagttgttgggcatggaaggaattgctcgcatctgactaatgatttgtgagcggcctgacaaaggaggggtcggcaagtgaccgtgggatttccaaatgaaatttggtgggtgggtaaatcacccctagtttctattatgaaattttaaccatttttgccaaatgagcatgagtgccgagatatgacgtgccaaagtttttacgcttttttaattagaaaagatataattcttttcggccaagaaagaagccattggtgtagaggtagtaggttagtcaaatcttttttatgtcacaggttcgaatcccatgcatgtatatattattttataatttttatttttaattttcatgcaaagttaactatctaaaaatttttagtaaaaacattttttattttaaatttttttccattagaaatcaaaaaattactacattaaacataaaggtgcaataaatatcctgtcgtattttttaaatattttattatcttatgtacatatcaaaatgaaagtaaaattaaaaatattttttattatcatatgtaccaaaataaaaagtaaaattaaaaataaagtctttttataaaactaatcttttgagaattgacttttcataaaaagcaaaaataaaaatttaaaaaaaaaaattgcatatagcggattctaacctggtgcgactgttactaacgcataacctctacaccatttgacaatgcgaatggttgcaaataattatttaatttgtttgttcattaaaaaagtttggcacgtcatatctcggcactcatgctcatttggcaaaaatggttaaaatttcacaatagaaactaggggtgatttacccacccaccaaatttcatttggaaatcccacggtcacttgccgacccctcctttgtaagaaataatattaactgtaaattcagtttcaaatcatgctgtatcaaaatctaagaaaaattgtgccatcagcagattctcaaccgttatcctccttcattcatgatttattacgacggaagttattaagctgcactcatcccgaatttccatacaaacaacagggtgtataatacattattgtgttctttaaacctttcatttttaaataccttacagatataactgcatattcttcgacattgccaaacgtgctttacgcgggtgttgatccaacagctgacagccttcaccttgggaatctcctcgtgctcaattccctgattagagcttccttttttggttgttctcctattttattaattggaaaagcaacagcttccgtcggagatccgagcgggcacaaaagaggtgccagacaaaacatctaatgaattattgataattttaattagacaggaaattgttattacatgaatttatctatgcgaattcaaaggcgttgcaaatacaggtggagaaaataaaggcgaatgtttcatcattgtatggggaagacatttctctcgaaattcgaaataatgcagaatggtataaagaggtgagtttggctcgtgggtctcttaattttcagctttttattagatgcggattttggactttttcgaatcacaaaaagatttcgcatgagtgacatgctgaagagtgngccgatcaagtctcgtttagacgactgtgaaacattgtcctacgctgaattttcctac

SEQ ID NO: 13818 - DNA, 914 bp, Heterodera glycines
acttcgaatgactcacttcaattaatgttatgctagatagtctcggggtcaatgctttctcgtccgggtcccaactcgatactttctttggctgttgcaatccgaaacgcaacattttttgtcccgaatcctaattgaattttttggccgtcctaacccgaaaccgaacaatttttatagtcccgaattccaccgaaattttcttttggccgccccaacactaatacagatatccgaacaactcgaacctacgaaaagttccaagttgtgtttgacatcattccatttttatcaataaataaaaaaaccttttaagttatccatatttattcatgtcaaataattcgaaataattcgtttttattgtaaatggcaaaaaatgttatacatatttatgaacaaataatcattttagtcacaattatatgtgccaaatttgtcatccaatgaatggtactgttttggtaatatcatgtacattcacctcttcgacacggtctttgactttttgaagtcgaactgcacgctttccaatccgtcatcttccagaaaacagacctattgttcatttagggatgattattattctttaaatttatttttaattacaatagctctgcggcaaggtgtgcaagtgtcaagtcgcactgcgccccacgcccatagaagctgccgaagaaggtgacctccgcgactaatgaaccttgtttaattatttattaatagggttataaattatatggaacatattttttctgcgcatatgctatgaagaaaggggtctaaaaatagcttctacgttaaaaattttttgatttgctgaaagtttttgtccatataaatccatatttcgggcgttttcgggaataaatccatatttcgacatttttgcatttctagtccatatttcggcc

SEQ ID NO: 13819 - DNA, 937 bp, Heterodera glycines
atgcgattttttgtttaatttgcggttcagaaattaatattcatttttgaacaaaagaaaaaaaagaaaaaattgaaccaatgcaacgaaagaaattagtgaattgtcatagaaacaaagaagaatgtttcttacatatcagaatctgtgtataaaaatgaaagctttgaaaaggaattttatttttcaaccgaaacttttaaaatttgccattttaattctttggataaatcttcccatttattcgcttttgaaatggataatgctgacaataatatttgcgactatttgaacatcagcacgacaacaaaaagtgatgttggtaatttgaccggaaaatttgccattttggacgcatcgaaaaatttgacagtttttgaatggcttttcagttcaatgattcatcaattaattgtcgcaaaatgcgcgtatcagttcaaagtggcacaagttgcggtaaaaaattattttatttcttaattttaaatttggcaatttaagtccgattggtaccataacactgtgctcatgttctttgacaagttgaattgcatttcgcctgttctcccttggattgtcttcccaaatattttcactccgatttcgattctgttcaatttgtctctcatttgggtcacatgcacaaaaatgtgaattaaattcataattttaaatttaatttaattttgctccaggactgatcacaaagtgtgcaattggctgatcgcctttgattcgctgtgccaactttttgtggtggcgccgttcggcgtcaatttgcttggcgtcattttccaatacagtaccattgactaccgttgctgcctggccacccttatggcagctaccgtagcatcgtacgcctcaatcatggcaatgtatctgatctcactcgaacgcctgttgatcataatgtacccaatcaagtgagttcctc

SEQ ID NO: 13820 - DNA, 1527 bp, Heterodera glycines
catccttttgttgtgcaccttaaattatgcagcaattttcggccttattttatggcgtcatcaaacaaacaaaggatcaactcagactcaacaatcaggccgcaaaatgtcctaattattcatttaaaattcaaattttaatttccacattttagcggcttctgatcgttcaatgcgcaaaatgttgcgctcggtgtttctgctgcttttggttttgctgatcggctggctgatcagttcggctgctcgcaatttgatcaccgtatttttcagagatagcatcactctgatcataaacagcctcttttctgatacggacactcagaaccgtcttattaccgatatcacttcgtgggtgatcggtattatcacttgtcttccaattttggcgtccgccagtggcgcgcccattcttttgctgaacaggcaaaaatgaaataaaaatgggcgaatttatttaaattatttttcagtaacgattatcggactgcgtacaaaaaagcgatgggccgaagaaacaattcgccgggagttgggccgctttttagcagcaaaattgttatgatttccaatgtgaaggaaggcaaagtgaaatagcgcagaacttttctgatttatttttatttaaactaagaacttttcaatctgtcccattatttaatttttacatcaattattcttagtttggcaaaatgagttttaacaatgatcattttcattcatttggattggataggaaggagtatcataagtagggcgtataattatggaaatccatatttttttcctggactgtggtgatcctgaaacgcacgaaaacatatttttagcttggtttgaagctttctatacccatatttttcataattttcaatattttgcgatttatgtccatatttatccatattttggcatttaagtccatattttatgtccatattttggcatttttccaaaaaccctctattagaacggccccttcagataacttggcctttttgaccccaaagaccggaaaattttccaaaaaataaataaatcatttttagcataattttctcgaaaattaaattaatttaatatgttcttattaattaatttagtttctctaattaaattaattgcaataacttattattattaaaataaaattaaaaaaacaaaaaccgtttaatgcagggctcgcagatctgaggctttagcctcattttgtagttttttgataggtcaatgaggctaaattttcaaaatgaggctttgaggctttttgtggttttttgagaaaaaccgcaaaataatgaattttttaaatgaaaatagggtcaaaattcttaatttttcccccggcggcgcctgtcggcaccgccggaccataaaaatttgctcaaaatcacaaaatttggtcatttttgtggacaaatctgttaacaaatcgcattaaaaattacaaaatttttcccggcgccgccggcctccaccttgttcccaaaagttttggaaaaagcgctgaaaaaaaaatcaatttcg

SEQ ID NO: 13821 - DNA, 3364 bp, Heterodera glycines
attggtgcagcaccaattgacggcgggggaatgcgcgtcgaacaaatggatacgaaaaatggtaaagaaattgacaacagtgggtacagagaatgccaatggaaaacggatgaaagaggacaaagaaaaagagagggaaaaagagcgaatggacgaggaacagagaggggaggacagagaagcagagggagggaaagagcggtgccaattctcggaacggtggctgaacaatttcaaaaggcggtatggtattcaaacaacgatggagggtactgtaaatgcggaaggagacgaagagacggaagacgacgaggcggagagagaacggcggggcggagacacaattttagtggaaggtacggaagagaaaaacagcgaaaatgagggaaagggaaaaggcgcccagtgatcacaacagtactgatcagaagcatacatgcacaaggggtgtctcagcccaagggccatacgacagacgattgggacagggggggaggtgtctcgggaccgattttccatacgaaggtccaaatttttctccggcgtcgacaccttttttttttttgctattcaaagtaccttttttgcgacgcgttttttccaaaaaaaaacttttaggaagggggtggggcgggcgggccgatagccgccgggaaaatttttgaattttgacaccccttgtacatgtatgcagctcatccctccccccgaatcagttctacctcccaaattttttaaaaaactaaaaaaaaatgatgaaaatcacaagaaaaaaagtgaaaaaaatttcaacaattttttgaaaaaaaactttttgttagcaattcatcacaaattttgcaaaaaaaaattgctatagaaaaaatttttcgaatttttttcttgtaaattttctcataaaaaaatttctggggggggggaaggcgtagtgcaccttcctcgaaaacaagttacaaagaaatgaattggtttcgtattctaaaccggaaaatcatggacagtttgtactgtactgtaccgtacatattggctggcatcgtagccccaggagaggaacagaacgcccgtgttgtacttctcccagtggctggcaatgaacacgagttggaccgcgatcagaacggagagcaaagtgagcggctcaacactgtggggaaaaatatagcatttttatacttagaaatgttgcagttatcaaaggcgtaggcagggggaggggctgagggggcttaagcctcctcccgaaatgaaaaatttaaatgaaaatgggaaactcctgaaaagcattttttaaattttacccaaaatcggcaatttttgaaaaaaccttaaaaagggcaaaattctaaaaaattttctggtggccttaccactctagaattaaaaaaaaaattattggaaatctggctaagaattttttttctatttcgtatcaaaacattccgttaacgatttcttgacagaaaaactctgggagaaaatgtttttgtgtttccaagttcatttaagatgcaaccatttttacttttcgaacttattgttaaaaatttttagggaaagaaattttctgattttttaaatcttttagatatttacaatttttttcctcgagattttcttataaaaagggcttgaatttttttttttttagtaccgtcggtcggcaatcagctaattagttgttacctgaattggccccgtccaaaaagtgagaaaatggtgatcgtaaatgggacggttgaccatgaatctgtggcgaggagagaccgaaaagtgcggggaacgcgttaaaaacaattggcaaaatgcgttttgttagcagacaaacgctcaccgaatccgtggtcaactcgaaatgttgggaaggcaaaaattaggtaaatctcagagaattaaataaatttatttagaaaatttcgtaaaaattccaggattttacgaaactccggtgaaaatcaattggatttttaagaaaaaatagatatttgtaaaaaaaagtgtcgggttaagccgccagagatttctgatctcgtggaatttcaaaaccgggccccctagccccatctgataccaatttggctttttcgagccgaatttttggcctcaatagcccggaaagtaattttaagtgccccgccggtctttggcattctataaatctctggcaaccacccaattttgtttcaggaagggcagcaattttaataaaaattcatggaatgaaaaattggggttcaatcctgggccgaaccggccacaatttaccaagccttgaaaaattcaatgagggaaaaataaaaccaaaaaaaaaaaaaaattaaaaaaattcgccttgagaccggaattttgacaattctggatgccccggacaggattttgaaattaaaacctgatttttgcgggaccccgatccgtttcatcatttaaaaacccgcccggattccggggttcgggatcttgtaacctgaccgggtaccgaccccgtccaccacagcacggcgtacttacatagttccccggtcggtccactggcacccacccgtcgtgcctgcttcccgtccgtgccgtccaacaagtgggccaagaaagtgccaaccccgcacaccagccacacccagcgcgggatgttcagctcggccggcccggtggccgaattggcgctcagcccggggtcaaagcacaccacgagcccatagcaacacatcacaatcagtgcaccggcaaatgtcagcacattgggggccaaccaacgggggtaaaactgaaaaaaaaaaaatttttttgaaaaattttgcaaattttgggcgcactgaaccgaccaaattaattggttttttcaaaattggactaaagcaccaaaattcggtcatgtaggcccttaggtctgttaattatttacggtagaaccggttttggtaatactgcggagcccccccccccccgtttttgttaaaagttgctttaaaagtcgtgaaaacatgtttatggttgttttcggggtcgctggtcatgaatctgatattcattttggcttattccaaattcccagacccgaattcgaacaaaaaatgccagaaattcaatttttaaaaattcgtgattcggaaagggcaaaaataaatgtcaaatccgtgaggcgctccaaaaatccccctaaacatgctttcacattttacaacaccctaaaaaaatttctaccaaaaaggagggaggggcaacggcagttttttttttgaaaatctttaaatttttgaaattaaggcctatctttaagcaaagaatgcatttttaaaccaattaaaattcgaatgaatttatcattcataagggtgagattattaagaataaacctcaaaaaccaact

SEQ ID NO: 13822 - DNA, 648 bp, Heterodera glycines
aaagttaaaaaattttcaaaattttttttattttataagaaaatcccaagaaaacaaaacatggacaaggggctggggtgagaaatttgcttttactaaatatgaaattggcatccccttgtccatctattgaaaaaaatgtttgaaaaatgcggagaaacacggattaagccatggttgaagcaaaatgccgttacgtcaaatgctccctccccctcccatttgtcttgtcagtatttcatcgtcgaagtgaacgcgcggctgtcccgctcctccgcgttggccagcaaagccaccggctacccacaggattacatcataggtcaatctcgggtgaattcctactttgattcactatagtgagctgcgataaaatattacgacatctttttttttgattatataaaactatttactttaccaacaaaaaataaaactaattttgaaatgatttaacattctgtgattatttaccagaaagccattgcacaacatatcaatcttggacacgtctcctcttggaaaaaatttaactgagctatttattaaaacaaatgtgcttatacaattctgataactctggtaaacaccagaatatttatgaaaattctggtaaacgccagaatggatctgaaattctggtaagcg

SEQ ID NO: 13823 - DNA, 3162 bp, Heterodera glycines
agtgtcatgtgctcgctcgggcgtttatcgcatcggatcatcggttcgagaaatttttttttaacttttttgaagataaacaagccatttaattgtgtggcatagttttaacaaaaaaaatggattttgacccagatacaagccgagacagcctacaatcaggccttaaattacataaaaattgaaataatttttttttttactaaaaatgtatttcaaatttgatacaaaccgagacagcttgggcctttaaacaaaactttgcttcattttttgaaattttaaatattaaagccatacagataaaaaaaagtcagtaatgggtgccaattatcctttaatgacactcaaaaatttccttttttgaaaaaaatttaaaaaaaaatattttttcgaggatttcaacttctaggtggagtttgatgcttgcgctgtcggttgtgtgcaggagttgaagcggttgggcttcaaaaccgtgatgatcaattgcaacccggagacggtgtccaccgactacgatatgtgtgacagactgtactttgaagtagggctgaggggggggggagggtgaaaaatcattccaaaattctaaaaaaaaaaattttccaggaaatttcgctcgaggttgtgtccggcatttacgaaaatgagcatcccaacggcatcattttggcattcggtggccaagcggccaacaacattgcgctgtcgcttcagttggcatcgccaaatctgacggtgccaatcaaagtgttcggcacaccgcccaaatttgtggacgaggcggaagaccgcttccagttcagtcgggcacttgacgagctggacatttcgcaggtgaatcatggcaatttaaaatagtcaaaatggtctaatatcagtgacatttctcgctttaactattcataattaagcccaaatggaaaaatgccaaatcggtggaggaagcggtcggccaatgcgctgccgaagtgggcggctatccgtgcctgattcggccttcctacgtgttgagcggagccgcgatgaaagtatgggtttgaaacgaaagaaaaaatggtcattggccacgagtcgagaaacatggcgggtcacattcggaacgagaaaattggcggattgtcgcgattcgttcaaaatggcaaaaaaagggaggtcacattgggcaacctagaaaaatgatgggtcgggattgtagggcggccaaacattttttgtttttaaaggtagcgcacaatgaggaggacttgagcaattttctctctgaagctgcgttggtggcacgtgacaagccggtcagtcgattaatatggcaaaatagaattaaaaatttttttttaaatttcatttatgtcggggacctttcttttttttaattttcaagaaattaatattttttgcgcttctgtttcgtttaggtggttgtgtccaaattcattgaaaatgccaaagaaattgatgtcgatgcggtggcaattgggggccgtgtgttggtcagtgccatctctgaacatgttgagaatgcgggtcggtggtcggcacatttttgaaaaaaacacctaattcaagcaaattttctaattggtttttaaaggcattcattcgggtgatgccacactgataacaccgccccaagacctgaacgccttcaccactcgaaaaattcacgaaattattcgtcacattgcgcgacgtttcaacgtcaccggaccgttcaatttgcaactgatcgcaaaggatgacaatttgttcgtcattgaatgcaatttgcggtgagcagtcatgatgaatgaatgagttgggtcaataacaaacaactcgtactttttgagaaatttttgcaaaacccgaaaaaattttcttgaaaaaggtacggggttgttcatgacacttcaaacttcagaaaaaaaattttatggatttttttttttaaatttattgacaaaataacccatccacccttcaaatttgtctgaaaaaattacattttatcaactaccaccataaaaatatcaaaaattccttactttatgattgcatgctcatggtttcagagtgtcacgcagtttcccgttcatctccaaaacgttggacatcgattttgtggcgttggcaactcgggcaatgatgtggacgcaagagccaaccaaattcatccaatccttcacccgtcctgaacagtccaacaacaaagtgggagtcaaagtgggtatttttttttgccaagttttttttttatgttttattttccatggttccaaatttatttttttaggtcccccaattttcattttctcgtctcaccggtgctgatgttgttatgggggtggaaatgctgtccaccggttggaacttttaatattattattttcaaattaatgaggccaagttttaattcaattttaggcgaggttgcttgtttcggccgcacacggagagaggtccaaaaattttatattttgggtttggtcatgcccccccctcctcatctgaatttttttctaaaattttttccaatgataattttaaacaatacgaaactcgctttaccgaatcccctaacatttgtttgcgtgaaacaacaaatcaaaattatagaattacatctaattttagcgcctaaattatgctagaaaaaaaacctagaaattttcaatgggaagcggagggtgggtgtaacgactttgaaacaccaaaatttttagtttttttaaatacaatgtatatattttttccccatttaaggcctatctgaaggcactcctatccaccgggttccaattgccaaaacgggtcatttttctctccattggctacaaacaacgggccgaaatgttggagagtgtgcgcatgttggaccgacttggcttcacactgtacggcagcaaaggcaccgccgattattacgcctccgaaaacaacattcgagtgaggggggggggtggaaatttttaaaaaatgtaaaatttttccccatttcttaaagattaagaatttggaatggccatttgaggagaaggacaattaccatgtgtacggtgccaaaatgaatacggtggacgaatttgtggagaagaaaatcatcgatttcatgatgggctgactggggcttgttatttataaaaaatttcaaaaatgattaaatcatttatgtgtagatca

SEQ ID NO: 13824 - DNA, 1705 bp, Heterodera glycines
taaaaataactaaaaaataccgtacacaattaaaccccccccggccctgaatcataaattattcgtgatgtaggttctttatcgacaacaaactcaaattcaacgaacatgtttcaataattctccaaaaagcttatctcaaaagcagaattctttttaaaaaaattaaaaccaagtcaaccaagacttggattacagtttataaaagttatattcgaccccttttagaatacgcaaccgaaatttggaatcctcgaaccaaaaaagaaataaaccgcctggaaaaatttcagaaaaactttacaaaaaatgttttcagaaaatgctgtctcccctacatctcataacagcgaaaggctaaaatttctaaaactttccaagcttgaaaccaggagaaaatagtcttgatataaaaaaagcctttaaaattatcaaaaatactactcacctcaacccaaaaaacctttataatttttcgaataggaaaaggtcaccttttcctattttgttaaccaaacggaaaattaccaaaacagaacactcctttactaacagaaccacaaaacatttacaagaaatttgtaaaaattcagatatttcaatatcaaattcattgcccaccttcaagaaaaaagtaaaaagtattttacaagattaatttcaagttggagatctgacaccatcatgtttcccggactatcattctcttccgaaagtataagcggcctttgtcccttcttttggacttttattacttgaataaataaacggcggtgtaagtgaagagaatgtgcacagcaattccaccagggaattgttaggctaaaaaatgaaatttcgaaaagacaaaaaaaaaagttttttaattaaacctgtcgaacaaatttggtaaattccgtggccccctgggcactgcacagttccaacagtcgacgacgttcagccggctcatgcgcatggtcggcaaagacacggagagcgagctgaaagcggggacaaattgttgatatttttgtcaccgccactgccatccatgttttttttgtgtgtttaaatcccgaaaatcgaccattttttggggaaaaacaaggttataaattagttgtaaatgaaataaatagggtctccgactcatcttcaaaaacttattttatgagcctgattgttagtggcagtggaattggaaatttaaatgaaaatttactcgagaaggcgccctgcgaatgtcgatgaactgggcgatcagttggcgaggcgaacaacgggccggaaaatgggcaaatcttccattggtttccggcactttgtgcagctccaaaatgtgttcagtgtccgctgtttcggcacagaaacccaacctaaaaacgaaaaaatatatatttatgggaaattttggattaatttactccattttagaatttgaaaaattcaaaaaaaaatcaccgccactgccatccatgtttttttttgtgtgtttaaatcccgaaaatcgaccatttttggggaaaaacaaggttataaattagcggaccgggtcggttgggcgccgccgattgggcgccgccgattgggcgccgccgtttgggcgccggtacaattgggcgccgccgattgggcgccatggggaaatttaaattcattaaccttgcctcaacttagggttaaggactttccaaggacgggtataataatttacaaggacgta

SEQ ID NO: 13825 - DNA, 3019 bp, Heterodera glycines
gttttccatagtgaacgggttcagtggatgatgacaaggacaagttctccaattttgccacgattttattgtcgggcctatttttggtaccgttctctcaaggacggtaaataatcagtgaaccattggtgccaaaaacgttctgtctgttgggaagcagtttcccatagattttgtaatgatttttgggtactttcgggcaattctgtctcggcatttatggggatgatcaaatgtgaaagagggttttggttgggattaagagggcgcaggaaatcgattggccttagggcgttaggatccatgggattcgcggaatgaaaagtgatgggacgtgagttgacaatcatttcaatttccgagagggaggtcattaactgagctaagggaactgctcgaggacgaaatgaggtaaatgcccttgtagatgatgtttgaccagtgagatcaaacgctcataatgtccaccacgccacggtgcgtgtggaacacgaaaattccattgagttggaaattggacagccaaaaattttgagagggcgacaaaagttggggcattatcacagtaaatcgtcgaagggatgccgtattttgaggaaaaacggcgaaaagcgagtgtaaagacgggcgccgactagtcttcgactaaatcgagagaaatggcacgcgtcggaaggcaaacccaaatgactatccaatgttttttcgacattttacgcttttttggtacgtgggggtttgtgacaacataaatgggaccagtaaagtctaagccaactttcgaaaaggggggcgaaggttttaccctatcttccggaagggggggaaaggggggaaggtcaaatggtcgggtgttaaaacgtcgacaggttagacaatatctcgaaatgatcggttttacaatttgtcgtccctttggaatccaataaattctgcgcaatagtgaaagggtcaacaatgggctcgaatggacattgtttaggtgtatttcgtgaacaattaaattggttaatggcgatttgggagggaggaaaattgggttttttgccgacggtggaagctggctttttccgagacgaccctttgcgcgaataattttctgcgggtctgagtaaaggcccaaaattttcgtgacctgatcagagggtggatttagggtttgctctcgtaaaattaattcctgtagagcctttctttgctcattaaaggaaatcggattcggtgctttatatttggaattttttcgggtgccatttgagaaacgaaacacataacttaacactctgagggcttttggtagcctagaaaaacgtgccaaatcaattaaatgtgttaattcgggtgtctgttcggtaaaaaacgtgaacaaagggggagggtttgcttgaaaaggggcgtttataggttctgattttccgtatgaatactcttttatttgtgggttatttggccaatggtttgccgggagagaaagccattgagggcctgaccaccaggcagagagagcggaaagggtaggtgcggaagaaattcctcgagtaccaatgtctgcggggttttccgggccaggcaaatgtcggacagttaaatgatcaacggatttaatggctttaagtaggttttgtacaaaaatttccgtgggcaatttgtgacaattaagccatgaaaggacgatcgcagaatctgtccaaagatttaaatttgggtctaaatttagagagggaaattgggcttgggtaaatttcagagcacgagttcccatttctacagcaattagttcgagtttggggatggttaatgggacgcctttgtgaattggtttaacttttgtttttgagaaaattaaaaaggtttccgcctgggaaaatttggggtgtgaaactcggaggaaaacggctgcgcacattgccaaggtgcttgcgtccgtaaagcaatgtaattggtattcacgagcagataaaggagacgaaatgggggaacgtgggatggttactttgtccgtccttttccaggattcaattgatttttgccaatttgtgattatttctgtgggaaatcgttcatcccaattgagtttaagttcaaaaagtgactgtaaaaataattttaaggggaggataagaggggaaattaggccaagagggtcaaaatgtgatgcaataaaggaaaggacagagcgtttggttgggacaaaatcaggcggagggaccgaaagttccaaaattaaaaaatccttttcagtgttccatttaagtccaagaaacttttgttcggtcccgggaagttttaattggcttgggagatgggaaatggcttccggataattgcaggcgaattcacgtaatggcattccggccttttgaaataaggaaatggcggaggttgatttcttctgtccctcggtagaatttgaggcagaaataaggatattgtcaacataaatattttgggaaatttcggtggacaaattggagggaaaagctgataaatggtggagaattgtggccgcaagcaaaaaaagggagcatgtgagcccaaaagaaacacgggtaaatcgaaggatttgagtatttgcttttgatgggggaagagaggtatttttcagccagggtacaatcacgatgtgccgggtgcacattgacttggaggaaggctttttcaatgtcagttgtaatgacaattgggggaatccgaaaacgtaacaagagaccgataagatcaggcaggattatgggaccgggaaaaagacactcatttagggatagttcttttccgacgtgtgcggaaccgtcgtagacaatacgcactttggttttaaggggtgaaataaccgggtgatgtgccaaataatgtaatggaggcgaaaattcgaagggatttttgacaatttcaacaatacccatatttttctgttcctgtataatggagtcgtacttttggaggaggtcgggtttagctgaaagtgtgttaaaaacagaacgaagtcggccaaaacaaagtccaaaattgaagggagggg

SEQ ID NO: 13826 - DNA, 2082 bp, Heterodera glycines
ccaaatcggttcttcaaaactgtggcgatccgttgctcttcaaacgtccgttcgcaatgatcacaattcggtcggccaaagtgtcagcctcctccatgtaatgcgttgtcagaagaatggttctgaaccaggacgcatacaattagctcaaaatcatgcaaatctcatttagaagcaaaactttaatttgccacaaattatattcaaaagaaattttgttttcggcccgaagagtaaaaaaagtcttcggattcgcccatcggaattttttttctggctatggacctgaccagccctttttaagagtatctcacaacattgcaattgtttgaatcaaataactgggccataaaatgccttgcctgtcctgcttaatgttcttcaacagatcgccaaggtcgcgccgtgctttagcatccatcccggcactgggctcgtccagcaacacaacactgctcttcccgatcaaagcgatcgcaacgcaaagctttcgcttctggccaccactcaaagcacgagctggctgcaaaaaaatgttaaaatttcttagataaccgaatttatcctgatttttgatcatttttcaattttttcaaaatttacaatttccttaacaatttaaccatttccagagctgcacctaacgagtacttacaatacccatgtgtaaaaaattgaacccaccatgtccagcagggcttcgatgtgcaattcattcgccaccgtatgaatctcctgaatcagtgccttcttgccatagggtccattgaaatggccagttttggtgccagcataaaattccaaatgctctctgacggtaaggtaatcgaacaacggattgtactgaggacagaagcctaaaagaagttatctgtggtaaattcttggatttcggggtttcattttaacaatttaaaatgtaaacactgaattttttttatacacaccgactctaaacattagagatgaaccaataaatagagaatggaggaaaaacagaatttactttctccatataacttttttttctattcaaacaatttcactatattttgcataaattttccgcgttttaatgattgtttatcctgtttcgtggaaaggaaccgaacctccagtgcagtcacagctcgaaatgtgtctgtttttgttttcagacccaatcacaaaatttgattgattaaaacaacaaataccgattttgttctgacattcgcgcatgtgcttcttctggtcgatgccacagatgagcactcgtcccgaattgtatttgagcagtcccgtcaaaatggaaaatgtcgtcgttttgccggccccattttggcccaaaagcacagtgatttggcctttgtatgccttgaagctgagccgggccagcgaaaattggctggacgaagaaaaaggctgtcgccatcgcttgcacaatttgtccacaacaatgtccgcttggtcctttgaactcgcccggtccgtttcaatgttttcatttggcggaagaccttctgaggttaatttatgagggacagcaagcagataaagcaagtgatatgggtgggacagaattagtgaattcatatgtatgatgttttatttgatcatttaaatttgttatttattgataaactaggtaaaataaaattatgtaagaaaaaatttgcaaaatatgtatgaaaaagtctaaaatatgtataaaaatatgaacatatataatatcgaaaaaaccccaaaataggtatataaataaaattcccaacttttgatcgcaaacacaaaattttttgccatttttgcgttttagagcacacattttagccattttttcacaagaaaaaaaaacagaagcaaaatatacccataagactttttgggaatttaaaaaaatacacacctatgaaatgaaaaattttcttctcttaaatttatttatttattttttggattatgaatgtttgattttaaaaattatttatctcactactaatttggctgttttgttacttttttttttaaataaattttccaaccattttacaccgccttgaatttgcgaatttttactgcctatttatttccattttttca

SEQ ID NO: 13827 - DNA, 1320 bp, Heterodera glycines
cggtccgtttcaatgttttcatttggcggaagtccgtcgcggcagttccctcaccgtcggagtccgtcccatcgtctgactctgagccatccgagatattttttaatgccgcaaatctgaataaatgagtaaatttacatggccagaccccttccgcatgtttaccgccgacccacccttattcgcaaaaatttctgtcgaccctccccctttattttcctgtatgtatccgatcacccctggatttaagttcgtacgaagttgggtcgaccccctccccctccccgacttttaatgtatgatgtccaagttctgttgtatgcttggaagacccctatttttgttgcagtattcaaaaccttgagaaagaacagcggatgttgtttgggtgatcctttcggtgggaaaaccgaggcaaagtaaatggaaagcaaaatgaagagaagcaaatcgaacagaagcatcagaaaggccaatccaaaggagaatttggagatgccacttccgagtaacgcagaccatccaatggttttcactaaacgaggaggggaattccattacatggccaagtggcctatattatgaaatttttcaaaaaaaaaaaaatcttagaaaaaagataatttcgattaagtgcacaaacgaagcctttccttttagctcctactcacaatgagtattggttcgaattgtgttatttttatggcctccgaaataatggcacgcaaagaactaactatttttggcactaacaataagttgcaaaaaagacgcgtgattatgtgccattaaagattgcatttgcaagtttattgtaaattacttttttgctcggtaagcgcaataatatacatggcacttccgaaggcgaaaaagggattaagcgataagagcagacacaacggcacatttgcgagatccggcttataaaagagaggaggcgcgcaaaaagaaagcgctgccatcagagaaatgggcccaagttgggggaatttcttgcacagaatgctgaggaaaagcgcaaatgccaacatcgaaatgccaaagaggacgaacaatacgatgaagaggaaggagtcagactgaaacaaaaagttggatcaaataagggatgaatttatgttttgaaaattttatttgagtgttttgtcgaaggtttggctatgccctcgtcgtaaagcaaatagcaaacctcaatgagtcgataaataacacaaagtgaagcgaatatcagagcaaaaggcaacattttgagcacagcaatcaaaagatgtgagccgtagaaagcgaactgattcaagcccatgacagacatgtaag

SEQ ID NO: 13828 - DNA, 3895 bp, Heterodera glycines
gttcatctgcagctgtagaaaccattcctctcaacctaaagtccagaaatgtccccttggcggcagcgaatgatcagtccataaccatgatggctccgaaaaagacacgccgcacctttttgtcggcttgcgacgaatccaacggaatggcaatcgaaagggtaaacgaattgaaaattcaaatgaaaataattccataaataatactgaacctgttcagcccatctcagcgcaatcctccgaccaacagcaaatcgtattggacaacccaacggcaaattcattaaaagtgcgggaagcgatgggcactgacactgcggggaatgcaacggcagatgtggggagtgtcggaaacgggacggtggacgaagcgatgagcacgacatcgacctacaccgcaaggcaaaggcagaacttcaacaaaaaacaacggaaacaaaatgtgggttatatttaaaatttatagaattcgtgcacaaaaaaagcaaattcttagggccaaatgttcgtggacgcaccggcagaaaaatttgggcctaaggttcgcaagaaccctaagcagggaaaatatgaggtgcaggccattttggccacgacaacgtacaaaaaggatgggcaattacgacggatcttctatgttcagtgttaggtaaattaatttttaacaattttatacaattgttaataaaatgtattcaggctatagtcaaaaagactatagttgggtcttgaacgagtggatggacacgcaggagcttgtcacagagttcactgttaactctgtgatcagctgggtcttcaaggcaattcgtggcgaggaagtgccggaagaaattgccgaaaaactcaggacaaatcctgagtatatctcgcgtagtttttatggggaaattgatgaaataattaataaatttaattgtttgatgaatgagttgaggcgcaatgtcgacattaggacgacgccaattgggttctcgtcaaccctggcgggcgatgtgagacagcaaagaattgtaagttttgaaaattaaaaatcatcattttcatcttctctctcattttatttgtgtgtttgttaagcctactttcttagaattgtgggccccaaattcaccgtctttaggggaccaatagagtaaaccgcacagtctcgaatgtgtggcctctattgttcttctatttcttttttaattcctactataaatatttgtttttaaccttggaaaattattgaaaaaattttttttcaggctgcggagaggctgaaggaattcttaaaaaagaaaaaatcgtgatggatgcataaaaatttttaaaaaaaatgaaaccaaaaatattaataattaaaacccaaaaaaatctttaaaattaaaaaatcaaaaaaaaattttaaactaaaattcaaaaattttaaatattaaaatccaaaaaaactttaatactaaaaaattccacacacattgttcttcgtataataaaatgttttgccgataagtttttctattcataattttttgcaaagaaagattggttcttagatcaaatgtgagataaacatttggcaacgggcggcacttaaagcaatgaatggaaattttcatttgatcattctcactctaatcatctccaaacattagttgcttttctagaaattcgtccacaatttttattcgtttttaagccatggaatatccatcaaacttttcctggattcaactttccgactgtgcttgtgatttcggtatttgcattaggccatcgtcctacaaaaagccaattatttgtgttcccaaatacatggctgagaattttccctccctcctccctcattgaaccattggaacggcatgcgcaccagtcgcaccttggagcttgctttttgctctttttctcctgcttctcaccctccaggtccaaatattggcctgattttccaaattcctaaccttcagtttttgaatatttgtttgaccctttttcgctctcgctctcgttcgcgttctcgcccttctgttgcgcactctgaaccggcaatcgagatggtaagaaatgtctttttttattgtgatttttctttaattcctaggttaaactttcaaccaatagcaacagtgctgctcgccatcgtcacaattttccggtaagataataacatttggttttctgatttaaaattttaaacagccattgccaattcctcaatttccaccggcaactcggcctgcatccgatgctgagaatgtaaatgcacagggcttcattgaggactcttggattggtcaaatgatcaaaacatatgagcagcttgctgcaattcgtgaggtaaatcactaaataaaattaaatagttttactaaaaatttaaactcgagaccgaggccagtgcaaccatgcgtctatgtacagcttcccaaaatgtttgactttttgtagagactcgatctgctcctgttgcatgctttccatctcctttttatggaattgttgctgctgctgaagcaaaattaattgccgatgctgttggtgatttttgacaaaaaaggcccgagagcctgttcgttggtgggctaagataattgtgataagaaaagaataaaggtgaccaaattgattgaccttgacgctattccttacctgcggaccaatgcgcaactccaatctggtgtcttttctttggtatagctttgaaccgacggttattctgtcgcattttttaaaaaataatttaataactaaataaacagcaaattaaataaattgaggaaccaaaatgttgagtaaatgaggaaagtgggttatggattcatctgcgcagagaactgctaccaaatcgccattgcgtgacttaagtctttcaccacttcccgccttcatcactcagttggagcaaagatttgtttgaatatttaaaaataatttaatgggcaatattccttggatggatcaattttggcatcaatccttccttcgttttcttgtcatcgtttcatttgtgatacagttaattcttgcacactcttcgcacatctcgaacccaaccgccactcttccattatccagccggcgtaccttctctttgttgtgaaataatttgttcctttggatgcacttaattaagcactttattcattcatgagaattattcttagactaattttgttaaacattttggcaatttcccattttagcacttattttggcagtttttagcacctaaaaatataagccctaataatgaggacttcaccataatcattatcatattcaaagaattaaataggctaattataagaaacttttggtgtgtaataaattttttatgagcattgggctctgtctgaaaaattttcctctttttctctaggctgaatgattatactattttaaataataaaatattacaaatgccactttatacattggtgtgtgccaattttgcacatgtcataaacatggaaaatgccaataaattggtgggtgccacctatgcatatgataaagtgcataattttttacttttgcaattataaaattttccttttttttactattttaaataataaaatattacaaatgccagcttagacattgatgagtgccaattttgcacataccgtatttgctctaattatagcccatgggggattactcctcagaatagaggggataattagagactgcgaaattaataaagactgggggattatttttcggctgatttatttagtgaaaaatttttgaatttttttgaacatgtcgccagaaacgttatcgcgacaaaaaataataaatttttattgcattttttgttacagaatttctgaattttttatgaaaatttgaaaaattaacatatatttagcaatgaaattctttttgctgcgttgtaaagcaa

SEQ ID NO: 13829 - DNA, 4418 bp, Heterodera glycines
gtatttatcatatatttgatgacatggaaaagccaattcaattaatgtatggaaacggggggagggacttgaaaagttgcaaatcaaaccgaggtaaagccattcaatgacaaattgggataatgaaaacacctgctgatgtttaaaaataaatgaaaatttttttttaattttccggagaaaaaaaagacatttttccatcaaaaaaatttgttttcccgataaaaccccatagagggggggggggggggggtcggataattgatctgtagcaaacaaaaaaacgcacccgccgacgaggtcgctgaactccgattcctggctgaggttgaccacatgcaatgggacccgcaacaggcgggccatgtgctgcacggtggccgtcttgccaacgcccgtgtcaccggtgagcagcacgggctcgggcggcgagcgggacacacatgcggccacccgttccaacagctgggcagcgtcccgggtgagcacaaacggtgccacagcaccagcgcaactacaattgtcagtattttattaaaattaatttttttttttgtaatcacacggaaaaccactaaaaacggcaaggaaagattcaaaaaatcccatttttcattcatttttacgaaaatttgaacctttttccactcctgttgtcgttgttgctttgctgttgttcctgttgcgccgcatccgtccgctgttccaacaccacccgaccaaattggaattggacccgtttctgttggtgctgcgcctgtttaggaatcctccgactgctgcggatgttctcattgttgttgttctccagaatggacacatccggaaaccgtacgtcgatgtggcactgctgctgttcaggcgacaatgacaacgcttcaccaatgacggcttaaaaaagaggaaaatttgtccatttaaaaaaatgcaaaaattgtggcccgaaaattcacgaaatcagcaatgtttacagtaaaactgtaacatattgacataatcagactcgttattaagcaaattaagctataaactagggaaatattgaatgtcaatgtttttagaaatttttcgtaccaatgtaatgcagttgtcaattaaccaaaaaaaaaaaaatttttaaataatttccatttccgacataattcttttttaaacctgcaacacaacggcgaagttcatcgccgctcaaatgggcggcccacgcgtcaaacagttcgccaaacaatgcattccgatcagaaacgagagaattcgggctatgctgctgatcagttgaattcacgagatggctgatcactcggaacaaatccttggcattcagtgcccggtccatggaggccttccgatggttgatcagtgcagaaacggtgacaaatgtttgcaaaagtttggaccgaatgttgaacaattctgaaattgcaaacaaagacgtacaattaaattaattctttaaaaaaaaaaaaatttttttaatttttcgagtgggatggaactttcgtctgttttaatcattttcaaacacaaaccatgatgcgatttggtcatttgtgccaaaattgagtccatctgtgccggttggatcggtgccattcggacagtgaatgggtagtctcgccaaatctagaaacaaaatgtttcattccgctctgtgaacgttcagccaccccctcaaaaaaaaaaatttttttagttttttaaataaaactgactgacagtaccaaaatgcaacaaaaaattgttttgaattcgtaaacacctcttaaagactaaccattgccgtatggtgttggtgctcttcccgtgaaattgtgcccaaaatacggcattgcgagcccatcggaatgtgccgtccgttggccaacacggcatggccacgctcggccaagccaacgattgccgaggccaaatccgacccaccatggtcccaattctcccacaaaatcacacagtcccgttgcaaaaactaaaaaatatttgaaaaaatgcatggcgctatttaaaaagagtgggtttttgaattttataaaaacaaacctgagcaaatttggaaggctgccaaaaaaattcgccgggaacttcagaacaactgtaactgccgtataacacctaaaaattaattaatttagagtgtcgggccaatccccaaacaccgaagaaaaaatttttttgaaaaatttgtgtgaaaaatttgaacctaccattttcgtctaaatcggactaaagagacgaggcttggacgtaaaaacaccaatttgatgggaaagatacaattttttccccagtattttcggatagaatatcgccaaggtctccctttttattttggattgtgccacaaatgcaaaagtatgcactaccagaaaaaattccaaaaaatttactcactgccaaaaaggcaataaaatcattgttcagtaaaaacctttgagtcgtattgttcgttgatctgcaacactttgagcggtacgttccgttgttttgcaacgcaatttgctgtgtgcgttttaccacatccatgaggcccctgaaaacgaaaatttagcaacgaaaatagcaaagatttgggttcgattttttcaaaatttgttaaaaattgatgtaaatgtactatttttccatagataacctgtaaaatgacgagttttttcgttgtaaaaagtgccacaattcgctcaacgtcagcggatgttgtcggttcttcaatttgtgccacaatttgctgaacgtcggtggctgttgttggttcttcaatttcaacaatttcaatcgttttgcatcgcttctcaatcaaatggattgcgtcctccgttttcgggtggctttgtctgtaccttttgcctgctcttctccttggcattattttatatatctaaaaattaaataaatgagtttttatatgaataaaatgggtggtctctattagaaagcaatttttgggatggggttgggttggagatttacatgaaagggggtggtgggttgacgaagctttttcgaagggatccgaggcgatacttacgtacacggcgattcaattttgggctcccagtgcaaataagtttattatttatttatttattaatcagaacgccaaaactttgcaaaactttaaattttcttaacccttaaaaatcaattttgagcaatgaacgtgaattttggtgaaaacaaattttcgactttttttcgaattttgttcgaatccaggttcggggttcgaattggtcaaaagatgccagaatcggttttcccgaccccgaaaacctataaaacaagtttattttcaaaaaaaatttttttgaaaatctgtacacagataacatataagtaccaaaaaacggcataaatgatctcttattgaaggattgatggctttcagtttgtttccgtgtattttaaacaatttttaagaaaaaccctaatttcgaaaattttgattattcggctttttgttcgaattcggttccggggtcaggaattcagaacgatgttcttatagaagtttacttctatattacaatactaatgccatagaattttattttcaaatagttgtatcaccgacgcattttctattgacgcattttccactgacgcattcactgacgcattttccgatcatgaatatcgaacatttattttctgccacgtaagcataatacatattagtagggttcggaattatatgcacatgcatattttttttcctggactgtgggaggcttgaaacgcacgaaaaacatgtttttagcttgttttgaagcttctaggatgactttccatatgtatattgtgcatatttggcgatttatttgcatatttgtgcataatttggcatttttccaaaaaatctctaatagaacggcccccaacagacaaattggcctttttgacctcaaaaaccggaaaattttccaaaaaaataattttttagcaaaattttcacgaaaaatattgaataaataaattttctcaaaaaatggttaatttatgtcaaaaataagcaaaaaaagcaaaatttcgctttttggttgatttttcgcaaataacaaatttgaagaaattttgagaaattacaccctcaattggaaaattttatgtgcatatttttcactttttatgcgcatatttcgcgttttttggtgcatattttatgcgcatattttacgattttatgtgcatataattccgaaccctacatattagagatcggaaattttaaatttgtgtatcccgctgcggggattgaaactcaaaattttctgcgggacgggatcccgtgggattaatcccgcaaatcccgcatttaaaatttgcggaatggatggtaaaaacagatcttgaatcaaatctgttaatggtccataaatttgactattttgttgcttttcaaaaccgcgtttttgcggcgcactttt

SEQ ID NO: 13830 - DNA, 3222 bp, Heterodera glycines
cttagaaaccaaaaaattgatataatttatttagatccccacccagcctttgatcaagtcccgcatgatcttttaatatacaaactcaaaaaaaccggaataacgggcaacttattaaattggcttcgggattttcttcttggaagaacctttaaagtaagaataaatcaaattaaactttttgcagatgatacaaaaatttatcattgctattcaaatgaatcccaacgtaaagttttagaaacagctctaatttcagtctttaattgggctgaaacatggggcttaaatttttcagtaaaaaatcttccgtcttatatctaggtaaaaataacaaaaaaataccgtacacaattaaaaattcaactttccctgaatcaaaaattattcgtgatctaggtattttaatcgacaacaaactcaaattcaacgaacaggtttcaataattctccaaaaagcttatctcaaaagcagaattctttttaaaaaaattaaaaccaagtcaaccaagacttggattacagtttataaaagttatattcgaccccttttagaatacgcaaccgaaatttggaatcctcgaaacaaaagaaataaaccgcctggaaaaatttcagaaaaactttacaaaaaatgttttcagaaaatgctgtctcccctacatctcatacagcgaaaggctaaaatttctaaaactttccaagcttgaaaccaggagaaaatatcttgatatcataacagcctttaaaattatcaaaaatactattcaccttaacccaaaaaacctttataatttttcagataggaaaagatcaccttttcctattttggtaaatccttaattttatatagtaaaaatttgcccttgcccatggactgaatttggtccaatctgtggaaaacaatcaccggcgagttcactcactggctaaatcccactggcgaaatcacctgccatcagcaaaatatttgctggagtttgaaaattaatcattaaaacccggatcagctcataggagtgaaatgaatggagttcattcatttatttagcaccttttacaggcggaatgcaaagcgatgggagcggaatggaaattgttcccccgtccccttttcctagtcattcccttccccaaaaattgaattgttcccccttttaggctcattttgttatctttttgtacatatatttcactgttggttttatggatgatattcattcactgaataaatgcgggataaaacaaataatctgctaagtttatttctgtctttcctccacgattgtgtctccttttgcattatttgcatgccgcgagtgcttcgtcgcgctcggccaacaattcctgcggggaaaagggcaatttgggttccccctcgtatttttttctggctaatgcatggattgaacgggtgatacattcggtccagatatcctcttttacaattcccaatttgttattatcccagttcattcaatcacacttttttggtgatgtcaatcttctgtttggcaaagtcgtcgaggtcaagaccctgcacaattttccactctttctgtgcatcgatggtgacggggaaggaaaacaccaatccctcggggatgccgtaagacccatccgatggcacagccatggacacccaacgaccgtcggacggagtgccgaaaaaccaatcgcgcatgtggtcactgtcagaaagacggtttaaaaaatcagagagaaatacagaaagatttgcttaccatgcggcttttgatgcggacattgcgctggacaatttgcgcttttcgatgatcacagcgccacgtttttgcacggtctttttggggagaaaatggattgaaatggtttaaattcacaataaccttgatgaattggtcctgaatccacgcggtgtctttgaccgcatcataggccaaagtttcggaaccacctgtaatttggattatttgattgtatttttgctgttccgattgaatagctcaaacctttgacaattttggcatgtcgaatatccgggaactgagtgctcgaatgattgccccaaatgatcacatttttcaccatcccaacggtggttccatctgcgcacttttgcgccacctgagccatggcacggttgtggtcaaggcgcgtcatggcactagaattgaaaccaaattacaaacgaaccataaaaaaagactaacctaaaattattagccggaattttgttggccgcgtatttggcgcaaatgaatgcgcttgtgttggccggatttcccaccacgagcacctaaaagtttatttttaaggatgataaatgatcggtaaccaacaaatgcacactttgactgttggcttggaaaatttggccaaagcttcgccctgcgatttgaaaattttgacattggccgcgagaaggtccttccgctccatcccttctttgcggggcatcgctccgaccagaaaagcgtagtcaatgtcttggaaggccgcctcttcagtggtcactgtctcaacgccttaaaaaaagaaaaaatgagcgaaaaaacgcaaaaagtgacacccattcagaaaagcagaaacaaatgaatgaaagaaagattagccaacgtacgtaccgacgaggttgggaagcgcacagtcaaccaattcgtaatggacgccggtgagcactgcagcaagaggagggacgtcgagaaggacgaggacaatgggcgaaaagggaaaacatttacagccgaagagaccaaaaggaacacacctggtctttgccaaaaacatcccctttggcgatttgcagaacctaaaggtcaaaaaacggacaaaacaaaatggatagcagttacaaaatacaaaactaaccagggaatagccaatttgtccggcagcaccagtgaccaacacgcgaatgggttgtgaggtctttacaacgtcagcacctatggacatataatcaccgtaaagtgccaagtgtgcaatggaagggttcttcttcaaaagtaatccgagcggttggccgatgcctccacttgcgccgattaaagttaccttaaaaacgatttaaatccacttaaaccggtaggtttttaattaatgccttaatagaactgcttttcatcctgacactcattaagcgagaacattgctgcataaaggcaacggcgtttctgggaaaagcagccaacatggccattttgattaaagctttttaaattgtaagctgaaaaggaagac

SEQ ID NO: 13831 - DNA, 3499 bp, Heterodera glycines
  misc_feature (99)..(99): n is a, c, g, or t
  misc_feature (110)..(110): n is a, c, g, or t
  misc_feature (123)..(123): n is a, c, g, or t
tgtcccgcctcacggtggggacttaaaaacatagttaatctcctaggagaattatttgttctaaaaattacaggttaattccttagagtgaaaagattngaaagagaagnattatataaaatnagaaataattttattaaattttttaattttagtttcaaaaaaacaaacaaaaaatgttcccaattttgaaaatgaaatagtgcacaaaaaggggggatggttagacgaaaagagaaatttttaggaagggacgcaccccatctgatattcccatttttccgttccacaactggccaaaggcgactgtgctcattgacacgtagttgtccaataaggtacttggactttccacagtaaaatgtggcacaaattttggaactgtcccgcctcacggtgggacttaaaaacattgaaaagtgagttcaaaacttcagagcattcttcgtatcacttaatagtcctaaagattctctatccaaaagttacaaaaaatctgattcaagtttgtcatcgtagttttgcaaggtgctaggtcgttccacaaaaaagctcagtgtgggcgttgcacgaaaaactcacagtaatcgataaaattaaacaaataaatttaattattcaattcacaaaacacggtgccgtccggttaaacttgtttcatcaaaacacaaaagactaaaggaactctgatattctttgccacacatcgacccatttttgggctaattagaattgttcaagggggggggggtggcacccaagaaaagcaaaatcctctaaacataatgaccacttagttccttgcctaactcttttcttaattgccaaaacataatttttggtaccaaacgagtgttaaagtctcgaaaatttgtaaatgtaagaaaagagatacggtgagaaaaggcaaaattccgttttgtcccgagtatatttagaaataatggtactttggctttatttgccacaaatttcaaattaattaatttattttttataacttttttgtttacaagcaaaaatagttgaatacagttttgtttaaatttcacaagccaaagtagtgttaaaaatttcattccggtttctttttgaaaaaattccatattttagacatggtcaatttggcgataaaattcatttggttggtcgatcaaaaatcagtagggattctttttttaggcacaaaaaatcgcgaaatagcacctaaaaaggcagaaaaaaatcgcaaaataggcattaaatcggcacaaaaatcctcaataggcacaaaataagcaaataaaaattttttattaacacttttaggtagcaaaaaatataaaattttaaaaattcacaagtaaatgaaattattaaatattttaaagcttttttcgaataaagacaatttttgaaccaaaaatttttatcaagaaaaatgtattaaattagtggaataaaagttttggaaaatttttacaattcttaggggtgtattttccgttttaatgcatttttgtcgaggattttttcaaaaatcctaaaataggcacttaggcacgaaaaccccgaaataggcaaagttaggtattataaaagtcatcgtagacatcccaaaacaagcggaaagagcttttttcgtgctaatctttgcgcattaagtgcgcaaaaattttaggtttttgcctaaaaagaatccttaataatcagtatattatgtaaaattttattacaaataaaaaatcaaataaaaaggttattttgtggcaggttttccaagaaacaattttgggaccggcgggagggtccggcgatgccgccgtcgggaaaattttaaaatttgaatgcaatttgttaacagatttacaccaaatatgactcgaggaagaagagaaagagaattattatgggttttttcgcgtaaatttaaatatttttctgactgctcaaaagttcaatctttagggggtgcattttcacttctcgtcccaaaaaagaggtgagaggcgtgtcccacccctgctggtattcacgtatttagttggatttgttatgatgtttggatttgcaattttacaatgcgcacggacaatgaccaaattggaaactacctgctgctgattggatcgatttcgattattttaaatttaaaccgcagggctttccgacttgcgacattttttggggtttgatttccgaaaaatttttgggcctcggaatgccatcactggtttacacacaaaacatcataacaattcaagtaataaagtaaatttaatcaaacttggccatattattcccttattttaacccctacttttgaccaattgattagggtttttactttggcatcacaaaattatggccccgtgaattggccaagttcttccaaaaaaccctcacatggaggacactacttttttgtaaggccataatttttcaattgtctaaaataaatgtttttctgaaatagcaaagttagaagaataattttgaacgaaaaaatttcataaacaaacttcttcattctttgggaaaaatgatttttgaattggcacatggggagtttttgagaaaaggttacatattttttgaaaaactttcaaaatttgggtagtggaagaagcggatcggataactcgcgtatataataatcacattatttttgggaattcgtctcttatttcgagaattatccttctcaacattttttggaccttgctgaaaatagtttatgatttttttaaacaaaaataaatgtgccatgggataattaacaaataaatagcccttacaatatatgcataaaggtacgatttttgctgtgaggcgtaaatatcacaccacggaaaaatgaaggggtctctttaaaaataaaaaagagaatattggttaaaatagttatggagaattcgttcattcaaaaagatatttgattaatatcttgaatattgaggataaaaggacaaaattgagaacttatgaattaattataaatgaataagtatcattaaataaattaaaaagtttgggacttacttaatctctaataaaaattttaataaaatttcattaataatattatattttggggtgaaaagtatttttatattcccttaatttatacaataacaaacttatgaaaactaattttattaaattgaatcaaaatattaagaaaaaaaattcgacgttaaaactcgaaaatcagctttttcgagtatattcaaaaataattttttgtaagaagttaggacttaagaaactgaggatggtcattgcttgaagcgtaaactgcagtaggcccaaaaaccagaaaataaacatttaaaattataaatttttaattaaccttcttaagtacttttatttacatatttatatttctgattttttttacaataataaattacttattttccgaattttggatttttcatacttttcttaatttttagcatttattgagggttttgaagaaatttgtgtaaaatggctgaaaaaatcgaatttttgt

SEQ ID NO: 13832 - DNA, 2765 bp, Heterodera glycines
  misc_feature (94)..(94): n is a, c, g, or t
  misc_feature (112)..(112): n is a, c, g, or t
acgaaaaaaagagttccttgatttagtaaaaaaaaaccctacctagatttacaattttaaacttttaaaatagaacaaccctttatttgtacgnagttaaatttttatctgnaaaaaaaggatctacctatattcacaaattattgaaaaaaccgatttaaaagaatgtcttattaatcaaataaaattaaaagattcttttttgaaaacccattataaaaaatgagtaatggtaataaaaaagctattcaactaaaggacaatgtaccgcttaaacaaaaactaataatcaataaattattacatgctttaaatattgttagaccaagaagttccaaatacaaggattatagtgttttcgctactaaaaaaacagaatcggattatttagttaaaacattaatcaaaaatttgtcgtgagaaacagaacaaattttttaaagcaatatttgtaaaaaaatttacgtatttttttttactttttttacaaatattttatttaaggatttttctgcttgtaattatgtagtgaatttttcgaatcatccattactttttaaatgatcattgaatagttagtacttagtaaagcattattttataataagtacttatatttttcgtttatgttttcagatataaaaaaataatttaatacatatttaacaaggtcaaaacaaagcattggtagttaaaagatttttaataatcattttttaatgaatttcaatccatttattttattgttatttatcaatgaaataaagattaaaaatttattattgtggatttacctcataatatttatctttttaaatgttttatctgatacaaacttccctattaagtagcttctataaataattgttcaaatttattagttattttaaattatctttgatacaaccaaatatatatatatatttattttataaaataaaacttttttttaataattatttattcaaaagttgtattaattattaaattttacaatttagtgaagtattatttagatattattttatttttcttgtttaattaagtataccaaatggtttattgttaaggatttgaattattttaatattcctaaatgcgaagtgccaccgtatagattaagttatgattccgaggtgccattaatattggtgttttattaattaaagtctgtcatatgatttaaataattatattaattttatcattaaaactaaaactttatttgatggtttggtttatttctctctatttttcaaaaatttaattcgagcttttttattcggataaattttttacttaatttgtatttattttcttgtataaataacaatataactttcttccatttccaaatgttcacacctatatctttatcattgtgatataaataaaattcattgttgtttatatttttttattaaaatttacatttaaatcattattgctttattttattgccttttcttgtcttgttaatcctttttttctttatgagtgcatctgatttagaattcgtagtttattttatatcatattttccaattcattaaatttttttgttttaatattatatttcgctctctcaccgcataaaaaactattgggtgggtatttgttccattcaaatcgaaaaattgtcgtctatactttatttttgattagggcatttataagttcaactacgtcatcattatcactgtgtattaattttattaattgatttagtttatcgttttaattaatatcagtaatttatttttacgtcgtgttccaatatttgcgttaatataaattgattttaattcagttttataagccaactgaataagcataaaatatacgttccattatccaaagtatcatagctattccagatgcaattttgttttggaatctgatcaaataatctattttgatttctttttattgttataaatttaaatggaaaaggtcagttttggcactaatcaaatcgggcaattctcatttgcttttttattttaaaatatctttttggtttcgcgcattctcccttgatttcttgtttgagctatttactaactctagtgcaagcggactggctaccaaaatttgctaagcggcaggtaaggcactcaattaaaaaaatgattttataaaattatagccgtgccaacatcttgctatgagctttttttaaaatttaattggaaataatgaattatttaagtattataatgcggctcgcggcatgacttacgaaggtgacgttgcgagatttggtctaagtcaagagggcctacttaccccgtgaggtgcactgcgatgcgcataaattttagtaatttaataaatcttaaatatcagaataaaaactaaattgaaagttcacattttttattttaaataaaaattaatatataaatatataaaaaattaccgtgacaaatgtgattatattggtaaaatatattaaaaacaaaattaatcaaaaaattaatttcttttctttaaaatgatttaaaatttcaaaattgcattgttttcaaaagcttttaatacaaacccgagcattgagtagactcttcagaaattctaattttaaaaataaaagtcaaaaaacatttttattcaataagataagtttatgtgtatttaaaaaagagctaaaagaatgtttcaaaataaagactcctaaaaattaatgggaaaagtaaaataataaaaaaatttgcttaaacccagcgacgaatacaaatttaaaaaaaaagttccattaaaaa

SEQ ID NO: 13833 - DNA, 1597 bp, Heterodera glycines
  misc_feature (1472)..(1472): n is a, c, g, or t
  misc_feature (1524)..(1524): n is a, c, g, or t
  misc_feature (1559)..(1560): n is a, c, g, or t
  misc_feature (1563)..(1563): n is a, c, g, or t
caattccgacgccgcgtctctgccgacataatgggcgttttggagcatgaacacacttggcaatttgacgttatccaattggaacgcgtgacggaccatcacccgttggccaacctcggggcgaaggcacgcgaaaaaccaaagaatggggggagggcataatgcacaaaaacatagaaatgacaaacggacactttcgggggagggggggggggggggtccggacgaggccagcagcagggccccgccgggactttaccgggacccacggcccagttttatagacaaaccaccgggagtcatggaaccggggtcccgtcccggcctattttccaagtcccggtccttggccatttcaaaattccgcttctaataaaacaccaaaaacggacgggaatttctggcagaagtgcacaaggccaaacaaattcccaaataatccaaactcgaattgctcctctgttttctgcaggtgtttgagcgttggaatgtctgcgaagcactccaatgtccgtcccaagtgatcgtccgatggttgacggtgatcgaagcgaattatcaggcggggaatgcctatcacaacgccacccacgcggcggtaaatggccaaaggaattgcaaaattaaaaagtataatgacagtaaggggataaatggcatttatactgtagcttcgaaatgatttgttgtcctaatgggccaaagtttattccattcatttttaggatgtgctgcaggcgacttccttctttctcaattcggattcggtagtccattttcaatttttaattgtttatttattaatttttaattgtttatcgcaggtcggccaaatgatccaagaccaacacgcgtcggccgcactgatcgccgccactgtgcacgacttggaccacccgggcagagggaacgcctttctgatgaacacgcgccaacggctggcactgctgtacaatgatcagtccattttggagaaccatcacgtgagaaagggggggaaggagggaaatagagaggggcgggggagggagagaggagagaaaaagagggacagatagacgagagagagggcggaagaatgcgagagagggacgagcgagagaaaagaaatgaaagaagagaaaactaaatgagaaaagtgattaatagagaccggacgggcccggcgagcttttaccgggcggcccggggcgcctggtaaaacgggctttttttgaacgggcgtcccggaccactgtaaatgtactttttgtaccttgtggttgctcgataaataaatatattcaaactcactttgcttttcccattttccttttctctcctcaggtggcactcgcctttcagctgaccctctcccagtcgggcgtcaacattttcgccaaaatgccgcgcgaagagttcacccaaatgcgtcaggcgatcatcgacatggttttggccacggacatgagccgtcactttgagcacttggncaagttccaacagctgatggccataatgccggacaacacggaggaggagcgngacgccaattcgttgatcatttgccgaatggtcgnncgnagggattgggcacgcataaacagggccaaggaaa

SEQ ID NO: 13834 - DNA, 3608 bp, Heterodera glycines
  misc_feature (1767)..(1768): n is a, c, g, or t
gggagagagagaggagagaaaaagagggacagatagacgagagagagggcggaagaatgcgagagagaaagaaatgaaagaagagaaaactaaatgagaaaagtgattaatagagaccggacgggcccggcgagcttttaccgggcggcccggggcgcctggtaaaacgggctttttttgaacgggcgtcccggaccactgtaaatgtactttttgtaccttgtggttgctcgataaataaatatattcaaactcactttgcttttcccattttccttttctctcctcaggtggcactcgcctttcagctgaccctctcccagtcgggcgtcaacattttcgccaaaatgccgcgcgaagagttcacccaaatgcgtcaggcgatcatcgacatggttttggccacggacatgagccgtcactttgagcacttggccaagttccaacagctgatggccataatgccggacaacacggaggaggagcgggacgccaattcgttgatcatttgccgaatggtcggcggagggattgggcacgcataaacagggccaaggaaaagacggcatttcttcagatggtcaaatgcgcggacattgccaatccgacgagggagtggcgcttgtgccacgagtgggccatgcgaattgtgcaggaatactttgaccagacggcggaggaaacggagcgcaagttgcccgtcacaatgaagggctttgaccgcgagacgtgcaatgtgccgttgacgcaggtcattcattcattcatttaatcgacgtgcttttggcatttcgttttggttttgatcacccaattttgctcccatatgatcagccaatcatttggccaattgtgcctttgtccgatcattcattcgtccatttcccctttcagtgcactttcgtcgacatgttcgcccgcgaggcgttcacactttggtgcgaatttgccgacctgccccatctgccggttcagttggaggagaactacgcccagtggaagacgagatccgccgaatgggacccgaaaaaggacaacgacaatttgttgaagcggacggaacggtgagagcggacaaagcacagaaaggaggggaagcggcgccgtttgtgccgtggcaatggacccaccacccaattggacggcactttggctgtcgcggcgactcgtccaattcctttcccaaaattaaattctcaacaccaataattattatttatctgctgttcttctgtcttcgttttcatgtgcaattgtctttttgttgctttttgcctctttttcgtcccaattttcaatttgtttttccttttcctttctttagcgtcgctcattttgaatcttttaagttatatttcgcatttttctgtcatttaaataaaggttatacataaaacccgttacttttccatttgtttgcttaggtaattaattaattatgcatcctttggcaaaatgagcgcattggttgtggtaattaatgttttatttcccctcccttttcccttctgtcaatccttccgccgatatcatttttattcttctacattcgctttaccaccttttgtttgatttcgttatactattttgtcccatatttccactcaaatattccaattaaaagagaaaataatgcataaatttttctcattgttgggcaaagcttaggtattttaaaaagggacaaatttaagccgctgaaaatttgacattcatttttagaaacaattttcgcttttgcggaaaatcccttcaaatggaatcctnntaatcccgagctgtcggaaggaataatttagacaaaattctcaaattatttgcgaatttaatccggctaaagggatggatggtacatagatcacgccgattgatttattttatgccaatggataggcaagagttaaaaagacaacgatttattctaagtaataacaaaaccgatttacgaacccacaacggcaaaccaacaaaatgtcgtgtcaacatgccaatgattacaaaaaaaaaattgcaaaaagtgaaattgacaaatagaaaggtcttctttccgcttttctccttccatccgctgcttttcaataacggtaatggcctggtttgaatggtccctcttggggaatgcccaaatatctgagagaagcaatgccaatcagtattcgttcaacccccaacccctcctcactcggcttggtccttgctcaatttggtcagcttggcgcccaacttgtccaggtgcagccgtgccacctcctcgtccaactgtttcggcaaaaggtacagtcccgttttgtaagcgtccggagtgccgtatttcgtgtacaattctaaacgaggaaaagcagaaaatgagaaaaagggagataaacgggcagaccgagctgggcgatcacttggttggtgaaactagcggacatgacgaaggacgaatgtccggtggcacagcccaaattgaccagtcggccctcggccaacagaatgacgtgccgaccgctgcgcatcaaatagcggtccacctggggcttcacctgctccatggacacgcaattctcgttcatataggtaacgttaatttcgcagtcgaaatgcccaacctcaaaaaagggggcaatgaaatggaagaataaatggtggcaattaggagtaattagcaaatatgagagccctaaagtgccattccaaccaccaccgctcacattgcaaacgatggcatcctccggaagccgttcgatgtgttcacccctcacaatgttcttgcagccggtggtggtgaccacgagttgagcaatgtcagcaacttcgtccagcgtactcacttggtaacctgaaaagcggcgtggagggacaagtgacaaatgagtgccgacggaacataaacggacgatacctacccgaattattaaaatatccaaaaatttcatttttttcaaatattttgccttaccctccatggccgcctgaagggcgttgattgggtcgatttctgaaacgtttggcgttttgtacatcggtgtcaaggacagagcgcacctgtgacgatcactcgcgcgccaaaattgcgcagccccgcggccgaaccttttcccacgtcgccgtagccgcagacgacggcgactttgcccgccaacatcacctgaggggaaaggcaatttgagaaacgatcaaccggaattaaaggggggggaatgactcacatcggtcgcccttttgattccgtccggcaacgattcgcggatgccgtacatattgtcaaacttggacttggtcaccgagtcattcacgttgatggccgccgttttcagcagtccggccgccaacattttggccaaattgtgcacccccgtcgtggtctcctcggacagtccgatgatgccgggcagaagttcggcgtgttggtggtgcacaaggttggtcaggtcgcctggggagggggtgcttttccagtccaatgcagcagaagtgactcacctccgtcgtccaaaatcatattcagcggctttccgtccgggaaaatcagcgtctgtttgggggtgaattcggatttaccgcaattttggtgtcccatttctggcacctgctcaatgcaccattcgtactcctcgtccgtctcg

SEQ ID NO: 13835 - DNA, 4062 bp, Heterodera glycines
cggatttaattcctcttaaaacgcaactgaatgagttaccatctatagattaatattttattaccgtaataaattaagtgacattaaatttatttatttttttgaagagagtaaaggcaatgtcgtctcctccaccttttccctccttttgttcacatggtttgtgtcaattgtttgtccataaagcgtcgttttgcgaaacaaagccaccacttacaattagtgaaggttgattttttttaatgctactactcactttcgaaggtggcatttccgggtcggggaatacgcggtcgacaagtcgaacgcccaactcatggcgcaactgttgaagataggcacgcattgtatctgaacaaaagacggaaaattaaaaaataaaagtgaaatgccatggcatttactatattagtcaatgacaataggtaagtctgtttttcttaccttcttcttgagtatttgcgggcggtttgaaaagtccggggaaaggaaaggacggctcgccggggatgggaaagttccgctgactgtccaatgccaaagtcagcaaatctttgcccgcctgcaatttccttggactcttaataaatgttttgttttatgtttcttttttttttttgcttaaaattggcactttttgcaattttttgaggcattcggtgatgtacaaaaacaaataaatcaaagtcctatcggccgggcctttgatttcaaagtttctggaaaaacacattcgccttgaagagagtcaatgcttcatctgtagaacagagggacaattcaataaaatttaaacaaagtttttaaaaaagtgccttccccttaccgtaccgattacgtcctcctcggaagtgtcatctgtaaacaatgaactgcaactcattcaaacaaaaccaaccaatccgcggcgccggccctctgacgcccgttttgatcggaagaacggccatgttgccgacgagcgaaacaccgctggtgaatttcgaatggtacggctgaaagagaaaattgcgactaatggcacttctataggaaaagaacgaaccggcataacgaatgaagggacgaaaatgacaaagcaaaaagcaattgaaaacgaaaaaaaacaattacaataaaatgtcggtaaaaattaccagctttggttaagtatttgcaatttaactttttctttgtgcaaatttatacaacacgtaaagaaattaggaaaaaattacaatttaattttaagcacagatgtgccaatgttgtgatcagtcatttttctctgtcccgcccttttccgtgctctcttcgctcttctccccttccttttcttctttttccgtacccttttcctctacactctctagcgactgtcgtgtcgcctccataaactcaaatgagcacgaagtcaaaacagaaatccaattctgcaaagcgtcataatcggtggccgccattatgtaattgtggccggtgctgaaaaaaatgagaatttaaaagaggaaattccaatgattatttgtgccccttctccaaattacgtgttgaatttgatggagaacgaattttgccttcccatcgtattgtcatcggccaattcgaccacaaagtcttccattacaattaacagcacggggatttcaaggcgttcggacgactcaaataaaaataacaaattggccttcaaaacggcgtataatctgcgccatcgctcgtcctaattaaaaagggaataaaatttaatggtaaaccgaccacaaaacgcacctgaagaacactgacatagccgtggattctccgctcataatttttatccgaaattaatgagacaagcgaactgctgttcaaaagcattgcttacaaaatgcagacaaaaactaacggacgaatacaaaaggccagttccaaaatcttcttatgttttttaaaaagcaaatatttgtgtataattttctgtttgtaaaataattaaacgctttatcaaattcattttcgccaaatcacaaaaaaaaacaattatatttcgccatttagggcaggttcggacaaaggatcaggcataataattcagactcgttttcttcttggcttgcacctaaattttttctggtaccaatcaaaatttaagcggcaattaacctcaaggatagcgtccataaaatcttcgtgcagaatgatgtgagattcacgacgaagcgcgatcataccctgataatcgaagcagtaaaaggtcttaaaaaaaattggtcccaccgcctccacacaaacagctttgcattgagcaccattaaaatcgtcggtacaacgtgccaactcatcgaaattaacatccttactgcaaaaatggcattcgattggttccgagtcgtaacaacttactcaacgttcatattccgggagtgaatgcggacgatgtgcgcccgggccttctcgtttggcgctggcagttcaattttgcggtccaatctgccggaacggagcagagccgggtcgagcacatcgacacggtttgtcgcagcaataacctgaaaaatcaaatcgaaatcgacaaattctcctcattattcgccacccacttttatgtcgtcatttggctggaagccgtcgagttggttaagcaattccaacatcgttcgctgcacttccctatcgccggccttctccgaactgaatcgttttgtccctgaatagaaaaatgcccaagttagataattgtcaaaatgcactaccaattgcgtccaattcgtcaatgaaaataatggacggtgctttctctttggccagtgcaaaagcatctcgaaccaatttggcgccgtctccgatgaacatttggacaagttgcggaccagccagcttcagaaaagtggacttggtttgagcggcaacggcacgtgccaacatcgttttacccgtaccttggaaattggctttaaatttcgaacaacaaatagacaacacctggtggtccatacataagaacgcccttaggcggctgaatgccaatgtttatgaagagatcttttttagtcatcggaagaaccttaaaaagtaattgtgttgatacggcatgtgaaattcggcttacaattgcttcaaccaattctctgatttgactatcgcatccgccaatgtctgagtacgtttctttcggacgctcgtccacttccatggccttcacgcgtgagtcgtactcgggtggcagtttttccaggatgagataagagtccttgttaacgccaaccaaatcggacggtttcatttcttccgggtccacaagaccaacaacgggcagaaagtaagtggcacgcgtggatgttttgatgacggcacactttggttttgtgggcatcaaggtcaatgtttgctccttcctcttcctgttgctcttcaagatccaaaagttcaatgacatttgagaccaaatagggaagagttttgttgatcttaacaattttatggaaaaatgcagaaaaaaattgatttgccctgaaaagtaacatatccattaatagtaattcttagttcggttttaatcggattataagcgcagagctataataaggtacaccctttttctggattgataactcaattattcgaatatttcgaatgaaactaactttgatcctttcgttgttttcctttgtcttctctttgagtgtttgcatactgtgactaatgcgctgaatttcactgcgcattatgcgaatttcgttgtcgagcaacagcgaccgctcccgaatttggtccgtagacatttgcaaaatttcagcatcgatctaaatttaagaaaaattaaatataataaagtaacggtctctgcataatcttgtgcacctcatcttcggcggtttccatcttctcgtcttcctttttagcaggttgttccgctgtctcaaccattcaaattccacaccttaattaaaacattagcactgataaaataaatgtacggaaatgaaaatatatttgaagaacagaaaaataagcgattgttaaagcataggcttaagctaaagagaaaaattaagtcagcaaaagagacaaaacgccaatttaaaaaaaaaccgacacaga

SEQ ID NO: 13836 - DNA, 2785 bp, Heterodera glycines
ttgcgcgccgtctccgatcggattcacttgtcgctcgccagccgccggctgcgctttgatcacgggccacagaacggagcggctaatttgatgacttttaccgcgcgcgaaaatttggcggcccgcttcgccttggggcgaaaaataggccaccaaatgacgactgacgaggatacggaccggttccgcgtcaaaagcggcgcaggcgcagcgcggatttcccctcgggccgattaacgggcacccgcgcgccggtggagaggcaattgcactgtgaagcatcagcagcagctgcagcaattcatcatcattatcgtcgtcatttttgggcataatgcttcttcttttgctgctgctgttgcgctttagggtagtgccaactcagcgccgggccagggcttggtactgagatggagtgacataagtgccaagccagcgacactcggggtttggcactgatttggcgggcattgtttggccaagcatttggcataatacattgcgcttaaatgggacaatagctgtcacttgagcactgtcatccatcagcgtatgactttgtgttggcacccccacgctcaattggctgtctcccattcgcgctaataacattaatgtgctgcaactttttttggcttcatcatcattagcaactattatcataataatatgattattcatcgcattgcttaccgccaaattgttttcatttttggaggtggaacggtgaaggattatgttgggaaaggggtaattttcatataagaaaaattgggttttcagttaggtcgcaatttatttttttgtttttctgtatttttcaaaaaaaaaatttttcaactcatgctgcctttaacaatggttggtatcctcaggaaattttggcttttttaatttttatattttttgtatttgattttggtatacagtaagccatcaattttatttatttttattttttaccacttttttaaaattttctgtgttcaaaatttattaattacgggcagaaaacatttttttttctgcagacgacccgctgcaaattacaaaattttctcacctttccattacataaataaaaagtggagttggttgttaattggtcacacacaaattttttgtggaaaaaattcgcaattttttttttgcaaaaaaataatcaaaattgccctcccctcgccccacctttgtgcatttacaaatttgcaatgtcgtttcattaatgatcacctccaatcctttgttgtgtcagcattgttcatttgtataaaaaatatttccctataatgaaatgcgctggagtctgctgctgatcagtcaaaatgataaataacaacaaaatgtataaaatggatcaaattgatcgtaccaaagtgatcattggcaccaaataatcatcaatttcagtctaatcagtaagaccctggcggcaaaacactgatttattttgacccgtatctgaccaatcttccaaaatgattattactaattaatctatccaactttcaatctgatcagactcatcagatttgcaaacaaaatgaccattgcaaattgtttgaccagtccaatctttcgaattgagacttttcgataattttaaaagaaacttataatgcgatcaaaaacttgatcacacacaatacttatggcccaatattaataccataatttatgatttttattaattacggaagcataataatcacccagattccaccgtaatccctctatccggcttttccgcctaccgtaatccggcacaccaatgccggacaattcagtcccgcaaaagcggagcatcatctgcctgctgtcggtgaagtgcaagacgccgatggtgatgatgatggaggacaacatgccgaaactatatttgtccgtgcgctgaaccggctgttccacgccagtggaagagttagtaatttttcccgaaaaattcaagcctaagtaatttctagggccttccttttttggcaaatgcctaaaatttctgcgcattttaaaatgcgttttcaacttagtttggggtgtctatgatgacttttatagtgcctatttttgcttatttcggagtttttgtcttaactcagctgttaccctgcaaaatttggtgcatttctgaacagaacgcgaaaaactatgagtgtttgaattttcactaaaaaagctaagcctaaagtttttcgctcgtttaaaaagcaattaaaaattttagaatttttattcatcgccctttttgatagtaaaagcatcagagtgccttaattaacctgtaaataaagtttggtgtgtttcagagcactctctgaaaaaatattaatgaatttattatttcaaaaattcgaaagatacgcaaaataggaataccgaaaaaatttcaaattccacaaaatgggaaggaaattcaaacctaattacctcttcttctcagctgttatcctgcaaaatttggtgcatttctgatcagaacgcgaaaaactatgagtgattgaattttcactaaaaaagctaagctaaagtttttcgctcgtttaaaaagcaagtaaaaatttttagaatttttattcatcgccctttttgatagtaaaagcatcagagggctttgttaacttgaaaataaaatttggtgcgtttcagatcactctctgaaaaaatattaatgaatttattttttcaaaaattcgaaatgtacgcaaaataagaataccgaaaaaatttcaaattccacaaaatgggaaggagatttaaacctaattaccctcttcttctcagctgttac

SEQ ID NO: 13837 - DNA, 2772 bp, Heterodera glycines
  misc_feature (2747)..(2747): n is a, c, g, or t
caagagccgtcataacatcatgaatttcggcatcgttgttgtatgttgcatccgccaaaattctcatgatgactgcgtcctgcagcacgtagcgtttgtgtcgtttgtgtatgaacttccttgctgacctcgctgcgtcaacttgtctgtcgatgcttccgctgacttcagaaatgaaatcggaaagggctgggtgatgacaaagacccttctaaaattattttatttggggttttataagtaataaatacagagaaatgaagatgggttgcttcgaggccattgttggtccgagcgagggcagaagccgcatgcaagtgcacgttccaatatggaattgggaacagtgcgcgacgaacgacgggttcttcccaaggacgggcttaaaattttttaaatcaacaattttgggaatttcggcaacaatggcaaagataggacatttctaaaaaaattatgaagtcaggtcaatttttgaattgttttacctgaaagagtgtcggaccgcttcaccacgcacagactgttccccatacatttgcaccagtttaagccccttcatttttcggaagaggttttgcccgtagtggaacatgcaacagaggatgtttgttgcagggaaaacagcagatacggcgttcatttcggctttctcaaaatcgcaaatgactaaaagaaaactagattttcacataaatttatgtgttagttttcaccttttctcggtgcgaccggtgaaattcggttacgtagaaagttcagcacttcctcgtagtagcgtcgatgtttcccgggcagaagaccccagactccaatgcacattcggtggttgacagacgcgcccacaacaaagcactgctcccacatgtttggtgctgccttgaatgtcccgtccaaatgccaagttgcactgtttttgctcaaaatgtccaaagtctaaaaaatttaaatttaaattctgttttcgcccctgatgattacccgttcgctcccaaaaacaagcacaacgtccttttctccaattctgaccgtgcgactgtcgtagagcactatgtcctcgccatccttcagccgcaatttgtccggaattgtgaatgccaatgggtctgcacagtccgttgcccaaaatttttttcttctgccgtcgcatcatgcagctgagcgcattgtcagatcccatagccacataagtttcatcggcggctgaacgcctcatctccgccaaaagccgtgtcggcttgactcggggtttgtctctcacgcgctcgagtatttgttgtcgtcgtttttcggcctgaatttctttggctgattcaatattaaccatccaaacttgttgtttttgcggctccggcaagtgactgtgatctttttgcatttggtaaccggacattccgttgtcacttttgctgacaatttttacgcgtgcagggcagtcacgcacactgcatctccacaactcattttgtttgtgcgtaaatcggaacccttaaaaacgaaaatatttcttgaaaaaatttttctcaccattaaaccaaatgcagacacctcctcttttcgtttctccaagttcgaagtttacgatggcgtgttcttcaaaatcatcgtcgcggtcgttgttgttctcattttgttcacggtgatcagcagatagcgtttcgttttcactgtcattgttatccaaaaacttgcgcttacgacatttttgaagattttcaatttttttacgattcatcatacgtctaaattcgtaaatttatgatttgtttaactaaacccagaaaaatttttagtggtaacactttaaaaactaaatattttataaataaaaagaaatttggggacgaaatgactcattttggcttggggggcgaaacgacgcgggacgaaatgacagcgcgccttcactaaaacacccgaaaaaatagatcaaacaaaaacacaagcaaagatacattagtttaatgttattgtaattttcacttccattttaatgaccatttgccatgggatcggatccgctcgacaaatgatgaatttattttgatttttttcaaagtattttacacttataaattggcacctttattgtgcctacccctctctattcacacaattttgagtcctttctcccgttaatcgctaatgaataaaatttaagtcgtaactcaaaaatggattaataaaataaatgtcagattcgttttctgcgcctaaaattaccatagaaaattttgaaaaaaaccgagagggttcagttttttttctcgaaatttaaccaatttttaacccactaaaaacaattttgttgccatatagccaaataaaaattattgtgccattgtaagtacaaacaaaaccaaactttatgttttcatccatctccatatttaaatcaatttaacaaaagttgttgttgtgatcaattaagataatttttcgaaagcgatacaatcaatcaatcaattaaaaaaaataatcgtaggaaatttcaatcagtataatttggcaaatgccttccatttaagtaacaaaatgaggccaaaatggttgggacaatttgggtgttagataatgaataataataatgaactattagaaagggttcacatacaaaattcgaatgaaaaaaatgaagtcaataatggtagttgaatattttgagtaaataatgccatacactcattaaaaaaaataggacataatctagagaaaaaaaaatttttttagagtgtattttaccgctntaaatgtcttaagaattttaaaatt

SEQ ID NO: 13838 - DNA, 1292 bp, Heterodera glycines
caaaaaagcaaagcatatatggaatatgtgagagaacgaccattttctgaatttactaaaaaaagttccaataaatctctaaaataataaaaaaaattgtataattaaaaaatgatatagtggcagcagtggcgataggcgccttgaaaagttcgaaatttttatcatttttaaagagttataccaaatttcgtggatttttggaaaatttgtatgcaagaaaaatttcgcttttttgaccccctccccttttcagttgcttgtcactcatcacaaattccatataaaacaaataaaatgccaaaatctgtcatctatctgcccattcgttgccgttcagtttcctcatttttcaacaaattcagtccccatcctctccacgcgccccttcatcttttgtttggcactttttttgccactacactattgctgcatttgttgttggtgttgtgccggtggcgcgcccgtcgccgccgccgccgcttggtaatggcgttgcgtgccgaaacggttgttgctgtggtagtggtttcggtgttgcggttgttggtagtaataatgttgctgttggttgtgaaggtgataattgttgtagccaacgccaccgccgcgatatgacgcggggaatgcccatggaccaccagcaccaccgccacctcgtccaccaccaccccgttgatagtgatggtgattgtgatgatgcatcattgtgcggacagcctttggttttttgttgaaataaatttttaggtatgtgtttcatcaggaagaaaaacaaaacaaaaatcaacggttataggacatttgcgacccgacaaatgcggtcggacttttgcggtccggacatttgcggcccgtttcttaagggccattttcggacatttgcggcccaagggaaaatcggacatttgcggccaacgaaacgccaaattgtcattcctttttcaaattaattataccaaatatttttatttaacacatttcaccaattattttgttcaatgacttataataattttcaactaatttttcgaaatatttttaactttttttcacaatttgattatttaatttaaaagagcttgctgaaggcttcaaccagcacatttatttttctcaatgaataaccaaagtgcacacaaactaccaatcttcaaagccagcattggcgagacgatactgaagagcatttaaatgtcgcaataatatttaatcaaaaatttattcgagattgtcataccgttgaattattcttttataaaggtggtcaattttcaaatatattttttcaa

SEQ ID NO: 13839 - DNA, 1572 bp, Heterodera glycines
  misc_feature (1553)..(1554): n is a, c, g, or t
attttatttttgttcgagttcgggtcaggggttcgatattggcaaaaatgggtgctatattcgtgatcagcgaccttgaaaaccccttaaaacttattttcattaatttctaaaacacatttataggaatctgaaaatgtatgtttaaaataccctgtaaacttaaaaagtacccatttttctcatacaaatcccaaattggggcattttctcatccaaatccatagtttcgacatttttctcctccgattcctgcatttttcacatccaaatcccgaattcctgcatttttcacatccaaatcccgaattcctgcatttttcacatccaaatcccgaattttttttgtctcttcccttgcggcaacactgttgttttggcacccatcgcaggtgttgcgcaaagggtccggcacactgtgcgaggcgttgctgatggtgcaggcgcagcgcagcaacatcattttccccaacaaacagacggccaaggagcagcggatgaccgacgccggacacttgattctcagcgatacatacgtggtgagagttgacaaatgatgagcaaaacgagccgaggaatgggaggggggacctgaaaagcgaaaaactaaattaaaaattttcgtcccattcggtgcttggacattactcaaaaaccatcaaaaagggcattgttcagaaaaccatcaaatggaaaatttttgacaaaaaactcttcattaccttgcttaagggtaaccaaatttttaaaaactcttggtatcattcgatagctttaagtgttctttattagcctgcaaattttcaaaaatgttcgttaactttcaaaaagttatggctagaggaaccaaaaaaaaacaaaacaggtttttcgaacatttttgggaacttacaattagctaaattttttgaaatttggcgaacaattgaaaatattaataacaccgaaacatccttcgggcagtgcataaaattgaaaattgctttccttaaaagggtggccatgtggaggcggtggagtcgggcgtgttccgagcggacatcccatgccgattcaagctggacgtggaggcattggcccaactcgtggtgggcaaatttctggatttttattttcatcaacaacaaaataaattcatttttgcacaattaatttttttgaaacttatattttatttttaataaacccacatttttaatagacacatttttacaattaaatatgttttttcacactttttaatatggtttacaatttcaaatgcaatttgttccttgttaatttatcttattttgccatactttgcccttttttcttttttttctgtattaatccattcttaaatacccaaacccaagtccgatcatttttcatcaacaacaaaaaaaatcatttttgaacaattaatttttttttaagttatatttgtttttaataaatccacatttttaatagacacatttttacaattaaatatgttttttcacactttattaaaatttttaattggattttccaaaattgtattattaatcacactgtttacctttgtnnctaagaatcattttttaa

SEQ ID NO: 13840 - DNA, 1747 bp, Heterodera glycines
gtggtcaccgaggaggtgtgcatggcgtgcattcacaacgcgccggaagcgaagtgcaaacgcccgctgcagtggatgtggcgaggcgaaattggtcagtatctcatcacaattaacccgttaattaccccctttgatttttaattacactttcctctcattagcgctttaattactcctccctttgagttttaattattaattaactaaatgcccgaaatcgctttgactttgacagtgccggccagccgtggcgagtacgagatgatgatgctgcagttggagaaggaacggtttggcaaggagcgcaagccgtacaacgctctggcgcaggaggagcgggagaaaattgccaaggagcggattaagggtgggcatgatggcgaaacaatttggcgcaaattattgtatactgtaatcaagggttacggttgtccgtccatttttgatggtttcaaattttaaaggcattagggactgtcccagagttttgaaaatgacttttccgaatttgttttccccattcattttttgtttgctttgccattttgcaaaattcatttgtttgacatgccattatttttgccacagaatattgtcggaatgcgtacaaacggttgcacgacacgcaagaagttcagcggacaaccaccgtttgccaacgggagaaccccttttacgtgaacactgtgcgcgcatttcgcgaccgtcgctacgagtacaaacaaatgctgaaggtggttgtgttgcaacgggtgcaaaatcaatctagcgattttttcaaaattttatgatgtattcactcattattttatttttttatgaagaatttcctaagttttcagcgttttttggagaaattttcgagaaataacccaaaaaattttggaaaatcgccagaaactttttcaaattttttttcctttgaagttttcttataaaaaattcgaagattttttgaatttttttttttcatttttcggggggcggagaaaacttattgttagtgtacccccctcgatgtgtactgtatttattctactgtattttgtctgtagaaagccaagtcggcgctggaggcggtgccgtcggacgatttggccacccggaaacaggcccagcaacgcgtggtgctctacgactcgctgcagttggcgcacaagtgcattctgaactccttctacggctacgtgatgcgcaagggctcccgctggttctccatggaaatggtcgaattttttaatttaatttaaattttagtgattttttagttttattgtttcaaaatttaatttttatttatttttgctcaataatttagaatacttaaacttaaatttatttttattttactatagcaaattgttattttttagttattctaatagaaaatcattcggttaattaaatttttgttttccttttttttattttaatcgtccatttctttgtttatactttttatattatacctatttaattttatttgaaattggtattgtacatttttactatttttcagttaactaaaaatatcagaaaatcgaaaacttcactaatcacacagaaattttaaaaaaaaatatttttaattctttttaaacatgtttttacacaataataaatgaccaattcttttaattcccgaatttctaaggctaacaaaactaaaaattcgtgataatggaaaaattgaattaactgtaatcattaccaatttacaaattttcatcatgcaaaattttgt

SEQ ID NO: 13841 - DNA, 2611 bp, Heterodera glycines
tcgaaacatcattgttgtagaaattccgattacattctccacaatgtatcacctcacaaacatccaaacaagggaacccaaaccccatccggcaacactttttgcagcgctccctacattccattcggtgacggtcgggtcgatcgaatgtcacctcacagcttacacaaaaatttttgactgcgaaaaattgagtaacagattttaaaccatcccaatgttcgccctctcttatcacacaaacttcgttttttcttactcccttccctttgaaaattggtctaagtccggttttctaaataaagatatcacaggcagtttaggaaatcttcgtttaccatatcaaacgcaacgatacgaaatatatctgggaattccttgtcccaaaagttttgcacaaattcgaggtgtttaagcccaaaagctttctcctgggtgtttatcccagccttttccatcaaaaccaatgctaattcgtgttgttttttccctgtttgcatgatatggcggaatttattacgagaaatttcacgtccaatcgtttgataaagcttagcgaactcaagtgcataaaatatacctaaatattttcataaattgagtttcatttttcttctcactaaattttccctttggtgttggaatacgccctagttctttgacatcagcaaaaaaaggatgagttgaacatttttcaaaacttagatatttgaaatggaaattttaaagcagaaaaaatgtacatggcttaaaccaagttttttcatgacacatttcaacaaaaaaattatttcattaataaggcggtgggtattctggaaaatcatcaaattcttctggttgttcttcttttgtccaataattccatgctgcacaaagaacaaagagcaccagcgaaaccagcaaacacaacatgagaagcatggcaaaagagaaacccaaaaggaaaatgagaaattctgacatttttgctgcaaaaactaattaaaaacgcattgagatttaacaataaaatggcataaaaccacgaaaaactaaaaaccaattattgtacatttaatccattgtgactttcaaaaaccaaacgagatatttttaacagatttctccattcttgtttctgtgacatcagcgaattgaaagtccctctgatacgctttttagcccatgttgacatgagatgattgctcaagaagactgtagacaattttgaggaaggaagggcttcaacaatttcaaacaatagctcaggtggcagtggcattgttagctaaaaaagacacggtggcattctcttactatagcggcacagaaacaaaaaaactaaaacgaaaaatgactaaaatcaaaacgaatccaattattttttcgatattttctttctggttaatttctgtgtgcgcggcactaacaagatttggtttgtgttcgcccccttcaaccgtcgtctcgaggtcataagccacaattcggtatgctttcttctgtcggagtttgatttttttaatgaaacattgccgacccggatgatagactttgcaaattctacagaatttctccccgcacgtgtgtttgtttcgcgtattgtgtgtttccccacatttgttgcatttcttgtactccctacaagctgtctttttgtgagactcgaaacaatcattgttgtagaaattccgattgcattctccacagtgtatcgcctcacaaacatccaaacaggggaacccgaaccccatccggcaacactttttgcagcgctccctacattccatttggtgacggtctttggtcaaaatgtcacctcacagcttacacaaaaatttttgacggcgaaaaattgagtaacagattttaaaccatcccaattcgtgttgtttttccctgttttcataatatgtcggttttcacgtcaaaccgtttgataaagcttagcgaactcaagtgcataaaatatacctaaatattttgataaattgtgtttcatttttcttctcactaaatttcccctttggtgctggaatacgccctagttctttcacatcagcaaaaaaggatgagtcgaacacttttcaatgttaaaagctttgatatttgaaatggaaatgttaaagctgaaaaaatgtgcatgaattaaacaaagtttttcatgacacatttcaacaaaaaatttatttcattaataaggcggtgggtattctggaaaatcatcaaattcgtcttgttgttcttcttttgtccaataattccatgctgcaaaaagaataaagagcaccagcgaaaccagcaaacacaacatgagaagcatggcaaaagagaaacccaaaaggaaaatgagaaattctgacatttttgctgcaaaaactaattaaaaacgcattgagatttaacaataaaatggcataaaaccacgaaaaactaaaaaccaattattgtacatttaatccattgtgactttcaaaaaccaaacgagatatttttaacagatttctccattcttgtttctgtgacatcagcgaattgaaagtccctctgatacgctttttagcccatgttgacatgagatgattgctcaagaagactgtagacaattttgaggaaggaagggcttcaa

SEQ ID NO: 13842 - DNA, 743 bp, Heterodera glycines
cgtcccgagaaaaatcctcgctctcagatttttcgttgaaatctcagttccggcaccaaatttcggacctaatctcgatctcgaaaaatgttcgatctcgagcatcaccaaattgcaacacccacttgaacactcgttgacgtgtcaatgatgaacatcaggtcgaccgggtctttatcacaatttccacctgctgctgttgcagctgtttgttgcggtgtaactgtcgtcatgtttgtcaacaatgccgtcaatgttgtgccgttggtttcgtcttggcgtacattgcgtgacaatgacggcacacttggcgatttgcactccaccagtgacatttccgcttcgtccaagaactggcgaatacgcgcatcgatgtacacaaaccatttgttgcccgcatacaactccaactccctgacaaattaatgaatgttacaaaaatggaggaaaatgtgagaatatttcaaaaaatgctttctttgtgtttttttattttttattttagggggggagtcaatttttcaacccccttcctttcaatgggcgtggggcgtgggggggggggatgggtgaaaatccaacgcataattaaagtacaggctatagggaagctattccggaaggattcggtctccccataaatctgggcgcatcggttcggggggactgccccgaaaacaaaaaaatcgattttttcaagtgctcgtttgtggtactcaaacaattatggggagcaaaaatcc

SEQ ID NO: 13843 - DNA, 2837 bp, Heterodera glycines
ttcaaattaaattcaatttattatttatttcatagtcccttttaattaatgctaataatgcgcaactttcagttcttcgtctgccatgcgttgaagagactgaacaaaacacaatacataatatacgattttcatgaatgctgatcaaagaaagtgtggtggtcatcggcaaaaaataatttgtcaagccatggatttttaattttaaagcacttgaaaatttataaaaattaaaaactcaaaattttaatttggaccaatattcagtgcaaaattagtaaagtaaaatattttctccgcgttaaattttatgccggaactgctgatcactttccctctctaagcatgttgctcattccgatccgtgctggcgcgtttgttaaaactgccaatgggtttgaaaacaaaaaatgggtaaaataattaaattaatagcctggctccaatttatccaaattaatatttcgtggtatcattcaatagctttaattgttctctttcagaatataattttcctaaatttttaacttaagtataaaaaaagttatggtcacaaaattgcaaaaaatcttaagtcagcattttttgttcagaacttttttgaaactcaatgaaattttctaaaattttaaatataaatagagaattcttagggctatcgaaatataaattaattttggttaaatttcattttaaagactttaaaattttaaatgtttattattatatatgcattaccattgcaaaaaacatagcctgttcaatgctttataacttcttttatacttaagttaaaaatttaggaaaattatattctgaaagagaacaattaaagctattgaatgataccacgaaatattaatttggttgaatttgagccaagctattaatttaattattttacccattttttgttttcaaacccattggcaggtttaacaaacgcgctggcagtttttaacaaacgcgccagcacgaaaaaattttatgttataaaaactatccaaaaattaaaatataaataatccaaataataaaaaaattttatagacagacacctgaagaaatagtcatggctgacagtaactgcgtaaacatccgcttcagctgctcgaagtcggaccgcagaacgtatcacatctgcccatggatcttgactggtgcctatgaaaataaacaaagatattttcgataaatttctgcgcaattagctaggaaattaataaaaattcaacaaaaattttctatcccttggcgatgcttggacaaatcattcaaaaaaagaaattaccgtccgagattagcacaaccatcaatcgggtgccttttcgtcgatgtttggccacctggtccattgccaaattcacaccactgacaacctgtaatttttaaaattttaatttttaatttattactaggtcgttttgaagcaaattcacccactgctgtttctcttttctttttttttatagtagcatacaaaaaaataattaatgtaaatatgtattgaatataccaattacaagctctgactattcgctttaaaatgagctataaaatcattccaaatcattttttaaattattaatggcgctgtttgttgagagattttttataaaatgaatttatattaattaaaaaatatttaatataaatatttcattcttttaccgaagtgccgccgcctgtgtgattaatgtgcaataatgcgtcaaggatgaccggcttttctttcaattggcccatcgtgaattgcagttgggcttttttgttgaacgatactgctccaacttggacacgttgtgcaaaatcttggtccggcaagcgtttgacctattattaaattggaaaaaatcattttttaaagatatttgcatattttttaaagcccaccaaatccacggcaaattggagctgttgttcaaatgcttcctgcacactttgggaagtgtcgatgatgaacatcaaatccacctgtgatgacatttttttaaaagaaaattcggaaaaatttggccaactttttcgagttattattttttatgtatattttatttatttattttttaaatttatttatcgagcaaccacaaggtactaaaaagtacatttacagtggtgcaaattaaaaaattaatgctaaaggaacccaatgtttaaggaaacaacaatagcattaagaatttagtgtttctaggagatagtttctgaaaatcttatatttctgaatttgcattgcctctttaggcagcttattccaaaagatacggttctattaaaaaagttattttttgttttagaaatatatttcttttgctgaagcaaaaggggttttctattgtttcggtttgttattataaaatagttcatttgcttaaggtgtgtataccctcttagaattttttggaccatgactaagtctgtagcagttctccttatttctaactttttaagtcaatttctaatctgtgttcataagattttgggactaatccacatcttttaaaggcaatccttgtaaaatatttttggattctttcaattctacatataagatctttcttctgaggattccaaatttcatactctaaatgtggccgtatatagcttttatatgcttcacttctgagcatttttagaacttttttggggtataatcaaaattttgtttttaataatcccaaagataattggttacaaaaagcaataaaaattcaaaggtattcttaggagaaaaacaattcaaaaacaatgaataaagtataatttagggtactttttgctgcgataagcataaaaaattgatttaaaaacatttgaaaaacctatgaaagctt

SEQ ID NO: 13844 - DNA, 479 bp, Heterodera glycines
  misc_feature (426)..(426): n is a, c, g, or t
  misc_feature (428)..(428): n is a, c, g, or t
ttttaaaaactccaaatatcgtattttccaacatcaactcttttaaaaaaatctcacatattttctttaaacaactcattttaatttttcttttccattttttataaatttctcaataccaccacttccttccactacaaaattcaatttattattcatccattatcaactcaaattataacattttaattatccaactaactaaccaaacaaaatctaacacttatcaaaacaatccaaaatcatcattactaccaatcaataataaaacaatcccaaaatacataaacatctactccaattcaataataatttattaatttaacaatttcaacactctcccctttatattttaccctaatattttatccattacttaaacaacacaaaaatcataaaggttttttctaaatcataattaatttncncttaccctcaggaggtgtctgcgccagaagaagaagaagtaggacaaagca

SEQ ID NO: 13845 - DNA, 5661 bp, Heterodera glycines
  misc_feature (4590)..(4590): n is a, c, g, or t
taaaaagcagaagtaataaattgttttttacgctatatatttaacaattcaatttaaataaataattttctattaattcaatgtaaaaatagttacgacataacttttcaaatatatgtagcatttttatgctagtattattaaatttattatttaattgataattagcatataaacaattatttattctattttcacgtttccaaaccgagtacttcgctattcttttgagagtgtttctatattaataaatgcatttttatgttagttattttttgaactcttaagataaaatataatttaattgaataatgaacgatttgggatgtgctttggcagatcaaattttcttatttcatatctcttatcgtaaatgttaaaaaaattgtttttaataaatgttcctcaacattaccttttcaaatttttattttagctattgaatttttagtttttgtattataatttattttattttatattgatgtttcattatttttgaagtgttatttattaattgtagaaaaaatcattaaacattagtttgtcttttttttgaaaaattaagaaattgtttcttttattgtcacttttttattttattaaatttatttttaatttgtaactttacactaataataatgctaataacatagctagctgttaaattttacataaatcagttaaattttattactgaaaattatgattattaaaaaaataaatgttttcttgttcaaacattgcctaaacttttcgggtcagttcacgataagctcaaatgtgggacacatttagctcaaatatcaacaataataaggctaacattttaatatcaagcaataaaattaatgaaaatcaagttagaatattttaatatttattaaatttctatagaaagacaataaatatcatttattttcttaatctcaaaatgaaaaaattaactaattacataataagtgttttatatattttttatgatgaataagaaatttcaaatttaagaaaaaaccaagaaaattatcatactttaaattctaatcaaaagcttaattaattaatccttatgcattttcaaaaaaaaaaaaattaataatataactaattaaaaatctcttatttgttttcttgttttttgacctcattgttggcactcgtttaaaactttctatgataataacaaaagaaaaattactatagtattattatttttttacaatttacacaattaaattcgagctaacaatctaaaagaaataataaaaaaatgtaaggcaaaataagcattttaataataataaaaccctagcaaataaagattctttaattaaaaaatataatttgaatcaaaataaataatataatataaattattattataataatccatcgaaaagcttttaaacagttaatgaaagttccaattttgtccccacgttaaagcaacaaatggaatggcttccactcggttatacacaagcgctatgacattccatgagatttattaaatgataataattttattttaattataataataataataatataaaaatatttaaaaaaggatgtgatattatcatgttagataaataaataaatacaagaaataaaaataattgtgcaatttcttattttgaaacattctaacttttattaaaattaatttatttaattatttattgaaaaatttataaagttaattttcaatacaatatttatgaaccaccaaaaaaaaatcataaaattttttatttacatattggtacatatttttaacttttttggtagtactgtatttcagaatcacatttaattttgaattaactttaaaaagggttctaaattttaaaatgctttttattaccattaatttttaatgcaattttcacgctcaaaacccataagttcaatgtcgtatttatttaaaatgaaaaacttgggatttttataaaatttttcccggcggcacctatcggctccatgccacaaatcctttaagatttcaaaacttggacctaaaatttcccatttattagtgaaatcaaatgaaaaatattcaaaattcttttttttctaacgcggcgcctatcgcggtaggggcgaactcgtcgagccaattccgtctcagcaaagttaaaaaatctatctttttctttttgataaaacagcaaaatagaatcattccgtgctgagacgaacctaaaaaagtatcagttataatgaaaataattaaatttaaatgttataaagtgagtaaatcttataaaaataatattatgtaataagcaatttcaattacatactcattttatgtcacataaataaataatgatttagcaatttatgaaccgaataaatgtaattttttgaagaaaaattcgttgatgatagataatatttaaaatgataaacacttgtttattattttttttacatatattcattcattttttaagtttctagctagctaatactttctgataaaaattgatatcgatgtttgaattgaaatacgagaagaaatgttgcgtaaacataatgctaaaatggctgcaaaaaacgctaaaaattagaattttataggatttactcactttataacatttaaatttatttatttttattatacactgatacttttttaggtttgacctagcaccgtatcattcaacttatatttttctataaaaaagcctttttgtctaaaatcagttattacgcacaaaaaaacccaatttttaccgctggcgcctgtcggcgccgcctgtgaattttcttaaaactggcttaaaaaccaaattttgtcttttttataatttcctattgaagtatgaattaaatttgttttatcattaaattaatattttattaattattttttaattaacacttttttagttactcatggacgaacaaaaagatttttgttgtttccatatattaatttgaatttactttgattactaatgaactctttactaaacaataagtttaattagtctaaatacttttggcaattaaattaatgattttaaaaataattttacattttttattgatatttcctttttatcacttttgttttattttaaaatttttaatttcacaagaaaacttgaaaaatacatcatagcttaattctgataaattaaattttttttcaaaattggggtggatgcttaactactccaaaacagtcctcaaaacgcaaaatttggtcattttttgaaaaatctgttaagcgattaaagtttttctcacccccacccattcctcaaaagtttttttttttttgaaaaaatgcggcgcaaaaagtgtcgtgaaaagaataaaaaaatttcataatggtcgacatgctaattacttcaccaataatgtaatgaattggccgatgaattgggacgggccaatgatcagaaaattcagcagaaggcacaggatgaaaggatttgagaagagcattttgccagtgtgcagcaacagttgctgttaatgaccgttaattaattaattaattagcaaccgggcacagcgcctaatctgtttggcgtgtcacagctatagccctaggaattggacggaaaacaattgccgtgagttatatttggttcctcaccatgccataaacgcaaaaatttaatcattaaggataagaggaaaattaattttaaaaaagtttggcaaaaaataaattaatttaaattgactggaaaactatatggttataaaaagtggtttcgatcacttattactcaaactcatagctaaattttggtacattaaaaagaaaataaaaatattttttaaatcattaaaaaatgaatgagtcaagcatattgtatttataatttatttattttaacttaaaattttaatatgaatattaagtattttgaccaattttaagtaatcaatttttaaaagaatttgttttttaatctttaacaatattccatactgtactttagctggctggccattttcctgtgacttgtcgctaattaattaattaattaaaggtaaacatatccaagggatctgcccttcacttttctctaacattttcagaacaaatttgtaatctttttttttctccggaggtcatttggtctttatatcccactcattaatgagtcattcattaatggtcgaccgttgtacaaattcgacatggccactttcaatgtggcccatctcatcactttaattggcgttggggtacaaaaatttaaattaaattttattcctattttttataatatttgattttgttttagtcaattgcttcatcggttgttgctgatgagcaacaaaatcaaaacaaaactcaaaatggagcaggaggcttaaagcatttgtttggatcagatggtaaaaatgatatttttttatttgaaatttatttaaatttaattaaataaatgttgaacaatattttaagggttaatttttgcttttagttttcactgagcttcgggacaaacaaaatgcgatggccgagaaaatgtcgggaactgaggccaaattggaaaagcaaaatgaaaatggtaagaatttttttaattgaatttttatattttattntaggaatgcgcgaaacccaaactttgttgtccaccaaattggaaaaacaaattgaaaatggtaagtatttttatttaaacataaattaatttatttaattaataaaataatttaaaaattttgtttagtatttactgaactgcgcaacaatcaccaggggctgaccaccaaaatagaaaacggtagaaaatattatttattttcttattttggaaatgcgctttaggaatgcgcgacagccaaaatttgttgtccaacaaattggaaaaccaaattgaaaatggcaagttttattctttatttgcctatataaattttggttttgatttaaaattaaataattttttatttaaaaaaattatattttttatattctatttgaatttgttttttatatttttttttacaaatttataccgttcaattcctaaataatttccaattaattgccagtattcacatataattggagctttttagagaatatggtgtggtatttctattcatttgtatttaggaatacgagagaatcaaaatgcattggccgagaaagtgtcggaaactgaggccaaattggaaaatggtggaaaattaatattttttctaaatttaatatttttattttaatcatctgcaggaattcaaaacaaccaaaaggcgttgtctctgatgaagaatatggcaacattagcggtttttacaatttaaaaaaattaaaaataaatgccaaattttatttttataaattaatctataatttatttagttgttatttaaaaattaatatgaatttgattttacagttctttcacttccctcttccaatttatcatcgatggaatgcctcggattgtcacccaaaaattgtgatcaatgaaagcacaaatgccattcagcgcaacggaacagaaagtgaccagaaatcattgaaattgaatgcataatttttactaattgaataattttttttaatttgtttaggacatattggcttttcgtgccgagcaggaccaattcatatgccatctgctgttggtcgcattggcattatttatgcggaatatcggattc

SEQ ID NO: 13846 - DNA, 2573 bp, Heterodera glycines
gttgccacgacacaaaataggcgcggctcatcatccacattcacgacacacccgtgagtggcctgagttcaaggagaacatttacaaaaacggtcaaatgttcactgaccgttttgacatgtggatgcgtgtatggtgcagcaaaattgctgttttccaccaggagctctatgaaaagagtttcttcggaacaatccttggctcaggcgagtcaatggagttccaagggcgtggtggcccacacgcacacattgtagcccagactgacctggacgcagtcccagaagtcatccaggaatacatatgggctcatattccacctttgccagacaaagatgatgactccccaattgcacaaatgcatcgcgaagtacgagattatatgcatatgcaactgcacagatgcagtgatagttggtgcggtccacgtgaccccaactttgggcggtgtaaaaaaggcttcccagccccgtactcgaaatgtacgattctgcacccggacaggcccgcgttgtattaccggcctagcccaaccgatggtggtgccaaaattgaggtgaacggcttaatatacgacaactcacaggtcgtgccgtacaacccatacattttgctgcgttaccgagtgcactacaatgtgttattcgcttatggtaacaaagcgaacatcaaatatgcactcaaataccctttcaaagggcctggacattgttatgtcgagtgcaaagaggagtccggcagcaaaatcggtatcgatgagccggctcaatatgccaaaatgaacttccgtggtgctacggaagcttttgcagttgtgcattcaatgcaatttgcaaaactctcacatcacgttgttcagttgtccattcatttgccaaaccagcagcccgttgtatacagggccttccaactggtgagcaaagctgaggaaattcagcgaggcgagctcccagagacgccatgctctgcctattggaagcaatggcaaaacgaatggcagcatgttccttcgctcaaggacatgctttttgaaaaagtcccagagcaatttagatgggcaaaagatcgatgggtcccatataaaaggaagcctaccaagaggcccccaatcggtcgtgttgtacctgtcgctccaaaggacattgaaagatttgcactttatgtgctgatgcgtcactttcctggtgatcccgaccacttaaaactggtcaatgggcagcagtacagcaccttccaggaggctgctttacagcatggtcttcttgaagatgaccaaatttggcacaaaacgctcggcgaggcagccttgcatcgctggccggatcagatgagatggctcttcgtgagcatcctcgtttttgggcagccaagcaattccctggaactgtggaacaagtacaaagaccaaatgtacaatccgcagggcattatcagtgcggctatacgccaagcacgggagcaggaagcgctagccgacattgattggcgattgcacttctttaactcaagctgcatgcactgtggcctcccagatccaccaaattcaaaagccaaaaatatcaatttggcaattgaagaatatttctatggtgatgatggtctgaatatgccgcctggccagccaaaacaaaggccacaacaaaacaccccacctccactcaacagcgaccagcaaaaggtctttgatgctgttgtgagggcaatacagtcggacccgaaggaccagactgtgcctcgccgtttcttcattttcggcgatggaggtacaggaaaaacattcctgtttggccaaattatcaagcgcttgcgcaagcccccatacacctataaagtgcttgctacggcatccactggctgtgcggctattttgctgccatatgggaaaacagctcattccacgttccgtctcggcagagaagtctcgctagacaagcttccaagcattccgcttgaaagcttctttgcccgacggatacgtgaggcccaactcatcatcattgatgagatcaccatgcttcataacacggtgattgcggtaatcgaccgagtgtgcaaagaaatggcaattcgccagcacaaggacctcctcttcggaggaaaaacggtcatttttagcggtgacttcaaacagtcactgccggtcgtgcctcatgaaggcttaaccgctcaggtgacagcctgttttcaaacatctccgttgtttgggcagttcagcacgatgaaattgaccatcaaccagagattgggccaaggtcagcaagcgtacttgcaaatgtgccgccaaatcggcctcggagagaccggagaacacttctggattcctccgcagttcctcgtaaagagcagggaagagttgatagactttgtctattccgacttccaaaaactccttggaaatgacatggaactgctcaatcgtctgatcctcgcacctcacattgacacgtgcgatgagatcaacgaaatcatgatggcgaatgtgcctggtcaagtgcgcgaatatttgtcttcggacagccgcttgacgagcgtcactggacatcgatgaaattgagtcggaagtggcagcgttg

SEQ ID NO: 13847 - DNA, 712 bp, Heterodera glycines
catttttaatcattagggatgtccaaaatatgtacaaaaagtggtcaaaatatgtacataaatatgtaaaaaaaaatcccgaaatatgtaagaaaaacccaaaatatgtaccaaatatgtaaataaaatttttaaaattgttattttttggaaaaaaaaagtcttcggatagggtgaaataggcacaaaatgccataaaatgacctaaacaggcctagaatcacattttaatattttaaaaattagtttggttaatttttatttttcacaagaaattttataaattttcaaaaattttcaaaatatgtaataaaaatatgaaaatatgtacgaaaaatttgccgaaattttggatttttttttgagaatttccggaaatttcttaaaaagtcctcaaaatatgtaaaaagtataaaaaagtcagaaaaagtccaaaatatgttaaaatatgtataaaatcccgaaatatgtaaaatatatataaaaccccgaaatatgtaaaaatatgtaaataaaagtcccaactgacatccctagttatcattatttaattaattattttgtgattttttgtgaccaaaaatccgctccctaattatcacatccatctcaattgttcctctttttgccaaccggtgcctctggcgaaccggcccgctccccctcccaccaattgtccctctcttcctattgcccaattgatcctcccgtc

SEQ ID NO: 13848 - DNA, 1945 bp, Heterodera glycines
aacttaagtccgcgatttgcgagaaagcaaatagcaattatcagggatgccaaaaatatgcaaatgcattttttcccctggattctacgtagtctaattagtaggaaaaacatcttcttttatatatttgcgtataaaagtcgggacttttatttgcatattttggctttttctgcaaatttcatgcatattttgtttttttgtgcatgtttggtgcatattttgcgatttttgtgcatatttgttgcatatttcacgattttatttgcatatttatacgcgtatattggctatttttcgtgcatatccctggcaattatgtaaaaattataaaacaaaaaattttcaatattaaactaatattttttaaaaattatttctcagtgacgaaatgatcggccaccttatttattgtatgtaaatagttaaagcagaaagatttttgcttttgataagtttttcccaaattttaactctttttgaaaattttaacggcgccaaatacacatgccaaatttaccacgacaccatttttgggattttcgtctttaccaatccattctttagtcataaaattattaatttttctattttttttaatgtacaattcttgatcaaatttcattaattatacatatagtctatttagctatttacccaaccgcgcacaacactgttttttaggtgctggctctaagtaaattaacccctgcaaattgggtgttttcaacataaatttgccatttaaaaaaattattttctttcaaataaagttgtgacaaattttatatgttaattaaaataagccaaccagcaggcggtttttgcgaaacgaccaagcacaaaatttggacccaattgtgaaacaagcgtacttaaaaatgtccttttttcagtacaccatgaacaccaaattaatactccttctaatttttgtcctcctcaccaattctgttgcaaaaatacaagacgacgttaattctgtcgctcttatctccacattgaacccggtgctaagctttctaatgacctctaatcatcattaaaaataattacgaagtgcgaaaaacaaaaaataaaacaaatgttaagaaaatggcaaagtgcatgcaatttaattaaaccgaattttatcaaaatgtttaatctcctcctcctttttaaataatcaaaaagaataggatgagtggttgggaatttacgagatactccaaaaattggaccaaatttcccttaaatttattttaaaggctgcggccatggcagcaggaaaagcacgacaaggaggagcaacagcagaagaaagtgaagccgaaggtgcccaagcatgtgagaaaggcgaagggcgcccggtaaatgcgtcagtgaaaattttattgtcataaaaataaattcattgggttttcttggtcattgatcacgtattcggtattcatttcggccagttccaaacccggacccaaattcgaacaaaaagtcgaaagtccaaattttcgaatttggtatttttttattttaaaaaggcataaatgatctcttatggaaggatttatggcttcagtatttaaaatgattttgaatcaaaaatgctaatttcgaaaatttgaactttcggacttttgttcgaattcgagtccggggttcggaattcagaaggatgtctacttttatattacaatatttaatgctacagaaccttattttaaaatatttgtatcactggcgcattttccggtcacgaggcggaaggagaacggcggacagcaatgaagctgctgtctgtgattcgttgcttggcaatcgaatttttgataaatcaaattttgaataattgttgaaaaaaatattttatataatttttcaaattgaaggtaaattttctgagaacttcataatgaaaattgatagataaggcatgcaattatttcagagaaaaacataaaat

SEQ ID NO: 13849 - DNA, 1671 bp, Heterodera glycines
tttatgccaaaaataaatccaaataaatccaaaacgaaatttcagttttctattttttcaaaataaatacttttaattttattttctattttttcttataaaagtttttcatactatttatctattttaaagatttttagcttaaatctaacgaatttcaagaaattttgagttaccctcaattttggaaaatttaggcgctatatgaaaagttaccacttttgaaaattttttcacttttttttgaaaatttttttttgtttgtttttttaatgcagaatttctattttaccagatggtacgcatttcacgttatttaataattgaaaaaagtgaaattttggaacagcaaaattgggtcaattttcgtgaaaaaaactcaacatttttttctacacaaattttgttgcttaatatttatggggaaggtatgttttatatttttgaaattacttggggctatcgaatggtaccaaatatttcgaaagacacagatggtcaacagacaaatctcatacacactgatactgtacaaatgatacggtataattttgcctcacccggccaactcagtcccttctccccaccccaattattagtcagtttgcccacccctttctcctcccctccgttgtgactgtttgccgtgcccattgggtatggcacgtcctttgccttcggtgccatcattccgttgggttggcttcgttctgccgtttgtgccgtgtcacccatcgccaacatggccttcttccgctgacactttctcgaattttgaaaggaaatctaatgggaaaagcaaaagaacaactgaaatattcctgtgaaagaaatgaaaatattattttacaaacgaaaaaaagacatcgtaaattaattcaaaatcaaaaatcgattagaggcaattaattcacttatcaatgatcattcagacgggcaattaagaaaagtccctcccttctgttgcttctgttttatgaattcgtacacaaattgaaagaaaaaagaatttcaattcattggccattttcactttttttagcgtcgttatgaatgactcttcctttgacttttgtcgtggcaataagtgcactttttcatttgtcctcagcacataattagggggagtgcggtggggtcggactgcttctgctgctcactttggtgccatttgcacatggaatggccaagggttgtcgtgtcatggcccacccctcccctttccctctgtccatgtgtaaatcaatacaacccaacaatggtggccgattatgtacctccagggttggattgcctgatcagaaaatccagttccaatcattatcttgtcaatgatcaaccgcggtaatgagagaagaagaatgaccgttgacaaatggggggatgcttttgcatcgttcggtctctctctctctctgttcaatgattgcccttccgtcactttgtgcttttgcctccccgtgcttccgttggactttatgcccatcttttggctcggttatttgttgtcctttctcattccccccccccctccccaattctgttctttttctccattcgcatttgtcgtcgttttgctctaacgccgcttgcgtttgaaactttcttcctcaccaccgccctatccatccccgacactcactcatacataaataaataaaggagtgaata

SEQ ID NO: 13850 - DNA, 2490 bp, Heterodera glycines
  misc_feature (289)..(289): n is a, c, g, or t
taaaattatcagagtgccgaaaatcgcatgtgatctaagcctagcaaaaaatggtataagtaaaaatcgtaatacgctcaaaaagcttctcaatcaatttttagcgcttccaataccttctacaatcgcctttatacatcccattaagagcgctaaaattatcagagtgccgaaaatctcatgtgatataagcctagaaaaaatggtctaagtacaaatcgtaattgcgctcaaaaagcttctcaaacaattctagcgcaggggggaaaccggcccgggggaccgtccnccaattattcgaagggaatttaatttgatagtcatccgccaagacgactttcactgaatcactactcttggctgaccaccaccattccttcattgcttaatgctttgacttttcgccttacattgtgccgttgtgcgacttcgtcgcattgtatcgtttagacaaacacgaccatttgctctttttcaaaagacacttttgccaattttaattggaaatgtcatttcagccaaaattttaaatttcgattaaatattaaaaaagcatttgcttttgctctgaattgcattcgaatgcattgaatttgctgagaagtgcctcttctctcttctctcctcccatctttgatgttcgctttcgttatttggcgatttcacttccgttttttgccgttttttatttcttttctcaatttgctcattcctttttctgcgcaccaacgttttcaacgaactgcgaaattattagtcaaggacaacgaaggcataagaaacaacaatttgattttggtaaaagcgaacagaaacaatgaccacgcaactaaaggtaattgattggattcaaaaagatggaaaattaactttttacatagattttgaaaagattatgctggataattcctcacaaacagcggaacgcattaatagccatattaacaaacatttaacttctcatgaaaatgaagaaagtgacacttcggaggacgaagaggaggaggaggaggaccaaggggacagcgatgtcagtgaagaaaggtgggattggacatatttcaggaagggacttagggattttggaaaatgcaatttatgggttaaattcggatatttaagcctgtgaaatataggaaccctgaagatctgatcaactctgagctttctgcggttaaattgcccgactctgagcagcagcgaccggacgacgccgtgtcgattataaacagtgcattcagcaacagaaaatcgttcagctgtccaaaaactaaaagcgaccttctaaccggtataaaaattaaaatatttgtccaaaaattcattcaataaaatgacttcaaatgaaggcacttcgacggcaaatttaagtcccgaggacattggcattatcgcatcaatgggcgactcattggccaccggtgccgggctttggccgcggacggacatcgaattccgcggtgccgcctttcccattgggggtgatgcgacaattggtgggaaagaaaacaaatattgaatcattcattgttgccctaaggaagatacaaataaatataaattattagcccattaaaaaacgatttggtcaagaattggtagattttgggcaataagaaaattattttttacttaatcctgtaaaaaataataaaatttcacaaacttgccaaattaatgttcaaaatgggctgaatgataatactttttcggattgtttggctaattataaggtagttgcttcttttttaaagcttcgcttgcattatttcctaatatatttcattcataaaagatggtctcgtcaccgtccccaacattctgcgcgagttcatcgactccaatttgctcttcggagtttctcacggaatgggccaacgcgaccaattgcccgaaaaccaactgaatgtggcagtcagtggggcgagcagttcttcgatgcctggacaggtccaagttgacgacgcaccgtgttttatatggaattcttccgtgtttaggccgtcgaattggtgagacggatgaagcgacttcgggaattggatgtgttcaacacttgggctttgattattgtcaccattggaaccgaagaggtgggtaaaattagccatttttgcaaaaaaaaaaaagaattagattttcaaaaggtctgcaaaaattgcacgggtccaaatacaaaggcactcgtccaggcattggacattttgaaccgtgggattcacaaagcactggtgattttgttgggtattagtgccattcactgcaatttagacattttgaaaatgactttcaggcccaattcacgtcacttcgctgtaccaacaaaagttcaatttgctcaagtccgtttaaatattttattgtcttttttgaatttttccaaggttttttaaggacgcgttgtttatgctctcagaataaagacgacaaatttatgagtgcactgagcgaagaatgggtaaaggcatttgaggagattcagacgcacat

SEQ ID NO: 13851 - DNA, 2645 bp, Heterodera glycines
  misc_feature (12)..(12): n is a, c, g, or t
  misc_feature (48)..(48): n is a, c, g, or t
acaatttataanaagcataatttcaaagaatataaataatacaaaacnagcgaaagtatcaattaaagatgcatgttgattttgatcctctacaagtggattggtccacattctcgtccgagtgtgtgcaatttggtggatacaacatttatcgggggttgccctatcagcgtggagcgggagttggcgcagtgttcagaagtcttatgagatatttgctgccgattggaaagcaaattggctccgcaattggacgtcagggaatggaaagcggaaatcgagtactcaccaatgtgctggagggaaaagacctcagagagtctctcgttagtgagagtaaggcaggactaaagaatcttctcgaaaaagcagccaacaacataaacactcagaagggtcaaggttttgattttaagcgatacaaaaaagactcggctccaaaaattgtaaaaataaggcgaaaaaatataaataaacttcaatcgtcaatcggtccaccaatggttgatgagaccaaaaataaacgtctgcgtgttgactcattaggaacctattaaaaaatgacttgcctacaaaaaatcagcgacagcagtcctctagcaattaacagtggcctaaacattttctcagttccaccgaccaatgtgtccgttgttcgctcattctttcgtcaggtgcttccactcgcaacaatcacgcaagaatcgccttacctatttcggctttacagtgacaatttgtggactgatttatctcggatatatctttatctcgaactgtccattgaaaaaccgggagcaaacgataaatgggttgcgatagaggacgcggatactagtgtctctgccattcaagggattggtcaaacatttgtccagcaactaaaagttacggttggcaacacggaagtatacgatagcggaaacctatacccattcaaggcctatatcaccaatgagttaagctttccaataaatgccaagaaaaattttcttggttcaacagggtattatcacaccgtaaaccaagatgactcaacagacgaggggttcaaagagcgttgtaaaattttttaagggtggaaaaaatgcgcaatttttctcccgtctcgactttgatttgggaaaccaagagctttatctcttaaataatttggacttgctcttcacaatttacaaggccaaagatgtctttcttttgcaaacattaaaagcaaatgattccaccaaatatcgtttgacagttcacgatgtcaagatttatgccaaacgaatttgagtacaatgtattcagcgcaaccattcctcgacgtgtgacaatagcgttggttggcaattcagcatttcatggtgactacaaactgagtcccttcatgtttgaaccgtttgatttgcgtgagatttcggtacatgctggtggcgtagtttacccagctgttccttataaactaaatttttcaaatgatcactttgtcacagcctttgttgacatgtatgaggcactcggaatggctaactctgaacgttcatttgacatttcaatggcccagttcaaaaaagggtggaccttttttgtcattcgaatgacatccacgcttgacgacagctgtggatttgagctgttgagaagcggtacgacaaacgtacgagcaacattcaattcaccaattccgcttggtggtgtagagatgattgtcttgggtgaattcgaccaaatgattatggttgattataaccggcacattgttaccgattcaaagcttggataaattataaataaataaaaatattattatgtaatgttaaaatgaataacaccaacacaacaaaacacgacatacaaattttgaattccccagaagagcctaatgaaactcttttgcatgtactgcttttttctcattatcttcttgcatttcctgtgtttttgcttttttggttcgttttaattcggtggcttaaaagtcacggtcacctctcgcccagcgaggccgagacagtaatggaagagatgaaaaatatcccccgacacccaccaatattttttgcagcaaaatgatgcaagattagagaaaactgacactgaactctctcttcagtatgacaaaatcgataatgacttatgctgatggagcattctcaaagctactcattctttttcatcattcattttacaaaaatgtctccaaatgaatgttctgaccgtccctttcaacaacccgacaatgtacaacagccgcatcaacaaccagatgaagacgccgagttgcgcgcacaaattgaagacgcggaagaggatttgctcttgaattggtggcgtgaagatccgacaattgtaagcttgtttttcaatttagcatttttaatttcttcacgtttcagattcgttttctttttggacatggacgagcccctgccatagaagccgcgcttcttcaacgcgccgaacgtgaggcagaaattttgcgcgaatatgccgagaatcaacaacaatgagaaggggccattcagatatcatgtcgtatgttatttttcttatttttttttttttttattatgatgataagaaattttacaatgcagaactgcggaggagaatggcaataagggatggggggggggactaaaactcgcgcaccctgaccg

SEQ ID NO: 13852 - DNA, 1719 bp, Heterodera glycines
cttaccaaatcgatttcatctcaacaagtttttcctttgaacatttgaaatcgtcaattatgtgcccaaatgttcgccgccgtcaaagctttggcctaattgtttacaaaataatttataatataaattattcattatgaatttaatattttgaccttttcaccgatttcaaaaaagtttgctttccatgcctcgctgcttatctgtccgtgccaatgatggtcattccgcgtgccattcacgacgttcttgaaattttgtataattttctattgtttttctcactttttttcatttatggtcgaatttttttgattttcaaaattcatatttttcacaacatttttttattacaggaacatgtctcatcccaatgcttttcgtcattccaagtgtatcgaagcatctgatcaaacagagggagaagaaataaattaaaaattgtaatactgtaaaaattatgtacatttttatagattactgtacaaaattaactctctatgaatgcagttctgctgaataacaaaaaaatattaaatttttcagcagctaatttattaaaaactccgaaagccttcgaaattctatgaaaaaaatataacgtaaaatgataaaaatttgtttcaaaaacaaaaagttttttgagactttacaaccataatttttttttacgcaagtcccaagtttttgcatcttttttcgaggtttcaaaaaattcacgaatttccaatgaaatttattactaagataaaaaaattctatttttaatataaaaatttgcaattttttgacgttagcctttgttttaatatataaatttttaaattttgacttacatttgtttgtaccattaaaatggcattttataattggctttttaatctcatgaattaatcaaaattttgtcagatcacagcatattcattcgttagaacaacgatagcttaaacctgtaataaaatattgtgaatgttgtttctacaaattttctgtttctaaaaaatttgaataaatttctttaataatttattggactatacgaatttacaaaaataaatttacgaataaatgagaaaaatgaatgaatggacaaaaagtgaaaacgattcccactgcatttgcttaatgtttcatgctgattcatcagcacaaattaacaatttcataaataattttacataaaaatgaataattttttacagaaaaaatattgaattagaaatatatgttttttattatttaataaatatattttagttattaaatttattaatgagtaaatggtgtttaagagtcaaaagtttcctatactttaaaataaggaaatttttggaatcgtttcttatgggtgtattttttgttttattacatttttactaagaaatttctggaaaaaggccaaaataggtgctaaccctcccgtttaggtgtttttggtgctaaaaagtcgctctaaattaaaaaatgttcggataaaatgggttttttgtgcttctctcatcaagtactatccgcaaaaaaaaataggttaaaccctaaaatccaggctctactaaggaaacaatactaaattgaggagacgacggcgattctttaaaactttggggttttgagcgcttcgaacttcgccttcggctaaaaattgggcttttcatcttcggcttcaagtgctaagccgagctttgcccaaccctgcgcccaattgtttgaattctgttg

SEQ ID NO: 13853 - DNA, 1817 bp, Heterodera glycines
tttaggtgtttatggtgctaaaaagtcgctctaaattaaaaaatgttcggataaaatgtgttttttgtgctagtctcatcaagtactatccacaaaaaaaaataggttaaaacctaaaaatccaggctctactaaggaaacaatactaaattgtggagacgacggcgattctttaaaactttggggttttgagcgcttcgaacttcgccttcggctaaaaattgggcttttcatcttcggcttcaagtgctagccgagctttgcccaaccctgcgcccaattgtttgaattccgttggcgtgagcactcaaaaaggcataaatgccacaatctgtgccataatttagagttgttccccgacctcggggggggggggggggttcaggaaaaccccaggcctagaccccttggacttcaaaattttttgaaaattgttcaataattttttaagtttttttaatatttgagagaagtgaactcttttatccattaaaatggaaatgcttttcccctgctggaaatcacggtaccgtagaatggttaagcaaactaataagctgggaatgacatgggtgattggtctagtggtatgattctcgcttcgggtgcgagaggtcctgggttttggggtgccgtgatcacggaccacgggtcacggattttttcaatttttccgtgattttgatccgtgattggcattttatatagggaatttttattgaaacgaaaatatgaaattggtgggaaaagggaaaatcattgagaaataattaaataaataaattcattttcttggaaatttctacaaaaagttttaattttcctcaaaaattagctcaaaatcgtaaacttaatcattttttggaaaaggtacgccgcaaaaaaagcggattgtgtttttttgtttcttaaaaatatcttttgggaatttttccagcgattaaattccctttttttaataaatttaaataaaaaatcatttgaaaaatttttttataatcacggaaatcacggggtttttgtggtgccgtgatcacggaccacggatttccgtgattggaaattcaatcagggccagccctgcactgtacccaatatggttttcattcacttaataaaagtggcattttgtcctgtcttctgctggcttgcatttttataaattctctttgccaaaagcaaagaaatgacccaacagagaagaaaagggcatgggaagggacggcggagtcatttcgctgcccaatttgaaatgtcattatttttgcataaacaaattaccctaattagtgttctccttcatgactaatccttaaatgaccccatttcgatcagagcataaattcccccctcattaaactcatttttctcttcttatttcattcatttttcggcgctactttaaaagagtactcttttgaaattttttcaccttttttattgcctattaaatttttagtttaaaaagccgtatacctaaacattttataggggtttctggtgccgctgatcacgaattttttatattttcttcacattatttcaattgaaatttaattaaagacaaatatttcaacttaaaaattattagttgcccgaccgtccgttgcccatcaaaattcgttttaagcgccttcagattgagtaattaaaatcagagctatggcaataaaagcattcattcattccctttttgcagttacatcgatcactccgtcatcgcttttcttcgttcaaatcaccaaattttcgacaaaagaggcaccaatttagagttgtggatttattccgcacacagctcggatgaccagccgatt

SEQ ID NO: 13854 - DNA, 3461 bp, Heterodera glycines
  misc_feature (53)..(54): n is a, c, g, or t
  misc_feature (58)..(60): n is a, c, g, or t
  misc_feature (64)..(64): n is a, c, g, or t
  misc_feature (71)..(72): n is a, c, g, or t
  misc_feature (781)..(781): n is a, c, g, or t
ccattttttcggtcctttcccacactgaattacccttctaagcgagaaaattnntggnnnaagnagatagnnctcctctcccaccgaaaatattgcaaaaaatcgtctaaactggccatgtttttggaggtttttggatgcttaaaagtcgaccaattccgcttttcagcagaaatttgcatttttgggattcgttttccacaatgcattcaatttcttattgcattccccatttttcaggaatttcccccgctctctccattcattttgcgatgcatcaaagcaccgtcgcgccgtcctccgccgctgctgcgcagagtttgggctgtaaaattgagcccccaaagccaagggttgacgccacgcgggcgaccgactcggacaaactttcgacagcaaaaagttagttgtgttttttttgcccccccccccttttctgacgttgacactttttttgactttggtggaaatgtgttgaagaaatggagacagttttgtgcaaattttgaaaaattttaaaaacctaaccctaaaactttggcgagtcgcaaccatcgttttcccagaggcaatcgaattgaattattgtcggttaatagaggaatttttgaaaatgaagtcttggtccacagcatttcccccctcccccgaatgtcttgcaaaaatcggaaattggccattttggaggcataacgaccaaattttaatatcaacaaaaccaatgcaacagaaattttacatttggaatttttgcttttcacaatccatttaatttcttttnttggtgtatgtccaaaacggaaaataccaaaagtttttggttttctttacatttttttcatttacagacactgtcacatgggcgctgaagggcgagggcattgccgtggtcaaaattgacatccccgacgtgaaggtatggggaaagatgggtgcacttcattccccccccccgaaaaattttttagaaaaaattttcaaacctagaaatttttcataaaaaaattcttaggaattgtcttagtatgaaaatttcaaggaaaaaattttttgagaaatttttcagcgattttttagaaattttataatgaactaccaagttttttcaaaaagtttctaaaaaatcgctgaaaattttctcaaaaaattttttttcttgaaattttcgtactatgaaaatttctaagaatttttttatgaaaaatttctaggtttgaaaatatttttttaaaaaatttttcggggtgggggaaacggcctgcgccgtggaaagatggtgtccgtaaatgtttttttcatttattgcattcttatttgacaggaaaacacactcaacgaggctgtgtcggacgacttgcgcaagacgttcgatgcaattgagcagaactcgtcagtgcgtggcgtggtgctgatgtccggcaaaccgaacgtaaggagtgtcaaaaaaatatgggaaaatattagaaaattcggcacttgctctgatgatggctcctgaaaaactcaaattggggctttttggttttcaaaattttgttggctggaaaattgattagtattcataattagcgaccccgaaaatccctaagaaaaagtttcataactttttatgacaaacaaaattttgcaaaccgaagtggtcacccccttgattttttcggttgccacaacagcaaaaaaatttggttcatcatcttacttacctactttggtctatattttatttcggcattttatcccctcgtgggcttttgatgtgtaaacctgacaaacatttggcccatgaagatttgggattatcaccactaattgataaataagtgttggctaacaaaacaataagttttttttcctcagagtttcattgccggtgccgacattggcatgctgtcgcggtgcgcaacagcggaggcggcggcacgcatttcgcgtgatgccaaaatccattttgaacggatggaggccagcaaaaagccggtaatcttcaagaaaaaaccaaaataacgatgaaatcatttcatacaaattttccgatttttttaaactgattaaaaaaagagttacttttttttgttgcttttaggcctttggtgtattggagggataggcgacagggaaaagagaaaattttctgtctgtacagacattttttgctgtttttgttttaaaatttcaaaataccaaaacagggcttatcgcttccaaattattatttttttcccatttttcgatcgttgccgccatctccggctcgtgcatgggcggcggcttggagatggcgctggcgtgccactaccggatcgcggtcagctcgcccaagacgcaattcgcactgcccgaggtgatgctcggccttttgccgggcgccggcggcacccagcggttgcccaggctgatttcgctgcagaacgccctcgacatgatgttgaccggttggtgggcacgggacgagaacaggataaatcgtcgctgcaaaaaatagagaaaaaattcaaaaataaatttctgaaaactggattatttacagttagataccaacatgcaataaattccaatttttttatgaaaccgttttttcctgttgttttttacaccctcccattttcaggcaaagtcattcgaccggacaaagcgaagaagatgggcctggttgaccaacttgttcaggtgaacacggagttacatttaactacaatttcgcattcttatttttacaattttcacaaattcttaacaaaatcgaaaatcaacaatgattttttaaccccttttttgctagaaaaaaaatcagaaaataaaaagaaatttcttaaaacattttaaaaaagtttgtcgcttgtttatttatttttatttgttgtctaaatatggatcaatttcagccactgggcccggggctgagtgacccgatcagcggcacacatcgctacttggaagaggtgcccgcaatgagttggaaattcaaccaattataattaattggttttttcaaaaaaaaacatttaaattttaccgaatttttaaaatttttatttgaataacttttactgttttttattttgcacttcgcaggtcgccatttccgcctgtgagcagctcgcggccggcacgctgaaaatcaaccgcgagcgaccgctgatggagcgcattcagaacgtgttgctgacacgaaaaccgttgctggacgcggtattaacgattttcattaaaatttgcaaaaaccaaaaattcgaacactttcccattttccaacccctctccctcattctcacgggcatagcctttatatctgtctgtattccccgctctgttctcgtttcacaggtggtgatgcgaatggcacgggacaaagtgatgaagcaaacccatggcaattacccggcaccgttgcgcattttggacgttgtccgcaccgggctggtggacggccagcaggagggctacgaggaggagacaaaggt

SEQ ID NO: 13855 - DNA, 1427 bp, Heterodera glycines
atttagattttttttttatgtaaaaattctgttttagttgaaaattcttgattttgtattagtacgagttagcacgacacctttttattcttcaaaatgtgaggcttcctcgtttttaccttttaatagtgtgcagacatttgattccatgcataaaatggtttcaaatttgtatttttaaattattaaatgtcataaaacattgaacatgatagatattaaacctttgtaattaatgaaatatttataaatttatttattggcacttgctaaattaccgtatatgctctaattatagcccatgggggattatttttcaacctcctcagaaaaggggggataattggagactgtgggcttaatagagactgggctataattagagcatatacggtatgtaaaaaagcgcaactaaacaaggaaagtacctgaaaaaataaaattgaaaaatggcatataacaagcagataaatgttggagttgtttcaatttattaactaataatttagttcaaatttttaaaattaaatgaaacatacagcattaaaaatgcaacagtaaaatttcgatcagactccgatcctcactccttggcctcctccatttcctttttctcctcttccgtttcctttttgtcctcctccgtttcctttttgtcctcctccatttccttttcatcttcatcgtttcccaaaaattcttcccatgcgttttcccttctctctttctcttgcgcagtttcagcccttttaaacttttctttaccgtcccagtgtttagccttaaatacgtaaaatgtattttgtaatttaaatttatttggccgtcggttacctgcacaacacgcccagccacaattcgtccgtcgattgcttgaacagcggcgtcagtgtgttcgacgttgtcaaaagtgaccgtcacaactccgtccggattggtctgaaaatggaattaactttcgttttggttcgatttgatattttctgctcacatcgtaaaccgtcacttttttcaccggcccaaagcgttcgcatagtttttgagtgtccttaatcctttggcattattcctcctcaaatccaacggaaatttgcctctttaagcgtgaaaattcgctgtgcgttcgcgtcaatttcctccaaattgaacattccgcgaagtaccaaagtgcactcgcagggcggccgatagttccgcggtttttccggcttccactcgaaaatccttaaaacgttgcatttgattgatttcttttacaaattttttctttttgcgttttatcgattttttgttacttttgctgtttttcgaagaagcgctttttctgtgccccggtgagacgccttcgctttttgggtcggtcgaattcgcctttcatttcaaactttgccctctccactttggatttttgtgagcactgtcccatg

SEQ ID NO: 13856 - DNA, 974 bp, Heterodera glycines
  misc_feature (965)..(966): n is a, c, g, or t
ttacatacaaaaaacattcatattaaattatcgctgtttcaattttcctcctccgatcaaagggaagagtcgcacagacacgcggtagcagacaagtccagccggcacgggcccatagtcgcgcgaatccaccgaatttgtcgcattgtcgccgcgaacttcgatacgaccgaccaacgggtcggagggacgactgttttcatgaacagcggaaacacgttttaagacatacctgtggagggagagaactgttatgaatgttaattttttaaatttcgtattcacgccaacaaattgcttaagtagaagcacttagtttactcgggatgaatttctggcgtatgaataaggaaaatactgtggaatactgtttctcccaaaatttcccacactgactgatttgcatttgtggggtcaactaaacacacgacgtctcccgggcgtaaaccatcgtttgggtcccaaactcgagcccatagaatgtcgccattatagaaagtcggcagcatggaatcacctcaaattcaaaaatgtaggtaaatttaatcatttggcttgccttggcatcgaatgaatgcgccaatcctttggccaaagacttgtccaatgcaagcccccaaaaataaatttcctacgaatttaagtgtcattgaatttataaatctaaacaactatccgcgaaatgagctccaaaaagaaacaagatacgcatagtggaagaatggaggttcggtacgaatcagcaccgcgtcattaccatataggtaatactggagaatctgggctccacccaaaaaaaaatttttcttgtgaaataatgaacccggggttttcggttgatatgtattaaaatttgcaaaataattgactttatcatttattttgaaaatcatagattttagaaattttgaccaacatggcagggtaataaatgtagagtgtttatgttttcgattgttctatgnnatcatctc

SEQ ID NO: 13857 - DNA, 948 bp, Heterodera glycines
  misc_feature (51)..(51): n is a, c, g, or t
  misc_feature (82)..(82): n is a, c, g, or t
  misc_feature (100)..(100): n is a, c, g, or t
  misc_feature (109)..(109): n is a, c, g, or t
aggatgtcatttcgacctcgatgtgagtcgtttcggttgccgtctaatgtnaattcatccaccatttttcttcagcgtgctntggcccgttattacacgnccgatgacnccgaggcctcctacaaaaaattccaaaccgaaggtttggacagcgcacaaaacacgggcagtgaggtggatgacgaggaagggtcgggtggaaccccaaatgacaaatcaaagggtaaacagccgccgcacaaacgttcgcggcatgaggacgaatcgaaggaaagctcgaaattccctgccgaactgacgctgatcacttggaatgtggacgggacggacggacgcaatttgaacaaacgattctatgcggtgctttacataattgcaaggtgagcaaaatggtggcagggaaagtccatcgaaacactgtgaaatgcatcggacatttgacacgattagaaccaaccccgaagtgattttcctgcaagagatgactcgacctctgatgccccaactcaatgagctgatggccccgatgtacaacattgtggtctccgacgtgtacaacccggattacttctgtgtgactctcattagcaaagtgagtgtctttccttcccacactttgtctacctttttctaacatttcagaacatcaaaatcaatcactccgaagtcattcgcttccccaacactcaaatgggtcgttccatgacagtcatccaaggccaatggcaacgcctccgtctcgcgctggtcaacacccatttggaaagcactcgtgaagtcggcgaagagcgcaagacgcaattcaaattgtgtatggaaaaaattcgctcaatgtccgggaccgacagcgaagagacattggcggtattcggtctgtttttggtggtattccgttttgaaggcaactcccgtttccacaggcggtgaccttaacatccgtgacaaaga

SEQ ID NO: 13858 - DNA, 1515 bp, Heterodera glycines
aatttcacgaacaaaaacatcacaaatccgctggccatccgtggtgtatgataatggatccacaaatctaaattggtgcctcttttgtcaaaaatttggtgatttaagcgaagaaaagcgatgacggagtgatcaatataactgaaaatggaataaatgcttttattgccataactctgattttaaattactcaatccgaaggtctttaaagcgaattttgctgggcaacggacggtcctcaggccatggaaatggcacaaatctgtcatccatccgcacagataggttcggttctggtcctttgtccttgcgacgaatttcgattggtctccaaatagtcaattcacttttgccattgaaatgtttgtccaccaacgcattgaaacgtggcgaaagaagtgccaatttgaggccgagttgagcacggtcaaaagaggggaaaatgtccatccaaacgtcgttgcaaatccaactgaaatgggaaaaagtttagttaaataaatgaagaatttgtgtgacttttcaaattgcttaccgtcggttcatttttgtggcaattagcacaattttggccgagttccgaatgatgtcacacaaagagcagaataattaattgcgttagaaatttttattttttttttcaaatgcgagacaaagcgaaaaaacaaacatttttatagccatgaaaagggattgatgaatgtttttgtatctttttgtttatgtgtcatgattagggcccggatttttatgtttttacatattttttttgcggcttagttatggcgagagaagcccaaaaatagcattatctccgaacaatttttgatttagagcgacttataaaaacataaaaacacatattttggcgttttgtcacataaaatatgttagcacatattttggagtttggcacatattttgcacatattttggcatttttgagaaaaattgcaataaaaatacaagaaaattgaaaaatacaccccctaaaaatcgacttttttcctaattattaacataattttcaaattaaaaaatgttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgggccctatttattagcctacaaaatttcaaaaaatttcggtgggtttcaaaaaatttatggccaaaaatgtttagaaaagcaactttttgaaatttgcaggctaataaaggatctacagttgcgaaaatg

SEQ ID NO: 13859 - DNA, 1181 bp, Heterodera glycines
  misc_feature (1119)..(1120): n is a, c, g, or t
gttcgaatttataccttgttttttagacttagctgatgcagagctttcgagtgatacgtaatttgtcggaatttgactgttttaaagggtcagtggccccctttttcactcaatttttcgagttttaaacagggtcaaaaaccggttttttggcacatccgcacacatgggggagaggtcggctatcgaatgatactaataatgtttaatttggatgcttcttgaaaaagggtgcactaaagttgacaaaaataatttatggtcgtgtctttttttatggcctgtgaactgcaatagagccgcttttaagtactcaatctgaaggcgcttaaaaaggattttgctgggcaacggacggtcgggcaatggaaatggcacaaattcgtcatccatttgtacagacagcttcggttctggtcctttgtccttgcgaatttcgattggtctccaaattgtcaattcgcttttgccatcgaaatgtttgtccaccaatgcatcgaaacgtggcgaaagaagtgccaatttgaggccgagttgaggacggtcaaaggatgggaaaatgtccatccaaacgtcgttgcaaatccaactgaaaaaagttttgttaggtaaataaatgacgaatttgtgcttaccgtcggttcattttttggcaattagcacaatttgctgttgaatttcgaatgatgtcacacaaatatatagcagaataattaggtaattgcgttggaaactttatttttatataatgagaaacaaagcggaaaacaatcttttttaacgaaaatcactagggatgtcaatttaatgtaaatacatattttttttccttgattccccatgctctaaatagtagggaaaacactttcttttctgtgtttgcgtacaaaaatcgggacttttatttacatatttcgggattttatacatatttggtacatattttgaggattttttacgggaatttttaaaattccttaaaaaaaatcaaaaatttcggcaaatttttcatttttttacatacgtattctgagaatttttgcaaatttatagaaatttcttctgaaataaaaaaacttttttagaaaatgtactcctaaaactagcaaaaattaattnnttaaatgttaaaatgtgattctaaacctatttaggtcattttatgatgacattttgtgcct

SEQ ID NO: 13860 - DNA, 1573 bp, Heterodera glycines
  misc_feature (16)..(16): n is a, c, g, or t
cgcaaaaagcctattntggacagcaccatgaaattgttcttttcaccgacaccttttggacggcgtcgttcacgggaagcgatgtgagcgaagaggacgaaactcagacgcaacagaacggcacgagcgatgccaaaggaagcaatggacagagggaacaaagggagggggaaaaggagggaaaagaaggggaagaagaagccaacggcaaaaccaacggaagcagcaacaacaatttgttggagatggcacgatatttgaggtggggggagggagggattggcacccgaaaaatgcgtcggtggaaaagtacgaaaaagtggccattttgaaaaccaaaattagtaaagcgtaatggaactgtaggtttgtttcttccatgccaattcgtgcttaaaataacagatgacacctttcaacaattccattccattgatgctttttccgctcatttgggggggggggtgacaaatgaacacaaattgattgatcgctgtcacttgctgaaggatgagagccgatcagctgaccgaattggacgaatttcgacagcgattcgacgacacggacaacgcaatgttggcacaaacaaagcacaaaataccgccaatttcggcactttccacttcccgtcactcaccactcattcagatgggctttggtgttcctcgacctgcttggccttgttctgctggtgcccattctgtgccatttctgttgccgcgcgtccgccgccaaaacagtgagcagaagttgctgcttcgccttcagagttcgtcaatcagccgaagggcattaagctgaacaaatttttcatccgctggctcaatttcaacacaaatgctttgtttggtgctttgactttcccaatatttgaacacttccattgtttttgtgggcaatttcaaaaacagccgaacagatcactgatcaatcggagggatggaaaggaaatgccgaaattaatgtccccacaatctctcctcagttttccttttatccctcccaccacactttgttcttctccaggttcttctcgtactgctcgtcctcctctgtcttctccaacttttcctcctcctctctctgcttgacaacgcactcaaattcccttcaatcgttgacaaattattcaatttttatttggacgaagtgccgacagaaaaacgagcggaaataattgggccggcggaggaccaattttcatgcaaaataaaagtggaacacgaactgttggaacggtacggactgcaggtgggtggaagggcaaaccatggcataaacaaatgcagggcatactgtagagagctaccgtagccgagggcttttaaatgaatacgatacataaaaaatgatggaacgttttcctccatacatccaaattccgatttaggaacaatgtttgccaaagatgaaaggctgtcttctgtcgccttccatcgtcgtttttctgatcctcatcactcttttcccattcattctcactattatcacatgcttttggccgaaacatttgaacattttgggcccgttggaaaaggcccatcgaaaagtgcagcttttccaaaccgaa

SEQ ID NO: 13861 - DNA, 3176 bp, Heterodera glycines
aatgactgagaaaggcactccattgtcaattctcgcgcaaaaatgcaccgtccatctgctggtatccgttgggctgtaagtggaaagaggccatccctgaagacactgtccgaagaatgcgggacaatccctgggtttccgccagcggaatgttcgcctgcacaactgcgattcggcctaaaacggagccgattttgcaaaaaaacaaaaaaaaataccccataatttaagcttaaaacatttctgtttcatggaatatttttcctttgtctacgagtctcacaaattgtaaactttttctcatgtggggggagcgatcatataaatccgtggtttatttcctaaaacaaacccttcgcgccgtccattgaaacatccaaaattgtcgcccgtctctcactcaatgctctgacgacagtgtccgggtcgggcatttctgcatttgttgaaatgaacagaagtagacgaggaatcccaccgttccattttcacttgcccttccgcttaccggcactttccgacaaaaccaccacttcgactagcatcatcggctcgtaaagcaccaaattcgcctgctcaagtgcctttgagagacatcggctggcacaagcgttgagcaaagtcaccggaattttgtgtccactggtcgaaagagcgctgaatatgaaaaattgaaagggtttaaattgaatgttgtggaagctaatggaaatgtaaaaatacgttcggttgtcacttgccgtagtttcacgtgcaaattgaccacgggagagcccgaaattggaccgccgtgcaccgcaacggaacacccggcgttgatcgacttcaaccagtccgggtgaaataaaaggttcttcaatgcctggtccgccatttcgacgtcctcctccctgtccaaatcaatggaaacctaaaaaaaggaataaagcaacgcttatgagagaatccaagcacttttctgaattggtggaccactgtccccgtgttcacgaagggaattggctcgatttccaatttcattgtgcaccattgccttttgtcgattacattttccatatgttcagtgctaactgctcgtttctgtgggatctctttgtaattgacctaaactgcaaaatgttatgcagaaatggggcaaaagagatttttttaaaattattttcgttttttccgtttgcattttgcattacccgaagagggccaaaaaaggcgttcagatcaaattcacgcagcagtcgttctcgcatcacttcgatgtgcaattcgcccatcccctcgagaatggtctgtcccgtctcctcttcttcgatgacgcgaattgatgggtcctcaaccgctgaaacgaaaaaaaactgacaattcgggagaataaaatggactaagttgcgcaagagctgcccgaaagtcccgttcatttttcaaatttggtggttcgatggtacaagaaaacactgccggaggggagtcaatgcctaaataatctcaaattttggttaaaaacagaaacaatggaatttaaaatactcaaccttcaagtgccaaatgtttgattttcttgtgaagcccccggttgtttgaaggagcaaatgcctcaaaatcgatgtgttccgtcctctttgcgctgtgtttgacgtgagtgctgccaattcgaagtgcaaatgattacgatgagaccaattcttattggcaaaataaatcaaaattggtaccaattgacgagtgtgtcgcccgttttggtgttgtttaggccagtgattacgacaatgtttccctcctctacactatcaatcggatgaagcaaatcgctgaatggagtgaacagttggaaactggtttggtgttcacctaaagaatatttgtgaaccaatatattgattaaatttaatgataaaatttggaaaatattttgtctaatttttatgaaaaatttaaagggttttcgacttaaaaacaactcaattttcgattccttttgacagtggcatggaattgggaaaatgaaacacaaacaaaaaataaaagaactcaccggtgttcgcatttactaatgcgcggctcggctgtccgagttgcattttgcctctgtaaactcttgcgtaattcagctgacctcgttttttgtcatgtctgacctgatggtggaggacatttggcaaaattaatgagtcccttcgctcactttaaaaacgaagacacaaacgtccgcttcgtcggcgattggataaatcctctcgaggggactcggcaaaaagtccaccaccgaatccaacaacggcaccacactggcagtgaaatgcaatgccgacccgcaaagcagcggacaaaggcggcgccgcagcgtattttgacggatcactcaaagagggaaaaaacgtcaaaacaattacgataacttttgaaaaataaagtgaccttctgtcaaccgaaaaggcgtaaatgcttcggggtttgacacgaattcttgctcaaacacttcgtcaacgtcggccaaacggatttgaagctcttccatagaagcggcataaacgtcatccccacggagtattttgctaaaaatgacgattgtaaatatttggaaattgcaaaaagtcgagtgcgatttagtccattcccttttaaaattattttattgtttgtttggaaataaaattagtcaaccggaatttccatccacgtgtcgttttcttttctgttaaatacgttggcatttcgttgtgcggttcgatcgattgccaaatatttgcgcgaaagcacttaattcgaaaaataaattgaaagtgttgttggactcaccatttacaaacccatccaatttgcaatctttgttcaaaacgggcacaacaatgggcaacacttaaccaaaaataaattaaaaagggagaataattgttgggatggaagtttccatgagttaatttcatgtctaaaagtcactgccacctttggagttcagacggtcttcgatcgatgcaagtgaacggtcaaaatttgcgtttggtttgtccattttgttgacaaaaaatatggacggaagaccaaatttgcgcgcctgtcgccaaacggtcaatgtttgggcctgaaacatcacaatattttaacacaatttacaatgataattaacgacctgaacgccggcggatgcgtccaacacttaacaacataaatattatgaatag

SEQ ID NO: 13862 - DNA, 2871 bp, Heterodera glycines
cctctccctccttttgtgctttgcttttccatttttaatttgctttacctcctcccacagcctgtcgagttggtccggcccaattcggtgaacatcctctggcaaatgccccaagtcttcgtgatgactgtcggcgaaattctactgtccgtcaccggattggagttttcctactcccaggcggcgccgagcatgaaaagtgttgtccaggtgccaacaattaagcatatccgctaattagtttaattacacattttcctccaatgttattaaggccctttggctgctgaccgttttcttcggcaatatcatcgacattgtaaataaaactataattattgcagctaattaatattattatgattatgcttttattgcatattttaatatttataatatatttttacgattaaattaattttttttttaattctctaattttaaattttgggccattaataaatttattctattatttttttatacggttaatctctccgttccttttaatcaggtcatttcgcaagtccaaatctccgacccggtggaggagttcttcatctatgccgctttgatgttcgccgtcatcggtctgttcgttctgttggcgatgcgttacaaatatgtggacggtaattaatataattagacgcctactttattactgtaaacacttaatacccgtatcattgcacagtaattaattaatttattaattattcctttctcaagaacacaatttggaaattcccgactcgccggaacggagccgtcgctccagcgacgagtacagcagcagcagcagcgaccggcgcagcgacgacgaccgcttggagttgggcagaggcccccgccgcggggcttccgcccccggcactgatcgaaaaagcggacagatgagcagcgaaagaaagtggcacgggagagaaagaaacggaacggcacgaattaatgctgcggaaaaagcggcacactctttttgggccattttggttggccaaatttcagcaatttaagcaaatcccttcaaaatttgtattttttacataattcaaaattaattcctactgtattattattttatgttgtttctcttctctgtttcacgtttttgtcaaagggatgggcaaaacattctcccactgatctcatctctgttctgtcttctcccctccccctttaatttggcataattttcccctttttacatgcccaccgtaatattattgatcaccccaaccattgtataccgtaaccacataacactgttttctgtgttcatttttagtcctataaccgttggtttaaattcaaatttgttggctcagtgtgtatcataaagagtgattgaaggatatacaatagtaataattttgacatttgcaaaaaataaaaataattaaacaattgcaattactgtttaataattaataaacaaaaaatggtgaaattgggccaaaaaatgggaggagtcaatgcgaacggaactttggcaatgtcagacaatgggacgttcatgttgcattgactggtagtgctgctcacatccgtccgtggtgaccccaaacggatgtacgttggcgatttgttcgtgtccggcggctgccggaccgtccgttcggctccgatcgtaaatgatcagcacagggatggcatagcaggccacttgggccaccaggaaaatcttaaaagagtgggtgaagtgaaaatgagaagaagcatcgagattctcgcgactctgtcaattttggtatttcctacggcatattatgtttagcgtttgacccacggcacatcaattagacaaaaccaagactctcagagcatattaacagttgggaaggaaggacggtttgctttcgcaattccatccccaagatttcggcattttagttggcatttttgttatcccccagtggttattcgtatcgttatattccaatcacaatttgaagtaaatttcaattcttcacttaaagcttaattacccccgcgaaaatatagccggccgaatggccattgtccggcacgtgggaggcgaagccgaatgaaagccaaaagcccaccccgcagagcagcgtgaggacagacgaatagacaaattcctgcgattttaattaagaaggctttaattgggtggtcatcaaattgtccccacaatgacgccccaggggagaaaagcgccggaaatggtgacgccggacaagccattttcacggttcagcagaaagatcaccgtggcggtgactgagacgatcagagagcaaaggccgatgaaccaaaggacgccaatgcccggcacggcggtggaggagccgagacagatcagtatgagcacggcattgatctgggaaggagaggcatttgatggcatcacaattgggaaaaataggggagaagcgacagaaaataatgggaggggggggggagaccggcttgaacaggtcgggcttttaggagagagtgacttacggattgaatcggcttgaacaggtcgggctgctgggcaaggaacagttcctttgctgccatttttacatgttatttttaattaggacaacaataataactagagaccggacaagagggtcggtcgaacggtttcggttaaaaaccgaaaaaaaaccgaaaaactcaaaaatttctcggtcggtttttttcggttaaaaaccgaaaccgaaaatcgaaaaataccgaaaaaaaccgaccggtccgatctctaataataacagggtagccagatctgaggctttagcctcattttgtggttttttgatgggtcaatgaggctaaatctttcaaaatgaggctttcaggctttttaagtttatctgagaaccctcgcatcctaaagaatttttttacgaaaat

SEQ ID NO: 13863 - DNA, 1827 bp, Heterodera glycines
  misc_feature (811)..(811): n is a, c, g, or t
  misc_feature (1790)..(1790): n is a, c, g, or t
ataactagagaccggacaagagggtcggtctaacggtttcggttaaaaaccgaaaaaaaaccgaaaccgaaaaaaccgaaaaactcaaaaatttctcggtcggtttttttcggttaaaaaccgaaaccgaaaatcgaaaaataccgaaaaaaaccgaccggtccgatctctaataataacagggtagccagatctgaggctttagcctcattttgtggttttttgatgggtcaatgaggctaaattttcaaaatgaggctttgaggctttttgtggttttttgagaaattttgaggatttttgaggcttttggggaaaatcgtcagatcttttaaattttgtttaattttgatgtttggcaattatttaatttgaatttgcctttttaacagatcatcaaaacgaaaatctcacccaaaaattccaaaaaattttttttaatttttcataaaaatcaaattaccattttttccgaaaatccacaaaataaggaattttttaatgaaaatatgcttaaaatgtggtcaaaattcttaattttgccaaaattttcccggaggtgcctatcggcactgccccccccccttgttccccaaaagtatttggaaaaagcgacgcaaaaaaatcagcttcgatttttcatgcttagaatttcataaaatgcttatttctaataaaaaattgcccaaattgatcatggacatcacaaatgtaacatttgaatattttaaacgtgttttgaataaatttcgtaaaaatgaggctttttgaccccaaaatgaggttttttggatgccaactgaggctttgnaaaattgtaatctggctaccctgaataataatgttttgttggaagaaataaagctaaattcacaatcagaagatcaaagtgattaaaaggcaattcggattggttggcattttcacagtttaagcaacttttgttggtcaattccaatgaatttattatttttcatatattcttacacaatctttttattatttgcttaatcaatggaggagaaaaattgttgagagaatgaacgattagaaaagacggacgggacggaccgacaaaattcgccaccattttcccttatcagagggaaagggggcaccacagagcacaaaagaggaggaggagggggaacacgacacgaagtactgctaccgcccgccgctgcgtgtcacacactttttgtttacggtccgaaaatgctgtttgatcatcattcatccaacggcggaatgccatgccgtgagaagcaaaaaatgaaaaggcttcagcgaatgccatcattggattaattatttgcatttattaaatttgttaattttggtatttatttaattggaaaaacataaaactgtttttttttgttaaaatcgctactgtattatatgtagatacaaaatttagatagatttcaatacaataagtatcgttctttttgctaatcttcaaaaagaagagtaccactgaaacccactttgaatttgaagcgatacgccaaagttaaaaaaaataatgaaaaaattttgcttttaaattttcttttacctacaaacaaagtacaaacaataaaattgcataaagtgaaattcctaaccatttagatgaaattcgaattccaataaagttaggtgctgttaatctattatttaaattcatttaattgtggcttatggatgtaaacgccgaactcccgccggacttcgagtttgactcaattttaaggcccattaataatagccctttcttttcccctcattatggcagatggtatcanaatcaaatagcgggtcatctttcctctgttatacgta

SEQ ID NO: 13864 - DNA, 2241 bp, Heterodera glycines
attatgtttttatacgatttttctttttgcgtgataaaaaaattcagaaattattaattttattttggcattttgccctaattaaaaaaaatcaagaaatgaaaaatttatgtttcccttccacttttcgctaaatgtaaaatctatgactctatggttattaaagccgttttttgttgttatacatatttccttttaacttaaatctctattttgaaggtaaattttttgtcgcacacaaacttgagtaaaaatggcatttcgcgcactttctttcgcccgtcgtccgtttacaacttcgtccatttgccgtaaagaaattgacctggtcgccggtgtttatctgaacaaagttcgggaagtggttggcaaacaaaggttcgttattatgtaaaaagtgggttctaatcgacttctgggagtctaatcaatgaccgtcatcagtttctttgaccattaatcttttcttatccagtcaatgcttgcttacatttttgggcataaaacggaagcttaaagcctacggaatttgtttttttataactaaattatgggctaataacactagacaaaaagttgaaaatttggtgttttctcattgtaacttctttcttgatttcaactttttctctcttcttttatttataaattcaagagactataagctttagtttgataccaataatgtatactttgtcaaagtaaaaaaatttatggccacaaaaacaggatggttattgtttggacgtaaaaaggtagtcggagaatggacctttttttgcaaatttcaattgaaaaaggaataacctggaactgggttttttttatactgcctaggacctgcattttttacacaaaaacccaagaaaatccagccgaactgggctgacaatgaacctggaaccagaagaattctgttttggatccagacccgccgaattttggtttttggcggaaaaaaccaattgtctccacccccctcaagcgggccttgattttttttttttttgtaaattttcgaatccctttacaaaattaattgtttcatgtttcagtgagattctcaattcgcctcagttgaagaaggagttgaacgaccaactgaaccgtttggcccaaaaattccatttgccggatgccgacgcggttgccaagttgggccttcagtttaaggttcgttggtacctcggcgacttagagacaaagacttttgaacaaatcgggatcgtttactgatccctgcctttatcaaaatagtcgggatcggggtctcgatacccccccccccgacttttgtcgaatatttccaacaaatttttgcatttttgaaaaattcgttttttattggtttttacttttcatctagtaccagggtggctatattataggaaatacggtaagtgccaaattttaggttttctcgggtttggggggacgtcgacctactctcgaattaaattccctggagaattaaaattttcatttttcgaaaaaccccatcacacataaccgtatgaaaagtttccgtttttatggattttctttttttttaaagggagcaagtgttgtcagttcggtggaccaattggttgatgggggacagtcggtggatgcccagcttaatgcgcttaatgacaggtgttgtacaattttaatgaggacaaacatacaaaaaaactatcgtaattgttttgcttttagggcgccataacaacagcaaaaaaaattacaaatctttttttttcaattttcgttgaattttttgagaatttttttgagctaacatcaaaatttttgagtacttatatattttttacctaaatttttaaatcatcgcatttaatcatttaaattataaattaatttattcatccgtcatcgctttttaagtcgtgccaaatatgaagcggagcagaaggggaagagacaggctgaacaggagcggatcggcgcaatttctggtgagtattttgcatgaaattctaagcggagggatccggttttttgtcacgattgtttccatttttttttcaaaaaaaaacgcctatccatacccactctcttccgccactcccgcccacccattttccaactccaaaaaagtttgttttatgatcgaaaacaaaagattaaagcatttatttcaaaaaacgctgaaatgttaagttttttttcgaaactcgcttataaaaaatttcatcttttttattaatttcgacggaaacgataccgccggggggg

SEQ ID NO: 13865 - DNA, 1400 bp, Heterodera glycines
gaattgagattcacactgaaacatgaatcatattattttgtaaagggatttgaagatttccaaaaaaataaaaaatcacgcccctctggaggggggtggagacaattggttttttccgccaaaaaccaaaatacggcgggtctgcatccaaatcagaattcttctggttccaggttcattgtcatcccagttcggctggattttcttgggtttttgtgtaaaaaatgcaggtcctaggcagtataaaaaaaacccagttccaggttattcctttttcaattgaaatatgcaaaaaaaggtccattctctgtctacctttttacgtccaaccaataaccatcctgtttgagttgctaccgtcctggtttctcctgccccccccctcccccgtttgtccattgcatgttttgtattgtatctgaaaatcgaaaaatttggtcaagaaaggaggatgggggggggggcatcgttccccgcctaaacaaaaaacaactgactattgttgttatgtccgaagataacaaattaaataagtttatttgccgaagaaataaataaataaaaatgcagaaataaattggagaggtcaaattggtgggcacaataactgaatgaggggaatgggagggtgaagatggcgaagtggcgtggggtcatacacctaatcaataattacttccttctctaacacctcccctcttaaattcgaaacccgaaggtttaagccaaaaattttttttattttgatggcgaataaaattggcggggctttttggctcgggttgatcggcggactaccaacggggaattggctggctgaggcagattttgttgaggtggaagaggtggttttacaaccggcggtggctgctccatttgtggtgcatccttttcggcctcgtcttccaaaatatggcgtcgccttagctgatttgcgtgccgatgaacaacgcgacgcagaacaggcacataaacgatatgtgggcgaattgtgcagcctctcaacaattttcccttgtagccactccgtcttgttgttccggtaattgatcagtagaacatgatcatttggaaagaaattggtcagttttgatccatgcttccgatcaaaattttgagccattttgtcggtgtattttgactgtccctttttgaatgagttttgatcaaaattttcggctttttccccttttggatggatgagcgtcagtttggtgcgcaatttcctgccgaaaaataattggtccggtgaaaagccatccaaggcgacgtgcggagttgttctgtatgcgaacagcatcttttcgatccaatctttttcacctttcgacattttcttcattgatcgcttgaaggtgtcacagagagcgtttgacttggccattcgattgaggatgaaa

SEQ ID NO: 13866 - DNA, 1713 bp, Heterodera glycines
ttgaccaattaattattcgttcagttgccaaatgcgtggcacagtcaaggggacccttcgaatggctatcacattttggcagagaggcgacaacgttcgcgtcaatttgtctattgtattcgtacgaattgatgtttttttggtcaataaattgtttgtttttggacgaattttttgttttctctgtgattaataaattttcgacaataccgctgaagtggagttgaagctgagttatgctgatcaaaataaacaatacaagaaattagcgctcgaaaaattccggttatgttatagtctaccacccacaaaaagaatgaataaaattgatgcattcgttctctcgtgatggggcacttctaaccttttaaaatggtcaaacccggacaaatttggtataaaaaacatttctcattttatagcttatacattatttcatgagttataaaaaaaacaaattttcgcatgctcgtatctatgtttagtcggggaattttcaccccgaaccccgacttttccaaccccgacgtcggggtcgcaaccctacttagtaccattcgacagccaagcttttttcggcgctatatggattcaactttttttttggcgatttttgggcatcatggagtttactggtcccgttttttttttctttaaaaataatggaaaaatttttctagggctattttactgtgctgagcacgaatccgaccttatttttgaccgattctgaaccccgaacccggattcgaacatttaaaaaaaaaattttttttaatttttttttctttcatctatgtttgtcttgagcataaggttacgcatgtaaccgatcgtatggtctatggtagagaattgatcacaaaaaacaaatatatccatggcttaaattgttagtgagcctacggccttaagttaaaacaagtgttatcatggtatgaccaaatttctcattatgcatatgctgtttatgctcaagacaaacatagatgaaagaaaaaaactttaaaaatgtttttttttgaaaaatgttcgaatccgggttcggggttcagaatcggtcaaaaataaggtcggattcgtgctcagcacagtaaaatagccctagaaaaatttttccatgatttttaaagaaaaaaaaaacgggaccagtaaactccatgaaatgcgccgatttttttatttaaaaagtcctgaaaccaaatacccgggggttttaaaggtcgctgatcacgagccgctgacaatgggtacgaatctgaccactttttcgaccataaaaatttacaattaaaaaaaatttaatattcaaaatcaaaaagaattgacaaaaactattaatgattcactacgaataaaataaaaaaggcaaaaataaatatgcgcctgcgaatacacgtatgtcaatgtgatgagactgtgtttttcaaaaaatttttggctcaagtggacatttccaattcgtcgtccccgtcgccggcggccgaaatttgtcggtgcgctttgatgtgcgacacgccgttctcgtccttggccaagctgtagatgtactcgggacggcatgccaagtgcaaatgctcgacgagccgacgatcgtgagtgatgacaatcagttgcagcgagcggttcagctccatttcgtcctcttctctgttgccagtgcggcgactgttccgttccccctcaatcattagatgtcaaacaaaatgttcc

SEQ ID NO: 13867 - DNA, 1058 bp, Heterodera glycines
gaccatttcacgaaaatccgtcggtgtggcggacatactcagccggtcgcgctcgttggactcgcccatctccgtgattttgtccagcgtcccgttaatgctgtcccgtcgagtgtcattttgcgcaagttttgctgcaccgtcgtttccaactccttgaaaagcactgcaaaattgtttttttacactttcgccattttgcctgcttcgagcgttccatggcgcgcaattggcgttccgtctcgggcaactcgcgaccggtggcggcgatcagctgctccaactgtttgacctgctccgccttgtcgccgatgctctcccgaattgtctccatttgaatgactttttcgctggcgttcgcccgtcggtctttgaactcggccaactgaaagtgccaagaagccaattaatgccagtcaataatgcctttttcaacctggttgctgagctgtacccggcgctttaatgttccaatgtgctccatggacaggtccaatttgtcgcccgcacgttccaacagtgcgttggctttgccgacggtgccctcgtccccggcactgctggccaattccatcatgtccatgcgcaatgtgttcaggtccgtcttgaagagagtaatcagatttaggcagggtcagtaaaactgggattttctgcaattaattgtcctttggtcaattaattacctgaatgccctgcagcattttccacacgtcgtccaacagagagaagtcgctgagctgcttcaactgcgactcccacttcacaatgtccgcagtcagcttgtcaacactaaattatgccaagagaatgggacggaggacgggggagggacaccccaaaatccaatcccaaaaaacccgtaaacttttcggtaccccgccccctatccctcacatttgcgtggtttgtcccatcgttcgcatttccctctccgccgatgcgatggcttgggacagtttggcacactcctgtctcttctgtgtgctgttgtttttcagctgaacgacactgagacggagcttctcaatggcctcggccatttgtttttgctgttc

SEQ ID NO: 13868 - DNA, 2426 bp, Heterodera glycines
  misc_feature (2261)..(2261): n is a, c, g, or t
  misc_feature (2266)..(2266): n is a, c, g, or t
  misc_feature (2328)..(2328): n is a, c, g, or t
aaaatttttaggtttaaggctctaaaaataaaagctcattaaatcggcactaataactcgaaaagtagcttaacaacaaccgaaaaaaaatgttttttgtgcgtttcaggtcacgaggagctcaggaaaaaataatgaaaaccctaaaaaccttatccctaattctccattcttggttttgttcgatagctctagttgtttaattatttctgccaaaacttaaaaatttcgaatgtttcaaaaagttttagctagaaggaactcaaaaacttagccctggttttttcaacatggacaaaaaattttacctgcatactaacagaattattaatagtttaggtaggtcaattccagaatttttaattttttgtcaaagaaaaactttggtccaaaaatccgtccggcgacgtttcttcctgctccgaatttttcaacaaatatttattatataaaaatttatatatatacatatatatatttagtaatttaacaaagttcccaaaatgatttcactggccattttggtcgtcttcgccctttacgaggcaattgccgtgccactttacctgcgcctcatttacgtgatgctcaaagacacacatttcgcaggcagtccactctttcgcattgtttcaatcattggcattttggtttggcatttttttgccattaaattttcacatcatttacttaatcccatttcaggaagtgtgccatctttctggtcgttctccttttctaccgacttccgctgttcgcgccgactgctgagtttttcggccaattcactgatccccagcgggtgatcagttgggcagcgtttgccatgttcttcctccgctacctctacattttcctccatgttttagtggccattaaccgggcaaccgccatttggattcccttaaaatatgacaaggtcattagcgtggtccaaccaactggaacgaaagagaatttatttactctgtccaaaatgaaatcatccaaattttgtgcggatatttcctcaccaatgccataattttttctttctttcttggtaaaccaaaataataaacttgctaagattcggaagaatttgacaggctctattaatctccgttttatataaaagatcacaaaattatccaaaactgattcatgcgaatttggcaataacttttaagatgatatattaatttggcaggctaatagaggaattgtattgttttaattactctaattattgacaccttaaagcgggtggcgagaattggtcctgtcccatctaataaatttacacttaaattcacgaaattctcagatttggaaaaggcattggcgtcggatgatctgcttttcattcgtgatcgccttccttctcccgtttgatcgtcttttttcctccagtgtttatgcgccaatggtgaaggggatgaacggaggctttacagcggtgccaaaaaactacgatttgtatacggtacttagagacttccgagagatcgattcctctctccctccagtaataccgtaggatcgtgcaaaaatttttgtattatttttagctggatcaaaatcttttgacggcaatttcctgcggcattggcattttgttgtgtctgtgtttgaacggagcgacctttgccaaaattgcaagtttcaaacaatcactgaagggagtggccaaaatgtcaccagctcaactcaaaacagaagccaatctgttcataatggccatttggatgaccatttcattaaccattttgggcgtttttcaagtaaaaaaagtgcataaaatttcgctgccattttaaattttgaatataaatttaaaataaattaaaagataattaatttaattccgattttcagtgtttgctgtactttttgccgcgcggcagtgactccgccattttcgcaatgacctttctgatgacttttgtggaggacctcaacagcttgagtcagccatgggtgctcattttgaccaaccaaatgctgagaaaagtggcatttccatcagtttttggcggcgcagatttgatatccaacccaaacattaaaatcatcaaaatcactcgagtggcgcctgtgctggctaattctgcgagattttagaatcattgacattgtcgaattttgtttttcttaacatttttaatcttaattttttattaaacccatttttaattaactcggcagtgccggtatgtgtgaaagtgggaaaacaaatgcgttttaaattttcatttgatattttattttattttttatangcggngatttaaatccatcttttgattaatacggatatagcacggaaaaagagggcagtgaagagangagagagagctttggtgctgtatagcacagacattgatgaaaatacaaatttaattaaacaaatgccattctgtacaaggctttgcatcattttattt

SEQ ID NO: 13869 - DNA, 2577 bp, Heterodera glycines
ttttcgaatttttcccggcggcgccctccaccagccaaagatttatttaaaacatagtgcggcaaaaacgttgattcatcaacttagaaattaacctaaatttggagaatatctattagcaaattgagcctagtttttaagaaattccccagcggcgcctgtcggcaccgctggacaacaacatcttccctaatttttttttaaaaagtcgacttaaacccaaaatcagcaaaagattttcgtttccaaatcacagttatcttctgatcattaaagatgtaaattctgaatctctctgggccatatttcaattccaatcatttaaataaaaaattcattaatttttcgaaagcattttgtttctttttcttttattaattatatatatatttattttatttttttgctataacattgcttttttcaattacctatgttaaaaacaatttatatttagaaaagcggaaaaaaatgccttttaaaaatttttttttcatgtgatataatttgtttttttaatcgataatgaattcgcatttttttttcatttattttttaataaacggatatgcatataatccatcttatgattcagacggatatagcacggaaagtgaaggcatgtgaagagaggccattgttgtgaaatagacatagacattaacgaaaataaccaattctttattccttaaatttaacaaatgccattctgtgcaaggcttttcatcattttgattatatattttttaatttattttttcctcaggcgatttttcatgtgaatttccaataatatgcatattatattaatgacatatttatatgtatataaacaaaaatatatatacaaagaaaacaacattaattaaataaaatccattcaaaatattatgtttaatttctttgttttattttttctttcattgcatttttccaaaatcattggaaattcaaatgaaatgagcaaaaggtaaacaaatgaattttaacaataaaatactcaattaatttgttattttacataaaaataaattaggaaattttgtgtgaaaattttctttttaagcgcttcacggtccaattcggtcggttctgataattcggataatattatgacgacagcccaagtatatgccgaattttatccttcaaactttgtgtccgattcggtgaattaaatgaatattttttttgtatttatgaattttattcgaataatattatctaaaggctttcaacgattcacatctgtttaaaaagtcgctttccttcaacccaacaaaatcgaaaacggtaatggcataaataaataaaaattcattaattaatttgcaattttttataataatttaggagggctcggacaatgaatcgcagcaacacattcaaaaatcattttcctttaaaccgtcaaatattgggaaaacatcgagagaaagtccgaccaatttgcttgaagaatcattcaacaacaatcgaaatttaaaattaaaaaaagagatggaggagaaaaagaagattttggacgaaaagattgacaaatggttcggaagcaaaaagggaaatggcaaaaatggtgaaattaattaatataatatttaaaaattaagctaattaatgtcttttaaaagagaaatcgaattttaaatgaatgaaacaaaaccaaaaacaattcgtcggattgaatttatatatttttaatgattattaattaataacatcatcaaataacaaaatttaactaatgatcgaaatacattaatgaattttagcaggaaatgaagaaaacaaattgcgtaatattctcgttgattggtgtctgaccacttttcccaatggaaatattaaaatgtagaaagaacagaaaaacaaaaaagagataaattatcacagtgtaaatgttatatatttattttattgtctgtataaaatttattttgaaatttttattgttttcagatgaatgatctggaataccgtaatagctaacagaatacaatacttcaaactttacatcatgtaaaaaattttaaaaatcaattttattaaaactcagttaaattttgcttatatatttaatagggaaatgggaatttaagtcatatgaaattcacaaagtttgaaaaatattcagttattggtcaaatgacttgaatatccccagccttatttcgagttaggacacaaattttaagttttaatatttcgatctgcatttttatgaaaaatttaaatgattttttttttttgtaaaatataccatagaaatcgagaaataaaaaattaatttttaaataattaaagtgttattctaagtcaatttatcctttttctgacattttgttcttattctctcttttcgaagaattttctgtccaaaaaccataataaaaaaatttttttatttatatatttgggttttatgaacatatttcttacatatttcaaggctaacaataagaaaagaaacgagcgcagcgaagaaatagtgcatgagttgggtccctctcgcctcccatccccctacactttacaccccagcgaaataaactgaaaacaattctcagctatatatat

SEQ ID NO: 13870 - DNA, 3186 bp, Heterodera glycines
ccgcctcacccggtcaaaattcgtcacagggccaaaaagagaagcggggacgacactttccatcattttcgaaaaagtaaacaaaccgttttagacaaacactcatttgccagaaccaaaaacggaaaggatttatcagataaacggacattacaggaataaaccaacaaaacgcggaaagatcagaatttgaactctttgtatttctttgaggaagacgaagttttcttctgctcttgtacttttcttttgcgcttaaaaattagtaaaattaataaagaaataaataatcactgttcacattttgctttgccgaatgttccgccacctagaaatccaacaaattatgtaaatcctttgaactgctcagaattacgctttaccatgtccgagaagtcctcctcattttccattcgtatcttcgcctgctttcgaagttgttcctcgtattttcgctcgagtcctccttggtcttcgagttcctcggggttaagtgacacttccacgccttcgttaggcaccggaattttgcgctgctgaaaggaaaagccttttccagagaaggaaaacaaagaaaaacaaaacatacggcggcgatgtcgtacacgtgactggtggccatcaactgagtgcccactctgtccacctttttctctgctaatatcgtgtaaagcggcggcgcgggagtttcggggccagagagactaaagcgattgtttaaagtccaccacaaaaggtgaaacaacacctgctttcgtccatcgttcgcttctttcgcagttcaattgttgaactcggagtttccacgcctggcaccgtcgtgatgccactcggagtcacgaaactgtaaacgaaagttgtaacaaggcggaatttaccctaaaagtccaattcaatttgtttcgccgggagttattcgcctcaaggtgtgtccgaaacatcgaaatcggacggacaaggtgagtggtgacttgttgttagaaaggaaattattttcctatggtacctacttttggataaacactaaaaaagattttctggagcgaaatcttcccccccccactttgaatacgtatgccaagcgttggttacccttctgtcggcgcaggtgttacgtatccgccctccgggggtggcggtggcaatgcgccggtgccctcctcgtcgtcctcttcggcttcgctttcctcctcactctcttcctcgtcacttccaatttccccccaatggcgacgttcaatcctcgactcgtcaacgtcgtcagccacttgaggaacctgagaaatgaacaagttagggcaggggtgtatctagaaaaatttttcgggggggggggaccggacccgaagatttttttttctcttcaactgaagacctgtttttttgcaattcacggaataaaaaaatttttttttacttgctgggttaaaactgcatttttttactaaaaacaacccaattttggccgttttaaggggaaaaattgtaaaaaatagtgtaaaatgaaaaatttttgaacacttgagtgctatttgttacgaaaattgactgtaaaatcaaaaatgtacccataaaattttagttttttttggggggggggggaatcgaaaaaagtttccattatttgctagaaaattttttaaaattttcatttcgggaggggggggggagggggattttttcccccccctgatacgccttgagttagggactttatactgcaaatgtacattatcgaattcgattccgaatacttacagtcagtccaaaaacgtctccatacaaaggctttccgtattcgtcaaccggtggttttccccagcccccagctaaaaaaataatattgcaattgtaaaaaaagagcaggaaattgccgtgatatccgaaggcacacccttctgggatcggacagttgaggccttgaatcttcaaattcgggtacgaaggaggcggcccataacgctgcatcgcaatgagccacggaggcggaaatttgttggagttctaaaattcactggaatttactctcggaacaatttgttggcgggtgaccggtccaactggcattcccagtgcaattcgaagttcatccgacaaagtgcccggcttcttttctcgcatttgcgcttccaattccttcccctcgtagtaaagttcgcccatcttcgtcatctgtggttttgtctgccatttgaagaaggcgtcgtgaagtttctgatagtcaatgtcgattctgcccagttttggccgggttcgttcgcgcattttgtttttcagcgattggtgctcctccttttcccacattgtctcacgcatctccattatccccgtcctcttaataaactccggcaattcaaatggtggtcgctcaaatcctcttttgccggccaaatatttcctttttgcgttccaatggcgtgggaccatgactgtgtttcgataggacttaagctcgacgagaagaaatgggtcacgggaggtcacatcggcccattcgacgacgtcggcccgaggtgtgctcttgaaaaccataaaaaagcattaataaagcattgtgactttttcgcgttaccgcctttaggtcggccatcgatggttgtagcgccagacgcaacttcttacgactcattttatgcgcctcacctgcctcttcagcttctttctaaaatgaaaattaggacaaaacgacgcgaggactcttcacccgtctctggttcaactcctcctgaagaatttgttcggaaatcgcagctttgctgagagtatcctcggggatttcggtccgaacttgtcggaattgttcttctcgctttaattcctcttctgtttttatctgcaaaagtatttgggtgtattcgttcctagtatttttttccttgccttgaatgcatcgaaaatcctcgaaaagtaagaaaagttcgggtccatctggtcgagctcgggcccttccccaacatattcaatttcgaccaaaagatcgtcgccagcagtgcccttctgcttctttccctcctcccctttttgagcctttttttccttcgtctccgtttcattgctttctttgaccacttccgaaacgtccttttcctcctccgtttcatttgtccctccttccgcttcaaatccactatcaatttcattcaccgcttcagacatttcgactttttcttcaccccatgtgatgat

SEQ ID NO: 13871 - DNA, 979 bp, Heterodera glycines
  misc_feature (930)..(930): n is a, c, g, or t
tttcatgcattcgaggggcatctgggtggataaagattaaatttttatttagtgtgcaaagaaatggagatagaccttttgtcaagctttattaagttataacaaatgtcatttatgttttctttttatatttgaaaaccaaatgctaatacattattttaatctttattttaaccgtacaaaattctaatatcggcaaaataattggagctgaattctgtgagcctttattcagagagccttttgaaaggccaacctttttcaaataaacacatcttagtagaagtacacagttcattatttcgaaattgaacagtaaatttggggagttgaaaattcttttcttgctacattttgaatcattttttatccggtgacagcttataatattccttattttcatgcattcgagggcatctgggtggataaagattaaattttatttagtgtgcaagaaatggagatagaccttttgtcaagctttattaagttataacaaatgtcatttatgttttctttttatatttgaaaaccaaatgctaatacattattttaatctttattttaaccgtacaaaattctaatatcggcaaaataattggagctgaattctgtgagcctttattcagagagccttttgaaaggccaacctttttcaaataaacacatcttagtagaaatacacagttcattatttcgaaattgaacagtaaatttggggagttgaaaattcttttcttgcaacattttgaatcattttttatccggtgacagtttataatattccttattttcatgcattcgagggcatctgggtggataaagattaaattttatttagtgtgcaagaaatggagatagaccttttgtcaagctttattaagttataacaaatgtcatttatgttttctttttatatttgaaaaccanaatgctaatacattattttaatctttattttaaccgtacaaaattctaa

SEQ ID NO: 13872 - DNA, 1214 bp, Heterodera glycines
ctaaagaaacgatgaacagtgtaaaagttggattgaattgaaaaaaattgatgttaaacctccttcacatccatcgctttgagcaattcgcgctccgcctgcgagaactgctcaccgtcccgtaacgcatgtttgctgcctttcagtgtctcggccacgcgcagttccaactcagtccggggctaaaatccattttgagatttattgataaaaatcttccagaaaaaaaaacaaacaaaatttaccgtgtgcgttttggcacgctcttccgctgtcaaagtgcgcagcggatcatcacgacgttcgtcgtgcggaaattgaagttgttcagcgacacgaaggccctccacaattgggtcccatggttgcaattcttctctataataataggcaggtaactaatagaacttggacattgtttaaattagttcctatacaaatcaaaataaggacagtgactctcgagttataaagaaatttgtatttcttgatagttaaaaatgaggccccaatgaaccccttcaaaaagagatacacattggctgaatttttcttcacaattgggaaaacagtctttacaaatgaaccatttggcaaaatgttcatccgtttttcccaccccaatatttgcccacttcgtctgtcgataggccagccgactttcgatgcgaatcgtcgcctgtctgtgcagcggtgcggccagcactttgttgtcgcgccgttcactctgctgcgcctccagcgccgcctccaactcggcttccgcctccgtccgcttcgtcacccggcggggcgtcgctgtgcgctttttctgctgctgtgccaccgccgtctttttcctccgattgcggtccaattgctcctttacggcattcacattccttaattttggacggtgaattaaaaacggggagttcaaataaaacacaagttggacccaatttcgaatttgtccaaacccaattcccatgtttcagtaacggaaacagaaaactaagatttgtgtggtaaaatgctacctcgttgatttgatgttgaccaacagttcgtcgacgcccacccgttcatcgtcgctcattttgccaaatactttaaggaataaattgcaaaatgcagtaaatttaggttgtcaaataataaaaataaatgtcatgatttgcaaaattaacaaattattgtctacgcatttggcaaagttaacaactttaatctca

SEQ ID NO: 13873 - DNA, 1408 bp, Heterodera glycines
ttttttggaaagatagtgcaaattttgtgtccgtatttcgcttacattgtcacgttggtccaaacctgcccgaactccatgctcctctttcagcattttgacaagtgcttctgacttttcaatcagttcgacccgcttttcatccgacaatttaacggtaattccgacggggataacaacgacctgaaaagcaaattagtaagatttgaagtcgttttgaaagagtctccaaaatgaacaaatccctgcctgaatgtccgcaacgcgtggtggcaacaccaacccggtgtcgtccccgtggatcatcaccatggcaccgatggttcgcgtggaaagaccccaactgttttggtggacgaactccacttgccctttgacgagtgagtcaaattcgatgttgaacattttggagaagttttggcccaaatggtgcgaagtcccgccctgaaaattgcagaattgtcgaaaaaactgaactggaaaaccaaggaaacacctataaatagactatttggttcaatgaattcgctaatttttttgtaaagtttgtaacaaaatgccgactctctttccacctgaatgcctcggccattgaccggcacatacgcctcaaccgtcgtggtaaaatctgcgccagcaaatttctccttttcagatttgcgccctttcaccaccggaatggccaataaatccgtgtagacgcgagcatacaaattcagaatgtcgtacacttcctcctcagcctcctcttttgtcgcgtaggctgtgtgtccttaattttgaggaaaaagaattgtcttacactttatttcatgatgcttttgaaaccaccttcctgccacaaaaattcccgggtccgcaaaaatggagtcggatgtttgaattcccatcgcttaaatggaaaagaataatttgcattttttatgggaaaataaagcaaatcttaccacaacattgcaccattggttgattttgataggcaaatccctgtgtgatttgcaccatttggcaaaggttgggtacatcaccgtttcactggtcggccgaatggcaattggaacggccaagtcggagtttccggccttggtcacccaagcaaccttaaaaattcgttttataaaaattcaaattctcctccccatttttaagttaacctccggggcaaagtcggccacgtgcgttttttcgcgttcgagcgcagcagcggagacgaacatgggaaagtaacagttcttgacgcccagctttttgatttcagcgtcgaagaatgcttggatgtgttcccacacggaatacgcccagggacggatgacgtagcagccggacacgtcgtaatactcaataagttctgccttgacgatcacctggaaagcgcagcgaagtgtttctttctatgtcaacagtcaca

SEQ ID NO: 13874 - DNA, 1261 bp, Heterodera glycines
taaaaaccaaaactgtttgaaaaaaaattaattatttgcttagaaacatcaaaaatttatcgataaagataaagaaaaaaaaaaaaattgccatcagaagggcgggaaccacttactctgatgactgatcacagtaaaatagtcacagagtaagtgaataaatatcaagtgagatcacaggttaaagataaacaataacgaaaaatttatatgaaaataaaatcgaggtcaaagtcaataaaatgcctcaaaagttaataattctttatacacacagcggcccaattttgggctccaagtacaaataagtttattatttatttagtaatcagaacgccaaaactttgcaaaacttaaaatttattggggattttcccttgtaaaaatggaagagccgatctcgagttaaaaacataacttcgaaaaaataaacagggattcgatagagggggtcaaaatatgggcctatgcaaaattttaagaaaattggtcaataggaaaatttttttttcaaggacaacaaaatcaaatttatttgcaacatttttagcataaagatggtatctacacgtaataaaactggaaaatttatgaagctaagcaattctgggactgaagcaagacgaaagcggaaggaatggcgccgggagcatgcaaaaaaagctggatcaacaccaaaaagtgacgaaaattgaacaaatttattttattttaaaaacactgcatttttcaggactaaagcagaccgaaaccgtgccaacagcagatggagaggggacatcgacccaagctgccgaaagtggaccatcaacgtcagcttttgaccttcgagcggcgaccatggccagagttgtacgaagattaccgtctcattcagccaggctgctcggtcaaattctccatcaaacaatttcgtttgtgccgttttccctactaaggatagccgcgaaaacttggagcgctatggaagcacactttgggaacaaattgacggaataggcacattggcgggcaaacgagtcaagtggtaaattttaaaatttattttttccatttttctgaattcaaaaggtttatgggcggagacgtcagttttatttggtcaatgatcgggcattgtggttctgcagtgacaacatttccgtctccaatttgcagttgcagaagtgatcatttggtgcaggaaggcaaaatttgtgaactccggacaattgatcaaaatgggcagttcgcggagcaattcaccagagccatggtgaat

SEQ ID NO: 13875 - DNA, 3783 bp, Heterodera glycines
  misc_feature (3746)..(3746): n is a, c, g, or t
tgggaaattttaaaaaaagtttaaaaaaatgttaaatttttttttcttgtaaacttataaatttttctaatttttgcgaatatccacaaaattaccatttttggtgaaaatctatcaaaaattaatcaataaaaaaaaaaaattcgcggcaaacgcttgcaaaaaaaggtagaacagtcacaattaagatttgcggttcaaaaatgatgcgaaacgcgctgctatacgcgtatacaaaaaacctcgcccgcgattggcggtttgctatgaagttagtcaaaaaccatcatttgactaacgtcccaacactttcgcttcacaacacttcgcccccgcccggcagcacatacgtaaagtgccgtttccttgatcactttgaaggcaaacagaacgtcctgttcgttggcgtcctctttgttcacacaaaaacggatggtcgtacgattgtccggtgcagcggcgatcacgtgaatgtgactactgagtctcaattctttcaacaagttttcgttcacctcttccgaaccatcctgtgcaaaatggaaggaaaacaatttaaaatagagcagggcacggggttttgcggaatccaagtccgattttttttttttggagaaaatgcgtgatttgtgggattaatcccgcgggatccggtcctgcaaaaaattttgagttctaattgcagcgggatccgcaattagttgcacaaattgaaatcactgtaattcattaatttaaattaaatgtatgcaaaaacccctcttcccaaatatatgttaaaaactttaatagaaaatgcttaaaacttcaattgaatatcaaacagaaaaatgattttaaggcgcttttccgcaataaaatctattaaaaaaatacatattttcaatttgataaaattatcgctttaaatttcaaagttaaacaaaaaattgcggaaaaaaatttcactaatctgaacccatgtaaaatgtataaataaagaggaacttgtaagcaatatttttagaaacaaaaattctttgcaataattaaatgtcatttaaaaaaaaactaatttacattcagcagagaagaaggataattataaaatttgagcagatcattgacacataagaattagaattggttttgtgaaatattctacatttttgaggttctacggtgccgttagtcgcctaagaaaaaaatggcccaatttcttaacacattttgcagcaaaaaataaataaaatattttttgaatttttggaataaacttttgaaaaatgcttagaaaagtgaaactgacaaaatgccagcaaaaaaaaacaatgaaaattctgcgttatttaaccccagattattttattcgtataattcagaaacggaggtaatttaattttctcaccttaatccgaaaacagaccaatgccatgatcacatcgccaacaatttcgaaagtcgggtcagcagacatcaatgatacaaaatatttggccaatcgcacatgctcgcggatgtaccgttggagaccctaaaatgcaaaaaataaaataacgaggacaaacaatattttggaatttaaatccgctcttcaaaaatgttaaaaattttgaatgttccgtagaccaataattctgtctaattgattaagaaaggcttttgattttttttgagttaccgtatttcttcgattatagcccccgggggctctattgttcaacccccctcaaaaggggggctttattcgagaggggggttctaatcgaggggggggatataatcgaagaaatacggtaaccgaaaattcagattttataagaaaaacaaaaagaaaaatttgacacaatctataaataaaataataattgaaaagattttttgaaagaatttcattttaaattaatttgttaaataaattccataattaaaaatactaaccaaataatttttagcattttgagtttttccattttttagggtccacatatttatgttatatttaatattttatcaatacaaattgcataatttggtaattagttaacttccaaaaaaaaagatttattaaataattaaaaattttgtgattccatttaaattcccttaattcggcattcttccccttttcgtctttactatattggataaaaattgcttcgttttaactaattgccacaattaataaattaacttttaaatcattgccccaaatggccacttcgttgtttgtcaagcgaatgatggctaacgcgtgctgttttggccttttgctgctctacgtgatgttcggtgggcttctgctgctgcgttttgagcgtggccaatcggagcgggcgaaagacgaattaatacggcgcaaaacggaatgcattcggcactttttgcgctaccaaaggcacttttttaataaaattaaattagcatttgcaatttttattgcaataaatattgtcttaaagtcaaagaagctgcttgctgggtagtttcttaaattagccacgggatataaaaaatagaaaaaagaaataattaaattggcttaaatttcagcgatggcattttcaatggccaagacagaagtaacgaatcagcagcaaaagcgccgactctcatctcagcagcggaacgtatcactgagcattgtctgttcggaatcgtcgacccggcggagggccggcggcgccaaacatggaacttccgaaatgccatcctctacggctttggcattctgacaacactcggtgagtgcgaaactggcgaatctgcggttaacacggcgaattgttcgtaattaaatttaaaaaaaaaacaaaaattaaattcaatttgatttttaaaatatccttcagtggataaatgtagaatatgagaatgccaaaacttatcggtcatcaagtaaattagataaaaatggccttattaagagagaatttgtgccaaaggagggaggcacaatttgagataaaattaattcaaatattaattattctccttaaaaatattggccatttatttgctcgacagacaaaaaataaacaataaaacattttattctcctttaatcacaacacgtaagtaaattttcaaaaaaatatacaaaaaaggaataattaaaataaaaataaagcatttaaaattcgcgcgcaaaaaaacgcttggccaagcccattgattagtcattcattccctcgggaggcgccgcttcgggcgattctttgcgccggcggaaggacgaagaagtgctggcgcggtgctgctgcggttgggaggacgaagtgctcggccggtggtgctgctgaatcggcgcctcgcctccgtcgaacatttttttcagctgactgaccggcttctgaacagcggacactcagtttggcacgttaaatttgagaatggcattttaagaatttatttcgaaatttttaacccaaaaaaatgaaggctgatatttttaggtaatggcgaaaaattcaaaaatatttttactaaataccagcaaaaattgcgaacggtggcgaaaaagggcaaaaaagtgatatgaaatttaaaaaagtgtgctttatatggaataaattaaacatgaaagcttgaattttcttttgactttttgaattccccgcggtgtcttttcaccctttttattttaattgcatttgttttacaaaaaagacttaatagtgattagcaaggcgccaaaatagtgacgtaattaacagttattacattttttcaatttaattattcccgttcattaaggtttttttggngtatcctaagcatatttttattataaagtttctgtat

SEQ ID NO: 13876 - DNA, 1778 bp, Heterodera glycines
  misc_feature (1754)..(1755): n is a, c, g, or t
gatcactcaattgcaaattcaataactcactataacactgccaaattaaagtgatcactcaattgcaaattcaataattcactttaactttgccaaattaaagtgatcactcaattgccaattcaataattcactataattctgtcaaattaaagtgatcacttaattgccaattcaataattcactataattatgtcaaattgaagtaatacacccaaattgccaattcaataattcactataattatgtcaaattgaagtaatacacccaaattgccaattcaataattcactagatcactcaattgcaaattcaataactcactataacactgccaaattaaagtgatcactcaattgccaattcaataattcactataattctgtcaaattaaagtgatcacttaattgccaattcaataattgacaaaaattttgccaaagtgatcacgcaattgccaattcaataattgacaaaaattttgccaaagtgatcacgcaattgccaattcaataattcactataattatgtcaaattgaagtaatacacccaaattgccaattcaataactcactataacactgccccataaaatgggcccctgatagtgatgaatcaacagattccacatttattcattccttactactttatcctattccttcaaatttcctacaatgaagaagcattttggcttttcactgttctccgttggtatttcggctgtgctaattataatgcttatgctgataacgatcctgccgccatctattgctgatgattatttggaaatttttgcaaagccgcctattgccgatgccaaccctaaaagcgttaggctgaagaaaacggattctgtggaaactttgaaaaaggaaataggaaaaaaacttggcattactccaagaacactgacacataacagcccatatgcccttcaacttgatgacaaaaaaacaatgcaagattatagcattgaagaaggtgatatcatttattatttcttgtatggtgtgattaaaattccggagggtgaatttgaagtgttcgtgaaaaacggagagaaaaaatacagtattaaggtgaagatcactgatactgtggaaattttgaagaaaaaggtccaaaaagcgactgacattccggcagaaaatcaaacatttgcgcactacccagtacgtggccgtgtgcttgatgaagacaataaaacaatgcaagattacggaattttggaagaggcaactgttcaaatggtgttcccatttgaaattgccgtgtgctgtgctggcaaaacgtacagcgttaaagtgaaagaaacggatactgttgtaacagtgaaggaaaagatcgaaacaattattggcattccgcccaaacgacaattgatgagcaagcaacagagtgatgtgcttgatgacaaaaaaacaatggcttattatggcattgtaaaaggcaaaactgtcgatgtgtgctgggatcaatttgaaatttacgtgcaaaatggagatgaagttatcacagttaatgtgcaggccatcgacactgtggcaactgtgaaggagaagattcaaaaaaagactggcattctaacagaaaaacaaacactgagacccaagcattcgcgtgcactgagcaaagacaactaccgatatggtgagataaatccgaatgctattcttgcgcttggtgagaacacaaaacaatgaaagattatggcattggaaaaggcgcaaccctttttattggaatnngcatttgaattttcgtcaaattt

SEQ ID NO: 13877 - DNA, 957 bp, Heterodera glycines
  misc_feature (58)..(58): n is a, c, g, or t
ggacaactgagtacaactgagtaccgaggtcccggtttgaccgggaccagtcccgggngttttcccggttttcccagccaaaaattcccggtttttcaacccgaataggtcccggtcccggttaagcccaaaattcccggtcccgctctactctagataagacccataaaagaaagggcggatgtgcctcggtagctcaattgtagagctgcccacggaaaaggtacacgagtggattcggttcccagtgggaacttcccacccgaggcccaacattttgcccatttcttattgtagggttaagccccaaccttcggggagagaaaagtcaaggaaggggagaggtattttgtcggggatggctgaagaatttaaagagtcgttccgtgctgacgcgtttcgtaaaaaaggccacccgggccaatgggttcgaaacaaaaaataagtaacacataaaaattcataacttagctcaaattcaaccaaattaatatttcatggtatcattcaatagatttaattgatctctatctgaaaataatttacaaatttttttacttaagtatgagaaaagttataaagcattgaaaatgctatgttttttgcaatggtcatgcatatataattataaacacttagtgttttaagtctacaaaatgcaatttagccaaaattattttatatattcgatagccctaagaattctctatttaatttcagaaaatttcattgagtttcaaaaaattctgtacaaaaaattctgactaatgattttcgaaattttgtgataataacttttctcatacttaagtaaaaaaatttgtaaattattttcagatagagatcaattaaatctattgaatgataccatgaaatattaatttggttgaatttgagctaagttatgaatttttatgtgttacttattttttgtttcgaacccattggcccttttac

SEQ ID NO: 13878 - DNA, 2797 bp, Heterodera glycines
ctgctgagcaatgacgcattataaaatttattttaaaaaattaataaaaaatgatatatggaaaattggaaacaattcgcaagaaaagcaagaattcggactggggctaataaggggaaaacttttaggaaaaaaatcacttggatttcgtgaaaaaatattctgaaaaatgttaagccaataggaaaatcaaaaaaaaatgaataaaaatattttttatttaaatattttaattatttttaaaaatgctatattcgtggtatatcagcagcggtgagtaattcgataaaatgaaccatggtgtcaattgttcgcaacagttcaaaagaaatactgaaatgccgtgccattcacagacctttcgttttggcactcaaaaatgaaaagtcaaaattggtaaatgtgcccggtcgattgaaaaaatttctttttaataaattgaagtaaatcttatccaaccaaatattagttttcaattattttctcacgcatgagtgaataatttttttgttaaagcttcacatactgttcagcattttgcttttcacactaaactcattggttggacggactaataattgtacttttaaaatttcaattgtttattgcaattttaaattactgcgcatggactcttacatgatcaagcaagaaaaagcacactgattaaatagcccccaatgtttacagtgatgatcaaacaaagtgctcgaaaagcgcgattgttaatcgaattggcctaggccaaacctcaattaggggtaattaatgatgttattaaaccttaatcaccagtgctgatttaaattttatcaccattccaacaagcaaatagataattaaaaagtcattatgattaccaaaaaacatataataaaacggaagattgacagaagctaaaattagcgtgaaagtttccatcattaagccccttaaaactgttaaagcagccatagaacgcagaaataattgtaacaattgccaaatacaaacgaattttgaatttattatgcctataaatattaattgaattaattctttaaggataattacagtacactttcaccaaaaactaatacgatcagtcggtcaataccggtgaaaaacatcgaagttaaatttgaaactgtgaaataatttaaaatgagatataaacgaacaaaaaatggtcaaattggtaagaatttcaaaaaataacaaagtgtcaaaaggtaattaacggtgccattgagtgaacctaaaataattaatattaaatcattaaaaatatatttaattaaataaaatataataataattacaaattaatatgctaattaccgttcaattgtttatatcagccataatgactagggcggagaattatatggaaatccgtattttttcctggactgtgggaggcctgaaacacacgaaaaacatgtttttagcttgattagaagcttccaggatggatttctatatccacatttgtacatattttgcatttttctaaaaaacctctattaaaacggcccccggcagctaaattggcctttttgagcccaaaaacaggaaaattttccaaaaaaatcatttttcgccaaattttctcgagaatactgaataaatttaaattttcttaaaaattaataaatttatgtcaaaattaaacaaaaatacaaaaattttgcttttcctgttgattttttgcttaaaattaataaattttagctttaatattctaaaatgatttttaataccacattagccatttttatatgtattttaataaaatttaattaatttgaagaaaatttggaagatttacccatcaatttggaaaatttatgtccatatttttgccattttatgtccatatttcgcgattttttgtccatatccaaaaccaaaagtgtcgaatggcaacacatttaagactgagcctatggcaactatggcgtgataaaaatatgataaattgtcgtcatttcatttagtcaaaaaagccatcaaatggaaaaattttgagagaaaataattcaaaatttcgcccaaaatgagcaaaatttaaaaatcttgattcattttaaaaaatgccaaaatttaattgaaaacctataaaatctttgtaaaaaaagaacaatttaaaaaaagtcaaatatttatggaaatattgaattacaaaactaaaataaaaaattaactgctcataacattaacaaaaattattcagaggcttaagcttgtaataaaaatttatcaatttgaaaaattgcccatttcagaaggtaagtttttgctaaataatttttttttgttgatttaataaaaatattttgtaatttataaacaatggaatcgcgatttcaaattcagcttcaaaaatcaattcattcaaattaacaattactgcttatcaaaaacaacaaaatatcaagaaatttgattgaaataagccatagaaaaaactgtaaacaattaaaaaacaacaaaaaaatttttttgaacaattaacaacatcgaataattagagagtatcatcttatccaattaatgatcattttcatttccgaattaaattgtagaaaatatttacttcttgtccttcataaattaaaatttttgagtaagatacacaacgttgctgcttcaaatttgcaaatcgtttttgcttaaattatcaactataattttttggtgcattttaaaaatgcatttcaaataggtgaaattttttaaatgttgtctaataattaattaaaacattaatttatttaaaatatacaaagaattgcaattttttaagactctataa

SEQ ID NO: 13879 - DNA, 2209 bp, Heterodera glycines
atcagtaacctcgaaaacgcactgactcgtttttatgtcataagattttcatcgacgcatttccaggagcgcccccgtaagatcattaaatgcgtaaatttagcttcaaaattatccaccttcttgtatttccgcaaaaaaaagtgtttgtttttttatctaaaatatttttagttttccactaattttgcaaaatttatcgtcataatttatataaaaaaccctatataaattattttaattgtccatcatcataccaagaatgatgcccatagaaaattttttttcttccataaatatttccatttatatatttttttacttttgatgcattttttcataattaaaccaaccaaccggtggaaaatcatatttcaatttaatttgatagccccataagtcatcaccatcatcttcatcatcattatccggctttggcacaatttcccatttaaacgctttcaccgtaacaagaaaattggtgcaaataaacagtttgaaattaaaacaaatttgttcaacactcttcgccgcgtctgctgtgatgaatgtgtgcgctttaattttttgtccatcattttgcataacgctactgtactggagtttttcggctacggtaccgctatggccaacgaggcaccgtacacgcacatcgtaactgaacaaatgcatgaatatgtaagtgatggatttttttaggtgcacaaaattgacaaaaagaaaatcgagaagaattgttttggaaaatgaaaattttccaaccctttccaaaaaaaaatatctgaatttggcatgttttatggtgctaggttgtttcgtaaaatcccccattttagcgatttttttcgacaaaacatggtataactttgcttataggcaatgaaattttacattctcggtaccattcgatagccaagctttttctctattagcctggcaaaacttcaaataaaattatccaatttaacatacgttatggcagaagtagtacttattttcatagaactttttctaaaatttatcaattaaattttgaatggtaatagagaaaaagcttggctatcgaatggcaccaagaatgtaaaatttgataatttatgccatgttttgtcaaaaaatctttaaaatggcggattttacgaaacgaccagcacgatttttatgtatggttgttttttaataaatcaattacttttaggtaaaaataatcgttccaccagcagtgattttgtctccagcctctgtttcttgtcagttaaaaatttcaaaaacttgttaaatttatgaaaaaacatttttggggggttataaaacataaatgcaaaaaaataaatattatatataatagaagtgaaaatttttatgatcacctaaagaacggatgttcaatcaaacttggcgaaatttggagtgataatttgctgccttcacaatttgctttatttaaaataaatgaaaatagaaaatttaagacaaagcttttgcaaatttttcccatcaaaatttgaagggctgctgaaaaaattaaaaaaaattttttttttttttatattataatacatagagatttatgtgcatataattttatattatataaatatcgtttttttatgaaaatttcatgcataatagataaaaggcatattcaaaaaatcgttacattgattattattttatgattatattatatttttttcgtcaaattttttcatgtttactatatttttggtgagcagacaagcgactcggaaaagctcggcatgatgtaatattgcgtactgggaatgacaatttaattattttaaaacgatgacttttcgcgtttattttgtgtttaaatttcatattcgtttttgaggttttttgttcgtctttagttactttttgatattctccgattttctcttttttctccgtgttttaaaaataaattgttcttcaaatcgccttaatttgttctgatcaacaaagtgtttgtcatcagacgactttttgactacgagctgctgccaatttgtaaggcaacaattctcttcgtcttctctccgcttctcttcaactccgttaaatcttgactaagcattcaatcttgtccccgtaattgtgtttctgagttttaattacctgaccaccccatttccttccccaaccgtccaaaatacagtcagtcccaccccttttactatcccgcacccggagaggtacgact

SEQ ID NO: 13880 - DNA, 2008 bp, Heterodera glycines
tccagtttttttaaatttataattttaagttcaaattttttgtgttaaaatttcaaggaaaaaaaattctgataattttctagcgggttttttgaaaaacgcactgtgccgtccgaagcctcgctcatgcagtgccacaggtcgtcagtgtccgcgttggcgtattggtgcttcttcagataggcgcgcagtgccttttggaaggtggactcgcccaagtagttgaacaacatgcgcagcaccgagcaggacttctcgtaggtgacctcgtcgtaaatctcgtcaagttcgttcggattttcgatgggcacctttcaataaaaaagggcaaaaattaattggaaaaaaaaattttttttttttaagtcattttaggtggccgcattttccgaattggcaaatttctctgtttgtatacaaaattatttggaaaacaagttttttcaggttcgtaacaacaaaaaaaaaatttttttttgaaaatttacctcgattgggtgcgaattgcgcaatgaatccatgcccatggctcggaccaccgtgttgtccacaaaggtggaccacactttgaactcggggtattttttggcggtgaacagagactccatgaagcaggcgaagccctccttcagccaaaggtcctgccaccacttctgaacacgacgaaaaatagattattttattatatacaataattagatatgatgtacaacaacaaaatgaaaattaaaaaaaaaatttttaccaatttttgacaaaatttttttgatgaattgtcaaaaattgaccataaaaaaaattaaacttttttttcttgaaatttacttataaaaatttcagcaggggtgagttgagggagcaaaaatgcaaaaaaaactcaaataaaaaataaattcattcaatgttactccttaagagatttcaagaaatatttccaataaattaaagcattctcaaaaaatttaaaaatatttttaaacaatttggttcaattcggacaattattaaaggagttatatcccaaaaaatctcggattgtcgcccatttgtccccttttttcgagaaaaattctctccccccccccaacggattgactgactgaccattgtcacgaggttaccgaaccaaaagtgggccacttcgtgcgacatcactgtggtcagccactgtctgtgggaggaggaactctttgccgggtcgtacagaacgctgctctcccgcgcggtgatcagaccccaattttccatggcgcctaaaaggatggcgtttttaaaacaattaaatgcggcatcaaaagtcagggttttgcatcccgccacccctgaactcgagagttcgaaaaaaaaattagaatcaaatttgccgaattttcgaccatttttggttgataaaaggcataaaacacagcatacatgaccaaggggtgcgccagtcagacccccatacgtcggacgtttggcgcaggggggggggtgcgccaggaccaatttttctcacgtcggcccctattttccccggcgacaaccttttttttttttttgctattcaaaccacttttttttgcagcgtgttttttccaaaaaacttcgtgggaaggggtggggcggtgccgataggcgccgccgggaaaatatttttgaattttctatgggtttcgctacggaaattgttcaaattttaactttttcccccttcgttacgaccccctcccctcctttacagccgtcccccttacgacgcacgtgggggggggggggggtgcgcccttgttaatgtatgaattcaattgcatttttataacaataaaattggtttcattttcactaaaaacaggtttggcaaaggagcgctgaagttggaactgcccaaactgcgctttgacgtggagaagtcgagcaccggcatttggcaaccgcgcggcattcgattggacgaagttggcacatttttaaatgcaaattttttttgaaggaacaccaaattcattttcgacaatctcaattccca

SEQ ID NO: 13881 - DNA, 2325 bp, Heterodera glycines
  misc_feature (2306)..(2306): n is a, c, g, or t
gtccaacttcgcgcttcaaatccgacaaaactgtgcaatacttaaattgcaaaatatgaaaaaaaaaatttcgggggcgcttgggaatttccatacacttattaaatctgaccccgaattgaggcaaaagttgaaaatgttttttttcaaaatttacgtgagagaaatcaaagttttacatcaaacctcgtgccccccccccccgccgaaaaattcaaaaaaaattttttttcgagggtctggggtgaaagacctgctccgccacctcactcacccgtcccatcctccaacttcagcgacgccttttccacctccaatgcacccgcgtggagtgtcaggaaatttgttggctttgtaatctgaaaatggagagagggaaaaattaggttggtgaggggggaggaaagtgaaatttgccccaaaattggtggggtaggtaaatccttcggaattggtgcccaaaaaaagagataaaaattttctttaattttttaaagtaagaaaatgtgctaatcatttctacactattcagacgtacgttttaacgccaataaattttacaaaattaatttttttttttgaaaaaatcatttgcttgatgcaaaatcatagatggaatcaatgtttatgtaaatacgagcaggtcaaggccattatcggtaaacttgggtttttctggacctgaattcgtgtccaggaaatccaggtccaggcttttttcaaaattcgggtctcaattttttttaccgccgggggacactaattccgaaggattgccccaaaattttagtgtcaactaacctcaagatggatggtctctttgcccttgaatttacacgtgtccacgtcaacgctgaggcaaatttggtacagcgacgggctggccaactgcggcaatttgctgaatttgtccgaaccgtttgccatcgacgaaaaaagccttcggattattgcagacgaaattttgaggtatttaaaaaaagaaaattgaattgcttctaaaaagaaaatgagtaccaaatgttcagttttttgcacaggtaattaattttaaatgttggtaaattcggcacttttacgcttggggccaccaaaaaatcttttaaaccagggctcccaacctaaaattttcaaaatcagcattttgccgacaaaaaattagcattaacagactttaaaaatgaaaagtttttgcgattttgtgtcaattttttatgaaaaaataaaatattgtagccaagcagtagcgacaggctccgccaggaaatttttatttgaaattttcaacgaattttgttaaatttttggtaaaatacataaaaatgagcattattgaggatttttttttcaaaaatcagcaaatttctcaaaaaattagtatccaaaaaaaatcatcacgttgatctcttgaaattagcaaatcccttgaaattagcaaatgatgataaatcagcactataggtcaagcccaatgtttgaacaatgctcgaaacgccaaatagctaaattggcgttattttagcgcgctaattcaaaaattacactgataaaggcctttttgcacaactagcggggtcagcgccttcggcgcatcccccgctaggtagtacgattgtattataggattatgaatgataaatcgactggctcggccgcttcgcggcctcgcatccttttcttggctttttctccaatcgccgagactcaacccaccaacatttcaatcactggaactcaacccaccagcattccaatcactgggactcaattctcctgcatttcaatcactggcactcaacgcaccaacatttcaatcactggaactcactcaacccaccagcattccaatcactgggactcaattctcctgcatttcaatcactggcactcaacccaccaacatttcaatcactggaactcaacccaccagcattccaatcactgggactcaattctgcatttcaatcactgggactcaacccaccagcattccaatcgccaggactcaacccaccagaatcaatcaccgagactcaattctctggcatttcaagcaacgcgactcaaattaagcaattctccgatattcttccggtctctcaatcaccagacaaaaaattgtgccaaattcatcactgcaatataatatcgtgtaattttaggtctatataaaaaataaatgcttattaacaacacaattaataaatataaaggtaaaattgcaaattcaataaaatagaaaaaaatgttaagatttatcaatgaaaaaaaaaattgatcaataatcaaattatataactaaccanagaacttaaacagacctgt

SEQ ID NO: 13882 - DNA, 2153 bp, Heterodera glycines
tttcagaaatttccattttttgatccaattaataaagtagcatttttaaccttgagtgtttctataacttggtcacgttgcgagagaatgtcgcgatgagacaaatccatcacatggatgagaaggtcctatgaaaaggaaacaacaatttagacacaataatatcgctaaattctcacagcggtttcgatgtattggagagtggcggtgaacgaggcgaacagtttaatgggcaaattcgaaataaacccaattgtatcggccagtaaaattttgtgacgggacggaaggacagcctagtcaaaaggaaaaaatgaaatggaaaaaggcaaaaatgcctggtgaagggtcgtgtccaaagtcgcaaacggacgatcttcgccacacaacgattgttcatctgttaaactgaacagcaaagaaaaaacacaatcggaagtgtgcgtttaatgttgtttaccttttaatcaacgatgttttgcctgcatttgtatagctaaactttaggattaattttttaaccaattttaaactcacccaatgacaccgatcactgccattttggaggcattggccgaggctgaagcctcaagtcggtgtcgcacttcgttcgcacgcgacgcaatcgcattgcgaatttgctttcgcagtgaatgttcgcgcattcgaagaagttccacgcgtcgcgtcccctcggtggtccttaaaaaatgatttgtggaaactttagaaacaaaagcccgttagttcaaatgattaaatgaatataaattccgtttaattactagccttcccaaagatggaatcacttcgtcaacattcagtgactctgccagttcatcagaggaggaggaacttttgtttgcctcaatgtaacacaaacgatctctgaaacagattagttcaaaaagcaggaatattcggttcatttcgatggttttattagcctcatcagattttgttaaatctctttaaaacttggatatggcaaacaaaacctcataagaaccgaacatttaaataagcaccgaatgtacggaatctcggcaagtgctatttgaagtcgggcttcctccgtccgggcataaagcttgaaaatgttcaacacaatgttgtaacggtcgtagaccggaatgccaaagtaggagttcaactcgcgctcaacaaaacaaaggttttcaaaggaacggcgactgtttccctcatccgtttacctgttgggcgggagccaaaatgtcgatgtttacacagagggcattcacaggatgttggagcatccattcccgaatccgttcgagccttccaacgccccaaactaattttttgcgaattaattgcgcatcggtgttgagcacaatggcactaacaataaagcaaacaataagcaacactctgttcgtcaccctcccgtacctgacgacagtaaatccgggaatggtctcgcaaagcgtttgcgcttcgtcaatctgaaaagataaggcagaattttgggcataattaaagagcgggaatttaaacaagacatttgagaaatctgaacatcacctgttgctgaacagttgtgtttttaagtgccattttgcgaatgcgcggatggacaaggagaatgcgctggtcacgcgaactccccgaaatgttgctgagaccataagcaactttcaattcggtgaactcacgctcagttcgttcaatataaaaagagaatattaaaaaattaatttaagcactcattttggtaatactgtgctttgtcccccccccccttctttcgaaaaatttttttatgatttcaaaagtcatgaaaacatgtttaaaagtgttttcggggtcggtgatcacgaatccggcacccatttcgaacaattccgaatcccggacccgaactcggacaaaaagttgaaaattcaaatttttcagattttccgttcaaactttgtttaaatacacggaagtgaactaaaagtcattagtgcttcaataaaagataatataaaccatttttagacaaaaatggaaaatttgaattttcgactttttgttcggaattgtttgaaatgggtgccggattcgtaagcagtgaccccgaaaacccttttaacatattttcattataaagggaaatcataaaaaaaattttcgaaaaagggggggag

SEQ ID NO: 13883 - DNA, 1269 bp, Heterodera glycines
actacaaaaaatgataaattatggaaaaagaaagtaaaaattaatccagacagcttcaaaaattttgcttacgccggctcgcactcgtcaagcgcaccgccacttgccatgtccaccggttgctgttgttgcccagtttttggtgtgccactgcctccactggcggttgaagagccttctgccaagtcagggtgttgagacttgaacgacgactgcagttttttcatctaatggaaaagaaaaatgttttgataatttttagttattttttctttaacggattattaaatttgggcatagtgacgggaagcagttgctccccacccgccgttcgaaaaatttaaattttcatttctgactttcttagaattagaggtttatttatctacttaaaaatgaggactataatggctgtctaataattgttcggggttttctttaataaaatttccattctaacatctccaaataataacgttcgtctaagaatataccctatccagggccaactgtcgtttctgagcggcaagtgctgcgcgttttgccgatttgttggcggcatcctccgcagcagcgcctgcttgagccggcgcaggttcctcaccaacaatcatttggtcggaggtcgcgtacagagccgacacttcattataaagctaaaaattgtattataactgacattcaagaatgcgaaattcgactcaaattcgcatacaatcaagcccgtagccaggaaaaattttcggggggggggggggaaagggaggggtccggtccgaagacctttttttttttagcctctctatccataaattttattgatgaaattcattgtgaacatttttgattaagaacttcttatttatgactatttccattattatagtaaattacattttagaaaggcattattatgagcataagaattgctgcagttctggcgattatttttgtttatggcatggaacggaacagaacatcaaaaaatttgattaataggttattagaaatttttcaaaaaataattaaggtaatttaggttacccggacacgacaaataaaagagaacatttagcaatgaacaaaaagcagcaggggatttgagctatttatattcaattggagaagacgaaaaagtgttatttgattatttaattaattaaataatttaaatttaaaaataaatctttttaaatggaaatccgcaagaaaacttttggacgaaaaaaatggatggaagttgatttgaacattaaaccgcttttaatt

SEQ ID NO: 13884 - DNA, 800 bp, Heterodera glycines
  misc_feature (9)..(9): n is a, c, g, or t
  misc_feature (11)..(12): n is a, c, g, or t
gcatgcctngnncaggtctgctaataagggaaaacaaaatttggaaattaaataagcaacgaacgaaggaaaagaaaacatttttttccaaataatggtattaatatgtctatttaaatttaaataccttttcaatttggctaaacggtttgggcccagtgcttaaaatgtgcacaatttcacgctccaatgccgtttgcggagtggcttcttcactgacaccgatggaatagcgttctccaagcagaatgatactgaaaaaagcatctcaatatggaataaacattttgaatttgaaaagggggtaagaaaaaaaatacagcaaatgatagaattcttcggcgagtacggagaatattttgccgctttcctcctgactggtcccctcgatggcaccaggctgcgtactgagatcctcgaaaccgattgcggcccatttggccaacccttttttttccatcacacggatcagaaatttgtttggctccattgttgcaccaatcacctgtaatttttgaatcaatgcaaacccaagagaaagtgtcaggttgtgaggccaagaggcactctaacaataagcgtatgattgaatttccgtaactaaattcaacatctataccaacctgaagcatcagaatgtcacgatcaaacatctctgtccgacataaacatgaagcataattgtgaacctggaaaagattagataaaaataaacaaattaattaaaacgtggcacactcttccatgtccatgtgctggttttgctaatgaataccctgtcaaatagtgctgtttcacct

SEQ ID NO: 13885 - DNA, 1874 bp, Heterodera glycines
  misc_feature (406)..(406): n is a, c, g, or t
gcaaatttatgaagtttcacccacacttataacccttctttgtcaacacctgcatggaactcaaaaaccgcagcaaagtgtgtccgccttggatgaagccgtcccgcaaagcgtcattccattcgctgccgtccttcggcacttgggtgagcaaatagccgatgtcgttcagtgagtacagcgcacgtcgcagcaccgcggggtaagtgtcggtggcgaagttcaaatgtttgatgtgttcgttgtgtggtgaaacttgaagatgaggcggattagtagaaatagatttaaaataagaggacaacaaattcaaattacgtgttttaatacgtgtcgggggagggagagcacattcaaaaataccctccccccccccttcttccaagcacggtcccagggggggggnggatacgaccccccaagcctctccgcacccgaaatttttaagggaaatattatttttgcggaaaatttatcttttataatgtaaaaattttcccggcacgcctatcggcaccgtcggacacctgttccccaaaggtttttggaaaaaccgccgcaaaaaacaaagaaaagaaggtcattgcccgggggaggtacccccccccaaggagaataaagaaattgctaaattaaatcaatcgtggaaaactaataattttttgtggaatgtgtattaatcccgctttggttgctcaccctttcctcctcctggcactcactcaccattcatatagcgctgatgacaaaacgcacgcagatgttcaatgcaaatgtgcaatgcgttttcctcactgatcagtcgccctaaaaaatttaaatatgcaaaactgaattcaaagtattagcagtttaaaactcacgcgcaactgttggcacagtaaaaaccttaaaaatatatgaaaagtgggaaagtgatggatgaatgggtttttgtttggacctgtacagtcatcgaagtcacactgacggaatgctcgtggtcatcatcaataaagtcgtcgaagatcaaattgtaattcttaatggagggtcattaaaggggattttatgtctgaatcgaatttaatattaaacagggtaattacccgaacaaacaaacgcccgaaggcatttttgtggtccaaattcatcagaacggtggacattaacagctggtgaaaggctgtgcgtgccgctaaaaattggtagaaaatagaaaaggggtttgacggaagattacatttccaaagacgtcgatcaaaaatcatcaaatagacgacatgggatggatgcgtacagtcacaaaggcgctcgagttggccgagtcgcgcacggcccaacggcggcacacagtcgcagtcgggacagccgaatctgacgaggaaaagggacggatgaaatcgaaatgagaaaaacagagcaaaccaaatgaaagaaacttgatcaagaaatgtaaaaattaaacatattccatttctctgtataaaagacacaacttacaaaagagactcgctgagaatagccgcaaatggtgctaaaataaaaaaatggtagaaattctattttttactcataaggaagcagcaaaaaaagatggaattgcatttttataatttattgcatacgaaattcttgcgcccgcgaagtgagccaacggagcaaccgaatcgccaacagttgaagagaagtgagagtagcgcggaacactttgaccaacaatggacccgacttttgggtgcgttggtttgagtcttttttgcttcgtttctacatgggaaaaaaagttttaaaacaacaattgataaaggcatagaatttaagtcaaaaaggtgcaaaagtatacaattggaaagtaaacccggcggcgcctatcggtcagcaaaaaatgacat

SEQ ID NO: 13886 - DNA, 3530 bp, Heterodera glycines
  misc_feature (3467)..(3467): n is a, c, g, or t
gtctcggttcccggtttcggggttttagtctcggaaaccgagaaatttttacactgttcaagatgactatttcgggcagtgggggtcgccagcgaagggggaaaaggggaaaatttattgaattttgaacgtattttttaacaaaattcatgaaaatcccaaaaaagccaatgtttagggcctgtctttgttgtgatagcaataaaatttaagcataaatttaagatgcttttagatttgcatcacaattattgggatgccagcgcttgtcaaaaggacgtcaaaattagtggtgccaagcatttaattgccgaatgcgttggaggcatatacagtgaatatagtggtaaatttcgttataattatcttttaattattgtatttattctttaaaaggctgccattccgtcttcgcaaaacattcgatttcatggaataatgattacccttacattttttactttgaaatttcaatcataaaaatgttaaggtacaaaaaaaatattttataaattgaaccaaaagcaatcgataaacaaataattaaaaaatattttaattttgtttaattaatttactttttttagtgctattgactttggatttgccgtcagagaacagaccaaattggatggattaattatgaagggcgcttccatatattcgagcagcggttctttttggtgtaacggttcatcaacagctggcaaatcttacggtgccggcgctaccgtaggaattggcttttcatttactaatcgacaaatcatttttacaaaaaatggagtccttttgggtttgttcgtaaattatttgtttttttataaagtttttcattttttacagatttcttcactctgttagacgattcttcattttccacaaattctttgtttccattcgtttctttgtgtattatggtaaaattgaggcgaattttgggccgaagttcaaattcgatttgacgactctctgttaaaggaagaaataaatattccttaaatttggtcattttttacgggccaggcgccgttttcgcgtggggcggagtttttggactataacttttttctttgccaaccaaatccaatattcttgatatccttcgaaagcccttcagatgcactattagcctgcaaaattccaaaaaatttcgttcagtataaaaaaagttcgagccaaaaaaattggaaaatttggtttgttgaactcttctgaccataacttttttgaaccttaacgaaatttttccaaattttgtacgctaatagagaacacttagggctatcgaaagataccaagattattggatttggttgacaaagaaaaaagttatagttcaaaaactcgccccacgcgaaaacggcccacgcgaaaacgaccccgaccccattttgatacccttgtactgtttgaatttggaccaggcatttttggccaacgaagtcgggtccaatcttctgttgaccagccatgtgtggattttatccattatatagccaagtagacaagcaaatatcaaaataatgcataaaactaaggctagaattccaatagagacaacgtccatgaaataacgcttcttgcgcctcttccttttatttttgttgtcagctgaaatgggaaaaagaatgtttggggatggtcaaggatttttaatttattttgaaatatgataatgtgcgccttgttttttttaaaagatttataccactaagaatggatttttcaaattccatccaaaaatttgatttttacgaattctaaatcaaagtaacttttctgttaaaatttttgaaatcttgaatttctcgctaaaatttaaaattaatttgccgataagcaaaatttttgtttatttttaattaacgtttggggttttttttccggttttggaattttgcttaaacttacaaacgcatattattatcaattatttttacattcatatttgatgtttgccgcaatgtttaaattttccactgccgagtgcataagtcccaaaatttgttttccattggatttattcgttctttcgtcattcttttcctttttgtgttgattatttttccgtttttcctccaataataatttgactaatttggccattaattttgtttcaaattttttattcgttataatttctgacagtggaatttgttctctcattatacaaattttgatgacgaataagagatattctttcaatgaattcaaaacattccctataatgtgattagaaaataatttattttaaatattttaccaatataattaattttaacctgattttacttcctttataaagattgataatttttcaattatttggctcattactgggtcattctctttgattgctgataattttcgcaatttttcagtcattttttcgtttattttttgctgagtttctagctaaaaaaataataaataaatttttccctaattaattaaatttttcatatattttaatcaaataaggccatggaaatttgcataaattttttgttagcaaatgttttgttcttttttcattgtcccctgatgaaaaccataaacctcctttgaaattaataaaacgatcattttgtaaattacgccgaaaatttttgctttaacattttttcattttcccctgctaattactttgtttgattgcccagtttgatgaggctcaaatacaatgtcaatcaaatgctcattttccgttatttcattcaaaaattcattaaattccttcttttcaatgctttccatgttgaataattcggccattgttttcccattactttcagttgatggctttttcttttcgttgagatataaagtgatcagatcagccatagtttgttcatttttgtccatttcgctagaatccgccaaaaactctttctcgattggtgcaattgaactttttggattggattgacgagcataatacaacggaattttttctgttattttaaaatttcaaatttttgtgtttcaaaatataatttagttattatgttcaaattttaattatttattaattaatgattgttcacctttgcctctctcaacaaaatccgctaataatgtgctgattaagcagcattgaagaacaaaataataaataatctttttcatttaagactattttttttatattttaccttatttaatttaaaatataaaatgaaaaaatgagttttgaaaaaaatttcgaaggaaaaaatatcctgagcaaaactaagcttcgtctcatataaaggcagggctacttattttttaatcattataaactgcaattttttattaaaagtaattaattatatagccatttttcatatattttttcgtaatattctgtaaccaattaatttcatccaatttatgacaagtatttgccacatcatattgattattattgatgaccatttttatttttacaaaataacagcattattttttaatcttactanaaaaataattaaacagcaaatataaaattaaaaattcgtaaaatgtgaaacgatttataaata

SEQ ID NO: 13887 - DNA, 1135 bp, Heterodera glycines
tattgataattgcaaaaaaaaattcccggcggtgccttcagcaccgcaacggtttgccaagaattgcagaaattttttttttttcgttttctgtctgacatcataaggccaaggagcaaacaatgaaattaaagaaaatcgcccaaatttttcagaatttttcctctttttacctactacatccacctcttttacaccggcccccctacgacaagggggggggggtaagtgtaggcaccaaaaagtttatatacaatatatttcattacatgccaaacaaaatgacccatcctcggtcaatcccctttttttgatttggcatttttcaacacggtattataatgactgatttgttttttctgtatagatgatgagtttttccgaccgcgcgattcgggcatcagcacaacgacgacgggggaggcggacgatgatgggacggaggagcgggagcagtacatggacaaaaacaacggattggttcagcaaccgcagcaatcactttttgaccaattgtggccattcagcagcaacaaaccgggcgaggaggagttggagcagtacagcaacgacaaagcgagggaggagttggagcagtacagcaacaacaaatcggggacggagttggagcagtacagcaacgacaaatcggggaaggagttggagcagtacagcaacaacgaaccgtcggagggggagttagagcagtacagcaacaacaaatcggggaaggagttggagcagtacagcaacaacgaaccgtcggaggaggggttggagcagtacagcaacgacgaaccgtcggagggggagttagagcagtacagcaacaacaaatcggggaaggagttggagcagtacagcaacaacgaaccgtcggaggaggggttggagcagtacagcaacgacgaaccgtcggagggggagttagagcagtacagcaacggcaaaccggtggagaagtccctttttgaagagttgagggagacggaggagcagcaacagaacatgattgacaggtggttggagggaagagaagcggcgcgcttttccaaaaaaaattttgggagcaagggggttgcaaaatttacataacaataaattcgccctcctccgaaatcccaaaacaaaaaaa

SEQ ID NO: 13888 - DNA, 4256 bp, Heterodera glycines
gtgaattgtcatggtaagggttctgcttcgaatgttcgtccgtccgcccctttcgttggctttcgccaaaattcggtcgccacggaatcccttcgctgtaaatcgtttgaaaatttccccatttcttcgcaacggaatgaacgaaaacaacaaaatcagcaaaaggattttgctgatcggcggcttggacttcgctggttttcccagcagcaaattgggcgagaaatgagcaaaaatattgggcaaaacggacgaaatcgcacggaacaactgacggtcggggaagaagccgccgccgcgccgatgggcggaaattgggcccaaaggaaaacaacgccccccggggtgtggagggaaagcggcgaggggccggagagtgtccgacggacgctgaaaaaagaagtggggacaggcggtggcccatcagctggccaagaaatcactggctggttccaacgacattctgtggaggcaaatcgatccgaacaacaaccccgaaagggaaaagcattggaagagtttgactattgctggaggggagacaaagcaaaacggacggaaagcgacgacggcatgggaaacgaatgggtggggagggacagcaaagggcgggggggggggggaaacggcgggggcatttaaagcagcgacatcacgaacctaatcaaccccaccatctcaacagccaaaaaacagcagtgccatcgccactgcttgccgccgttcggccaccctctcccaacttgggcattcaacttccaatcgatatcgactctcgacatcccgactaggagcagtagaagcaaggcagcagagagtggggtcagagagcccatcaatcaacggattggctacggggggtcaaggtaggatcaggaggagaggatcattagggagcgtggtgcagcaacacactcgaggaggacgagctgtcaataatcgaggtacgcgagaactgatcagaggagagataaactgatcagaagagagaggaactgatcaggagagagtgggactgatcaaaggagaggacttatcagaggggagagagaatgatcagaagagagagagaccgatcagaggggagagagagagaagaggtcgaccagaggagagagggatcgatcggataccgtcactatccaacaaacgcttatgctcatagttttgatattattctttcagatactacacgtgccgaaccaattaaatgggacgacgccgaaataaaacaacgccataatcaaacagcgcaaaacaattttccactaattaatcgttcaaaaacgctcccgagcatcaaatttgacgccgatttgcagctgaaaaggcaattcgccgcagaaaatattcgcaaacgcgaaaacgaacaaaaaacggaaataatcgaaaggcaaagagaacgctgtgaaaacggagaagaaaaaggaaatccgtgggattatttgggcagaaaaaacgaaacaaacggagagaaaaagttggaagaggaaattgataagctgttcgaacagctcggacttctcgacagaaagcatttgatgaacaacggagaatttaaaagtattttcgagtcaatgcgaaagcatttgccgacaaaagaaacgcaacaaaaacaacaacagcagagcattggccaggggcagcagagcttttgctttacgaccaatggggcgcaaaagacagaaagacagcaaaatgcgtacaaaaagggacggagggaaactcttttgggacggagcgcatcgaacaatgcattagccgaaaggtatggacgaatcactcactgatcaacagaagtgatttgagacgaattaatgggtcattaaaagtggccaaactaacaattgaccccgaaagtgattgatcaaaccaatgaacagatcaaacattttgcagagcaaatggaacaacaacaacacaatcatcatcatcagcatcagcatctttattattgtcatcactttcaaatggggagaaacgacagcagcagagaaggcaatcacttccaaaaaatcagccgaaatacggcggaaatttggaaaatttttggcaatcggttggcgtgagttttacctccttttaccccaatcactcgcagatggtaaaaacgcgtgcggcggagacttcgccaagcaaacaaaggcttccgctgggattaagttccgtcgaaaaactgcagggcatttgccaatttacgaatcaaacggtggaagaaccaaatcagccaattaatgtgtacccgcgaaggtacggtggagtaattgagacggtggcaatgcggcggaacaattatctgatggaagcggcgaggacggcgagtccgtcgggcacgagcacaccgacgaccaattcgggcagagccacgcccaacttcagctgcggcaggttcggtcccaaccggttaaacggtcaaaatgtgcgtatttcaattcaacagagcattcaaatcggcctctccgtcgatcgccgatcaatcaaacacggactatttggactgggggactccgtccgcaaaagaatgagcaaagaaagagagaatcggaaggggtgcggtcgctttccgaccgtaacggaggaagagaaaggagaagcggtggaagcattggctaatcaaaatgggacaattatcatctcgattggtcagccacaaaagattggcaatgggaaccttagaatggacagccaaaggcagcagaggacaagtcgaagtccggacaatgtttgttgggtgggggagaatggcactaatcactcgggggggggggaagtcgggtcgaggcactaatcactcgccaaaggtcagcgagtgctcccagcagtcgcagtgttcagcagcgaaaccaacgactttgccccagccaacgccaaagcacaatttacgcgataagctgatcagtgccggctttccgatcagttgccagacaacgagtttttttggtggaaacgcaaagaacccattttatgggcagaagcagccggatgatcaccaaaagcagaaacagcagtcaaattcagcgccgaatttcccgctgacaaacactgtgatttcgcgagtgaatctgttcgagagtcagcaacaggtggacaaaagcgccacagacacagaacgggttcccattaagccgacttcggttgcttctgaggttggcaatctgtcgcaacactcactggaaacgaatcgtcagcacttggacattgtgaatggaaccaccagcggaaatggccaattgtcgccacgttcgtcggtgttccgtacaaaatcagtgatcgttttcgattttgacaatttgggcggcactcccacaaaagcaatggccaaagagcaggcggaagaaaacaaaaggaaaagcggaggaaagaccaaagaacagccgaaagcgaagcagcagaaaaaggaggagcagagaaggacaaccgcaaagggagaagagcaaaacgccaaaaaggtgaaattaataaaacaaattgaaaagggaagcaaagaaaagagaaagcggtaattagcggtaattagtattagttgtaagtaattgacccaacttaaagggagaaggcaaaaagggtatatatacgtattatttgtgataaagcagcacgaaaaatgccaatctcgggaaaagaatgcccaaccattcctcccttccccttcccctccccgttatccatttttcgtcattttcccgtttctgcggttgcccccccccgccccgtataaaataaactgaacagagtcagcaacaacaccccacaactcattcattctctcctactcttctcatctcttctcctcttcccctccgtttgtcctcatttattcttaattaatttattattatttttttgttaaatcctctcactcattaaattaataatttgttcaaaataaaatgcaaaaacaacgtaataatggtgtaaataatgaagggaaggatggaggaaagaagcgaatggcggacaatcggcgaccatcggcgggcggcagttgcgcagaaacatttatttgttcgatcgctttttagagattattttgcgcagtccgaccaaaacattcattcatttatttaatgttggtttcccatttccctcaatttctccgttttcaatttaatttttcatttcattaattatgtaaaaatcacttaaggcattcctttgctaatttatgctaattaatgagcaatgcctttacaattaattctgcggctccttttcttttcttttccaatctttgcgttaaattctgcccaaatgag

SEQ ID NO: 13889 - DNA, 2367 bp, Heterodera glycines
  misc_feature (72)..(72): n is a, c, g, or t
tgaatatagaaaaaaaaactaaaaatgtatcaattagtcctacgttaggggaaaatacagatttcttaaaanagcttgcggccaccaggtctgataacgaaaaaacgatctattgcagggacatccgcagaacaaatacttgcccttgtggaaatttgcgcaaatattttaaaatttaattttcgtctaaatccgagccagaggcgacggttgtcacaatacgcggactattacagggccatagcacgcgctcgcagtgagaactcagctcggcaaaaacttcaacaagggagcggaattgcccttggtgctattcttgtgcctgttctcagtgtcttagcccaaatattatttaaattatttaatttacattattctcataataaaattagggctttttggggttcgcttctcaattaaatcaatttatcgaattgaaaaattgatcatttaattaagcggctcatcaaaatccaacagttgacaataatgataacggcaggaggcagcattcaaacagaaatgcagaacccgaacaacttcatcagcaaaatgtccaatcaaatcaacagaatgccacaagtacaaataaccaagaaataatttttttttgttataaaaggcatgcgctgtgaattgatgtgccggcttaggaccgcttttttctccgatatttaccaaataaatacattatataaaagtgaaaaatgaaatttctaggtcttcagaaaaagcatgggatgatttagtctctctcttacaatattaatttaattttaaaaaataaaatttcttttttaatttatattgactcgttagttaaatttaaaaatttaagccaaaattttcttaaaagaattctttagcttttgctgatgaaaatcataatccgaatttgaacaatgaaaatacgccgccaaataccaggacaaataccagcagcagtgaacaaaatggcagaccgggaagaacaaggagaggtacaatcaataaaaatatttattgaaaattttaaataattaaatttctttacaaatttaatctcctccgtccctcaaaaaagaagttaatcttttaatataaattttaatttttaactgaaaccgagggaatttatttgggttaggacgggaagcacgcttttgaaccggaagccggtacaaaatttaaaaattatcttccagttttatcagcaaatgtataaatgcaattttttcttttcaaattaccaattttttattttatgacatatcaaaatatttttgttattttatttattaaatttaaaaaaaacatttaatttaaagtaacacctgttgcttctccattacgaccaattaatgctaataatgatggtggtaatgatgctgttcatcagccacgtcaatcaacaaatattggcaacctgtcgaacaataacaataattatattgaagaaattgtacaacattatatgcgtaacaatatggaatacatgatcaccacatattccggcctcaatgatcaaacattacaatcagcaatgaatgagcagcaacagcagcagcagcgatcagtcgcaaccacaacaggttggtcgcccagaaatatatgaaatgataggctactgtacttttggtactgtaaaaattgtaaaattaaacggggagaaattgttagtgatttatgctgtaagaaaaatttattaatgaaaatattgttattattattattatttatgtaatgattttgattactgaaatccgttagttttgataaagtgttccttactgtatttttggaaaacttttttggcaaaaaattgccaatttttccaagtctttggatttatgcctttttgaaaaataagagggacaaaaatctttggctttaggccttttttgaaaaatgtttcatgcctcaaaataaggacagtacttaaaataaagacaaccagggaattttccatttttaggaagtgctgacagttcaaattcgattgaatatttaaagcaacagatgcaggataatgagtgttgtgattcggaaaacaatgacggcgagacgaactgtacaatttgcttagaaaaaatcacaccaacatcacatgctaagcaattgacttcatgccaagtctttaaaatatggaaaaaattatttataaaggaaaattaatttttgagaaaaataattgttttcccaaatttagcacacttttcatcgcgattgtgttgacacatggtaattaataaaagaaaggttttatttaaagatatatttatttgtttatttaggcttgtcacggcccaacatgccctttatgtcgtggttgaagtgatatccgtgatctcttggcgggaaattaaaaaaattgagttaatatgattc

SEQ ID NO: 13890 - DNA, 1918 bp, Heterodera glycines
ttttcttaaattaatgtattgtaaatccccaattaactgttggattaattattcagtatctcccggcgaatcaataaccattaatgacagaaatggtcatttaattgttatagtgcgaggtttttccgacatgctgcaatgtaaacaatttttttttattatttttaattaccatcgggaccggtactgtaattagttattagtttatggtacgggtcttgtttttatataaataaaaatatcgaataattcaaatatttttaacgctaatttgtttgtataattttttatattttagtggatttgagcagacgtttacattaaaagcggtaattcaaaaatattttatttaaaaaatataatatttaaattttatttatttatttttaggtggtgaaatgtttacaataaatgttattgcatatgaatgagaacagaaactttatgtaaaaaatataaaaatctttggatttgaaatcaaataaatttaaaacataatttttgtttccaatgtttttaatgataaatttgttattgaacattttgcataatttggcgatttaaacaaacaaataaattagtacactcaaaacagtatttatcaaaattgattattaaaagatttttggcacattgactaatcactgtgcctgctgaatgcctgatccaaatctaaatgcctcagttattaatcactttaccctacccaaattattatcacctcattcctacttgagtcgttcgtcgaagtcgggatcaatgtttcagtatgaaatctggattaattttatccaacgaaacgaaatattttttttatcaaaaaaaaaattgaaaaaaaacaaagagatgttttttaaaatattttttggcctttgtcggtgggtaatcaatcctttgttattgaaccccatcctcggccatatcccacacaaacatacttttcagaattacataaataaccttcaaaaaagaaattcccattaaaatttgttttaaaagatatttttaaatgcttagaatttctgtcaaaaatcagtcacccatcaacaaaatgatgaatcttttggtcaaaatgtggaaaggaaaactttatacaaaagaatttaaaaacgacagtaaaattgaaaatccaaggaaatgaatgtacaaaagtgatataataataatcataatcaccaagaagatagccaataatgttctgttgggcaacaggaatttccccatgagtttttgtgccaatagatttcatttttctaaatttcataattttctcgttaaaattgaatttttttttcaatccaattttcagttaaatttaatttgagctcacattcccggattttttcctattgccctgaaaatcccaaaatggaaaaaaatgaaatttcccgatagaaaaaccaaaataaaggataaagccaacggatgaaaagccccaaggatcaaaagatatacgtctcccccccccccaaaaaaaagaataaaatctcaaaatacatcaaatccattctcatgaaatctcaagcgatttctttggcgccgccttcaccaacattcgaattgtttgcctccaatttattggcaaaatgctttttcatttctttgaacttttcccaaatgcttttcgtctctctttttgctttttctttgttcgttttgatttttgtttccaaatttccaattttgtttttctcttcttcgatttcctttttcaatttctttttcctttttttcttcgatttcctttcccaattctcctccattttttctttcttcttcttggttttctttttcaattttccaatgtctttttgctttgatgagttgttccaatgttgttgcataatttgggagctcttctttttttcaatgtttcctcatcaatcgcaaatttctttgtcttcttttctaattgttt

SEQ ID NO: 13891 - DNA, 1361 bp, Heterodera glycines
aattggagcccatttcaacatcacttctggggcttttctgcaacttttggtcccttctccattcattttgttcattccttttcctttgtttgtttctttcagtcgcttgaccgcaaagaacaaacctcgaccgcccaaattagagaaattgacaaagccaaactcgctctctcagtctgtaattatttaatggaattttccattttgttaatcgtcgccactatacgtagatcagttgttttaagatatttcatttcacttgcatttcaattgcaatttggtaatttttagggtcggcatgccaaagcggacagagcacagctcaagcggttggcacctttgtttagccaccgaaaaaggtcattctaaaattgcagaaaaagagcgttgatcatcggaaatttgggctcaaatgcgcaaagcagcgaagaggcgaccacaactttgcttagctttttggccgcttccggcaaaaatgagctgaacgaagagtgggtcttctccatgttcagcagtttcattttcattcaaaaggtcatcgtccagcgaatcgggcgaagaatttgtgaagacggaatttatcacttcattcggtggcgacgaggaaaaggacggcgcgaatggagggagagcgggcgaagtcgccggaggacaaaatgaggacgaatgcggcgagagagaggcggtcgttcagggcccaattctcccaaatcgggaataccgacgccttctgtacaggatttgccaatttgatcattgttgtccgtcttcactttcattttcattttgttcctttttgaacacagcgaattgtcccgacgacggtcgaatagccccgaaaacgcgtgggagcgaaaagaccaccgcgccgaagagagtggacgtagcggtgacgcttggtacggtcatcgccgttcgtcgcgctctccgccccgtcgacatcgccgtcgaacgacgcgttcacgcgagagggaacgaaggcgccggagcagccggtcaaggagtagaaatagtggccgacaaagacgacgacatcactcatcaagactttcttcagcctcaccatcgccgaaacgctcagcaacagcatcgacaagtcggaaaactgtccgacatgcggaagaacgcgaaaggtgaagagtgggagagagaagggacaaaggagagtagaagagagaaaagaggagagcagcaactctcccctcagcccccgccgtccctaagaaaaaaaaaattcttgaaacttttacaacgatttttagacccaaaaagtaaattctaaaaaaatttacactacaattctatagaaaaaaacaaacaattttttcctgaaatttttactaacaataagtttttttttt

SEQ ID NO: 13892 - DNA, 943 bp, Heterodera glycines
aaaggcactgacgaagacagcggcacaactgaaagtggaggaggaacagcgacagaaggaaatgctgcgcgaaaagaaggtgagagagagagaaaagggacagaaagcgatacacagagaaaaagagagagagaatgaaactcagaaaaaagaggtagagagagagagagagagagaaaaaggaggggacagagagagtgcataaaagattggatggggcagggtcaaattgactgtgcgtgttgatggtttaaaattggggagtgagtgactaggcctcgaagatcgtattgagaatttgaaaaaattggataacaaaatttgcatttagagacgagaagaacaattgttagaggagtcgcgtcttttgaggaagcgggagagagagaagcgaaagacggacgacggaagagaaaaagagcgcagagagagtgaagcgcattcatccgccggcagacgaagaagacggtcgtcctccgagaaatgaccagtgatcggcgacaaaagcattcattcgaattgtgactttttgaattcatcagatggattataacatttcatttctaagttaacagtttttgccatgttatcaattcataccttttcctcatttcaattaattttaattctctattgaattcgttagccttcgatgcttcgctcattcgtctttttgtgtcgtacttttccgtctttgagttttggtgcgcagttcaacaaaaatctgttcgccgcttcacaaaaaaatgctgctctaacgaagtgagtcggttgtttccatgagagaatcattaattggcgattagtggaaatctttccatgtgcagccgatttttcagatttttttgttgcggttttcattggtttgggcatttcgtttattattcattaagtcgtttgcattttcgtcatttgtccctttttaattggacttcgaattcaa

SEQ ID NO: 13893 - DNA, 1129 bp, Heterodera glycines
  misc_feature (45)..(45): n is a, c, g, or t
ggcatttcgttaattatcatttaagtcgttttgcatttcgttcanttgtccctttttaattggacttcgaattcaaatgggggtaattctccgccggtcgtgccgatttaactgtcccccaattgcgaattgtccctctctcagacatttgcacgtctctcctttccgttacgccgattcttcggacgatggcaaagaaaaaaaagaaaacacaattaaaattgacgaaacaatccaaaaggataaagttgacgaaacactccaaaaggaagaaaaggcggcccaattgacgtcattagagccgcaaaggttgaggatgaagccggacaaccggcgagtgctcgtccgaatggccatcaaagcacacaaaataaatgcggccagcgaggagggcggcggaatgtccggcgcaaaaaggtagcaaaagggcgttgaaaatacccgttgattgtgagagtgcccgggcgtggtggctttccccatccatttttggcttttcctgccctgtcccctcactcactatgcttttaagccttctctccatgaacaccactgaaatcgaccgacatttacccactgcgatgactttgcttcaacctttcgacggcgtccctttccgcgaattgcccgtcgttcacatcaaagcgtcgtccaacaacacaatcattcacgcgttcaatttcattacggtttcgcctcgccttttctccttcaaagcttcgctcccttcagaagagggccattatctatacttcgtgccgcaaggagggatttaaaaacaccaaaaagaagtcgccgttggccggccaaacgacgggcgtagcggcaggtcaaaagctgttgaggcgaggcgtttcgactgtccgcgtgatcattaagggcattgggccgggacggatcagttcggtgaggggattggcgttggctggtgtaaatgtagtttcggtgagtgtggtggcatttggccaaatcttcggaggaatgtctttttcagatttcggatgtgacgccaatccccgaattggggcctcggcctaagaaaatccgaagggtgtgacgccattgtgaattgtttttgcgctttttctaaagttctctcctcaacggatgaataaattgatgaatgcca

SEQ ID NO: 13894 - DNA, 1562 bp, Heterodera glycines
cttttctcgtgttgtcgtttcaagaccatttcaggtggcaagtaatcaagtgtgccgcacattgtctgacttaactttttccatatttcgaagtttttgtaaggaattaccgcctatttttggcgtggacagcccaaccaaagtcggcaatccgaattttaccatcggcacaaagcaaaatattctcgggctaaagagaaacaaagaatgaggcaaataatggtaacaactgactttgatgtcacgatggatgaccttttttgagtgacaataattgagcgcatcggacacttgaaagatgtactgaaacaatgaatagaaaacagacagaagaacataactgacaatgaacagcttcggtgtgattacctgggcagaagttgactcagagaaccgacgacttttttgcaaaactttgaacaattcgccatgaagagcgtactccaatatgaggtacactttcttatcgtcgtgaaaatagttgaacatccgcaaaatgttcgggtgtctgaaagaacagcaaagatttcttgcttccgcaaaaaaccaggccatgatacataataataaccattttttcaaaaagtgatcagctcagagagggttagtgacctcagctaacaaaagaaatgaactcacctgaggtgggcatgaatttctatctcacggaccaattggtgctccacattccctttgaccagctgagatttgaagagaatctgagggaaaaagtgcaataaatggcacatgcccaaagacaaattaactgcaaatccatggaactgttctcaaaggattttttcatccattttgtgttaaaatatgttttctcttaccttaagcgccaccggaatgcgatactttcggtcgcgcgccaaataaacatttccgaattttcctttgccgagcggacgtccaatgtcaaagtcagaaagggtccattgtttttcgctagtgttaatttattacaaggttagttaaagatcacctacttccattcctttccgaactccgaataatttattccttcatgcattttattgcttggctgattggctgggcgaagattttctttgttaattattggttctggctgcttcatttcttcagaaaaaaaactagaatataagaatggctaaaaacaaatcttgtaaacttctttgtcaatgtggtaattaggtaggtatttgtatttccaatcttgcagctaacccgggaaatcttttacaaagcaaaggcagggagggattcccatcaaatcaaactcaaacaaatgcaaaataattaatgcaaatttaaatttgaatattttgacgttttatttaatttcattctcttactcatacgtattttttacacttaaggcaaagacgcagatagctcactttcacttataagttgttaactttcaacttttttcaaggcgcattttttgttgtattatggcaataaacactgataatccatcaaattctgctacaaatttattgtcggataacgaaatgtggaaaatccatgcagtcacttataaatatcatggacaaaggccgaatgaacaaagt

SEQ ID NO: 13895 - DNA, 2717 bp, Heterodera glycines
  misc_feature (72)..(72): n is a, c, g, or t
  misc_feature (242)..(242): n is a, c, g, or t
tgagcataaatataaatttgaataaattttaaaggtttttgaaaaaaaaaatcccaggaaaattccaagtcnccgccggagaaaacataaaaaaattcaggcaatgattgatgtctgcaaaaagtgaaaaaaaatttattgttgtcgaaccattcatggttaagtcgtaggaaaatcgaaaaagcaacttttggcgagttttgcaaaaaattttttatgataaaaaccccatgaaactttgnttatccgggcttttagaggtcgatgatcacgaatctgacatctaattcgagggtcatttacctccaaaaacccccattaaataaattttggtaatggttacttttactggtcccataaaaaagaataaataaggcggttttttacgattctttgtcacactcgggggttacttgggccgctgatcacgaatatggcatccatttcgaccaattcctaaaacaggacccgatttcgaacaaagaatcgaaagttaaattttagaaatttgggttaatgtctcgaaaacgacttaaatgcatgaaaacaaactgaaagtcatcattcctgtaataaaagatcatataagccttttttagacgaaaaattcgaaatttgttgaaatgcgaagttccgattttttgttcgaatccaggtccgagtttagaaactggtcgaaatggatgtcatattcatgagcgctttcggtttggttccttttttaatttttgcttccgatttatctttcccagcgaccccgataagtccataaaagatttttataaatataatttaaaaaatgaaaaattactttttgaaaaatcttattagacttgatgaaaaatcacggattagatgaagtcacatgacagatctgatgtcatattcgtgatcagcggcccaagtaacccccgagtgggacaaacaatcgtaaaaaaccgtcttatttattcctttttttatgggaccagtaaaagtaaccattaccgcatttttaccccaggaaaacaaataaaatttgtaacttattttccttcgggaccagaattctgcagtattaccaatatttaagtatttgattgaataaatttcaaatttttattctaataattatttgtttagcgttggcttgattccgattgtgcgagttcggatggaaatggctttcacatcatttgcattgcattgcaagtaagaacaatgaaagaccgcttttccaatttaatccgttgactctttctctcttttaggaattgccttttgcccaatttttacgtgtgactgacattaacaacacttggtctcttcacatcacttcttggatgaatgcacacaatttggctctcgcaagtgaactttacgtcgcttccaacgcccttttgatttatttttcgtggaatatgctaaacatggtgctgcatataattgaattctattactataaatatttatatagtactaatactgattttcccccaaaggttgacagcattgaagaccgatggatcagagacagtattttcggtaaaggcacaatgtctaccaaaatcgcttttcgcaacaaaactgtgctcgtgttcgttaccagtcacttttttgcggatacaaaattccacatggagcgcatcaaacaataccaagtcggacgccgctgcacattccccgaggaaaagtcggcgaaaaaattcgtcatttggcagggcgacctcaattcgaggtgattgaacagtttgaaattgataaaagcagatacgaaaagtactacggtattgtttattttcagtaaagttcagaatagaaggcattgccaacgcaacagaactgatccaaagattgaattccatggaagagggcgacgaaatgaaagcggaaattgcgaaactgctccaatcccatgaccaactcacaaaggcacgagcgaaacgggaggcattcggcgaatttaccgaagcagaaattggattcaagccgacttatcggacattggtaaagtgcaacaatttaaaaactaaaactccaaaagtccattcactgttttaatcccaatgcctctttttctatccgttttccttttctttcaggtccgttctggtgcctacgactcactccgtgtcccttcctggtgcgaccgaattctgtgcgaaggtgacatggacgcacttcgcatcacaaaatactcgtcctgtccttccataactttgtctgaccattttcccgtgtcggctcaatttgaattgcactttcaaaaagaaaagcggcaccagctaagcgaagttgaacaaagacttcaaacattatctcttatggaagctgaacacagacaatcttcgccttggctcatccgagttgagcacattccaacttgggaggaattcataccgctcgtgtgccgaattgcgattccaaatgacatctgggcagatttgtgttcttatcgtgattgggtcagttaaatctctccttctccaccttttcactcattccagacattttcagatcggcatttaccacaactcgttgaattcgattacgaaaccgttggaatggatgtacactttctcatgtccaaccgacgacgaacgtaggattgatactgagcggactttgattgtcgaattccaaccattgaaaagtggtttctacagagtaggatatttctcggcgcgcaaaaaatgttttatgaccctttcaaattcattttttgttcgaatgactct

SEQ ID NO: 13896 - DNA, 2213 bp, Heterodera glycines
  misc_feature (56)..(56): n is a, c, g, or t
gacgcagaacgacttcaactgggacgagacgaccgcaaaatttgaaacatttgtcnggagaaacccgatcattgtttctccgccgtttcgactgtttccaaattcgtcaagccgcgcatcaggacgtgcaaagtttgatcgcattgatcaactcgtcctgcgaaaatgccgatctgtcgctgagcaaagaggagctcaaatgcatgatactgatcattgcattgcgggacgaattcaccgatctgaggcaaaaatgccttcagcgcttggaagacagtcgaacgagcggacggtcaacctcactgcaagagcttggagaggagtgccgaaaatatcaaatcctaaaggaaagcgcgctctccctcggctcaaatccctgcagcaccagtgccatccgagccaaaccgcagcaaatccgggacaagcagaagtccaaatcaaggccacagcaaagccagaaaggacatttccagccgaataattcaacggctattgaaaaggaagtggacctgcctgatcagccctgctattcatgcggaggcaaaaatcattggcaaaaagactgttggttcaaaaattcgaagtgcgaaaagtgcggacgaatcggccatatcgcaaaaagatgcaaaaacggcacagaaacccgacgtgttcgtgccgtggccacaaattctgggaatgacatgcacattcacaccgtttcacttcagccaacatgtaaggctattgaaggaagtagtaacaaatggtggagaattgtcaccgaaatcaatgggatggaaaacccaatgaatgtcgacaccgctgcacaaatcacggtgatcacaactgattcgtggcaaaagcttggcaagccaaagctgggcaagaccaccatcgcagtcaaaaactgcaacgaaaaggcattcgcaattaaaggaaaattcaattgccaagtttcgtacaacggacgaacagcgaaactgattgcgtacgtcagcgacgaaatccatcaggatttgctcggcatgccttggatcgaagagttggaaatcattccgaaggagcttatgtttccaaattcttcgcaaatcaccaattcggtgccaatgaagcatcagaaaatgccgccagtcaatttcaaaaattttggtaaatttcaacagaaacaccaaaagatgaaacggcaattcaacgacaaaaacggcgccaaaaccatcactttccaaaatggagaaccagttttcatttggaatttgaaaggcaataaggcaaattggttgccggcgacgattatcgagagagttggcaactctccgacttatcgagtcgacgttccgacgctccgttgcgcagtccaccgccttgtcaaccaaattcgccgccgtttcccaatggaaatggagacatcgcaaattggccaagcaaatggaaatattttggctgggaaccaaccaaatcggaccccccattaaggagattgaaaaagccaaatccccaattggccaaaatcaaaatgcgccgcgaagatcagcacgcgccaagagggcacctcagcagctgaacatggacccgtcgaagcggaagtacgatgtattccggccatgatctcgcgcagagggatttttccaaagaagggaggtgttggataagggaacaactctattgattatattttccctttcactccctctcttattgactctcgccccgccccttgaccagccccataaatatgtctccctttccctcactccgggcattctccctttcattccaccatttcattattttatttatttattccctgctgtcctccatatttatttgtttaataaattatttatttatttatttgacaacatttgttttggtcgaagaccaaacatttttattgttgtagtaaatacacaacagacacactgccacccaaaccgatgaattttatggaataggtattctaattgaccaattaggtcaggtcagcaaacatcaaatctcactgataatgtggaattgataattaattgattatggaggaataattatataaataaaataaaataataaatgagcaaaaaaatgctgaaaatggagaaataaatttcatcgccgccacattcaaaatcccaaatgcttctgactaatggacaacaaaaaaaacatgaaaataaatgttataaaatctgaaggaatgagaatgtaacatttcatactcataaggtaaaaatgtc

SEQ ID NO: 13897 - DNA, 3363 bp, Heterodera glycines
accaaaagaacgagttttcttaaatttaatgctgttcaattcatctatgattaaaaagtgtaagtttgaacccgatttgggagataggcgcaaatgtctggacacgctttatccatttgaatcactgtgaaacctatcgtaccttttcaaatgcagcaaaaagttcaaagcgactaaaacactaattctgtaaaacttaaataatgggacgtcctgaggaacgaattagcccttttaagagacgcagtccgcttggcattgttcgtgttcattttttaaattttatttcaaatgttttgtttagatttcgaaaaaggttcgcgactgtcttttttccgcttcgtcggcatttggtcgttctttctctttggtcattagcaacaaatggaacggtccgtccattcgttgttttttgtttctgtttttccctcatcttttccacttttatgcttttttccttttccagttgaacaacataagctctcgtcacttccacttgagcttctgttccatttgttcgattcggcaaccggtcctttttcactttacaaacttttgtgaacaatttccatttcattttcagttgccgacttgcagaatataagccttatcagccacagtcatctgttcaaaatgctcggctatttgacttccatcaatttcagcaaacgatttgcatctttgctgaatgcatcatttgtctccagcggaggcactgacaattccaaaaagcattgcgaccgtatcgagaaaagtgtcagcgaatatggtccttttttatttaaatttattaatttttaacttactattaattggattgtcgtcctttttcagcacgtctcatccgaatttgtcatatttttcgaacacgcgaagaatgcatttgttttaccgttaatttgttctcaaaacttaactatgtcatcaaccgtaagggatttgaatgctttggagcgatttggggaatactcataacagaagtgaatggattggggggaggatttcgactgagttgccctttggtttcgcagatatccgccaattggtctcagaaggagttcttcactttgatgcaaactctgatcaactctttcgggttggctgaacgagttgaccccgttttgcgttctgaggtggatttgattaaatttccaatgtgttcaattgtttctttctcaaaggacactctgtggggggaggagttgctcctccgccgtttgctccgtggccttttcttcgaccatcgctgtccctcgtcgtcagtgtccgtcccctgccaaactccgcgtcgtttctccccccataacgcgtcattccgtctctctgcgcttctccgtttgttggcgcctgattctctgctcactgcccaccgtttgctgctcattgtcggtgctccaattggcgtcagtgttgcgcatggacaaataaacgacacggaaaacaacgaaatcagtgcagggaaaggtaaacggaccataagtggacaagagggaagttaagaggggggattctgtatttcgtacgggggtccgaagaatttcataaggttttcgaagaaaagcgaaaaaacaaatattctttgtcaataaattgctgaataatttataattttcaaaggtaattaattattattttttaaaatgcattcaaagcaaacggaacccataattaaactttgttatttgtgttgtattacattagtgcattcaatcacttttcattttcactttgttctcagaattcgtggattaccaacgcatttacacggaaccaattggcgatttggacagtgctcatgcaattcttggtgaattgccatcgatggtctctttgctgttggaaacatctgatgccgttgaatctgaggagttgcgctggaacgacttggaagtgttcaactgtttggagatgcttacaagtgaaaaagcaaaaatattgtttttgttgcccaatactttagtcatttttttaattttaaagcattttatttatcgctagaaatggacattttacctgctaattttatcaaatttctcccttccattagcatttcccgagccttgggtgcttcgcaattttgccgctttgctcataatggcccctggcctcgcccgtgtggcggtgcaaacgcgcgcaatgcatggaaatcctggcgaagcgggcagcacatttgtcagttgcattgaggtaattgggtacaattctttaacaaaattttgattcgttcttccataaaataaggcattcgaaatgttgacataatataattagttggcggcgcttctttaggccagcattctgctcaaataccaagcgtccattctgttgcgtgacactctccactctttgctgaccaattgcgagccgtccgtctgtttggtggtggtgcgtgaggccgtctcctgcatgtaccaacacacattggagattctgcccaccaacgaacaaaactgtgtgtaccctttcccttgttttttctcttttaggcaataaccgaacgattttcagtggccggccaactctttgacatggatttgttgcgaattgcgctggaaatcagtcgtcaggtcgccgagatgtttctctcccatttgcacttcattttggtctgacctttgctcattgtttcccttttgttgtaaattgctttttcaatgtaatattatttatcctatctcttccaattctcttctcatatttatcctctttcttctaatttctctcctcctaatgcatctcactttgcttctgtgccttgtgatattttgtcattttccttgccatattaaatttttgccaaccaatcaccaccgtattttgtgccatttcttcaatcttctgttaatttattttaaattgtataaaatccgctatttaaaaaataataatctatgccttctttaattgtttattttataaataaatagacaaatacatatatgcgtgtatattaaattgtgaatctcaaaatactcggttttctgttttatatttttcgttaataaaggaaaacggtgtcttgctctttcgatttttgttcttcattcgtttgcttttttctcccctttaatgcccaaaataacaaaacgcaaggggcgaattgtgccaaaactgcgcttatcaaaagccaaaaggaaaagcccaacctggaaaagatggggagaagggattattgggaatttgacagttcacatactaagtaaatgaattatcaaaaaagtgccctttcccatcgcccaatttaccggacgcatccctccgatgagaaaccagcggaaatatgttcggacaaaagcacattgtggcgaaaccgagtgaagaattgccagaggaaaagtgcggcacaaatgccgtaggaaacag

SEQ ID NO: 13898 - DNA, 3047 bp, Heterodera glycines
  misc_feature (16)..(16): n is a, c, g, or t
aaatatagatttatantggtctaaaaaccttcagtaaaccctaaaattttaacctagaaaagcttttttagtccctttcttcgtaacatataagcaaaaaaaaaagtaaaaccatacaatttataattctatttataatgtccggttttggccgtaacgatcattgtcgctgtccaagagcagcatataaaagtgtggctgcaataattagtgtcctccgcccgctaccttcctttggttctatgttaaatgagcttatattaaagatggccatcagcagagcctacttcatggcacgacaaatttgccagaatgaggagttttttctccggcacgaaatcaaaatagggttgaacccggatatttctctcacgggaaattccatcggggcggctgccatgttagcaaccgtatcgttagcaaaaaaacgaccggtgcgcatggacacaattgtaaccggcgctgttgaacataatggcgacattgatggcgtcggggaaataataccgaaagtggagggggccgtccagcatggattgagccggattgttgtcccgctgctgaatggccatgaagtcgccgatttggccggcattgaaatcatccccatagtggactgtcaagaagttgtggacgaaatgatgtgttgaggcatattattaaaatgatttgatttttaaatgttgagaaattatcacttaaattaaaaaaatatgtattttttacattttactcgtaggtaaattattttaccgtcacctgttcattactcattttcaaaaacacaaatttattttttgaaaattcattgttcgtggttgcgaaatgtcgggatcaacaaggttgggatcgggttgggagccgggactaggattttaattgtttccttatcgcgaatttaaattttcgcagtcgcgaatcgtggatcgcggcaaacacggaaatttcactaatttaaaatctcgttgcgtcttaaaaagcgaacattttcttgccagctgaccaaacctttaattacgctttcgatgcccctgcaaaaggcattattctcgacgtcaatcccgctcttggcaccaccagctccggcactgatcagttgacagatcaatcaaccccggagaaaagacccacccattcttccgccggttattcggctgttgttcttgcctatcattgctgatcagtagggatgggaatttttgggatctttctacatattacatatgtacatatttttatacatattttggactttttcgtacatattttcattttttttacatattttgaggatttttgagaatttatagaaattttttgtgaaaaataaaaaataaattttttgaaaatgtatccctcctaaaatcgatttttttttcaaaaaatgatatatcaaaaattaatttttgaaataatataatgtgattataagcctattttgctcatttttatggcattttgtgcctatttcactttttacgaagaatttttttccaaaaaataatcatttaaaaaatttttatttacatattttagtacatatttggggatttttgtgcatatttcataaatatttcaccattttttatacatattttatttacatatttcgcgattttaaagttgtcttgccagcgacgacgttccaacgttttgcactggcacaatgggggcgcaaccggacggaactgaaacagcgtgtcggttggcagcgactgctcgtcaggccctccttgacgaaggaagaattggcggctgagcgggagacacgtgaacaaaggcggatgaattatgaagaaagcaaaaagaacgaaatggtgacgacgcggcgtggaggcaaaatggaaaaaaacttttgaggtcacaaaactttctcaattgtttttactttaactcaagaagttttgtaaacaaaatggatgagtttaggcttttacttttagaaaataggtataaaattatcgcaataaccgaaagctggttgaacaataaaataagcgactcgcaaattttagaaaattttcctttttctttaataagaaaagatagaaaaaataaaaagggaggaggggtagcgtttgtcatttttaatgaaataccgtttgaaattataaaaactccaaaaatacaaaattctgatatactttgtatcgatgttttttcgcccattgccgaatcaaaaatccgtcttattttggtttatagacctgtaactactgaaacactcgaaaatgttatgcaacttgtagaattaatttcgtcactaacagcagttggtcccccattctcacttagtgattacaacactgtaaaattcgacttaagactaaatgtttttccttgtagaaaatttaaacactttaactttaaaaaagctagttacttggaaataaatgccatactctcttctactgattgggttacctttttttcggactgtatagaaattgaccaaatttataacaaattcgcagcatttttacattttttagtatcgaaatatgttccattaacagtatcaaattttaaacataatttcccagaccatattaaaaaaaaattatgatttatcgtcggcaactttggaaagacattaaaaaagaaaaaactagagaaaaatttatagaaacctctaaaaaacttgaatatgaaataaagaaataccttacaaatcgtgaaaataaatttttaagtggtttagaccctaaacaacggtgccatgtgatttcgtcagaagtgatttcgccagtgattgatttcgccagtgagtgatttcgccccgggaaatattttgaaaatttcggcgtctgtatttgatttcagattatgtcaaaaaattgtacacattttggggtccggtggtgccgataggcaccgccgtggaaaattttgaaaatctaagtgacattacgctataaaattacaaattttctgaagaatttttaaaaataagaacaattgcccgaaatcagagcagcgcttaggcggtgccatttgttagtaccattaaaggtgctaaattaaaaacaaaagagaaaaacaataaa

SEQ ID NO: 13899 - DNA, 1511 bp, Heterodera glycines
accctagaaaaagattaaagaaaattttatctcttttttccgtcgggacaccaattccgaaggaataccaagactataccatgaataactcttcgttacataggtaaaaaacgggttgggttgtatgtactagtaataaataatgcattccaaaaaaaggttttggaaaattaatagtattacacgagcggttgggcacgcgggtattaaagacaataaatggcacgcaccaagatttatgaagattgttgcatttgttcagcaaagttaatgttaaacagtggcgagaagtcagtcttttggggattaattattcacttttagaggagggggaaattggggaaaaaatcaaaacaaaaaataaataaaacaaaacgaaacgaaaaatttgtgaataatcaaagtgaattgagttgactgacaatttgtgaaggccatttcgtgacaaaggcaattcaaatgggcgaaaagcaaagaaaggcaaaagaaaggtgaacgaaaagtgaaagaaaagtggtggttacggctgatttatgactttttatggttgggaattgctcccggcggagtgttcttttcacgcagcacaaaaacacattttgcccgaagcaaaagcaatcagtggaccaacgaaatgccaaaaacaaagcggcaaataatacggaaaggaaaggacacgcgcattttgtggatgccgaaatatggactaaccgtcgacggatgggccgaccattattcgctgcaataatcggaaatgcaaatttcgggcgaatctcgcgggccttcctccttttgccataatctcgcgacgcccacactttaaacgatcgcatgggcgcaaacaaagcgaagggctcagagtccgctcgaagacggtacggtccctttggccgttccatttgatcgtcgttgaaaagggggagagaggaggggggggggggggaaggaatgcgccaaaagcggacgccacggcaaataatttaatcgcatcaccgaaggaaggccataaaactgtcccaatcatcaaaagaagggagcggagaggttcctaataggggggggggggggaattgttaccggagtcgtttattcttcattattcagataattgaccggatgattgaatacgatagttaaaatccgtgcttcagcatgggtatatgtgctgatacagaggtgaagaggatgatcatgtagacaaaaatcgaacaggccatggacaattaactataattatttgaaagagtaaaaaaaggatttaggattagtgtaaaagtcatatcttttccgtctcagatacagagaaagcaatggacatcattatcttctcctctgcgatcaccaactggttcatatgagaaactactgattgtgacattataaacatttgtgaaatttgtaattatatgtatattatgaactataataattgttgtttaaatgagataaattatttcaaattccggtttatttcattatttgtggaagtttgataatagatatcgagattg

SEQ ID NO: 13900 - DNA, 1193 bp, Heterodera glycines
  misc_feature (1106)..(1106): n is a, c, g, or t
ccaccaagttcacatttagtctcttccaccgatacttttttctttcttccttttctcttcctctcatgtttctctctttctttccgtcctcttcttttcttcctctttcctttctctccttcacattcctcttctcttcctctcatgtttctttccgtcctcttttcttcccttttgttcctctttcctttctctttctctttcctttctcttcctctttcctttctctccttgacattcctccctttttttcgtcctcttcttttcctctttcttttctctccctcacattcctcttcccgctcctttcttcctcccactcgtgtttttccgtgtcactcctcctttgccaactttcccttccgctttctctttctccctcacttgcttctcggttgctctctcccttttccccgctccctcttcctttctgctcccctttctctcgttctgtccgctttttcctccttttccctttaactctttcgttcggtttattgctttgagcagcttttccctgaatgattcgttcagctgctgctgtttgtgagaaagtgttttcgcttctctgttccgatggcgccgtttggaaatgggccgcaattcatgcgcaaattgcgaagctttggaagtgatcatttgttatgatactaaagggaggcttctgttctgatcaccttcgacttccgttggttttcccttgggacgaaatcggtccgaaatttgccccgatgggaacaaacgcccggatcgaatcagcgaaaaaagagtgggaaaagcaaacggtccgagggactgaaaaggaccttcgtttctctgttttcctaaagttcggaatggaaatcactttcattaaaatacaaaaactcttcccaaataccattctctggtgccgaaattggaaaatgttccaatgaaacagctccaaattggagttttggctgctgtgagttgtccttccgaagactgaggccataatgaaaaggcgaaaaacggacgaaatcactgaaacgcggcacggcatcgaccgtcaaaagatcggtgtcatcttcggagacaaaacgatcgaatggcttagaaaggggggggggggatactatactggngatattttatacaaaatgaattattttgagcatgtctttaaaaaattaattatggcggattagtcgtccgacggtgtcgaaaaactc

SEQ ID NO: 13901 - DNA, 1561 bp, Heterodera glycines
  misc_feature (104)..(104): n is a, c, g, or t
aaagtgacgacggacgacagtaacgggcgacaaatcagcggcgaaacactccgatggtacaccgagaaaaacaattgctccgaggaaacaattaaatcccttanccaagccgtttcatcacgcgttcctttgtttgtaaacggaggaggagagaaggcgatcaagtgcataagcataattaatacacaaaatgtaattgcatgatgttaattgactcgcactaaccaaggacatccgtttcggaattaacaaaaacattgggagtgaataccacaagattaacagtcggataatgttaatttaatgataaaaatgtgaaatttctgttgggtttattcaaagcttcttccttaaataagatgatttttttagaaaatgaataacaaaaagtgcgatcaaccatttaatgtaattccgtccgtctttatctttcattgtgttgccattcttttccattatttttctgccccggcagaatgtcctgatgagaccgaacgagaacgcgaacgagagcggccgttcttcactaaaacattttgttgtaccgaaaaatttcgttttttgactaatagcatatttaaaacattaattgagtagcactaaccgggcgaacgcgagtcacggcgagaaggtggagaagagcgggagcgagaacgaggcgagcgggaacgaggtgagcgagaacgagaacgcggcgaacgagaacggctgaaaaaagatgttcgttttgtccgttagttccttcatccctcgagttttttctggatttaggccttccctttgcgtgtctaaaggaatggaagctggaaagagtgcccatgggaatgcaccttcatgacaataaaccacacttttaaccgtagttaccacaattattctcatctaaatgctatgcatttacctccgagttcggcgccctcctccccctcctccttcgctttcatccacgagttttatgcgacgtccattgatgtcttttcctaaagcaatgcaattgaccaagatatttaacaaataaaaaaaaataccctgaaatttgtctattgcgcgacgcatgtcatcacgattagcaaagcaaacgaagccttcgttcggttttttgtgcgcatcggcgtaagttacttcagcgtatctgcgcatcatgtccttgagctcctgaaaaaaagaattatttacaagaaatattataacagacacccaaaaacatgacaaacggattattgaaaaatgaaagactaatgataataaaaaatgcagattggttcatttacattttttgaaatgattgaattgagttctaagatatcgtgaaacacaccagttagaaatagttggccattttttgctcatcagttcaattttgctgaatctgacaaccggtttatggcttgcgagtcttttttgcccgtggctggctcgactacattccttggccggtacaacgaaattcgagaggtgaggcctagcctcgaagaaagaagcttcgggcactgattgtgagaaactggaccccttggttaaaatggcatcttttgcagcaaagaggcaaatatcgggctgg

SEQ ID NO: 13902 - DNA, 3736 bp, Heterodera glycines
  misc_feature (706)..(706): n is a, c, g, or t
ttaagaggaataaaatattcagaaaagcattaacgaacatttggaggaattcgagggacgacagaatggggaaaacgaacgtttggaaagaaaaatcgacaatttggggcgaaaatttggacgcgccaatttaaaaggggaaaataaggaggaaaaaacggaagaatttctatcggaggatgatgagcaatgaattgaattggaggggaataaaagatgaatttttgtaataatttactgatttgatttatctgatcttttttctcactcttttattttttgtctgaatctttttgaaaataaatggagcaaagcttttaattaattaattcaaaatagttgaaaaattaaaaaaacacggtttttgtgagtaaacaattgacagaaaagagggattagaaaaaatcggtcggttttgaagagattgagacggcaccgtccacagttatcgttgctgaaattggcaaatgttaaaaaaatcgtaaaaaagtaattaatatttttagtgcgaatttgaaatttaaaaatggaataaataaaacgattaaattattcaaatgccaaaacacccccggtgatgtaagaggcgtcgtcgctggccaaaaatgccacgactttgccaatttcctccgccgtccctccgcgacccatcggcacgtgatttttgatccaattcaactcgaacttcaacaattgcatgatcaanattgagtggagtgttcactcactcactttgttcgctctgttgtcgtcttcgtccaaagtttcgccgatgataaaaccggggcttaatcagaccaattaattaactaattaattaatgactaatcgattggccaatttgttaggtattttacttaatgttgttcactcgaatgtcgcgctttgcaaatttaacagcgattgagcggcaataattgtctgaattcattcattgtcagtggacaaaatcacaccattttacgcttttcgcaacctaaagcattttttatggtgctgtaataagtgtagtcggacagctgaaaaaaggaaaattaaaaaataatataaaataaattattttaaattcaaaaacattacggaacgctgtgtgccgaaactgctgatgttcactacggcaccctttgtttcttcgagataaggcgcgcacaaacgggtcaatttggcgatactgtggggagagagaaagcgaaaataatgaaaacgataaattaaaaaaataaaatatttaaattataatgagaaaaaaaacaattttattttatttttgcaaaaaataaaaacctcttcaaatttatgttaaacaaaaagtcaaaatcgttgtccaaagctccaaaaattgagcaagtgcggcgactggtcattgccgttgctgaggaagaagtccttcgaaagccgcggaagccgtggtaccgaaaaagagagggcaaattcacagcaaaagcatcgcaaaggcccaattaaatcaaatctccgagtgatccgatcaaagtgatcagctgctgctctctgatcgttttaagcaattaatttgctttgattggacggcatcaatggagaaattgcccggggtaggggatgggattaagaattccgattttagaaggcattaaattccgacgacttccatggatttggcatcggcactttcccaatccgtgccaacattgggtccttcccccaagggcacctcccgcgtcctccgtcctcctcctcggctccgttttgcccatttgtgtagtcgtagccgtaattattgctgctggtgctgttattgctgttgctgttctgccgcgatcgttggtgctgaagaatgctgccggcgttgttcaccttggcatttacttttatttttaaaattccgccatttttggcaattttctcaccaaaacatcgatttggccaaatttattgtacgtccgttcgaccaaatttttcagggtcttaattgtgcaagtcattagagtgtgccaattaatggagttgacttggtcgttgtcaatggcaccctccaccaccaaaatgtcgtcctgcgaaacgtccgccattctgaccatttgcaccaccgtccgctgaatgttttgccaattaaaactcggggtttgcttcttctacatgcaattcggcctcttcagtgccctgaattgtcactttggctccctctttgccgaataaaattgcggtggcccggtcaatgccacaattggactctgtgccgtcgtggccaaaatgttttacggaatccgttttgattatgaccaacccgtgataatggccactttgccctcaaagcgtcgtcttcggtcagtggaggtggcactcgtattcgtgtttgcttcttccgtgccaaaatttgcttcttccatcgaactctcgtcaatactcattgaattcattattattaatttaaaaggtaattaatttattttaaattattttttgattggaataaattatttttgttagtttaaaatatttaaaatttaaaaacaaggaaattccaaatttagttattttgcagctaaatgtcgctcaagatttagagttgaagttggtcgccgagttgtgaaattcgctctgactcgcctccgatcaatttcagactaaaattttggctctaaaatgtttgcgcgtgtgaaatttgactccgtttttgagacattttctgcattttcttcccccgtttcatccgtccgtcttttgtgatttctctctctcccccctcgcgtcaaatccgctcctaaaacgcctgccgattccaaacggagagaaattgggaaaaacaaataaattgcgaaacaaaacaaatcggatgattggcaattgtcttcgttgtgaaagcacgcaaaaataccacagagatactgatactgacattagtttttttatttaaattaatagtagcattttgttcaaagcaattaaaaagttgaaaagtgccattttcggagtccacaaacagcacgtccggagattcaggcgttcagttggtgaaatgtgaccactttggaaaatttatgtctcttacaaaacacatagaaacaaattaaatgttggattagacaatattggaaaatgagctgatgcatttggtttaaacatctcccaaaataaaacatttattttatttcttggcaaaaataactcaaaacaacaatatattattcaacaatgttattaacaggtagccagatctgaggctttagcctcattttgtggttttttgataggtcaatgaggctaaattttaaaatgaggcttttgaggctttttgtggttttttgagaaattttgaggatttttgaggcttctggggaaaatcgtcagatcttttaaattttgtttaaatttgatgttattaccattttttccgaaaatccacaaattaaacttgctcaaaatcgaaaaatatggccatttttatggacaaatccgttaacaaatcgcattaaaaattacaaaaattttcccggaggtgcctatcggcaccgccccccccccccttgttccccaaaagtatttggaaaaagcgccgcaaaaaaaatctgcttcgatttttcatgcttagaatttaataaaatgcttatttctaataaaaaattgcccaaattgatcatggacaatcacaaatgtaacatttgaatattttaaacatgttttgaataaattttgtaaaaatgaggctttttgaccctaaacgaggtttttttgcgtgcaaatgacgcttctgaaaatt

SEQ ID NO: 13903 - DNA, 2694 bp, Heterodera glycines
  misc_feature (32)..(32): n is a, c, g, or t
  misc_feature (80)..(80): n is a, c, g, or t
aaaaaaagttagtaaaacacaaaaaaaaaagntgtatttttacatgccctcctagcaaaattccgacccccctccccctntttatgtagttgcgcattttagaccaatcccttttttaattatttgtttcatcagtcgtgcttatgttcctttcccttgctttgcttcatatcgcaatctcggcgactcgcactcatccattttcgacgctggcgcgtgagttttgccgttaatattatacgattaaatttattcccctctcccatttggttcagttgcatttcgttgaacccgcactttgtcaagctggtcagttggtacaacaacgagttcggctactcctgccgtctggtcgatctgatcactcactgtgcttccaaggcataggaaagatgcgcaaaaaaggaaggatggagaagagaaatatactaattttgactttttgttttctaatcttacattttgggttttgttttaacttgtcgaaacgtggaattgctaatgtccatacataacaggtttcagcctttccgttactttgataaacgatgattgagaaatttatttatttttttttaatcaaaaagagtacatgaattaaaaattaattgtgttaagtgaactgttgagattgtgaaaatgatgggaatataaaagaaatggcatttttcccgtatttattcgactttccaataattggagtccaagtcatgggtgttgtggttgttgttgggccgccaccagcagggcttgctatggaaaaaattgatttccttaaccaaattcaaaactgcttttaaaaacactctaattggtgtaaaaaggatagaatgagaaaaataaaataaggggagcgcatgccctttttagattgaaaaagtgccggatttgagtttggtgactaagaccaatatttaccagatgttgctgcagcccctccaaaagattttgtgctgtttcgattcgccccacggattccgccgcatttccctgctctaacaactcgacagcctgccgaatgtgaccgatggaatcaatgaattgggcaaaatgattgaacatgtgtaaatcgcccaaagaggataaaacatttcgtaaaagagccagagctctttgttcgttgttgttgttgttaagtaaaataacaatgcatggaagagcagagatggcaacggtaaatgctcgaccagacttaaatttgaatttgagacgctgcaataaaagtatttagagagctctgtcgagtttaaaaccattattttatgtcaaaattttcattaaataaaccgtacaaatattccaaatcggcgctacttattgaaagcgtcgcgtccgtttatattaatatacaattttttcgcattcaaattatttttttggactcggtccaataaaattggtataccaaaaaaccttttaacataagattctattacttaaaccattttaaaaaattttgaagacttgaccgggcccaaaagcgtctaatttgactcagacccgacccgaccaaccattcttgcaagttgcaaagcggcaaatggattcgcaaccttaatttggttaaaaaatattatgtatacttatacaaaaagctaaccatttttaaaatgtagaattttttgtttaacggcatgttaatatcttaggataagataggcactccaaaggtactaaaaggacaacgaaactttggcattgtacatgcataaacaaaacaaatcaggcattcgctccaaattaaatataatttaaatctcagcgccggtttagctcagttgggccgagacggttgggccccagcatgcttttccactataacttttttctattttaaccaaatccaacattgttggtatgtatcaatcgaaagcttaatgcttgactcaaatcccgatctacagtccggtctctaaaaactactctttcttttctaaaaaaggaaacttttcaaatacccctgaactgattgttttctcttatgcctcctctaaaaagctatgatcccgacattaaaagaatttttttttcaaaaattttaagaatgtggggcgtgaaaccgtccgtttccattcctccgctaatggtgatcctcaaacattaccatacccagttccattttaattaaattttgaaaaacgccaaaacatttcaaaatttttgaaataaaaaatagagaccggcgcggaacgggccaactccgtctggccaactccgtctgagccaactttgagtcaatataactcttgaatttattgaccgaatcaaacaatcttgatatcattcgaaagctcttcacaggctctattagcctactaaaaattacagaaaatttcgaactataaaaaaagatagaaataaaaaactttgaaaattctgccttttttgcggctttaaactgacaacctttttgagagctgattaatcacgcttataaatatcttctaaacatctagggctttcgaatgatattatgattgtgaagtttgatcaacaaagaaaaaagttatagctttttgaacattgctgagacggagttacggagttgacccttaccgagaccggcggcatcgggactcccgcggccgcgggactccaaaatttcctaacaaaaagttaaaaacctgctagataaaataataaataccctttttttgtttagcctttaagataacataatgcatgtacaatacc

SEQ ID NO: 13904 - DNA, 2613 bp, Heterodera glycines
agtaaaacgaaatggcaaacctcatcctcaaaaacattcgagcagacaaagctcagactgttcatctttttctgctgacgaacgaccgaagaaaagcagagcctggaaaagcaaaagaaagaaaaaacaaataaataaataatggtaactaaatttgcatttgctttcgttcaattgaaactcgatccgccgattttcgcggcatttccccccccccctcattcgccccctccccttttcccccttcgcccttcggctgtttactttgtccacccattgcgctgtttcttcctcctccatccaataatttccttgtttttgttgctgatgttcgccttcaaaacggcccaaatattggaggatccattgagtgaccagcaaatgcggggacgggggcgaaagcggggacagaacgggggaagtgccgctgacattggaaattggcgaaagcggcgagggaatgtcggcgttggtcggcgcagagttcaaagagcgccgagggcgaaatttgggcgaattccgaccatcccaaattggccctgagggcattgagtcgccgcacttttggagaaaaacggacggagggggcgaaaaaaggcggcatttcttggaaaggggaaaaaactcgacatggcaaaggaaatggcattggaaaagtgttcagtcagtgccttgtaacgatccgagcgacggaaaggcaaaggcaaacgatggaagggcaaccgccgccggggagagcccgcgggggacgacgagggacggcccggggacgaagacggacaccgctgaaagggcagagggacgacttggccatttggcaaattcgtaccctgacagtgagccacgcttcacaacgccgtcgcatcactttgcgcattttggccaccacctccaaatggcccaattcggcgacactttcccggtcaatggccaaaagttggtcgttcgactgaattcgtaagttttttcccttcaattttggtcatccttatcaaaatggcgatttgttcaccttgagtccgtttctgtgtgcaattcctccgtcgatcactttgagtttggccggcccggccccttccaaagtgaggccaaagccaaaagaggacgaacaattggaggaggagcagcggaggaagacggtgatcagttttgggggacgaggtaaagggagggggccaaatcgggcggaggaggagggggaagaagaagaggaggaaagcatcggcaaatttaaaaaataaataaaaaagaggaggagtaggaggaagaaaagaggaagaggaggagtaggaggaagaaaagaggaagaggaggagtaggaggaagaaaagaggaagaggaggagtaggaggaagaaaagaggaagaggaggagtaggaggaagaaaagaggaagaggaggagtaggaggaagaaaagaggaagaggaggagtaggaggaagaaaagaggaagaggaggagtaggaggaagaaaagaggaagaggaggagtaggaggaagaaaagaggaggagggggatgaagggaaaggaggagaaaagaatcgaaaatttaaaaaatgagggaaaatggaaagaaaaaaaagtttttttctgctgaatgcccaacagatggaaaagggtgggaaatgacctctccacagaaggaacagaaaagggacggcactgatttattattattttttgcatttgtaagggcaaacaaacgaaaaaagagaaataaataaaaaaggcaaagatcggccgatgggtgggcaaacattgcgcaaattaaacaccaaacggacaaaaacagaacagcagcagacaaacagcgaaaagtaattatttaatcactaattatggtaattaggtttttggttttgtttttccccaaagtcggcccatttgtggcgaattttgagaaaataaataattttataaaataataatgcagtaaagtaaactctcttctacctgagagtttttggtgccattgcacccggacgattcaaggaatttttgtttctgagaaagagaaattcaaaatttaggagagaatgaaattaaattaaattttaatttcattaattggaaatgttcaaaattggacatttaatgaatgggcagatgggtaacgggaaaacatgggagaaatttggaaaaaaatgaaaattgcaaaaaatgcgagtgaaataaatgattttgaaaataaaattaattttaaaatttaaatttacatttcatcgcaccattcgtcttcacaatggaaatgcatttggcttctcttttcctctctttttatactctttcttccatcttcgttttgtgccgtgttttatcatttgtcattctgtcatttttacaataatctgtgacatttccaagtgaaaaaaggcaaatggacaaacgaatgagtgatggacaacagaaaaagggtgactaagggcagagattaacaatcggacgacacaagccaatctgagaaagttaaacaaacatttttgcgggttttaggcaattagtggcattttcctgtgccattggcacgccaacagcgcgaaaatgcgaaacatttgtcgctatttggcgttaaaagtattaaaaaatctaattctgcttcttctgtgtataat

SEQ ID NO: 13905 - DNA, 1166 bp, Heterodera glycines
  misc_feature (18)..(18): n is a, c, g, or t
agaacagcagcagacaancagcgaaaagtaattatttaatcactattatgggtaattaggtttttggttttgtttttccccaaagtcggcccatttgtggcgaattttgagaaaataaataattttataaaataataatgcagtaaagtaaactctcttctacctgagagtttttggtgccattgcacccggacgattcaacgaatttttgtttctgagaaagagccaaagagaacttcaaaatttaggagagaatgaaattaaattaaattttaatttcattaattggaaatgttcaaaattggacatttaatgaatgagcagatgggtaacgggataaacatgggagaaatttggaaaaaaatgaaaattgcaaaaactgcgagtgaaataaatgattttgaaaataaaattaattttaaaatttaaatttacatttcatcgcaccattcgtcttcacaatggaaatgcatttggcttctcttttcctctctttttatactctttcttccatcttcgttttgtgccgtgttttatcatttgtcatttctgtcatttttacaataatctgtgacatttccaagtgaaaaaaggcaaatggacaaacgaatgagtgatggacaacagaaaaagggtgactaagggcagagattaacaatcggacgacacaagccaatctgagaaagttaaacaaacatttttgcgggttttaggcaattagtggcattttcctgtgccattggcacgccaacagcgcgaaaatgcgaaacatttgtcgctatttggcgtttggaatattaaaaaatctaattctgcttcttctgtgtataataattttataaagcaatccgaaattgtttgcttgtgcttctcacacacttccattaaaattaattaccgttaattattcaaataataatgcctaattatgctcccgactgtgcagctgattcatcgcattttaagatcccatttattgtcaatcacaaaaaatttaaaaacaaatagattcatagaatattctataataaattcaacaaatagttggaatttgcgccaattgttgtcaaagcataaggaccaaaaatgtaaaaaaataaaattttcattaataattaatcattaattaatcgcagtgctccaatttttttcgtttggtatttttc

SEQ ID NO: 13906 - DNA, 2270 bp, Heterodera glycines
tgttagtgtttttcaaaatttggcaaaaaaaaatcttcgatttgatcatttccgaattgaaatctctttttttttggaggtctttatgttactttatacatatagttttataataataattgtttgtttcagtccgagttggacttgaagattccgattgtgtgccgtctgcaggggacgcgcgtggaagacgcaaaagcgctgattgcaaactcgaaaatgcggatattggcatgcgactcgctgcaggaggcggccaaaatggccgtaaaggtaggcatcagctcgttttcctcccagacagtccccccccccagaaaattaaataaaatttaccaattttattaagaaaaaatcttagtttttttacaagaaaattccagaaaaaaaataaacttcatgatgaatcaatcactaagatttttcgaaattttttcaaaaaatcgctgaaaaaattttcaagaatttttttcttcgaatttccttacaaaaaattttctaagatttttttctttggacaaattcttagttgataaatttttcaacaatattttccccacattcactgtgcttcttcccctcccccttttcagctcagttcgattgtgacgctggccaaagaagcggcggtcgacgtgaaatttgaactgtcaatttgattaggctttatttgaccgactgacgacgtgtagaaagaaatggacacagagaaagaaagagatgtagaaattcgtaaatttgtaagataaaaaaagcaattattcgatcattagcattaatgatcgccggtatttcctagtgcaaatgaaatgtaacaaccaatcaatcaatccatacggcatacatatgtataaaacgatggacacgctcaattattattattattttattagcaattaaaaataaaacacaaaaaatgcacattagtgctgttcatattttcgggattaatacgttatgtgtgctcgaaaataattctgcttttcccgtcataaaaaaatatatgaaaaaacctctccatttttcgggaaataggtttaaaaataacgtaaatacccttaattaccttttaaacacaaacagaaaaaatggatcgtaacactttattatacatagataaaaaacaattattgttcattattaaaagtatcaaacatttaagaacattgaattgtacaaaaacaatgttgaccttcttttatggttgttttcttcatagttttgggtcaattcccctgtaaaaataaaacttttcgtaaaaattcaaagtttttcttactcaataaatatataataataattttttgtaaaaattgaatttttgctaaattaaacgattattatgtgcttatttacgcttttgcccaccatttttgcaaatctttgcgctcggcgatttccgattttagccaaacattttgaaaaagtccgttttgaaagtcacttttaaccctttcgtcaaatttctttttcaaattggccttcattttgcctttaaatgagttattcggcctttttggctccaattcaatgcccacaagccatagcctcgtacaaagtgcgtttccgctgccattacttaaaaagttaaagtttaaattagaagaatttcataaagtttttttttaatataaattggcaaaatctctattgaaaattaatcaaaatttcaactggattcgctcattggcaccgtcgactggcttttctccctaataattcttcagaatttaatccaaaagcgccctcgaaaattagccattttgactcaaaccctattaagaagtcttaattttaagacccgatgtaaaaaatgtcgatggtgggacgtataataaaacttttttgggacaaaactcaaagcgctttttccatgggaatcgcatcccctgggggtctgtctgtccgttgaaaattcataaaaatgcaataaaaagtttatttaattgccatattaatttctctctttaataaggattgaaaatgtttatttatttattttatattgcgtgaaaatgatttttacccctttttggcggaacattcctcgctggacggagtgatcgcttttgggaacacatggcaaaagcgcacccaaagtgccaacggtttctccacaaattcgagcagttcatagcgcaagcgattgccaacaaaatcgtagaatttgtccacgttatgagttgggcctttgcattcgaccacaatgaaatggtcgtactattgtaaatgtacgttaatttttatttttccattttttaaatttactt

SEQ ID NO: 13907 - DNA, 2376 bp, Heterodera glycines
cattctccattattattctctgctcctcacaatgtttctttccgttggccaaccgaacactttggaggcaaccgctgctgcagcagctgaacgtgttgccgaggacggaaatgccaacggtggcggcactttgcctggcccaatgacttggaacttcgcgtacagtccagatctcttacggaatcgttcgttagagaacgagaggaatcgctttgttgtacatatcttgttgcacattgtgacgttttacttgaaaattctgacattgttaaaaagcaccgaattttccctctttttttgttgttgttgttgttagcctagcccagctaattcctatttttaaaaaatcagcgccaaaatggtaagttcaaaaagcaaacaaatatcatcaatcaacaaattgataaaacgcaacaatgatcggtcatttgtcaaatgatcacttcttcttcttccgctaatcactgggcccggaaaaagagaacactttttcgtcgctttggtctgttggcggagacaacggcctaaattaagcaagcgaaaatagagcctggaatttttgaaaaaacccgggccatgcaggacatggaatccgagatggaccagcagaacaggactggaaaactgaggaacgaaatcctgttttaataggaacccctggccctgccaagaatctgtgaaagtactgtacagaggtatcaaaatcgcaaaatttggtattattgatttttaaatttggaatagaattttacaaaatgatgacttgaccacaaataccgctttttaaattttcaattggcacaccatggttttaggcttctggttccaactgtttcatgctgttttttgctttaatgattttgactattaaatagtaaagaaaaaaattttgctttcgcattttatttttcgattagcggcctaaatatcaaaatttgaaatggattagaaaatttttttgtaagagtagagctcggaatttaaaaaaccgaggatcagggttttcaatacgataagacagggaatgaagtcccgttttaacaggaacccccggccctgccaaaaatctgggaaagtacggtaaagaggatactgtcctccctgtccgttacaaaaaaataaggccttctttccgctcacccaatgcaattttcataaagacggatgtagactcggttcaaatgctccaaattttcgtctttcttctgctgctgtttctgattcgtcttcccaatattttggcatcgtttcaacatccaattattttctgatgattctttgctcagtgtcagcttctctttggtccgttcgttcatcaatttaaattgttcaattggcgttgtttccttataaacagtaatttgaatattgtaactgacagaagtggtggcacggcgaaatgcctaaacaatgaaaaaataaacggatgtcattatttttggctttccaaatcaattgtcagggatttgatccagtcgaaacccatttttccctttaagcaaacgaattccccactcatttgtcagataaatttcactttttttttgtttgtctccctccaagacatatatttcgcaaaaattttctgaaaatgtacaaaataggcaatttttgatggaaaaacatgcaaattttgtctttttttggacaaaatctgttaacaaatcgcattaaaattacaaaaattttcccggcggcgtctatcggcaccgccggattcaccaaaagttttttggaatatgaaaaaagaaaaggtcgtctcccgggtggggtaaagcccccaggccgtaatcctgggaccgtccatgccgtccacctccttgaaattgttgacccatgcaagctttgatccatccaaataatcactgcaacgcattcgcttcggctgaccatctttgctcggcgtgtgcaaccatttcgacagaatttggccagcagaagttgcatttggcccaccaaaatcatcggcaaaaacacccgcggggcacagacaaatcgattcgatgaaactcagccgagtgaaattggtgagaattgttggcgaaatgagactgcgcaaattgaccaaatcatgaacatcgttgaaaatgaaatggcgaatggtcggcgcaaaaatgggcaaaacttcacgggaaaaagcatccaaactttgctgggcatttgtaacacacaattccaatttggtgccaattctgtcaaaaatttgcttgttggcattgagaaaagtgatgacggaatgatcgaagtagctgaacaaatacaaaaaatgcattaataataaatatagaaaatttacggaccaggccgttttcgcgtcgtgtagccctaagtttgctctattaacgtgcaagatttcgaaaaatttcgttaaggttc

SEQ ID NO: 13908 - DNA, 1425 bp, Heterodera glycines
gaaaattttttggttgcaggaggtactgtttcatttccggaaaaatggacagaattttgttctgggcttccgacgaattggagtccttttcggaaatcggttcttcaacaatttcggcacaacgcagtcccaacagatcacaaaattcagactccttgccttgcccgtccatgaaccgttgttgtaaactcacagcaaccttgtcaaaatcctcacacaaacgctgtgaagtttcataaaaagagcacctccgcggcttcgtttgaattcgtcgtcggctgaatcacttatcaaaagataaatggtcatggctcggctgtacaggatgtatgcatcctcttccttcccttcctgcatttgtgtttttcctttccgttcgacttccatcaaaaagttgagccgtgaaaaattgtcgagccgttgaagggaataaagcaatcgtttgtcaatatcggaggcataatttttgagcacttcatacgatttgtacaacaatggatgccaatttgttgatgaagatgaagtcgacataattgtttttcaacacgaaataaaacaaaaatccaatttaaagcaacacgagctttataaaaattgattggcgcagcacaacacgagtgctttagacgaatttgtaagtggacgaaataaggcgaatgaagaaaaacccaacacgagggtattaaaaatttgacgactggcgaatgaagaaacccaacacgagggtattgaaaatttgacgagttagtcgatgaacccaacacgagggttttaaaaaaattgatgagcagtcgataaacccaacacgagggttttttccaaattaggtagtcgctttttttaatgagaaattcactgaagaaaaataaagccgtccgccaccgagctaacctttgttaccaggagcgccatgttggaaaagaaggagaatttgtcggggtttcttttttttacacttccaaattttgtaacgaggggataaatgtcagtgaaattaggcaaaacctgcttttaaaaaccaaacaccaaaacaaaataaatttatccaacaaatgattaaaaagacaattcaaattaaaacaaattcagtcaacacaaaataaattaaacacaaatcaatcaacgaccaataaaacggctaaaattaacacaaacgaccactaaaatccaccaactactctagaagaaaaacaaaatatttgaggtcaattcaaataaacactatgccaaacaaattcaaacaatcaaataaagggtcaaaaagtcgggactgggtcgttttggcgccgacgttttggcgccagcctcagtttttttattataactttttttcttgttgaccaaatctaacaatcttggtatcattcgaaagcccttcagaagctctattagccttacaaaaaacaaacaaaaattttagcttct

SEQ ID NO: 13909 - DNA, 2690 bp, Heterodera glycines
tgaaactaattaatttttttaatataaatggctgtttcttcttttatggccatttttgttcagttttatcatatactttgtcactcattgggtatgtagtaatttaaagttattttttgtttatgttccatgctgataaaataatttctgttattaagttgattaagtcacatttactctcccagataaatgctttttctgtgttttcaattttaccattaaattgttacaatttgtagatagatttcttttacattttgatcgggaacattttatgtaaatatatgctggcactttgtatatatttgcttcctttttcgtcaaattttattgatcaacaatttaatatttttgtatataaatatttaaaataaacaattaattaaattaggcttgcatccttatgtttatttttcttaggttttgttataaaaaacctgtaatatttaaataaatatttacgaaaaaataccgaagtattaagctaatatttaagaaaaatgcaaaaatgtatagtgtaaaaaataattaactgtgcataacacaagcaaaaaaattattcattggctacagttgctaatttttgagattttgaatgcatttttataagtaaattacaaaaaaatgcgttttttaaatttcttcaatgcatacaagcaaatatttaatttaatataattcgcagccataattatgtggttttgtagcatttatagaaaattaaattacataattattcaaaatcaatgaagaaaattgatgttaaatgcaaaagaagtggaattaggggaggagggaggggagcagttgatggataaatgccaataatgtgctgcggaaatgccaatgatgcgaagaagggcaaggcaaatgatgcgatgagacggcgtcgttttgtgttgattggttaagaatgcagcgatagtgagagagagacacagagtgaccaatttgcgacgagaaaaagtgagagagataaagggaaaaagagagagtgagagagacacaaacagagagaccaacgagcgaagagaaagagaaaggaagttgggaaaaaacaatttttcgaagggtccccgccaatcagcatttttgtccaaaaattctttcggatccataatttagaagcctagaggaatcgattgatatcatttgtcgcaattccatgcgttttgagtagtggacggttcagtaattatcagaaatgaactgagaaattaataaatgagtttgttttataattttgtttttcttgtttgacactacttacaaatgtgagatttaaaaaaaattcattttaatttttagtcattttttaataaaaccaaatgaaacagaaatccacttttaatttttttgaatttaatgttatttacatgtttttccattgaaaaataaataaattttatcatttttcactacagaatagtcaacttaacctttacaaattcgtgtacttaaatttacgttgttaattgggttattttggttaatttattggcttttgtggttctttctttacgacttgcctttgccttttgattttatttttattcttttattttattcaaattatacaacctttgaggtgtatagtttttataagaaaaatgattcttatctttcatttttcaattttttaataatataatcttttagcaattgcatttttaatttaatttgtttattttttaagtacattttttattatttaataaatgctcttaatttcaagccagaaggatttatttaaataattttcttcaatttaccgttatgccttttggtcagaaaaaatatcttttatgaaaataaatcggttcacgaaaatggcggcgattcggtcgctggtacaagggtggaggaatggtattggggagggggaaattatgggaaatttaaattaattatgaaagaatttattataaaattgaattgaaagagcatttttatttatttgttgttcttttattaattcacattagtgtatttttaaaccaattagatttaccttttttgtcgcatctaactttaaacatgaacaaaatttatttatttttactatgctttcctttttcttttaaattttaattttcatgttttttttattaaaacaaaacaaattaatgattcttttaatttgttttttttatttagttaataaattgctcctttgtaaagagtttcatttagtttaaattttgcagtgaattcttctatatattatatttgtttttctcaatatgtataatggttttgaagatgaagtaaattttgttattttttccaaacaataatttataatattttagtaatgatttgatttccgaagttgcacggaggatagcaaattaacatgtaaacatacacgaaggttatgagggaggctcttgtcccgggaacaaaaagaataaagaggtaaaaaacgaaaagcaattttttaattcatattgtaattataaattatttttcacctttgattctgtctatttactttttgtccatccgaaattgctatcatttttattcatttgtggtgatcgagtagatttaaaaattattttttaactttgcgtgtgtataatattatttatgaaagaaagtggaattttccacataaaaaaaatataatttaatgcgtaaatagttggtaaaaatttcaagtgtaggggtataaactcgtaaaattt

SEQ ID NO: 13910 - DNA, 2456 bp, Heterodera glycines
  misc_feature (2435)..(2435): n is a, c, g, or t
gggcaatatttaatttggcagggaaatccggaatcaagaacaaagagcattaattaaactagtgaaagaccaatagaaaaataataaattagaatgggatacttaggtccaaagaaacaatttagcaatgggaattttacagaaaaaatgatatcagctttatcttaaaaagcttaatattataaaaaataattttgcctatttgtttaaaccatttttatcatgaaaaattgaaatttgactgataaaaaaacacaaccaatttcgttccatatcatcgtcttcgtttacataaatgttttttatatcattgtcgcttgccactttttgatttgaacattgattcaagcgtgtctttgtccgcgtcttcagtgaaccatgaagacgggagaagtgaacgtattgagctcgaggcactaaaggtatttgaagaagtgttttgcggcacattggaggagtttgatgggttgaatcgggagttgaatgtggatgaactggcaaaagcatttgaagaattgctctgtggcacgttgaaggaatttgatgggtttaatcgggagttgaatgttgatgaactggcaaaagcatttgaagaagtactctgtggcaatgggaaggtgcctgatgagttaaacccggcggaagttctcgaaggatttgacctcaaaaaggtgtttctggattggaatggtctacttgatgaaccagaagccatcgacggttgttggtccaaaaatgctaacctcattggcatagagcctacgttttgtttcaatgtattactgctagagttgagcggtaatcggtaattgcaaaaaaaccggtaccggtactgaccggtactgcaaaaaccggtaccggtaccggtaccaactttttcaaccggtaccggtaccggtaaaaaccggtaattttccaaagttaaattttttggataaaatttttcaaaattttttttattacttttaacaaaaatcatcatcatttatttccaaataatcaatttctaattcttttccttctgcatcgggctcagtagatggtgccaaaaacaactggtccatatttgctttgatgagtaaaattttttgtgccatttctccgctcaggcttaaattccttggttttacagaaatcagaaatcgaaaataccgatttcttaatgagttgccataaatgagccccgctttcgagaacagcctttccgatgacacagatgtggcgggaattgaatgaataatccgggccagtaaaaacaaatcagggaattgagccccaacttctttccaccacacgaaaatatcagtctcaatagtggttcttccatgtgccttgtaagaagctaattgaagttgaatttgtgattgatatgacgaataccggccagtaccggtaccggtaccgctcaaccctaattactgctcataatgttaccactttttgcggatttatatacactatattgttgttctaccgagagtcgaaggtattcattatcgtccattaactttttcaacatttcaacatcgattttttctcccttctgtttatctttcccatctttcgcgcagtggcaaaggtggcaaatgatgtcaaaaagatgagaagcgcaaaaaggagggcactgatggtacatttcatcttccaaatcgaagatgttgtccaagtgttagtaaaaatcttaaactgaatggattattgctaacaaataaataaaataaaattcgagattatatgaaaaatatttttttttacttatattttccaatatatataggttttcccgggtctaactacattttttgttgaaaaagttattaacaatcgagctcaaagaaataaataaatgatgtcgtcctgaacttttaaaaaaatacaaagcattctttttaggaagacttaatgagtgaaaatttttttataaaatatttattctccattctcaagtctaaaaatttcctgtttcatgggtcaattctcgctctcggactctaagtttactatttttggtcatcttgaatgtcggctattatatgtattaaagcacacgaaattgaaaaagctgattttcctattcatttggtaagttcgaaaaaatgttacgttagattttaaagttataaaaacttcttaaaaaatgtacaatgtgtgaaattttttcaaattttcagacaaatttctattaaagtattttcatgcaagttttcatgtcattctgtcaactacggaatgaacaggaaaaacggctttttaatttggttaattttaatttcattggcattttctgcgccagttttgacaaataaacaaaataagtgccgacgtactcgcattacccaaacattcgagatcggtcgagattctattgattttcaaaaatatccgctttttttatcgggtttttgttttttttctagactatattttaagacaantaaatttaaaagaaataattt

SEQ ID NO: 13911 - DNA, 2994 bp, Heterodera glycines
  misc_feature (8)..(8): n is a, c, g, or t
ttttaccnttttggttgaaatcagcagttcctgacttgagttataaagtgttaaaaatttgaaagactcataacttttttcatttgtatcgaattacttagcattcgcttagaaaaagattctacttttcaaaagctttttttagataccagataccaaacttgttcagtttagttgggaatgaagcgagttatggctgattaaatttaaaaaatacaaaaaaaagcatttaccagtgtaagttttgaattagcgcgcaaaaattacgccaattacgttatttggcgaaggccaagaattaaaaaaggtaataaggctgaggttcggttccgctcaacatcattaacattattatttattttttatacgaaaaacgaattatgaaaattatttttgaagaatatacaatcttggtacatatcattcgaaagcccatgaagcttttctaagcaaaagagcaattcgttgaattaaaaaaatatattggcgttcgaaaaatatacctaactgttgaactagcgcataaacaaaaataattgtctaatcgatcagaaaattttctctatcgatatgcgtatttaacattattctttctttctttttcatatcctatttcatgttaaaatatatggtaactaattgagccaaaatccagccctgttcattataaatatttttttgactcaattaaatgggtgccaatgagagtgtgccaattcctggcggaggttcagaaggttaccatgttctacgggtaattgtttttttctttctttattttttaattgttatttgtttaggtccaggaaaattcaccaggacaaatggctggtttagaacctttttttgactttattgtggccatcgggaacacaagactggtaaaataactccattaataaaaaaaatttatgagtaaaaaatcattaaaattatttttaggataaggacaacgattctttgaaggaaattttgaagcaaaatatcaacaaaccattggaattaacggtttataataggtgagtaaattcggacaataattcgagcaggtgctcatattttaatttttgcatttttggttaaaatgttttaattagctttactggataacgatgaatttcagttagtttcaatgtatttaagcatgttttttaactaataccacccaactcattcagtaagacacaaacggttcgcgagactcaaattgtgccttcgcagaattggggcggccaaggagtgttgggcgtttccatccgtttttgctcttttgagggggccaaccaaaatgtttggcatattatttcggtttctccgaattctcccgctgagttggccgggcttcacgccaacagtgattatgtgctcggtgctgagtcagtgctgcaacaagcggacgatctcatcgcttttgtgcaggccaacattggaaagccattaaaagttagtcttaaccgtcgtaacattccgtacgcctttaaacgagttttggtttattagtgcaatatttttgcactatgtaaattaattctcaattttagctgtacgtttataatgtggacagcgacagtgtgcgcgaagtgattctgactccgaatggctcttggggaggcgaaggctgcttgggatgtgacattggctacggttatctccatcgcatcccaatttccgttgatcggtccaaaccgtgtggcgatatgcagccactgcttccttcgcaccaaatggaaatgccgaagcaatcgtcatcgtcactgcctccgccacaaactgggattccgcaaatggaccaactgatcagcgtaagttgcgagcagtaattaaattgggacgatgggcatataatttaaagatttcaatttaattatattttttgttccccatttttatactttaggcttctcaatttgttgtctcttcttcgactgatgttaagcgttttccggacccaaatgaatttgcgcttcctcagcagtcactcaatggggtttctgtgccaacaattcccagcagcagtgtccctcttccaccccaatcgcaacaattggtttccccgcctcttgttcctgtcgattattcgtctccacaacatcaacaagttgtttatcagtatattcgacaaatatttttgctgcaaattttcagagtcagtcctacgactcgggtaatgccgccaaatttgagcttcatggcttgccacctcatcagccgacacctcggcaggtcgacgaacccattggtcctccttcgtttggccaattgagagagacaccaatttcggctccgaccccctctgtcatgtcaatggttcagccacaactccactcttcctcattggactctgtcccactgtcggttccgccggtgacgcaccaccagcaccaagaacagcaacagccacaaattcaaccacttcatcaaacaccaccgccgccaattcacaccagcacttatcaaccgtatttggcatacggtgcgccaccgatgcatgcctttcagccacctcagcaacaacagcaataccaagtaggtattttgagaaacattttagttgttttctatttttaatttaggctgtgaatcaaacgtctgcttcgccttttatgtttccggcgcaaaatgtgcaacagcacattcaattgggacagcaacaatttcatgcgccaaatcagccgtcttccttttaccatccttcatatccgccccaaccgcaacagaaactgatgtcttcaagtgccttttatcaatatctacttaattcatttttcaattaaatagctatattttttgtgttttattggcgtttaattatccgtaggtttttcagctgctccctcttctgtctctggttataacattgcctctcatccgtcgtttggtcagcctggcggtcagccataccaacaacaattcggcattggtcactcttctcctgtccaaccacaaccgccgcccaatgtgccaatttcgtttccgatgccgcctctttcttcg

SEQ ID NO: 13912 - DNA, 2350 bp, Heterodera glycines
  misc_feature (53)..(53): n is a, c, g, or t
  misc_feature (89)..(90): n is a, c, g, or t
gtaaccagacaaaaaaatcaatcgtgtaaactactatagagtagagcggaccngggactgggtactgaaaagacgggacaactgatacnntacaaataagtccggttttgaccggaaccgggactagtcccggttttcccagccaaaaattcccggttttttaaccctaaaaggttccggttttgcccaaaatttccggtcccgctcttcttctctaggtaaaccaaaaaaataaaagtgtattttatatcccgctccgtttcataatattttttcaagaaaatgataaagtttttctattttttttaattaaagatttcatttaaaggatattccctctcactggctgcgggtttattctgcgtaattcaatttttataatttatttaatgggatcagacaaaaggttgttgcttgttttatagtctaatttattcactgtgcaacgaataaacattattattgttttgttaattttcgtgtttttgataatgctttattcaattaaaaattgccaagatattgacaaaatgtgaactttaataattgtgtttactccatttcttgtccattgttggatattgcaacataataattgcaaatgagttccattgaaattgaggcggctgatgttgttcgacttgtgcaacagtatctgaaggagaacaacttggtacgtactctacagactttgcaggacgagacgaacattactcttaacacgggtgggttcggatgcttttgaaagcccatatttttggaagtgaatgcgtttagttgacagcatcgaccaattctgccaggacatcaccagcggtcattgggacactgtgctcaaatgcattcagccattgaagttgccggccaagaaactgattgacctttatgagcaagtaaaatgttggcgatggtctctcggggggtcgccgcaaaaatttttttagattttttttctaagtttgaatttttattttttttgaaattttttcggcagattttgtctcggcgagattttggggtgtacccctctcacgggggcatcgtttaatccacaaaaaatgcattaaatttacgctattattacccatttgaacagatcatcgtcgaattggccgagttgcgtgagttgggctccgctcgtttaattcttcgccaaaccgatccgatggccttgctaaaacaggccgaccccgagcgttacacccggcttgagaatttgttggccaaaacatatttcgatccgcgtgaagtatatcctgaagggggctccaaagaaaagcgtcgcgcggccgttgcccaatcgctgtctgctgaagttcacgtggtgccaccatcgcgacttctgtctctgttggcgcaggcactgaaatggcaacaacatcaaggacttttgccgccagttgggtgacaaacccatttatatcatccaattttgtttccgtttattcgagtattttcagatgatcatttttaggcacccaaattgatcttttccgtggcaaagcggcaatacgagagcaggaggacgagcgtcacccgaccactttgacacggacaatcaaatttggggccaagagtcatcccgaatcggcccagttcagcccggacggtcaatatttggtcaccggatcagtggacggttttatcgaagtttggaatttcaccaccggaaaattgcgcaaagacttgaaataccaggtcggaataatcaacaagtcatttaaacatatgctagcctaattaaggcacaagacaatttcatgatgatggaaacaacggtgcggttttgccaaaccatactcattgtcaattcgtatttcggcactgttttaggtcctctgtttggcatttagtcgcgattcggaaatgttgataacgggctccaaagatggcaaaatcaaagtggggttaaaaacaatcatcttttttattcagaaacgaattttatttttaggtatggaaaatccaaactggccaatgtttgcggcgttttgaaattgctcattcggagggtaaaagcggatggaacgatgggaattttatccatttctttttatgtgtgaccagtgtttcgttttcgcgtgaccacagtttcgtcctttcctcctccttcgacaaattggtcaaagtgcacggcatgaaaagtgggaaatgtctgaaggaattgcgtggacacaattcatatgtcaccgatgtcaaatacacggaggactgtcaccaatgtgtgagcggatgtgcggacggaacggtgaaagtccgcgcgcggggcatataataaacataaaaaactgacccatatggggatattatttataatggcattttccattgaagattttgattgtttagg

SEQ ID NO: 13913 - DNA, 2915 bp, Heterodera glycines
tatgttcaacacttaaaatttatgagttttaacaacattaggtgggttttttgttagtttcggtcccacctaacgcggtcttcagggtataagtccaaccagaaactagcacacgtttaattatacgtctaaacaaccgtaagaattgattaaataataagattgccaggttcccatacataaattttttgattttcaagaacatataaattttaagaaaaaagggttgctaaaatttactaaattttaatgatttatataacattttatttatttattttgttttatttttttgaaatcccccctctggtgcccaaacttcccggtgcccaaatttctggtgcccaaacttcctggtgcccaaacttcatgtcgccgtctgggtctgcttcctaccgattttcgttcattttccgttctcgtaaaggataatgatatagattaacaaagacatatacataaaaatgaaaaacaagcaattcagatagacaaccaaatcattgaatatgatggaagttgacgaccctcctaatattcaaactccaagttccaaaccgatggaaattgaacgtgaaattgagcatctccctcaagcccaagcgaccaaagatgaaactgagcaactcccccaagtccaagggaccaaaggaattgtttttgtaagtctaatctaaaaaacaactgttaattttaatgggattgcaggaatccgatgatattgcatacgaggaggacatcatacgaaaccctggccttctccgaccctgggaacgttacattgagcacaaagtgaagaccaaggctgaccctaagcaagtgcggctagtgtttgaaagagcgctgaaactgttcaatcggagctacaaactctggtacaattacctgaagtaccgccgcaaaacgattgcgcacaaaccgccgacagacattgcttatgcgcatttgagtgacgcttacgaacgatgcctcgtttttctcaacaaggtaaacaacattgtcattatttgaatagaattcttgttcaacacattgccaattttgtttttccccattgtcagatgcctcgcatttggatcgactattgcatgttgatgattcgtcgtggccaaataacggaaacgcgtcgcgtgttcgaccgtgccattcgtgcacttccaataacccaacatatgcgcatttggcccctgtatattgactttgccacacgacacaacgttcccgagacagccattcgcgtgtaccgtcgctttctgaaggtataccccggcgggcgagaagactttgtggagtatttgaaaagtatcgacaaattggacgaagcggcacaacagttggtcatcttggtgaacgaagacagaccgatcagcgagaagggcaagactggccaccaggtcgaataaatttttatatttaggcccgtatccaggggagatgaggggcgcgcactcccattcctaaaatgaaaatatttttttttagaagaaaatgcagttttgaaattttcagccattttcttaataaatatctcgttaaacatgactaattcctttaaaatggtaagaattttaaactaaaaagatagccatttagtcgttctgtaaaaaatggtgctacttttaattttggacaaattacgctgaaaaaaaaattgtgagactgaagagcgaaaacaaaacaaacttttcgtccgttggtgcctcctcaaaaattattttctgaatacgggcgacacgtttataaaatatcgatactttacaatgtgcagttacttttagctttggactgagctgtgtgatttgatctccaaaaacccaaataaaattttcacgcttcgcgtcgagccgatcattcgccaagggatcggccgttacactgaccaagtgggcggactttggctggcactcgctgagtattatattcgaatgccgaactttgagaaggtcatcatcaatttggccaacaaataataattggtttcatttaggctcgtgacatcttcgaagaagcattgggtgtggtgaagacagtccgcgacttcacccaattgtttgacgcctattcaaaattcatggaacgactgacctcactgaaaatggacgcgttgtcctccgcccggccaacccaagttgatgagcgcgagttggagttggaattggttatgacacgctttgagcatctgatgaaccgacggccattgcttctgaacagtgtgttgctgcgccaaaacccgcataatgtgcacgaatgggtgaaccgagtgcaaatttacgagggcgaccccgaaaatgtaagaaattggcgtatgggaaaattgaaaaacatcgaaggaaatggcatcaaaaacaaaaaaaaaagaagttattattttatttgactcttgcgccaaattccaaagctctcaaaatttggtctgttttagtcattattttaattcatttttacaatcattatattttaaaaacatttcgttgtattttttttctcttgctgctgaatttgtgttaaataatcctagcggaattattttagcaaattgcaactttcgaaaaagcggtggctaccgtggacccgaagcaacaagtcggccgactcggtcagctgtggattgagtttggcaagctgtacgaaaagttagacaaattggacgaggcacggaaggtgttcgacagagcggtgcaggcaaattttgttcgtgtggacgaattggcccaagtatggtgtgaatatgccgagatggagcttcggcacaggtttggcattttttttatttcgataaaaaataaattgctttccattgttcagcaattacgaattggcaactgctttgcttcgtcgtgccactacgcctccaccagtgcgtcgtgacagttactttgatgattcggcaaagtgcagaaccgcgtgttccgatccct

SEQ ID NO: 13914 - DNA, 2119 bp, Heterodera glycines
  misc_feature (1889)..(1889): n is a, c, g, or t
ccccccccccctacgacgaacgaggggagggtgtccgaggcctcttacgacgagggggggggggggggggtgtctcgagacaccccttgtatatgtatggaggggatggagttttgtgattatttattcgtttttttatttgttcaggtccaatctcagttttgggagagttggaaggagtttgaagtcaagcatggcaatgaggacacaattcgtgaaatgttgcgcgtcaaacggtccgtccaggccacgtacaacaccaacgtgaactacatgagcggtgagggaaattgacggggagggtgttactggacaaacgtgcaaatttgtctttaaattaacttgctaactaatgggtctatggcaactcgtacaaacaattagtacaataggcaactcgtgcaaaaataaataatataaaattctaaaaaatacgaaagcaacgacttttcgttattatgggttgtcacgaatttattaaaaatattttatcttaatctgactgttttctatttttttttaatcacaaatttgtatttttaagtgttttatttacctttactctctttagcccaaatgatggccacattaggcagccagactgaaatggccggtgaactcagtgctgccgactcaatggcacaattggaggcgcgcgcagcacaaattgcgcaggaagaggcattgattgcagcaaaaaaagtgttgccggcgacgggtaagcagtttgatagtaatttgaccacttaaaactttaaaaattgctaattcacagacggacgaatttcgtttgtacgtggcgaaggtcgcacaacgacagaagcacgggctgaaaatccggaagaaattgacattgatcaaattgttgatgatgagggcggggaggaagaggacgatgaaaacgccatggatcacggggatggcacagcggcgaaaagtgcagacgatggacagagggaaacggcggaggcgtaatcgcgagccaattgtccactttggctgtcgttttgcactcatttattttttaaagtgttcataaatttgttttctttttttatgtgaaaagtttctccgaaattggattttcccttttaagaggtcgacttttgtctgtcctctcccctctcccccccatttcccttcctcattttgttgcccattgactctcgcaatgaaaactttttactattattttatcgccacacaaaagggtttcctcccccctcagggggcgggtgctggacaaaaaggcggaaggtgctcaatttaaaaagagagaatgaacggcggctgcactgactttggcacatggggacaatttgccccccccccttcccccgcggggggacaatcgaagggaaaagtccgtccgttgtgtgaagccgtgtgacaagcgaatgaacgggcgaggaatccatgcaaaaagtgccgaaaattttattgtccgcttctcatttgcctcgtcaattccattggcattgtcaggtttagtccaatttcaaatgccattcgctttatcctctcccctttttatagcatttaattacctaattagtcgcccatggacagacaaagcattcggttctaactaattggaaaatagcatcatatcatgggaaattagtcgctgcttttgtccctggcaattcgaatttaaaaagaaaatgctcatcatgctttatacagttcaggtaggaaagggaaatggaagagttaattagggtaatttaacggattatcccatgaattagggtttaattggaaaatgtccccgccctttgggagtctaaagtaataagtgcgtctttggaggtgattaaatgccctaaataggcttaaaattcggctcgttccctttgatctcatcacagtccgtccttctgcaactntctcctcgccgtgggtcgacccgcgggcgccgaagtgcgcccgtcggccgacgcctttcgaagcggacaattcggcacggacagaagcgacggcaaagcgatggatggtcaacagcagaaacaactgcgaaaagacgcaaaatgtgatcatacggacagctcggagaaggcgcaggacttggccatcattctgatgcgcaactattccaggcaaaatgccaaaaatgggt

SEQ ID NO: 13915 - DNA, 4023 bp, Heterodera glycines
  misc_feature (30)..(30): n is a, c, g, or t
tgcttaataattttcaattgtgtcttccgnttgcttacttctcgcatacatgttaatgtgtttaattatgcacttttctacctaaaaatgacaagttcgtgtattttttaaaattgtatcttctattccttaataatttacaaattgtaacttctttctcttaattctgcatatttctacctaaaaacgacgttcccaaatgcttaataattttcaaattgtgtcttccgttgcttaattctgcatacatgttaatgtgtttaattatgcacttttctacctaaaaatgacaagttcgtgcacataataaaattgtatcttccactccttaataatttacaaattgtaacttctttcgcttaattctgcacttttctacctaaaaatgacgttcccaaatgcttaataatttacaaattgtatcttctattccttaataatttacaaattgtaacttctttctcttaattctgcacttttctacctaaaaatgacgttcccaaatgcttaataatttacaaattgtaacttccattgcttaattatgtatgcatttttattaaaaacgtgaataaaacgacaaaataacacaatttttggtataaaatagagaaataaaaggggtacatgtatgtgtatgggtgtgtatggggtatatgtttatgcgtgtggaagagagatataataaatggtgaacaaaatacaaaagggtacatatgtgtatgtgtgagagagatacaatgattggtgaagaaggtattacaatgtgtgctgacaaaatagttacaatgaatgattaagactataaacattataatcggctcctacaatacccttcccaacataaggttgataacatttttgcatagagcttgatattacagatccaccatcacgaatattgggtctaataaagtttgggtatattacattaattggttcaatctctcctgtttgagcataacgtttgacttgctgtttttatatctaaagccttggttgttgatcacatcataattgagtgtcaatccacggagtttaagcacgtattccatttccgcatcatgtagaacatttatacgtcttaaagccaacacatactattttacaccagcagtgtagaattctacgatttccatcaatgaactgcttatagtgtcgatcttattcagctaaaaagcatcgcgtagatgtgagaaaacaagactatccgtgtcggtggagagtacttaacgccgcggctatatcatcatttctgaatagttttattacccactttttttattttcgtaggtgatcaaaacatgatacacctttcaatcctcgatggccattacgtctattgaactattatcccaaatattctccaaaatcaagtacatcattattgaagtaaagtctgttaaaggctgtaatttcgtaaagaaatatgtcgcacaaattgttcaagcatagtttaacaatcctactcttcttggttcacagctatctttgtttggttaagatctctaatttctctttgcactctcttacaaattcagcttccttctcaccatttccttttatgtcagtatcaattggtaaatgggtaaccttcttcaaccgtagtaacattaatttcgattgaaatgcagattgctcagccatctcattgtttgtgtttgcatatgtatttacgtctatcctgcctttttgattgtttttggtgcacttcataaataaagagaatcagagcctaccattcactttgacgggcaaaacagaatatcaaattttctaaagaaatcatccaaaactttgagtattgtcaaggggtagtggttatcttccgggtatttccattcgacttattcattcagcacatgtacattggtttaccaatcgagtagtgtgtagtaaaattaacgaaggggtagagagaaatgaagtcacatagaaatttttcattccgtcttcaaatccgctcatttatttgttgctcattaacattttcgcgatctcgcagcctaatacacttacaactggatggacaacttgacttcgtataaattcataacgttttacattcctctcccgcactttagcatttatttttttcaattagacattaatatacatcttctaggtagcgctaattgcaggtatgctaaacatatccgcttacttctattgcagttctctctgtttccaactattcatccacagaataatgatcaatttgccaagtgttcagttgaaaagttattgatctagaaatatcacaaacaggccttatactagtcatacattcctttagtacatcaatgggtactaaaagacgctgccttctttaataatgccttagttcctttgagacatcaaataattccctcctaaacgataccagcgctgtcattaaaattttcaatgtcattacattttttctcattaattgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttaggtataatttacttaattttaatcaatactattgtatttattatttttattatattttaatacaactttaatttaattttttaatttagttttatttatttttatttttatttaacatttattttcttttaattttaatcttatttttatttttattttactttttatttgaattaatttgaattttattttactttatttattattcagttaatttaaaggagttgttcagaacctctatccaataaaggctatttcgccgctcagcacagcataaaaggtactttaaccgtgcaccgtttagcattgtatgatatcctcactattttcaatatttttacttgttttaattgtttatttctttgaaatttctattaatattttacttttgtagtgtttaatgcaatcaaataacattttaacttgaaatttttaacaaaatgaacttaaaaaatattagtagttaattattgtaaaatataatttattaataaataagtttaattcatttattaaaatctaaaaataatgataagaatatatgtatacttcatattatatatcattttattaattaatttttcaatataaaatttctttcttccatcattaaaatatttttgcttagcaataagtaaaaaattccatatatgcacgctacccctctccgcctcccatctgatatgaaattcttaacgcttttttcttaattattattatttttttcatttatttccttatttttaactatcatcaccattattattattttactaaatttattttaatatttattttttctacaactcttcatctcttcattaggcttgggttatgacacaagtaccatttgccacccctccagtcgccacatgtcaccacacccctcaaataagttttgggttatacgaccaccatttggcaggttgccaactaaattgttcatgctatgccacactacactaaaatgagcagctgtctcaaccacagaatatctgatgttgggttttgcataggcacaactgtcacaattaatcacccttttgactcacagttgaaagtcaaccggcaatagggaacagctacacactatctgtcccttcgaaaagggtcctttgacttggttgtttgggtttgcatgggcaaactgtctcaattaatcattgactcacagtttgacctctatttccagtggtatattaccgacacttccgtgggctttatacagtcaaaatgcatccaagggattattaattaccattccattggctttggctcggtcagaaatgcaccaaaagaattcccaaggggataattaatgaccactagcttcggttggacagaagtagtatatggccacaaatgtggtgggtaattttacccccacattgtgcccttcgcagcgcgccg

SEQ ID NO: 13916 - DNA, 2603 bp, Heterodera glycines
atcagctcctcaattgtatagatatacattgtttttaggtccgtatttactactatgtgaagcatggcgtaaagctcgtttatcctcagcttccctgtgttcttcaatttggcggtggtgaccattgttctctgtttccgcttgagtgtctgagcgtcataaaagatgcttgattaatacgcatcgggtgttttatatgtgattaagtttgctgtgttattgttgttgttgttgttgttgtttttttttttaatttctcctagataaaaaatgttaattattcaaaattgtaccgcggtgtttaaattacagctgttgcctttcacaaaagagcagtttttgaaaattgcaaaaaatggcttcaattccgagtacgacccccaacgatttcatgcaatcatcatacgactacgtctccccaaaaaacgcactcttgcatgtcttttatttcgatcagcccgtgctgtgttgactggtgtgccttgtccagacagagcggtgcgcgaggcacaaaaaatcagacggagggtgcagcatgcgttgggctcccagctaggaatccacgagttacgtgttacaaatgttgttggttcttgcactttatcacatcgattgtccatgctgaactttttaccaacactggacccacacaggttccgcaacatcaaatatgatcctacaatttttcccgccatgcgttgtaaaatagtcattgacgacgacgatcacactttggtcacttgtctagcctatcattctggaaaaatcattttaacaggatctaaaaggcaggacaatttgaaccacgctttgcattcattcttagctgtcttaaataattgatttgttcatccaattgtaataaacacttttttgtttttgcaactgatttttttattaattccaagttgagcacccaggacggttagaaattaaaaaggcatcatcatcatcatcatcatcaccatcatcggcattaaattgctgtaattcttgcccctgctgatgctgaactgtttgcgcttctcggaatccaaacggggttgtcttcatgccgggtcgaatgcgccccttcacataatggggctgatagtctttgtgagcttcgtgggtgtacaggtccgaacacggagttcgaccaatttgaggaaatttgattcttattgacgcactgcttcccggaacaacatgaacatcttccatgttaagcacatcgtcactgtggcatacaatgttaggcggagtgttttgtgcaattgtaaaaaaaaaattacatttgtccatcaatgttgtaatgttccaaaacaatgtgcttcatggactcgaagtttagcagttgctgggcggaataagaaagacgaaaacttcggactttcagttcagcacgctcatcctccccacttgcgctatcacaatgacgaaagccataattttttgggccacccgacacaaattcatatattcgcctcgaacaatgttccctcttcatttggcccagcgcttcgccttcaggtacgtgttgtctcccactgcttgccacgtaatagattgagtcggtatctttgaaaatgatcacaatgagaaagtagcgtttttttttttttgttgaacttaccacaataaagaagcttatggcccaatgtctgcacctgctccatatagctgtaaagatgtagacgagcatatgaagtgacaaaaattgcaattggcaggcagttggttgacggcgctttcgcaaattccgcttttttcctcacaacaactcggtccatatgaggtgagacgtgatgaaagtcaataatgtcgatggtgtgattttcgagcagtgcatgaaattcagctggagtccgagtataacgtacttccgtaccaccaactcgttgtgcaagttttccccagagtgagtttgccagaattttctgttttttttttttactcgattttatacgaaaatttctctaaattatttaccgcaaccattcgaagcccgggattgtttgaaattttgttggggtccagctgaatgccctcaatccgcttaaattcatcaacatatgctctgcgctgttcatcggaatcacaaccgggtggccagccgcttgcttgtactttaaggcccacaaaagtgttaacgtattcacgaaaaagttcattgtcccactcttcataatgccaaacctatattttttttaaaggctcgatgcactgaacgtaatttttttacctcatataagtcaactactttataaccaagctgtagggctttgttcaattcggcatgagtgtacctgaggcaaaaaaaaaaaaagagattgacagccgcaaaaaattcccaaaattacgcggaaacccatgcccttgctgcatcaacgtgttgacatgcccgttgttgccgattgtcagcacagcgcgcgcaaagcggaaaagttaggcgtccgtctgtcgtccggtatggaagcaaagggattgttagcgggcgtgtaacaggatcgggcggaagaacacggacaaacaacaggcccgagaatgagttagcgtcgggtgagcaccagggaagcggtgacgtgggtgggcttattactgtttcacgagaatgaacacga

SEQ ID NO: 13917 - DNA, 3495 bp, Heterodera glycines
atttttgtgaaaattttttttcaattcttagggggtgtatttttcatttttattgcatttttgttaactatttttccgaaaatcctaaaaaaggcgtaaaaaatggcgaaataggcacaaaaataggcaaatcggcattaagcacaaaaagtccaaaataggcaaagtaaaaatgctaattaagggcattaagaatgatgatcagctgaagcggaacaaaatccgacggaggatggaggagcaaagggaaaggagggcaaacgacgaaggagagaattgggcggagggggacgacgataaaccgccggaggagcagcagttatactgaattcattgacgatgaagaaaaaaaaacaattcagcatatgttttagcattttggcataaaaacaaatgcaaaaattcattttcgctgggacgtgaaacagacacacagattaattttcgaaggaacaacatatttgatcgaacacatacatatatatatataatatcatcatcttcaaaataattatcggcaattcttcgcgctttctttgatcatctctcacagttgaaatgggatgggccttccttcttaaaagtatgcgctgccctttgaagtcggattctaaacaattttaaatataatagcggacgataagtgggtagtgagtgtcttacggagggagaatccatttcgtgtttgcttttcgacgaaccgacatggcttgccattgactgagggcttctgatgcttgctgaaaaaaaaacaatatttgttgttttttatgcggagcaacgacacctgctgcaaatacggaaagccgtacccaacaccgaagtttcgctgggctgactggaggacgaaacctaaaagaagtggaaattttgcgaggggaaaagcgaagaaaattgaaattctgacgagtttcggctgtttggtcggtgctgcacgctttttgctcttcttaaaagtcactgaaaataataattgggaaacattcaatttagacattatttttttcactttttgcgtatccacgcgccgcttccttcgtaaacgtcgcgttgagtgtgtagttttcgacaggaagggcctttggcggcgatggaacggagttttgcggttgcacgacttctgctgctggaggcggttgtggagtcttcttttttgtcatgaagaatttgaagattttcggcggttcctcgtgcgacgattctttgaaaaagccacacggtatgcagcagcagcagagacccccggcggcgacctgttgcttctgttcgtagcgaatctctgaaaatgaaaattgtcaatcgtttttcaacggtttcaatgcttcgtccattcttaccggtcattccaaccatttccattccttcgtctccgtttgattgcactgaacggttcactgaaaaagagtaaaaataagcttttatcaaaatgaatgttgctcggctccacctctgacggaattctctccttttgcgttgccacgtcccgcgatttcgtttgcatttggcgctcccttctgctgatttaagacgggggaaaagggcattgttgacggatacacaattgacaaggaatgtaaaatatgggcaaaatgagtgcttttatatgccgactctgcagtcagaaaaagtccactttgtttgttgtcattcaaaatgaaaaataggtatataaattcaaagatttagcttcctttgactattaatttagaaaaagcacattcccgccagtgtctccatcaaatagaagtgcccaaaaaattttggcaattctttgcttttccacgtcctgaatcattggcatttgtcaaataggtaaataaatattgatcataggccccaaactcaaaaatgcttaaaaacggacagaatcgatgtaagaaggttcgaaatgggtttgaaaaatagaattaggtgtgcgcttgccccttttcaggctgattcaaattcgtgaaaaatgcttagatcacttgtccaagaaaatggaatccgtcaggagttctccaacatctcggacaatctcaccccccaagagttcctccgtagggttaatcttttgttgtaggaccattgttccttcacttttccccttcgcaatgagcgttttttagaaatgaggattttgagcttttttagaattttgaggctttttgggaaaatcgtcaatctgttaaatttcatgattaataaactggcataatgtttgaaaatcatttaatttgtgttttattagagcataaaaactaaagataaacacaaatttttcgaaaaatttttcataaaaccagaaaattatcaattttttccgaaaatccacaaaattaggatttttaatgaaagtctatcccacaagtttttggaaaagcgccgcaaaaaagtgcaatgtgtacttttttatcgaatacaacgaaaaaatttgtttaaatttttaattctgcatctgaaagacaacttttgtcgggattagcacacgggaaaaaacggattttgctggatcccagtctgcaatcccgcatttttattaaagttaaacttattttttcatgcagatttcattcaaaatttgtgaaattttccggcgcggaccccgtccactttcacaaatttttttgaaaaagtgcgccacaaaaaagtgatgtgaaaaaaatcccaaaattttaatccatcgcttacactttgggctatatctttgtttagcccaaaggcttttcgcccgtgtggatgagcatatgtcttttcaagcatgaaggccggtcaaagctctttgtgcaaagagtgcatgaaaagcgttttccgtttgccattttcggttgtgccgtcagtcgctgctggaaaaatagggccataatttggccattggcatttttaatttttggccattggcaacattgtggttttattattgctcaacaaaattgtgcccttctttcctcccaatgcctcctcctcttccgtcgtccgcttctcctcctcctcactgtcaaatagctcctcctcctctccctcttcttccatttcatccgttgtcccttccaattcctccaaaagtgcctccattctatcctcctcttcttcttcgtcctcattctcttctccaacaaactcctctccttcagcctcctgcttttcctcttcctcctctttctcatcgtcgctttgtccattccttcgcccaagttttccagtcaaaattttgtcggcatttccgaatatcttgacttaccttatattctctttttatcccccatatccattaatcccctattccccaattatcccccattatctgaggaggttgaaaaataatcccccagtctctaattatccccatgagggataattagaattttaaaatatgataccaatttttttcaaaaaacaaaagcaacaaaaaatactaataaataggcatgtcaaaaatatgaatataaaatcgcaaatatggccataaatatggaccaaaatcgcaaatattgatataaatggcaaaatctcaaa

SEQ ID NO: 13918 - DNA, 992 bp, Heterodera glycines
gaacagtgcacaagtgcaaatcggcgcgggctcgcgaaacatacgaccctaaaagcaattgatcactggatttactagttattttttaaagggaattattccaaaaaatcgctagaaaatttgtcaaattaaaggggagcaaaatgcacaaaataagtaggacatgataattaggcgctggaaaatagcaattttctaaagcgggatagaaaaaaacaaaattttccccgatgccgtcgggcgacttctctgggacgcttcagcgactttaagtgttatatctaaattctttaaatatcaatgtccttccgggtcggaaacaattgctaaaaaagattttctcgcgcaacaaatctattgagagtttgtcataatttgtggagaaaaatgaatgtgagtcttatggaaaaggtccaatttgccctttggtgttttccccagaaaaggatatttttcaatggtcagtttgtcttggcagataggaatatagtgttaagcggttctgtaaccatattcctaaagagtccatattcagttaatatttgatttcctaactaatggtgggcacttttgtaaggtattattcttgaaatagaaaattatgttgccaaatatatctatatattcaggcagtggggagtcatagtggtgatcataaggctctgcaatatcccataatcacgcatcccagagttcacgggactaaaaaatttttcgtcaaaaaggggggggggtaccatctatagtattacctgatcattttttgatgttgcaataattttggactaaatttaagttgttttggtcaatttatgaacaaaagtgagaattttaatatttcgagttttcgactttttgtgcgaattcgggtccgggaccctaaatttgtcaaaattaatgtgtcaattttaggttttcggagtcggtgaacttattttccggatttttataaaatttaattttgttttttctggacatttcgtgggtcagcg

SEQ ID NO: 13919 - DNA, 1390 bp, Heterodera glycines
attttccatttttgacttatttctgcataaatttccatttttataaaattattttcctattatatttttcgagaaaaaacacctaaaaaatatgatgtaacgacaatgacttggattttgtttttaagactttgattgagtcttaaaattatttacaatattaaaatttttaatactttattattgcgtcatttgaataaaaaaaataccaaataacaaaatacaattttctgtttaaaattaatttttttccggagagatcagatgaatattttttaatattttgtagtttattttatttgaaaaattgtttttatggtaattttacttcatttatgaataaataaatgtataaataaatggccatcaataatcaaaagaaagaattttgtatttttttaaaataattttgagaatttttgataaatgaaaatattattattatattttcttttattttcaattttccaattaaatcaaagtgaatccgaaaataaaaaattgcaacaacaaaagtcatttgacgaaatatttggagaaaaatgggaagaaaaagaagaagaaaaacgaaatgaactcaaaaaaagagaaataattggaaaattttataaaataaaagaaaaaatcaagcaaaaaggaagaaaatattcaagaaaagaatggaataaaattgaagaaaaaatagcgaaaaaattggagacaaatcgaaagaaaatttatgaatggattaaagaattgggattaaatcaaaaaatacagaaaagctacaaaagaaaaactgatgaagaaaaattagaaattgtgcaaaaatttattggaatgtcaaatgaatataagcaaaaagaaagaaattattcgccaaaagaatggcaaaaaatttatgccgaaatttgcaagaaaattggagttagcctttcagtaattaagaaatggaagaaacaatttggaatgagtaaatttataacggagaaggaaaaattggaaaaaatgaaaatttactggaaaataaaaagagaaaatccgaaaatgagtgacaaagaaattgcaaaaatattgaaaattgatagaacgacaatttcaaaatggaagaaacaatttggagaagaattgttctaagaacagtagaagaattttttttcccgccatttttccttcaattattttacaaataaaaaatgattcttattttgtgcccaccctttcaaaattgtttttcgtgttctatcgatggtggcattttttttctttttttttacaaaattttaattatttttctgaaattgagcaattttagcggttgagagcggccagttcagtgttgtccagtgtagggtcgacaactcgtcgttacagtcggtgctgttagttttcgaccagtgttgatctcgac

SEQ ID NO: 13920 - DNA, 2688 bp, Heterodera glycines
  misc_feature (14)..(14): n is a, c, g, or t
acaacaaaagtcantttgacgaaatattctggagaaaaatgggaagaaaaagaagaagaaaaattcggaagaaaaaagagaaaaaattgaaaaatattataaaataaaagaaaaaatcaagcaaaagggaagaaaatacacagcaaaagaatggaataaaattaactcaaaaatagcgaaaaaattggggacaaatcgaaataaaactaatcaatggattaaagaattaggacttaatcaacgaatacagaaaaactataaatcaacaactgatgaagaaaaattagaaattgtacaaaaatttattggaataaaaaatgaatataagcaaaaaagaaaatattcagcaaaagaatggcaccaaaattatgcggaaatttgtaagaaaattggagtaagcaaagggacaattatcaaatggaagaaacaatttggaatgagtaaatttataacgcagaaggaaaaattggaaaaaatgaaaatttactggaaaataaaaagagaaaatccgaaaatgagtgacaaagaaattgcaaaaatattgaaaattgatagaacgacaatttcaaaatggaagaaacaatttggagaagaattgttctaagaaagtagaagaattttttttcccgccatttttccttcaattattttacgaataaaaaatgattcttattttgtgcccaccctttcaaaattgtttttcgagttatatagatggtggcattttttttcttttttttttacaaaattttaattatttttctgaaattgagcaattttagctgttgagagcggccagttcagtgttgtccagtgtagggtcgacaactcgtcgttccatcggtgctgttagttttcgacagtgttgatctcgacagtaaagtttgtttttaaaaacttgttctatatggtaaagtttcgataaattttgaaaaattaaaatcataaggacaggctctttacattgcagcggggtttgcgattttcgaattctgctataagaaagagcttgtagatatttgcatcttggcactcaacgccagcatttgttagcatattttcccacacgattcgagaatcgtatataagattttttaataaaaataatcatacgcatctttattattaccacttactcaattctagattttgtatatgcaaattgtatattaatagtaattcatatgtacaataaatcaagtagaaaatcaattaaaaagtactgtcgaaaccaatcactgtcgaaaacagctggtacggttttatcgaacttaactctttttataattagaaaaatcgcactaaattttacagatatactccccggtacagaactaacttatcctgaaaatatttcaacgcatattgattgtaaaattgttcgaaattctgagtttccaatatttttttgcaacattaattcataaaatattttttgaaaaagtgcctgaaacgcaccaaattttattgtcatgttattaatgaacagggctgcaaaaaatatgcacgaaaaatgaccaaaatcactcgcgcacccattcaaatttggatttaattttaggcataatcaaattttttttcctaagagatattcgaatcggaaaatatttgacgaaaaatggcaaaatatgcaaaaaatcggaaaatatttatatttgacgaaaaatggcaaaatatgcaaaaaatcggaaaatatttgacgaaaaatggcaaaatatgcatgaaatatgcagaaaaagccaagatatgcaaataaaagtcccgacttttatacgcaaacacaaaaaaaagaaagtgttttttatgcaagtagtaacccctgccacaccttcgccgcttgacgctaattagaagtgacaggtggcggaggagggtgtcaattagtcactaattgggggggggggtgtgctaattggtcagcggtcaagagggcactaattggtcagccgtagggtgtggggtggtgtcaattaattagggaaacctaaacctatgcgaggggtgtgtaaaattttcatgtactttttttttgacataaaatttgattgatttaaaaagtgacagccgagggggagggggaatttgattggtcagcgaagtgacagatgagggaaaaattcaaatttctgatgggcggggatcggaaaattatgattgatcaacaatgtgacagtttttgatattattaaattattcaaatgaagtgaaataatttgttttgcatttggactttatcaaacttgttatgaaggtgtaaatttgcaatttgttgacgatttcgcgcaatgtttcgaccgaaattaaattgtttgtcacttataaaataggtcaatttgtgaatatttaaggtttccaaaatggaattcattgtaattgctacatttgttccatacttttcttccaaaaattttccaacccattctattgtttacccaaaatggcaccacgtgatgactccagtaacaataccaatggtcagccagtcattcaatttgatcaacaaattcgccaggaccctggactaaatgccgtttttgactttgttcgggaacagggcgcacgggtaatttgtcacaacaaattaattttttcattttttgattaattttgtttagcatggcattttcaacacacccgccgaaatcgtcaatgttcttcagcaaatggcacagcatcgactgaatgagc

SEQ ID NO: 13921 - DNA, 2166 bp, Heterodera glycines
gacggtcgggcacgccgttgcaaaagtcgccccggcagcaatggataacgcatttcgtaaatacgtcatcagtgtgatcggcacaactcgagctattattttgttgacaatgcgataaagtgaactggttttgttcaatgaactcgctttggacaacttgaaaataaaaatcactattttggcgttttgtcactatttcggaattttttagataatttttctacaaaaatacaacaaacccaaaaatacaccccctaagaatcgacctaaaaaatttcaaaaatcacccctaagaaatgaaaaaattttctcaaaaattcattttcatggcaagaatttttaattttaaaattatttttttaggtacctattttgggttttttcccttaaaaatcccagtcctattcatttgcaactgaaattaatgaataaaaaatttttttgctcaatttttggctgaaaattatgtcactattcgtcactattttgccactattttgtcactcactattttggcatttttactcactattttagttaactattttgaaatttttcgtcaccaaaagtcacgaccctaatcatgactgtatatgttttcagatttttttcaaatgatgacattaatatgattttataatattctaaggaaattgggactcggcgatgctgacggcactgccgaaaagattgggattttggatgagattgataagaaatatcaaatttttctttttattaaaaaaaatactatgtatttggagggggaggaattgatctaacgaaacccacgcaacttaatgcgtcagtggaagatgcgtcagtgatacaaatatgtactttaaaataaagtacagtagcataagtattgccaggggttcggaattggccgaaatggatacagaattcgtgatcagtgacctcgaaaaatttttatgactttaaaactttcactgacgcattttccggcaaccgaccacgcaaccgagaaaagtcgagactcgagacaaataaaaaacacgagacttttcttgagaccgagattctcgagtagcaagcactaccacaaaagagacttttaaaaggatggaatatttaagtactttcttgatacctttatcctggcagtacacagtattgcagaggacagtcccaggaaggcactgttctgctgtcgtgaaataatcaggatgactgcgccaacacttcagtgctaaatcagggtactgtctaattatttaaaataccatttttttcaacaacaaaaaaattcaccattttttagaaacaaccaaaatttaaacgtatttggagtcatatgcttaaaatttttcattttaaaaagttaaatttgaaaattaaaataattttattttgaacattttgcaaaaaaaaaaaattaatacaataattaagagtattatttcctaattttattgatccaaactctctgtatttgctataattactcactgtaagccgaggtcaccaagcatgccaaagcaacagccaaaaaaagggacgatgaagccgccatttttatttaaaaatgattgaagttggaaaataatagttaaaaagggaaaattgaaaaatgaaataataaaaaagacatttttgttgtttcttttcactgtacaaaaaaagggcagtgctttagcctaatattttgaaaaattaattcacatattttataaaaatgaatcaatcggttgggaaattcagaaggaatttagtaaattaattatgattcatttgtgaaaatgtaaaagggaaatttatcaattaatgaattttaaaaaaaatgttttttagtatagaaaattcaatgaaatttttttgaaagtttaaagataaacaagtattcttagagctctcattaaggcttatctcatttgcattcaatagcgactattaaacatttaaagcttttgaatgaggcgcagtgggacatttgcggacggacatttgcggagggacacttgcggacggacatttgcggacggacacttgcggacggacatttgcggacaacatttgcggacggacatttgcggacggacctttgcggacgtacatttgcgggacggacatttgcggacatacatttgccgacgaacctttgtggacggacattttcggacgaacatttggggagggaaattt

SEQ ID NO: 13922 - DNA, 1778 bp, Heterodera glycines
gcaagtgtccgtccgcaaatgtccgtccgcaaatgtccgtccgcaaatgtccgtccgcaaatgtccgtccgcaaatgtccgtaaggcatgagtttgggagctatgataaatggtttccaaaccaaattattattaaaattaaataatatttaatttaatttaattacaatgaagcgaaatgagccgaagcaacaaaatttgttttgttttcatgtgtggacaaacatttattacagttgccataatgtttgttacagtaatcctcatcaattatcaaatcagtgaatgcttacaagaattatttggtgtcaatgttcaaaattgatcaaaatgacttgcatccatattcatgatcagcaagcagagcgactttgataaaacctttttatttttgagtaaaaatttagggcaattataaaaccgggcgggcattcacagccagaaagacttaaatttagaaataatggcactagtctaaaagaggacagttttgaatttatcgaaaacaaaaaagggggggggatcagggatgggccgaggtttcgcttttcgcatttcgcctttcgcattattcgcattttttggcgtttcgcatttcgctttttggcgcgaaatgcgaaatttccacccctaagaaatgaatatatttgaaaatttaatttttaaaacgaatgcttcagtctaaaaaacccccaaaataggtgctaaaaatgggaaaataggtgccaaaaagttccgaatttggggtgtaaaatcgaaaattttcttcaaaaagcaaaatattatgccaaatcattaatgagatagataattttcaaaataaaaaattctcgccaagaaaataaacaaataaattttggagatgatttttgagaaatttttcttttttcataggtatatttttgaaattttcgagtcgattcttaggggtctgtttttcctttttattgcatttttgttaacaaattttgggcaaaacgccaaaataagtgaaaatagttttaaaattttttttaggtttttaggtgctaaaaataaaaaccgagaaaataggtgctaataacttgaaaagtagcttaacaacagcccaaaaaaacatgtttttcgtgtgtttcaggccatggggagctcaggaaaaaaataggtaaaaccctaaaaatcgtagccctacatattacactcaaaattgcataatggaaaaattcttcgaatttctccccacaaacgagaattaaaaaattttatgggtacatttttgaatataggcaatttttcgtaacaaagtgcactcaaattttcaaattttttttcaaaaaatttcacttgggaaaattcccggttggtcccagtcccggacgaaaatcgaggtccccggcgcttatcggcaccgccggacattcattttaccttaatttttgaaattttaaccacaaaatgggtagaatttgtcattttttatctgagaaaaagatcgaaccggaaaatgcagatttttttttgcatcacaacctcaaaagctattggtaaaattttttttttaaatttcgcttttcgcattttcgcaaatttcgcttttcgcatttcgccttttatttttcaatttggcacatccctggtaaacaacttaaagttacattgactcaaagttggtcagacttggccagatgggaatcggcccattccgcccgtcggacccctcctcttcttccccagaacttttttttaaaaaaagcgcgccgcaaaacgaccataaaataaattttatttcgtgcttaaaa

SEQ ID NO: 13923 - DNA, 1769 bp, Heterodera glycines
  misc_feature (1735)..(1735): n is a, c, g, or t
  misc_feature (1739)..(1739): n is a, c, g, or t
  misc_feature (1746)..(1746): n is a, c, g, or t
ttccctttttcctctcattttttgtttgccatcccttcaaatgcaatatttcccccccccccccatttattgtaaatttcttcaacaatctcacattttctttctctttttttgttagttccaatctgttaatgataaattgagcctatttagtaaagcaattagataaataattttcattttgaataaattacataattttcgcaaaatttcagtttccccccccccccccgcattttaacatgaatggcaaatgtttacttacataaataaatggccaaacttccaaagagaaaggatgtctcgagagggcacttatgagaaaaatgattgggatgggacgtacggaagggaaaggggaaagagaggggaaaaaaggggggggggagggttatcaccgaacggtggggagaggggaggggtcgatgatcagacgcacgccacgcttttaattgattaattaaccaatcgctgtgaagacaaaagtttctgtgcttttgatcaattttaattaaaaattgaattaattccttaaaattgaaacaaagcaaaagaatagtcatctatttctctgtttccgtcgcttttcagtttaagggaatgcctttcattaatcacaactttttaacattttatcaccttttttacagtaaacctttcttatttgctttcaaccatttttatgaaatgaattcgactccattaaaaatagattaaataataatttcatgttactacaataatatattttgatttaggcatttattaaagtgaattccgaaaggaaagggaagcttttttgtcgaaaaatttaattaacgaccataagggcatcattatgttggttaatgattgccattaataaacctattaaaatgtttttaactgctatacaattcgagacaaatttaaattttaaatgaattaaaagaattataaaaaaagataagaaagtccagcactaaatgcattccatttgctgtatcatcccatttgacaatgtttcacttcactaattaacaaatgggcaataatgggaggcgatgaacagcagcaaaaacagcgattgggagaaggacaaaaaatgatcgagacaaaaaaggaggaagaaataggacaaaaggaagaggaagagaaaaaggagcaaagtgaagagaaaaaggaggaacaaagggaagagaaaagggaagaagagggagaaaaagaggagaacagagagaaggaagaaccgaaggaggaggaggagaaggaggcacaaaaggaacaatgggaagagaggcagcagaagaggcgcttcgtcaagcaaagaaaatgccaaaattcggtgccacttgcgaactgggcatttaacatttaaatgcccaaagaatttagcacctgaaaatgcctaaagcggccggcggagtgcctttttccgcgacgatcagtcccgccaccaatgcgttcgccaaacagcccctcggtggtcttccgccccaccggcggcatcggttggccatcggcgacggggccctgcgggcgttggccaacacccaaaatgccgtgagcgacgcctttgaagagtattcccttctgctgcatcaaatcggaaaagccgccctcctcgtcggatggcacatttttctttgtgagtcaaaatgccattgccgtgatctgctgatcataattccccagcatttgctgcattccattcgcttcgtcgtgcttctccgctgcttacgctgactgccatcgngtgngccattntcgtttatttccgtctgatggcg

SEQ ID NO: 13924 - DNA, 2192 bp, Heterodera glycines
tcagtgattgatcagaagtttaattaatcactgattacctctgatcagtgtgattgttcgattttctgtctctttcggtcgcgtcaacgccttctcggccttttcggcatgttcttctacttcgtttgcatgttgctctgttcgaatagtccttctgaagttcgctttctctcttcctttccaaattgttcaattcgattcaaattcgttcagattgtgtggcgtcccgtcctgtggggcttcttcctccaattttccatgggattggccgttttgcgttgggattggggtgggcattcccaattttccattatttgatcaaatcaaaagcgatcattttcccaggttccaatcagttcgactccctctccgagttggtgctcacctttttggagtttactcacaatggcactgattttgtgtacggttttctctccacgccaccgaaaatttgtggttctcattaatttatttttgtttttccaaatccgtactttcttaggaatggaccccgttttcgcctttcataccgcacaaattgtcatttattttggcgccgttgtggttagcacgtgggggggggaagaacgaaaattattaaccgatcgaaaaggcgggacacacaatgccaggggatgactaaaatgaccattctttgcacattaatccaaattcatccaaggcattgctctaccattttggcataatgcaatttgtgatcaaaaagatggcatggctcgtccaaattacgctggacacaaccgccaccgaatcgctgaatgcctgcgcttgcattttcctcggtttttgccaaattcaaaaaaccaatgattactgaactgattttcgggatgagtgaggcgcctctgctgatcaggccgtatttggacaaaatgaccgcgtccgaactccacgcggttatgaccacggggtaaaagcgaataatccttcaattgcctactgtttcgtaatgcaaattgattatttcgtttgatcagtttctcgtgcattgctggtgccgtttttgccacttacattaggtaaatatggcccatggcatttacccatctttgaaatgcttgaggccattcaaagcagtgccattttgtcaaattcccggccccgcacagtttcggcgcgtgccctcgctatttgctgtcttccaccgtcatgtccgccccgggctcattggcctgtgccaaaatgctttaccccgagacggagcagtcgcaattggtcaatgtggacgaattggagttgccagcggggtcgttctattcaacaaattgattttcccacggatgccaatgtgttcagagaagaaagcagtgccctcgagtgcatcagcaacggtgccatcatggcagtggaattggtgctggccattgtggccaatatcattgtgttcctggccctgcttgctctgctcaactctgtcctgtcctggcttggccatttggtgggccagtcagattggacttttgaggtgatcagagtggccattggcactgatcactgctgattttgtgctgtcgttttggtgtgattcctcccgttcagctgattctcggctatttgttcttcccgttggcctttgtgatgggcatcactaatcccgaggagacatttcgagtggcccaactgatgggcacaaaggtgcgaaaagaattgtgccgccagtgaaagcaataattaattgccctaccgtttaaatgcttaagactgccctcaacgaattcattgcgtacaaacagttggggcaaatggtcgaacggaacgaactttcggtgttttctctttgaagtgatccgcaatagtcaattaacacagagtcggtctgcgatgatcgcaacgtatgctttgtgcggcttctccaacatcacttccatcggcattcagctgagcattttgggcggcatggcgcccagccgaaagcggcttctctctcggctggcacttcgcgcgctctttgccggcagcatttgctgctttatgaccgcctcattagcaggtaaatgaatgattgattagctgccatttgtaatttatcttattttgaaagggattctgatcgatcagccgtctcaatgtcggcctcggtacaccaacgaaaattgcttcaatgtcagcagttttctgcacattaatcaccaaacgacagccacggcacggatgggctggagcagaacaaa

SEQ ID NO: 13925 - DNA, 2444 bp, Heterodera glycines
ttaagtgcaatgaccttaattaacattaaaaaaatcgccgcccaaaggcccgcgccgtttcttttgtcctccgcctgcgccgtttccgctaaaatcagtcagtgtcagtcaatcattcatcggtcatcggccggtgcctgtgaactctccgcccgggggcattttcgtcctttccccttcggctctctggtgactcatcaaccccaaattgcccttcttccctttgtctgtgttaagcatttctgtcgaaatgcgcatttacgtgacgtaaatggtcgaagggggggggggggaaagaaaagtgaaaaattgggcgacgaaagtgaagggcgacacaaacagcggaagaagctgcggctttcccaattgtgatgtttggcgaacaattaatgatgctgctactcttagctttcacgcggcagaatttaaaggaatttggccataaatttggtgttaggcagcttaaatcagtcgaaaatttgattaaaccggaaaacttgggattttgacagattttttgtgttttatcaaagccctcctgccgtttccatttcatttgtcagtcaaattagtgggccattggcaaaggacggagatttctttggtccgtttatttgatatgaagaaaaattatatataattacacagagaataatgataaaaacgaaaaacaggcaagaatggctacaatcacaacaacaaaaggcttgacatacacacaaatacatatatatgtgacaatacgattacatcaaaatggcgcttgacatccctccaatggcatcatttcttgtcctccgctgtcgtcgacttcagactggacggcacgctcgacaccgccgaaaacttctcgacactcgccgtttgtgatgaagatgatccgccctttgccgcatctttcttcgctccattggcaccagcggccgccggcgcccccttcgctgcatcaccaccatcgacggcgtaggaatcagtgcgcgcttgtcgccgacgccacacaacgaccgccacaaccacagcaaccgccaaggccacaaatacgctgaaacagggagacaaaagttattgcagacttcatcatttattcaacaaaaagttgacagaattcggaacaaaacgcacccaactcctaacaaaatgaacaggagagtgttgccgctgccgccgcctccgtttgcagcggtgttgttcggcgtagtcatttttggcaaagtggtcgtagtggtggtggtggtagtcgtcgttgttgtgctcgttttggtcgttcccgttttaggcctgaaattgggaaaaaaatggtacaaatttaacaatagcaaaaaagagcgatgaaacaactcactttctctccttctgaccatggcaacaggtgacgaggagcgaaacagcgagcagcaagcgcaaaatttgaagaaaaccggcggaagtcatcgagcagcaaataatgattaagagaagaggaaaagtgaattgaaactgaggagcacaggccttttatataaatttaggtacttacttgttaattacaaaattcacatttaaaattaattttcgacttattgttagaaatcgggtcctgggttcggaattgaagtcagaatcgggttttccgaccatgaaacccctaaaaagcgttttttggaacaaaagatgaactttagttaaaaatgaattttcgatttattgttagaaatcgtgtccggggtttcgaaatcgaagtcataatcggttttcctgacccttaaaacccctaaaaagcgttttttggaacaaaagatgaactttagttaaaaatgaattttcgatttattgttagaaatcgtgtccggggtttcgaaatcgaagtcataatcggttttcctgacccttaaaacccctaaaaagcgttttttggaacaaaagatgaactttagttaaaaatgaattttcgatttattgttagaaatcgtgtccggggtttcgaaatcgaagtcataatcggttttcctgacccttaaaacccctaaaaagcgttttttggaacaaaagatgaactttagttaaaaatgaattttcgatttattgttagaaatcgtgtccggggttcggaattcatcgaaatggaagtcataatcggttttcctgacccttaaaacccctaaaaagcgttttttggaacaaaagatgaactttagttaaaaatgaattttcgatttattgttagaaatcgtgtccggggttcggaattgatcgaaatcgaagtcataatcggttttcctgacccttaaaacccctaaaaagcgttttttggaacaaaagatgaactttagttaaaaatgaattttcgatttattgttagaaatcgtgtccggggttcggaattgatcgaaatcgaagtcataatcggttttcctgacccttaaaaaccctctaataagcgttttttgcgacaaaagatgaacttt

SEQ ID NO: 13926 - DNA, 1083 bp, Heterodera glycines
tgaattttcgatttattgttagaaatcgtgtccgtggttcggaattcatcgaaatggaagtcataatcggttttcctgacccttaaaacccctaaaaagcgttttttggaccaaaagatgaactttagttaaaaatgaattttcgatttattgttagaaatcgtgtccggggttcggaattgatcgaaatcgaagtcataatcggttttcctgacccttaaaacccctaaaaagcgttttttggaacaaaagatgaactttagttaaaaatgaattttcgatttattgttagaaatcgtgtccggggttcggaattcatcgaaatggaagtcataatcggttttcctgacccttaaaacccctaaaaagcgttttttggaacaaaagatgaactttagttaaaaatgaattttcgatttattgttagaaatcgtgtccggggttcggaattgaagtcagaatcgggttttccgaccatgaaacccctaaaaagcgttttttggaacaaaagatgaactttagttaaaaatgaattttcgatttattgttagaaatcgtgtccggggttcggaattgatcgaaatcgaagtcataatcggttttcctgacccttaaaacccctaaaaagcgttttttggaacaaaagatgaactttagttaaaaatgaattttcgatttattgttagaaatcgtgtccggggttcggaattcatcgaaatggaagtcataatcggttttcctgacccttaaaacccctaaaaagcgttttttggaacaaaagatgaactttagttaaaaatgaattttcgatttattgttagaaatcgtgtccggggtttcgaaatcgaagtcataatcggttttcctgacccttaaaactcctaaaaagcgttttttggaacaaaagatgaactttagttaaaaatgaattttcgatttattgttagaaatcgtgtcctgggttcggaattgaaggcaaaatcgggttttccgaccatgaaacccctttaaagcgctttttggaacaaaagatgaactttagttaaaaatgaattttctatttattgttagaaatcgtgtccg

SEQ ID NO: 13927 - DNA, 1828 bp, Heterodera glycines
tcaaatttgcggatcccgctgcgggactggaactcaaaattttttgcgggacgggattccgcgggattaatcccgcaaatcccgcatttaaatttgcgggatcccgtgcgggattttggaaaattcgaaaaaatcaattaaattcaaagaatttccaaaatcaaaaaatgctgaaaaataaatttttaagggctggcgagatgcattaaaaggggctgatgggtcgactaagatttttcgattggatccgacggtaaaaagttgctcggaaatcaaattattaacggttcataaattgactatttttttcttttcaaacccacttttttgcggtgcaatttttcaaaaaactaggaacagagggtccggcggtccctatcagggatggcattccgaggccccaaaaattttcggaaatcggaattccgaccccaaaaacgtcggaaatcggaaatttttcaaaaaatatacaatataataaaaaatttctaaatattttaataggctaaattttttaattcttaaccaagtaaaaggtatttcacaaatgtttttagtatacgcttgaaaaaattattcaattattttatcaaattttttttttgtcatttttcattattttagaacatttttgggaaaaggagtgactatttttacacgttttatacagcgcgattttttcaaaaactttttgggaacttggaggagggtacggaggtgccgataggcgccgccgggaaatttttaaaaatttcagtttaatttattattagaaattgtacaaaacttactagtttaattaaaaaatttacgacttttcatcaaaaattcggatgactcaaatattatttgatgtttaaaatgtacaaaacataaacctattcaccatttcaactgtcatatatttttattacctaatttgtgtttttaaatttattatttaatttatttaaaaatatttggcattctgtcttagaaaaattttcaataaaatcaataaaatcccgcataatcccgcacaaaaaatcaaatttgcggatcccgctgcgggattggaactcaaaattctttgcgggacgggatcccgcgggattaatcccgcaaatcccgcattttccaaaaaatgcgggattgcggactgggatcccgcaaaagcccgcgcgggatcccgtcccgcgccggtctctactgacaaatatggatgcgtttttaggcacaaaaaatcgcgaaataggcacaaaaatcctggaataggcaaataaaaattgtttattaacgcttaggaagcaaatcacgtaaaaacttatcaaaaaacttgattttgtttatatttcaattattttaaagttttttcgctaaatatcaatcatatgcccctgaggccaaaatggccgacatatatatcatttgatagcgctcggtctgtaattgaagaatccgaaaaaatatttttgcggaaaccaatccttgaagagttacagacccggaacggaagtggccaaatgcctttgggactgaaccatccaatgccttaaatgcaaaaaatgctacaaaatacatatgaatcgatcggactccgtcagttgggccctcacgtttgagctcaaagggttgtacccccgaggtcggggttggatacggtataacttttttcattgtcaaccaaatccaactttcttgacccgcgacaacagcccgttcctctgaggttaaattgctccagtcgctgtttgagcattacaaaaagttggaagaaaaaatgaactccctaaaaagggaaaaaaaataatttcccctttaaaaattttttatttttccattttttttt

SEQ ID NO: 13928 - DNA, 2589 bp, Heterodera glycines
  misc_feature (46)..(47): n is a, c, g, or t
  misc_feature (61)..(62): n is a, c, g, or t
ttggacagccctcgtagtcaatcgcctgtcagaatgcttccccccnncctctgtctcgccnncaccatcacttttctgtcaaaatgtttttttcgttttatccggtactgaagtgttcaattgtcctgtgctcaaagctcatcaagagctatggaatgataccatatttgttcagattaaatcctttaaaatcccccgtatttcaaaaatggaaaaaccgatctgtcggcacatgcaaatctgggcttttaagttcacccccttcaaaaaattcagctcttttaaattaattttttttttctgtcagacatttgttaaaatattacaaaaaaatggacacggttgaccaactgtccgcttctggcaccgcagcacaaagtgttgttaacccacatgcagccgctcttcaagaaggcaagcgattttcaattaatttgcggcgcgcttaagaaagtcagtttctgaggttatttgtgacgctgatcacgaatatgacatttgttttgctgaattccgaaacttggacccgaactcgagcaaaaattcaaattcattaatacacaaggaaaatcatattttggtagaagttcagtttgtccctccatttttgaattttttatttttattttaagaccataaaaacatgttttaaggggttttagagaaagctgatcacgaatacaacaaaaattttgagcaattccgaactccgaacatgaactcgaacaaaagtcgaaattttaaactttcgagttacgcattttcggttcaaacaaaccagcttaatgcaaggaaacaaataaaaatcatttttcgaaaaaaaatttagtttttaaagtcattaaacatgtttccaagggttttcggggttgctgaccacgtatccggcaaacattcgactaatttcgaaaatctggtccggggttcggattggccgagatgggtgttagaagcggattctctcatcccagaaaacccataaaatgcctttatttcaagaataaaaattgattttcaaaaaagagtgcacccatcgtttactattaccaatgtttttagaatttcagaaagatggagaattacaatttttctagggccactccatctcttaagggctttttcggacattgcggtctagcatttgcggcttcaagtcaaaattctaggatttgtccctcccccgcgccgggttcttactgacaaatatggatgcgtttttaggcacaaaaaatcgcgaaataggcacaaaaatcctggaataggcaaataaaaattgtttattaacgcttaggaagcaaatcacgtaaaaacttatcaaaaaacttgattttgtttatatttcaattattttaaagttttttcgctaaatatcaatcatatgcccctgaggccaaaatggccgacatatatatcatttgatagcgctcggtctgtaattgaagaatccgaaaaaatatttttgcggaaaccaatccttgaagagttacagacccggaacggaagtggccaaatgcctttgggactgaaccatccaatgccttaaatgcaaaaaatgctacaaaatacatatgaatcgatcggactccgtcagttgggccctcacgtttgagctcaaagggttgtacccccgaggtcggggttggatacggtataacttttttcattgtcaaccaaatccaactttcttgacccgcgacaacagccgttcctctgaggttgaagtgctcaagtcgctgtttgagcatcacaaagagctggaggaaaaaatgaactccgtaaaatggagaaaaaataatttccatttaaaattttttaatttttcaattttattttgtggctattcattacttgctgcgtcttcgcatgctcccttttgcgtaattttgcaagtaattattattttttatgcaattttaagcctgggacttatgatggatattttcctgatggatatttaccgttttcttttaacttataaatttcgagtttttgttcgaattagtgttcggggttcggaattttgtaaaataaagctcatattcgtgatcagcgcacaaattaccctagaagaattatttaaaatgtcttttgagtgctttttatagtgcggtcacttgagtgccagctgagtttggcactccaattctggcaccttttcagcctgaaaaagggcaagcacgcccctaattctatttttacaacccatttcgaacctttttacatctaatctgactgtttttaagcatttttgagtttggggactatgatcaatttttaccaatttacctaattaattatttacattttctaactataaaatcatccaaattattttgaggaattccgaattgcaaacggagctttcaaatgccgaaaaggaggcgcgacaagccaaagagaagatgcatagcattgagcagcaaatccaagaggtgggacataaatggaggaagaaagtatgaatatgcattccctggatcatcaaactcatgtcccaaccggtctttggcaaaaaaaaaactcgagaaaagccaaagccactaaataatgttgtgttgcagttacaagcccagcgggacgagcaggaca

SEQ ID NO: 13929 - DNA, 912 bp, Heterodera glycines
aaatcgattgctctgaatgtttgtttcacttctaattagtcatttttcgttaatttttttggcattttgtctcctttaaggcgctttttcatttgcaattccctttttttgcccttttttgtgtgttccggacaaacattattgtgaatcagttaatatacctaaatttgtggtggtgtcaaatggcaatgttcagcccaattttttcgcgattctccgtggaggtgtggcaacgatttgcagcaaatttttaattggacattataaatatatatttttaaataatatattattttaataatccttcatgagcatttttttaaattttttttttaccattaatttttattttctattttttcatatttttattagatgatttttaataaatccgttattcgttttctttttcattagttttttatattacaaaattagttaattgttttttatttttaattattttttttttgtttcttttctgtaattgctcaaaaattcccttttttaattccattgaattgactttgtaaattaattttacatatgctttcattttatttttcatttttcattttttaatttgaatttgattttttcaaaattttccccacattttttgccatgggacaatgaacggaatttattgggaaatttactccaaaaattgttccaccgtcgtcgggggggggggggggggggaagttgaacgaagaatccaaagatttgtgcggattggccacacataaagggaattaccgaatggaacggttgcccttcggtgtaaagtcggcaccaagcatattccaatcaattatggataaaatgctggccggactaattttgccaccgcttaccttgacgacatcattgttgtcagcgggacaaccgaacaaacccgttcgacatttg

SEQ ID NO: 13930 - DNA, 1345 bp, Heterodera glycines
  misc_feature (1262)..(1262): n is a, c, g, or t
tttttctttcttaggccttacatgcgcaagcagagcatccagaacaagttcaccgcaaaactgggcggacttgcactgttcaaggacgaagatgaggacgacatttcgatggcagccgggggttggccataaaaagggggaatttggagacaaaaaagggggggggggactgagaatgccaaggaaaattgggcgaaaatgcctaaatgtgccgacaaaatggcaagattagatagatcagtaggacacatggcatggcatgattgatcacccggggttgacccctgagactcctaagaaaacttgaacctcggacccggaaaaagctaatttgggatcctaatggataggtttttcgggacaaccctgaaacccggtaaattaagtcttactgacaaaaacccagaatttgatttcagtattagctcactcaatattcgagaccagtgcttactagcattgatacccagtcgcatttgacccgtgagcacaatggcacagaaagctttttcggttccggaccagcagcagatgtcatattttactgctcctctcccacaaacgggagggacccgaattatgcattaataaatttataaaaaaaatttcggcacttttccatcaggcgcttcgtttatttccgcttatacaacgccagggcccaaagagagggcgaccagtgccaagaagaaggccaacttgggcgtcatgttcggcgtttacctgcccaccattcagcacattcttggcgtcaccatgttcatccgtctgttttgggtttggcacttttttccatttttggcattttaactttattttaggttgtcggagttgccggaatttggcacacaatgcttctgctgctgttgtgctgtgcttgcactttgttgaccagcatttccctgtcggccgtcgcaacgaatgtaaaaaaatgccaaaatttttgcaatttttttattaaaattttacaaaaaattttagggcgttgtcgaaagtggtggcgcctattttatgatttcccgaaatttgggtgccgaatttggctccgccattggcattttgttttatttggccaatacggtggccacttccatgtatttggtgcgtttttcgaaaatccccccttaaaaataatgataatacattttgccaaaggttggcggtgtggaagtctttttgctgtacatttacccgggaatgaccatcggaggcgaagcagtccattctgatgtatgcaaatatgaaatggatttaatttttanatagatttaaaataattatggaaaaatatttatttttttatgttaaataaaatttattttataatatttcattttatttatcc

SEQ ID NO: 13931 - DNA, 2445 bp, Heterodera glycines
  misc_feature (2334)..(2334): n is a, c, g, or t
ttcagaccagcatgttcggcatgatgtcacatgtaagaaacatatgtatataaatttagttttattgcccaattttttattttaatccgtctttttcgtgccaatacaccgtctccccctttcccctcctgtagaattaccgtatctacggcaccattctcctactgttggagtgtgttattgtggcgcttggtgtccgttttgtccaactgttggcgcccgtttcactgctctgtgtcattctgtcaattttggcatgttttgctggtggaattgagaaggcggtggtcggcgacggacaacagtaaacaaaaagaaagagcaattaaagcaaattaataaatttatttactttttaaattatttaataaattttatttttattttgattcaaaattgcaaaaaactcattaatttaaattggctatttgaaaataaaaatatattaataatatttaattcatatattatttctgtaaaattttagtattttttaataatattttgttttattttaattataaatttgattgattttcaatcattttcaatcattttgaattattaaattatttttatttcaattagcgaggcaaatcaaaatgtttttttttatttaattttttaacatttaaatttattaagcgtctgcatgttggaggaccatctgctgaattcgcgcattctgaacttgccgccgggcgaagacattttgaacatttgcaattactgcaaaaagggagatcagtcagtggccatttaaatcatcaaaatttaaattttggcatttttaggcaattaatttttcaattatttttaagcattgccgaccaattctgcgagggcaacaccaccacggaggtgtgccaaacgtacaccggcggcagtctgaagtgtgtgaacgcattccccggcttcaactcggcactgatgcatgccaacatgaaccccaaatatatgcaggcccgtgaaaatgatgaaattttgaaatttcgaaaaatttttgaaattttttaggagggtcaagcggtggaaagagaaccgaaggcggaccggagcagagaagtgttccaggacgtgtccacctcattctttttgctgttggccatttattttccggctgtcaccggtgggcaatttgttttttattttaaatttaaatttgaattttgttttaaggcattatgacgggcacaaatatgagcggtaaaacgggattttaattaatttaaaaaaatttttaagtaataaattattttttctataaatattttaaaataaaaacaaattttaatttattgaaaaaataataaagtagtcaattaatatttaaattaaaaaaggaaaatctttagaaaataatacaatttttgataacaaaaaatttattttaaataataaaacagaaattagctaattttttctttttaattaaatattaaattattatttttaagtttgtcttaaatttttttaaaataattattggcaaaaaatataataaaaaaaattacgctttttttgatttaaaatattaaatttattttctgtcaagttaaatccaaaaatttctttaaataattaaatataaaaaaatggaaattattacgtcgctttattaaaaatttaattacaaaatgaattttcaattattttaggcgatttaaaagacccccagcggagcattccgtccggcacaattaccgccacgctgaccacctccttcatttattatgcattggcaattctgttcggcgcttcaattattgggcaatattttgttgtggaaaaatttttttaccgaaataattaattaattatgggacagaaatcatagtttctctctcaaattatatgtggaagggagcttcgaattgcttccctaagtgccttaattttaaacccgaaaatttttgcttacagttttaagaagcaaatgctataaatatttatttttaaataaagtttcaaaaatgaaattttgcctatttatttagtcccgtcctaagggacaaaaacgggaaaagcattgacgggagtttggtggtcgcttcgctgtcgtggccctcgccatgggtggtcattgtcggctcattcctctccacctttggcgccgcgcttcagtgcttgtgcagtaataaattgcacatttgaaatcgcattaattaaataaaaatatttttataaattaaaaatttcatttttcaatttttaattaattaattaaattaaattaaggtgccccccgcctgctgcagtcgattgccaaggacaatgtgattccgatgttggcaccgtttgcgcgtgtcaccaaaaacaacgagcccttcctgngcctgctgatcaccactgtgatcgccgagctagccattttactttggtggtatcgagtttttcagatttttcattatccccttcacatttcgaattactttttttttgaat

SEQ ID NO: 13932 - DNA, 1410 bp, Heterodera glycines
aaataaatttggcaattttttctgaaagcaattttcataatttctctttctctgtttccacggacccttctaatatgtgcggtagagacgcataatttttaaaaatgtttaaatgtttgttatttgttaggtggtatttttcccgggtccactgcgtttcggcgctcccgtttcggcgccagcatgtttttggcttaacttttttctttgtaaaccaaatccaacattgttggtgtcgttcgaaagcttaatctatttagaagctttttctaagctattgctttgcgattagacaattatcaaaacagttatgcatgaaaattacgaaaagtcgaaatttttgaagttttttcttaataaaatttttacaggcttgaaaaacttttcgtttttgaaaggctaatagagcatgttaagagctttcgaatgataccaagattgttggatttggatgccaaagaaaaaagcttaagtggaaaaacgaactggcgccgaaacgcgtgggtcccatttttcccccaactgtcgaagtttttgtttattcaaccacaccacaaagtcaatcaacaaatcgactctcattcgtgctcatttcgcaaaatcctgtttacatttacatatatgtcttatgcacatttaattcgtaaacaacttttttatatgcatcaacgttgtttttgagtaaaccaaaaccaaaattgctcgaattcgagttcggggttcgaaattgatatgatggcgctatttaaaaggagcactattttgaaaattttttcaacttttttttggtcaaatttttttttttgttttttttacacataatgatgaatattaagtattaacagcacaattatggtgaataaaatgtatattcacgatttttatccaaaaaaaatttacaaaacaaaagggtccccctttgtttttgataaaattcaaaatctatcactttataactagcgccaaatttgcttaataggcccaaataattgtcatattcgtgatcagcgacctttaaaacacccgggtacttggtttcaggactttttaaacaaaaaaaaaatttgaccaaaaaaaagttgaaaaaattttcaaaattgtactctttgcaactagcgccaaaattttcgtttcatttttatttttagaaaagataaatttgacttctttacaatgactgcttcatcccgtcgtttgcaaaaggttgactaattacgggcttttaactttattaccatatgggatcagaacttgaatctcttggctgacctaaaatctcacttcagtgcttttttaaaaattctttttcatgattgaaactattcttctaccttactaaaatatttaactatatttactaacaggaactttccgaaatgcgtgggaacaattcgggcgctgttcgagttc

SEQ ID NO: 13933 - DNA, 977 bp, Heterodera glycines
aattatggtgaataaaatgcatattctcgatttttatccaaaaaaaattgacaaaacaaaagggtcccccctatggtttttgataaaattcaaaatctatcactttataactagcgccaaatttgcttaataggcccaaataattgtcatattcgtgatcagctacctttaaaacacccgggtacttggtttcaggactttttaaacaaaaaaaaatttgaccaaaaaaaagttgaaaaaattttcaaaatagtgctccttttaaatagcgccgataatgtacaaacacccgaaaatccccgagtgcaccacaaaaaagctcaaaattcacgattctgacatccattttaaccaatttgaaataattgaaccgattttgtgcataaaatgtgaattttcttgaaaaatggaatttgacttttttgttcgaatccgggttcggggttcgaattgggtcaaaacagatgccagattcggttttcccgaccccgaaaacctataaaacaagtttatttttaaaaaatttttttgaaaatctgcacataataattggcaagtacccgattttgtgtataaaatgtgattttttgaaaaatgaattttgactttttttgttcgaatccgggttcggggttcgaattgggtcaaaacagatgccagaatcggttttcccgaccccgaaaacccctaaaaaattaaaaaaaaaaatttttttgaaaatctccgcacagataaccgacaagtaccgatttttcagtggtttttgagtaaatttagcttatgtatttaaatcaatttaggaacaaaagtaagaattttgaaaattttgaattttcgactttttgttcgaattcgggtccgggattcgaaattggacaaaatgtgtcagattcgtgatcagcgacactaaaaaccccataaaacgtgttttcacgactttttagaacagaaaatttttttttttgtaaaaagggggg

SEQ ID NO: 13934 - DNA, 2023 bp, Heterodera glycines
  misc_feature (42)..(42): n is a, c, g, or t
  misc_feature (112)..(113): n is a, c, g, or t
  misc_feature (116)..(116): n is a, c, g, or t
aatgtttttgaatttgatatttgccattattattcttcacanaataagttttttgataaagtatgtgcatattatagtatattattattaacaatacacaattttatgtcannatntaattcaattaataaatcactaaattaaattgccagttgttggcctgcaaaaattatgtgatcgacgaattgggctgcacggactccaacaaaacaacagttcctggtatagttttttccaattaaatctaccatataaagaattaaatttgcgcgcgatggcatatttttagacccatactgttttgatggtggatgtgcggtgtgccaatttgtctacggacaaaattgcagcttgaagacgaggtgcaactgcgccgtgtgtggcaccacttttttattgggggttatcattagttgccagcatggatgcgaagactgcattaaagattgacggactgtaacagatatattggatggcatgttattagcattagttaaattgcatctctgtggagagattttatttaattatgtgttaaaatgatgtgatgaaattgcaaaaggcaaaagccatttgggctctattccagtttacgcgtccaatgagtgaccaccctcacttttttagaacagaagttttttctttcttggataacccaaacattcttgatatcattcgaaagcttaaagtttagggaatttataaatacaagaaaagaacaaatatttatattaagaaaaaaatgtaatgagaaaacctgaaattcgcaattttttgcgtatattcaagaataattttttgtctgttgcctttgtcccagaattttgctatacaaaaacttccctaaactttaagctttcgattgataccaaaaatgtatcgattgaccaagtaaggaaaaagttatgatttaaaaaaatgaaaatggtcattgattggacgcgtaaactggaatagagccagtaaaaataaaagtccctggggctctatttcaagaaatattgtcttatatattacatgcacaaagcttagtcaatcacaccgaacataatttgaccacctgaatggccctggtcaattgcaagttaaccttaattgtcaaaaaatattaaataaattgaaatttatttttatttttactaccggtaccggtttttctaataaaccggccggtattggaaatattaattttttggtgaaaatttgttaagaattcgggcgaaaatttccaaaaaaaaatatttcatggcatttatctgctgagctccggagccttccttcctcaaataaactttttttttattaaataatttttaaagcaattatgctttggaaaatttttcaccattttgtaaattttttcaatgtaaaaatttaaatttcctaacttccgattgaaaatcctgtcttgatcccgacttctcgggccccggcacttttttgttacagcttttctggccccgacttttcggtcccggcttcaagacggtcccgacttttcggagccggtttttcggatcccagtttttctggctccgtcttttcttgccctggcttttcagtgcccggtaagtcccatttcgagtttttctcaaaaatttccggccagttgttactcaaataatcaaattcttaatttcgtttttgtacataaaaaaattcggtacttatgtattatctgtgtccagattaaaaaaaatttttttttgagaataaattatttatatggttgattgggttcaaagtggtaaggagaatgataattttattttttttaaagtattgttttggatgtttaagagtgtcactgacttgttaatttttacatttctacattaatcagtcagtcactaattgtctcatggcaatatttcgtttctgacaaagcgactatttaacgagccaaggtttcagattcactaaaaaaatattaaattttttggtaaaatgtgcaggtcccaccgtatttcatgtgtagaattgaattcgcaaatttctgccgtttgtgtctcattttcttttg

SEQ ID NO: 13935 - DNA, 1004 bp, Heterodera glycines
ctggacgatacgagctttggataatacatagtaccaaaaattcgagcgccaacaaattggtctcaaaaaaaaacacatatgcccaaacgttcagactccattcgctttagatcggtaaaaaattccatatcatttgtcggaattcgatcaatgttgctcttaatggcacgtgaagcggagatgcatttttggcctgaaatttttcctattttttaggcaacgcgaccgcgcttcgcggtgactttttgcgcgtttcccgactgcctcaaaacccgtgaccgcgccatttttcggtccgcgccccatcccctggttagacgatgaaaatattttccaaaaatttcacttttaaggtgaccaatgtacagtttgtacaatggaatttcgtacaatttttttaaatttctaataaatatagaattcttttcacaaaaatcaaaattatttttttctgtagaaagttttctgcaaatttcaaatgctccaaattttttaataaattttttaagtttttctaaaatcattccatttttcaagagacaaattcgaagttttaattgaaaaaattgtacgaaactctattgtatgaactgacatggcactgctataggatctgcctaagaaaaatttattttatttaaaaatgaaatttatatgaaaattattcagcggagctgaaatatttttcttggtatggaccaatttttctaagaaattgtagaataaaacccacattttacttttacctattttagtacatattttggaattttggcacccaatttttttaaaaactccaaccaaatttccaatctgtattagccaatctcccttttgattgatcaggaaatgatcaaacacaatggacacacgaagctgtgcccattttttgcggaagagcacaaaacaaattgcttcaaaaagcaattcattagggagacgaaaatttatttgcattttaaggaaaaatgatttcatttgttttataaagctaattaatatga

SEQ ID NO: 13936 - DNA, 2406 bp, Heterodera glycines
ctttcactttttgttcgataaacacacttttaattgtgcgtacactttctttcattttccactttctaaatttcttcttttccatcacaaaatttgggcatttaatgaacaaaaggaaaagtgtcgctggtaagtgaaattcatcttttctaattaacatttagcaaaataatccaatgtttcccacatgttttttatggcttattattatcactttttccaatttgttttatcatttggcctttggcggcggaattcccacggaaaagaaaaagataaaaaaaatgttcaaagtgtcagcaaagaattaataaatggaggtgctttaacacacaaataaaatcaattccattgctatctccgaataatttggctttctttcccatattttttgcccatttttgtgctttttaagtgtccgccgatggcgggacggcagctaccggcagaagcagtccgttgcactgcggggtccaagccattcaatgcgtgggcttcggccggaagaaagtgtggccggccaaagacgcggcaaagtcgcagctacgagacagtctcagttcggtaaagagacggacaaaacggaaaatgaacggaaaaagaaaatggcaataaatggaaaaaatggaaaaacggcaaaggcgattctttgtccttcttcgttttagtcgccggagttatttccctttttttctgttcagtcgtacgttgaacatcatctgaccctcgacgaacttcgcgacgttcaccccgattcgttcattgacgtaaccagcccggagaagagcgacggactgtccagcgaggaggccaagtcagacacactttttataccgtaccctttcgttacggtaggaagcgccttttggacggaggggcaaatgttctggcgccgcccaagcgcatttccaacttgcagttgtttgccaaacagtttctgtacaagttttggcttctcctgatgggtaattagctttttctcatccctccctaattaattcctattaattgctcattaattatttgtcaggtgccgctctgtgcaccattttcacttattttatcaatttgtaccacgggacggaagagttgctcaatttgtactgtgccttcattctgatcgtcatcgtcgtggtgatgtcgttcatgtcattttggcaggaacgcaaggccattcaggtgaaaaagagacgaacggaattggaaattcgaaattcaaatgcacaattattctcagattctttatgattttgggcttcacatgccatccaatataagtgccatttattagcaattaatccattcattaatcaactaattatttgttcactttactgctcggtgattcgagactgtgaggagaagagtctgcagccggacaatctcgtcgtgggtgacgtcataatcatacggtaagcggagaagcacagtccgtatacggtggatgaccccgggaggacggacatttcgccattgaaacaaaattaaacaaaatgtaaatgttttttcaaacagatcaggacaacaagtgcctgctgatattcggtaaggcttctctttatcttaaattatctttcattttgtatataatttaaatttccctaaattgaaattcttaagcattctccagtccacaggggtcaaaattgaatcctccgcaattaccggcgaaccccaacccgtcgactacactcacgaacccgctgctgctcacatttcgctgtttgatgcacggaatgtcgcactgaggggatgttactgtacggaaggagaagctgtgggattggtgatacgagcgggaaagtatacggtgggcaactgtaatcctcctgtctgatcacttctcacttctgctcaccaatttggttttacctctctctttgcattactttttcctgatctctcacttttttttgtccgatcattcttttctttctgttcactccttctcctctttttccctttctgatcactctttctcttcttttttcctttctgatcacttcttcttctcctctgctgctgatcattccttctcttctcagatgctcggcaatttcactcacctccaatcgaccgttaagctgaccgagactcttctgcagaaggaaattgccaagttcgtgcagttcgtttccatcgtcgccttgtcaatgggtgtcattttctttctgatcggttgcatcgttacaaagttagcagtcatttcgcttttcttactcagtcattgctcaatttttggtttgaaaatgtgctctaccatttcgtcaccggctttctcatcattatgtaaattgatggctgattgaaagaaggcaaacccaaactttcctccttcgacagagttgccaatgtcccccaggggcttccggcgatgctaatctcccaaatggcaatcatcgcaag

SEQ ID NO: 13937 - DNA, 1497 bp, Heterodera glycines
tcccccttttccatttatgtatatcgtcgcttcttttctggtgcgtttttccctcttttggtgctttcctttcgtcttttcagtccatggtgaacttaaacaagcacacattaaaatgatgaagcaaagtgcacagcgaagagagttggagaagcctttgcccgatttgttggcagtgatgtgcatgtgcaacaaagtgagggagaatggcaaatagccaattgaaaagggcaaatgtcggcaccaaaatgactcttggcaaaagttaccacttaaatgacccttggaaactgtcggcaccctaatgacccttggaaattgtcggcaccctcatgacctttggcaaatgttgccacttaaatgacccttggaaactgtcggcaccctaatgacccttggcaatgttggcaaccaaatgacccttctcccatgccaaaggcccatttcgaacggacgcgtcgttcgatgcgtcgtgtcagcactcagcgtgcgttggaacgtgaattgcgcgagtttaaaatcgcttctcgtcagacaaagacgttcactgtggtgtgagtattaggggggattgatcagaaggtgccattggccacccgcagcaatcagtcgggccacgagtcggtccgcgtcccctccaacaacaatttgtcacaaatggaggccacggtgaccggcgaatggcccagcgatgacccggaacggtggccgacctcacgcaaaaggaccaacgatctgatcggcagcccattagaggtggcacttctccgttacgttgaaatggtcgccagcgttgagggcattcggaaccgatacaaagtcagactccggaaattgcgagactgtcctttttcatttttttgtttttctctttttcggtgtgcgtggaaatcccttttaattcggtccgtcgttggcaattagtcgtcgtgcgctgcttggcaactttgagcagtcaaagtcagtcaaaagatacaaaaaggcctaaatttggccaatttcttacgccgtcttcatccttcgaacggagtttcgatgagagagcggccaaaaaagagacgacagacacagcaacggaagaaagcggcgaatttgtggtgatgatcaaaggggcgccggaagtgattcttaggtaattggagacggaggaaagagacttggaatgggactgatcggacgagagagatttgaatgggagtgattggaattggactgaatggaatgggagtgattggacgggaatgattgtaatgcgactgatcggacctgcaagatttgaatgggactgatcggatgggaggatttaaggagaagagattggacgggaatgattggatagacattatttggagggagtatatttttaatgatattttaaaaattttttgattttcaaagatgagtcacgaattttccgatttattctagtccgttgtttctgaagtgtctatatagggggacaggtctctcgactcgataacggaagagtttcgcaaa

SEQ ID NO: 13938 - DNA, 3511 bp, Heterodera glycines
  misc_feature (1012)..(1012): n is a, c, g, or t
taatttcttgcagattgaaagccatccattgcctgccccttctcggcacagcaaagcactaatagggtgtttgactcacttcaaaaaataattcattacccaaaagttttttacaaccacttattgccaatataatttcttgcagatttaaagctatccattgcctgccggttctcggcacagcaaagcactaatagggtgtttgctcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatacggtgtttgactcacttcaaaaaataattcatcacccaaaagttttttacaaccacatattgccaatctaatttcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagattgaaagccatccattgcctgccggttctcggcacagcaaagcactaatagggtgtttgactcatgtcggaatttttattcctatcgccgatcaatgatcggcggaattaagagggaggaggcccttcaccaatcccccgcccgccgcgcgacatgttttcgccgttccatccctctgtccccctttccttcaaattgtcaattgtntttgtgtgttcccctccccgcccgcgcacaattaatgaccaatttgtcaaaccgcaacttttcgccccccgtccccaacttggcgaatcgactccaaagaacgatgaacccccaaattcctgttttccgtcaattttgtcccctcgctcattttgtggccccgttttttatcatttccccaatttttggcccgtccccgttctgctcaatttcaccattttttgttcaattttgctcgtatttaatgcgagaaatccccaccaattcccacaatcagaagcaccagcaaaggcaagcaatgcctcttccgtccctctctcagtccccctcatttcattgtccttttcccccggcccaattgtcggttccatttctgtcattcacccggtccccctcattcaatgatcagtgattggcccttcacttctgtcccatttcgctgtgatttgccccaattgtgataatttccagacccccggttttggtctttgttctgtggcccggtgcccttcaattctttcccatcccggtccccaattcatttgtgattaatcccccggtgatggcattttatctgtgatcaattttgtgatattttgttcaccatttttaaattttggtttaattacccaagtttgaggctttttcccggaataaattttgcttaatcaattctcggcatttgatttggccggtcctcgtccctgcctgcccctgacccccgcaccgtggaattcatttggcccgaccccagagcaagtcgggacaaattggcgctcctgggtggatctgtgaaccacggattgactcaacgaatcccggtgacacaggggaagggaaaagcaaattagagagcctagacaaggaccctctgaggcttgtctagtgttcatagtttcgtgtagttattgtcctccgaggcataacttcacgagggacgtagcggacttagtgtttaccctctgaggaagcacttcgtccgaacagagggttgaaaggtgttgtgtagtggacgaagtacttgccctccgaggaagtacttcgtacaaaagggtgttcaagcgcgcacaaggccactgacaaataaggaaaaaggcaaactaacagtcctccgaggctttagtttagccataaggcaaaaggcaaacaccttgtcctccgaggcagctgtttagtcacaaaaggtccaggaccaaggccagactgatcccggaaaaagacacaaaacaacaagtgcaccacaacacacacacacgcacaaccaaactgcacgcaatgtctgggccaatacaaaaagggatcatcaatgcactcaaagctctggataacgccaaaagcgccacctcactcattctacaccccgacccggacctatcaaactgggaaaatgccgtcaacttggaggctcaatttgatcgcgtcgtcaaggaaatccgtacaatggaaatgcagatggacagtctacgagactcatccaacgcttggattgaacttctcgcccgcctgaccggagacgacaaagacaacggcgaaaaagaatacatcaaattcgacaaaaatgagaaaatcgccgaacgatacgacgcagcatcaaccaaacttcgggatttgcgagatctcgaagcaacactcagtgccgcagccaaactgcacagaggcagagccgacagagaagcaaaggcggatcaattggccaatccacagcaacaaccgcccatgccaccagcaatggcagcaccaatgacaatgccaacattcacagcaccgctctaccaattccagccaattcaactggataaattttttggccaaaagcgaaaatggcccgaattctacgaatccttcaaatcggcaatcggcagccaatcaatcagcaaagcgcagaagctgaacttgctccgcaatctgctgggcggagaagcgcgagaactcatagcgggcttccggctggaagacgcaaactacgagacggtccttcagctgttaaaggacacgtacggagctccggaggaacacatcagaagtcttcacttcgaactggccaatctcaagccgtgccgaagcctccgtgagaccaaagactttctgcttcaacttgagcggcttacaagggagctgaacaatgccggagaggacatcgagggaccgcaggtgttcctcatgctggagaagaagctgactccaccattcctacgaagcatcctcacaaagaaaggagaggatccggcaaactggacgacaaccaaattccgggatgtgctaaccgaagcagtccggaaagaagtccaaatccaagaagtgatgggagaatatggccatcactacgtccaaccaaaagcagaagtcgtctcagcagcacctgtacaagcaccgagaacaccaaaccaaaggtcacgaaggcctaaccaaccaatggcactgcgtgatatgacatttatcgcctcatcactggacgagggtcacagacatcaagggtatgtaagccaacagcacacacaa

SEQ ID NO: 13939 - DNA, 3588 bp, Heterodera glycines
  misc_feature (2726)..(2726): n is a, c, g, or t
taaaaaatttaatttatagtaagtttaactgtaacctttgcaacaaaagcactttcgcaaacatttttaattgaataaaattagaaaaataaatttttagcgctgtaaaaaatttcaaaatctcggagcaaacccagtcagtctgctgtgtattacattcctacgtaattatgagaaaaatctaaacaatttaaaaatggcatatagttaggcacgatgaaagaataaattaaactttttttttggaaactttttggaaattttcaacactggtaccaaaaaaatcaatttataacgggcgccaaatagccgcgccagaaaagcccgcgccaaaaaagcaaaggccaaaaaaaccgcgccaaactgatccagacccactttggtttgatttggtattaccagtgaagaaagcaccttaatcgccaaaagtgcgcctttaattgcgcgcaaccaaagtgatatgggaaatttttgagttccgatcccggtttaataaaatacaaaacacaaaaaaaatatacaaaactctacttaataaattaatgaatattatgatattctgtaaggtagatccgggttttcttgtttgccggccgaagcctatgaatttcacattctcacatttatttcatttcgcatttaatttcccttttgcgtattgtcgcccctttcccgacgataattgatcgatcacattttatttttcacgtgtatttaatgttcgccatttcaagcgaagtatcttcagtctctccggaataaagccacttatcccagtgtgtccatcaaaggcgggatgggatccctgggcttgatcatcccatggggcctttccttcgggagtttatgagttccttcccaatgttccccatctccccatctgccctcccaaattgcccagtcccaacgccagcacgtccaccgcgcacggccgcgctactcaagcatccgtagacatctactcattttagagcactcttagcaatgatttttcaccgttttcacaaccttttcactgcctgagcaaatggttaatccaaacgtactaatcatcattaatcttctattttacttcgtcgttgatgattcacaattgcaaaagttcaatataattattttgatatttttccatctttataactttccttactagaatatttattatcatcatttgaaaagtttttaattattaaacaatcaatttataatcttacataaataggaggaagttttattttagttggaacggaatttgtaccgttttcagtgtccaattcaatttttcttcctttaagctgtatcttgggccttaggattttatttgcttactgaatatgccaatcaatgtccattcatccaattttcacatcttttataagacagactttgtctaccaaaaatgggcgttattcaaaaaccattttaataaaaataaattttacttataactttgctaaaaagcaaacatattaaaataaaatgattttatattttttaaataattaatatagtaaataaatatttgctcatcaaaatgttctatccgaatttttccatctttgccatggccattggaatgttcatttattttgccgttacctccaaaaacaacacaacaaatggtcattaaaattaaaaatccattgaaatttaaaattttaattatctctcataatttaagctttgatggcgccgacgaattgtgccgtcccatcgatggcactccgttccacgagcattgccggcactcggcggtggtcaaacataagggttttgtgccgcgccatttgcgttcgccatggcttaattcgccgctttttgacgacaatgaactgagcagcggagaaaacacgtgctacgcatgttataagggaacaaaagcgagcaatggcatggcaccgggggaagagtactgtgcttgtacggtaggcatttgatacggtaaaactgttaagctgtgccatcttttagtacaaaggtcaagtgccgaacgagaaattcggcattgtttttggcacattcaaccgaagtcggccgatttgtctgagggaattgcaaaaatttgcatttgtaaaaaataataaaaataataattgtatttaaattttattttttgtacagatgccaggctgcggtaacaaatattatgaccatgtgaagcattgtgccatggtatgccaatatcatataatttgtttatttatttatttttacaattttaggtcaatttctatgaaaatgaaccggacaaaaatcctaaagaagatcctccaaatgaacgtcgtaattaatgaatatttttgtgccaaatttttgttcccattttcggcactctcgcactttttgacggatgcatcaccggggcaagcaaaaactgtacggcaaatgtgaaaattgattacaatgagacttttcaattgtccaaatgctattggggagaaagtcgccaaacagcttttgagggcacgtaagtcgtaaaaacccagttttaattaccgtaaatactctaattatctcccccctccacgagtgggagatttttcgaaatcctcagaaaaacttttttatataaactttttataattaaagattttcgagttttatatcattgattacaggttgtccttaatcaaatcagttttttagggaaatgtaattcggagaaattgaaggttttgataattaagagattccttaagttgcaggggatgaacgttacatgattntagttcgaactacccgaaaaatttggagggcataccataattctggttaaaccaatttttttatttttacagtatccaaatcaaagcatccgttgatgggtacggtatgagtggcgcttcaccgttcacttttcccgtggtttttgaaaaccgacacttgctgggacccgattaattactacacttcaccttttttcgcgaatataacgatcacattgagtggcgagtaagtctataaaattgaaaaatgaagacattttaaagaatggaccttgactcggcaaatgatttgttttctgaactatgatcaggaatgaccagcagagtctctgatacataaaaaattttgaaaattcagtggacatggattaaggaaacgaatccataaaatggttttctcctgctgatccgagttcattttcaaaaaaaaaaatccagacaaacccataggtctttattggcaatttttgatgatggttttttaaatagatgcggcacagcaaaatacgagctaacgtggcttgacgctaatcgggttggttcaaattagagagaagaaaaaaaacactttttgaattctgagattaaaaaatccaacatttaattgaaaaataaattattttatcaagcaggcacaacttttttgtaaataaaaaatatacgaagcaaaaatttttacaaaaattattatgttgattaattgtaatttttccgggtcttttgggttgagaggcagggataaaaccgaataaggataccggagtcaattcaaatcactttaatcgcaacacaaaatttaaaagagaaagagaacaaacaatggaggatgaagtcaatcaaaaagaaaagatgagaagaataa

SEQ ID NO: 13940 - DNA, 4530 bp, Heterodera glycines
tttgataagcctcttgtgacccaacgggggtcaacggcttaatggtctgtattaaagggctcctgggtgtcccttttacagaaaatgataagactaagactctttcttaatctttattcaattcaattgcacaattacaatttaatgcaaatgcttggacagaaaactgtcccgacttaatgctgatcaagcagaagtgcttgtagaaatctcacaagatgaagtgaatcaagaagtgagaagcaagaagcaagaagtcaggaaaatggagaatgggccgggcttttataccctcacaaatcaatgggggcggggccaggcacgtgaaaaatgtgcacaaacaaatagaaaaaaatccataaaaatatgaggaagagagaagatgactcataattaacgagcgagcgaatgcaaaattgatcgatgaaaaggattaaaaaataaatgaaaatttccaagaaatttgtgtcgcttttggcgacattctccgggcctcgagggtggcggcaactgttgctgtcctccgccaaaattcttttcatcgtcggttcatctgaagtcgacgagccacccttggaggacgattctccaaacgtccatctggtagctgtgcttggtcaggtggaggaagatgcggttcctccaccactgcaggcgctctccaggcaactccgactcggtttcggatgttgaccaattcgaccaggtagaggtcgacgagcatccctccttcgtgagggctgaagcctacatattcttgtaggcaaggcatgaatgggtctatttcgtgacccattcgttggtaatgatccattaccgatctacctcggaagaggtagagattttccggtccataacatgtgaatccatcaaaatggatgtcacgaattggaccaacatgctctgaaaacaatgtggccccttcgcggagttctccacgaagtcgctcttcgacagcacggcggtcaagtgctgtctcgtaccatctgggttcatggtatcgctcaatccacgaactcagaggctcaatccggccatgaactcgacgttcacgccggagatgagcgtcattcgctctctcttcttcctcctcttccaatcttggatcgcgtagccggcgatcaacatgatcgggaaccaatggtaagactggctcccagtcttcctcaaaccatgggtcccggtggggattctcatcgccaaaaaggcgatcattgagaatctcggcattttcgggtatgacaacccggctagccgagaagtacggcccttctcttatgggaataggcattccgtggaaggatgatttgaagagtgtgtttgggtggcaaatccgccacccttttataccaccattcgatggaagcgatgaatcattccccacaacaagggatgactcacaaaattttttgactgccgagaggataggacgtgattcaacaccacatccgaaggatcctcccccggccaagtacagtattgccaatactataggcacattaccgtacccctttctcgttatagaccaggaaataaatttccaaagtctatagaaaggagaaagtttcatgaaaattgttaggcaaacaatgcctacacaaataatcattatgaagatgagtgatgattggaggccaatcaaagaccaaagggtcgccttccaatcaaaattccagttaggccaactggattggctgtttatcactctttcagagtgatttggactgtaatcttctatttgttcgggttggacatagtgtaatgtccccctgagaacaaaagaagtgtttccagccaaacactttgtttggcattttgtctcaattctggctttatcaaaagccaaaattgtttggtaaattgatgcattggaatcacattttgttgaaaaatgtgttccatcgtcgcaattaatttcggcaagagaattgccaaaatttgtcgagcacacataacggaattgtgctcccgttgaacatctgtaacacccagatatgttcaacggcaaaattgtgcaaaggctttggtgaagttccaaagccatttggagaccttctatttgaaggtttaattggacaggactaaatcctgtcaaggcaattacctttctcccagtatttctgagttggtaatttttgatgtttaatggaagtctcctctcaggactttccattaacttttcaaggttatgtgaacggcaattgcagttcactaaacctgatgaatggtcaggtatgcaatcagtgcatgcctgaacgccaagactgcaattgaaatcaattgcttcttgtcgacttttacagttaaagtcaattgttaatggctctctggttagagccatgttgctcccatcaaaaacaaaatctgagtttaagacgggggcgggcggaaaagttactccgatcggagtaaggctgatgttgttccatctcagggttcttcctggataaagaaacacctgagttgacttgggtttttcgcccaaagtttccaggcgaattattgtatagacaataaattcccaggaattacagcccatgatttcatagactgtcttggatttttttcgagcaaaccaacgataaaataggcaggcactgccgcctaagaggcatttgttgccccaaaaggctgtgctgtccaggcaaaatgaattgccaggataatcgttggcatcttttagctcaggaattgaagtattgtggcgaacttctccacaatactttccttcgcaggagcccattttagggcaccttttgccggccaacacattaattgcgtatgaacgcagccaggctttagtaaagctttggcattccaaagctaaagccttaagcacaacatttattgagccaaggagaacaccttcctctgttttcagaagaagagtgtttgtttggccaactggcagcaacgtcagcgttgccgagttttcgacaatgcatctcatgcttgtcgcatttttaatgcatttttccgatttggccattactgcgatggtctctgctccagtcaaatcctggagagagttagccataaggaccacaaacgccattgttctgtaaacacggcgtgatgtccaattttgagaagctgttgcccttggcctcctctctttcggagggcgatttgggccagctaaataaattattggcctgataaattgaattatcagccaaatgaccatataaagtcctgaaaacaggacttttaatatggaaaaagccacaaagcttatgctcatgaatgataagcaaagtccccctgctaacattgatgaaatcaatggataacaggttggattcgctaactgttcaatgcaaaaatagcattcgatgagttcacactcatcaactgctggacataaaatgtcttttttgaacatgtgtttcgaatccatccagaaatgaccttcgcatttgaagtcatttaggaggatctccttgggcagctcgtaagtgagcttctttacattctcatgaatgtaacagttctctgcacagcagagctcaactttattgatttcttttggatctttgctttaacgcctttgttaaagcaaagaagtttgcattcattgcaatgattggttggataagctcctaccaacgcaaacatagcaaaaaggatggaaagacagttcaaaactgtccccatctttgctttgctgcgagtgatcatgccatgccggttttggtcaattggttgatcaaccaattgaagagtttcagtctccttttcatccattggagcttccaaatgagagatttctttctcatttgttatttgaggagtttcatttgaactctcttcaaatttttcttcattttctataggattatctaatcctacttccaatgggaaaatcttattcaccggacgggtgataatgattttccgaggcatggttccatacctctttgattttatcccatgaattgggagttccaactgaacgcttctaatggcccctggtcggccattaagctcaatgatctttcccaaagaccattggtttcggggagtgaactcctcatgaatgaggacgatcattccctcctttggttctgttttgtcctgaagacggggactcttgtggtcccatttacctctctcccgcagaaggaggaggtattctttttgccacatttcccagaaaaattcatgggattctttagttgcctgaaaaagggcaactaatttttggtgggatgaaagatttcgatccgatggatcgaattcttcaccattcgtgtcccagttaatttggacttccggttgaaggaagtccactggacgaaggggcaggatttcatccatcccttctgacacagaagtaatagggcgatggtttaatgtggcttcaacttcagccacaaaagttatgagttgatcataactgaggacttttctccccaaagtccttttgaagcaatttttgcacaattggacaaggcgttcataaacgccacctgcccaagggctgatttgtggaaagaatcaccacttaattttattaagggcgtaaaa

SEQ ID NO: 13941 - DNA, 1365 bp, Heterodera glycines
tttttatgtaatcacatattttttcctggcttcttcatgctctaattagtaggaaaaacactttcttttttgtgtttgcgaacaaaaattggaacttttatttacatatttcgggttttttttacatatttgatacatgttttggactttttagcattttttctcaaaaacccaaaatgttgttgttgttgtttttaaattgtgccggtttttttagtgttggacaaatatttaaaaaataatttttcataaaatctcattaaaatatttctaaaaattttttctcggcaacgcctttccgcgcaccccctggtcccaaaaccgttcgaaaattttaaaacttgacccaaaaataatttttttttttttttgaaaaatgaataaatttacttttttatataaatattttcttgcttctgcatattttttacatcaaaaattgtaggtttttgtgagcatataaaacattttacgcctttgagaattagaaatttcaaaaatcaaaaaattaatgcaatttttggtgccaatttttgttgtttcctataaattcacacactcacccattattttctaattacgcccctggattagcaattcatcattaatgattgtttaatgattatttttcaccgttaatcgatcccaaaaaaatccctcacaattttgttaatgcgaatgtttctggttatgattgctacataaaattgcttcgtcagcatgtacccagtcaattcctgcttttattttaatgtttctttaataaaaatctgaggattagacaaatcattggcatttttttttgtaatttttcgtgataaaaaacctcccttttttgttaaaattattttttatttttaacgtattaaaaaaaattaaaaaaatcattatttttaactatttaattttttgttaaaataaatattttggtttattattttaaatcaaaaattaaaaaccaatctatgtattaaattaatttctcacgaaaataaaaaaaattgcttttaataaagaaataaaaaaatgaaaaaaattttttaaaattttttgtattttaatttcatttaaatatattaattaattatttatttaaattattccattagattttaaatcaaagcattaacctgacattttttcatctcttttttaccaatttttaatgatgtttagccgaaaataaatagtaaatgaatacaaccaccgctgtcacactaaattgcttttcttaagttacattttttggcttcccaatgtctcccatgtggtctagtggttaggaatttgtggttttcaccccacacggccccgggtcgattcccggcatgggaaagaaatttttttcaaaaattaaaattttaa

SEQ ID NO: 13942 - DNA, 3721 bp, Heterodera glycines
  misc_feature (56)..(56): n is a, c, g, or t
  misc_feature (86)..(86): n is a, c, g, or t
  misc_feature (104)..(104): n is a, c, g, or t
  misc_feature (114)..(115): n is a, c, g, or t
  misc_feature (120)..(120): n is a, c, g, or t
  misc_feature (125)..(125): n is a, c, g, or t
  misc_feature (127)..(128): n is a, c, g, or t
  misc_feature (147)..(147): n is a, c, g, or t
  misc_feature (149)..(149): n is a, c, g, or t
  misc_feature (170)..(170): n is a, c, g, or t
  misc_feature (172)..(172): n is a, c, g, or t
  misc_feature (229)..(229): n is a, c, g, or t
  misc_feature (250)..(250): n is a, c, g, or t
  misc_feature (261)..(261): n is a, c, g, or t
ttttttcaaatatttaatatattttatttattatttttaaattaattatattccanaataaacaaatataaaatatatttaaaatnctttatccatctcccatntaatctaatnnttaanatttntnnttttcacccacaccacccnanttctattccccacataaaaananattttttttcaaatatttaatatattttatttattatttttaaattaattatattcnacaataaacaaatataaaatnaatttaaaatnctttatccatctcccatgtggtctagtggttaggatttgtggttttcacccacacggcccgggttcgattcccggcatgggaagagatttttttcaaatatttaatatattttatttattatttttaaattaattatattcgagaataaagaaatataaaatggatttaaaatgctttatccatctcccatgtggtctagtggttaggatttgtggttttcacccacacggcccgggttcgattcccggcatgggaagagattttttcaaaaaaaattaatttaattttttttataaagctaatttcaatttttattttggcattaagatcttagtaaaataattttaaaataaaacttaaccatatataaaagtaaatctcaaagaatttttcaaaaccttaggccaaaaattcaaaaaaattcctctacccctccaacatttttaattaaattaaaaattattttatatttgaaatctttggcgaaaaaattcctcgacaccaccagcattttaaattctattaaaaattattttacatttaaaatctttgtcaaaaaaaaatttaaaaaattcctcgacaccaccaacatttttcattataataaaaattagttttagcgtatttattatttcgatattattatttaatttcatatatcaaaaatattttcccacatacatactgatgatgatgcaattttttgttttgcctttttactccgtaatgagggtgaatgaatgaatgttttgtttgtttgtgcaaaataacaacaattcccatccgtccgtcaaaacaggttttatgtaacacaattttcgtgtgccaatttcgcctcattctccgctttatagtgcacacataaatcgaaaacaaacaacaatttaacgaacaaaagaaaaacagtggaaaacggacggacggacaaatggacgacggacaaatggcggaaaatttgtgggacaaaacaattttttttaatgttaaaacacaaaatgccaacaacaacaatgtttcgaaagtgtattgatgttgatattgttaaataagaaaagaataaaaattattaaattattatttttttgtaaaatcggacaaaaagcgaaccaaaaaaatcagtttttttcaagtgccatcggcctcgtgctgggacgtttcctaaattccgccatggagtaattgaaaatcaaaaataaaaatcataaaattgcttttatgccatagaaatgacggaaataaaaaaaactatttaaaaaggaccgttcaaacttttaaaataacggaaccataagcttatttttgtcaatgcacctgatttgttcctcatttttcagcttggctgctccatcaacaaaaagcctaagggcacgactattaattgatggcctgagggggtaattaattaattggaaaactgtagtaatttacagtacaggacagggaggcgcaaattttgtgcccaaattgtaaacacaaaattgttgtttttgttcagcgaacccaaaattgccagcacactgtgtgagtgtgtgggcggggagaaaatcgagaaatacctcacattaaaatggtatttgtaatttgatttgattttgatcgacgggtgtttttggggtgatctgataggctgattgataaatatggacaaaggaccgattgatcaaaatttgattgatcacccaaatcacaaaattgtacaacagagaaggggggcatcttgctaccgcccaaacttttgtcaacaaactctcatacattcttgatcaacttgatcaattgatcaaacgacgtaataccatttcccgaaccggctgaaaatttttttttgttttttgctataaaagtgggccgaaccgacgaaaaaaatcattccataaaacggatcgccaaaaacaaaaaccaacaaatccctcaaaaaacaaaaatgtctcctttccgcttcctgatgatgttgctggttgcgctggtcgctgccatggccatgggcagtggtgttgaggccgctgcgccagccaaaggaaaagcgccggcggcagcagcaaaagctgctccggccaagggagccaagaagccctaggcaggcaccagcagcaggtagggaggcgtgggtaagggatttacatttttggactcaacgagaatttcgaattttccccagaatttattttgaatcgtaaaacgaaatcgcactaaaatccttgaaaatttcggctccaattaaatagtttttctaattattactgggtttaagggctgttcgagagtcggattttttctccaaaaatttaagtcgaactcaaaaaagagaccaccaaaaaaaaccaaatttgtcggttcgagaattgaaaaagctcggcaacctaggcattcgctaactgttactatgctctggagtccccatgaattattgcttccgcatttttggtcactcacgaatacagtaaccatactggtcaaaaagagagataataaccgtatgggaaagattttccgtttgagaaatttcgtttttttttaatctttatttctaatttaggtgtagcagaacaactgcggacatgtgtgaagaatgatttagaatagatgaatgttgatgaaaaattcggtgattgttttttagaaagaacaaaggcattggaaattttttgggttttgcggaagtaaagaattcattcaaattcggattgattaattttgaaaataattaaggaattaattaaaaaataaaatttaaataaaaaataataatgaaaatcaacaaaaaaaaaataataataatgaaaaatcaacaaaaaataaaatttaaaatttgattataaatttataaaattgaatttttattcaaaaaattcaaaaaattaaatttaaaaaattaaaaatttcaaacaaattaaaaatgaattatttacaaaccttttaactcctttaatataatttaaattcgttgaaaattaaatttaatgatttttatcgaaaattttttaatctatcaaactaaaaataataaatcatttgttcgatgcaataaattcctgtgggatgtgttccttggcttccttcactttgccggctttcttcaaaagctcatatttttcgccagaaccaagcatcatatgagccggacagaaccacaaagggcctaattaatcaaatcaaaatttaaaaaaataatatttattaaataaaaaaattaaatggaaaataaatttgacggaataaattttttaaaatgtgaaggtcggcccgactcaaactcgatctctgacctcgataatttaggacgacgattttctgatacggacaatctaagccaggatgtcacacatccgttctgtctttttttttcaagggttgtcctttttttgaaatttcaatgcaacctctgttcatagccctcaaaattttccagttttcccgtccaataatacgttttttcccccggtaaatttggacaattta

SEQ ID NO: 13943 - DNA, 1695 bp, Heterodera glycines
  misc_feature (21)..(21): n is a, c, g, or t
atgttacaggtgaaaagaganatcgggcgaaaccgttttctgggacgtatcttcaattaacaaagaacggaatggcatttgcgataagttattgctctatgtttcaccgcttttcaggcttcgcttcgttgtttggcacagcacggacgctttttggaaattggaaaggtcgacttggcacaaaactcggccttgggcatgtcgctattcttgaaaaacgttactttccacggcattctgttggatgccatcatggaccaatcggtgggcgacatggaggactggatggagtgcgcaaggctctttgagcagggcatccaccggggggtggtacgaccactcgacgccaccgtattcccttctgacaaatgcgaggaggcattccggtaagaggagccgttccgccgccggcgacacaatcaaaaattttaattgacctctttttctaaggtttatgtcggccggcaaacacaaaggcaaagtgctgatccaaatccgcgaggaggaacaacaactgttgtgcgcgccgtctccgatgcgcgtgagggccgtgtgcaggacactgtgcaatccagaacatgtttatctgatcactggggggctgggcgggttcggattggaattggcgcagtggctgatcaacaggggcgcgcgtaagctcgtgctcacctctcgatcgggaattcggactggtgagtacctttgggaagactttcaccacaactaaagccccccccccttaggctatcagtcgcgatgtgttcacttttggcgacgtatgaaagtgtcagtcgcggtcagcacacttaacatagccaaaaaagtgaggagggaaagggtttttgtcggcactcactgatcactcaccgccacaggaggacgcggtcgagctggtcagaagttgtcttgagattgggccgttgggcggagtgtttcacttggccatggtgctaagggactgtctgttcgagaatcagaaccagcaaaacttcaaagacgcggcggaggcgaagtatttcggcacgattagtcttgacgaggcgacgcgcaaaggctgcgagcagttacgatggttcgtcgtgttctcctccatcacttcgggacgaggaaatgccggacagaccaattacgggtggtccaactcgacaatggtcagtcatgggaaaggatttggctttcgctagagtgccattggcgtcgaaagtgtcgagaagactcgttttttgagtggcattgtgttgtaccctttcacctcctcccttttaaggagcgaatcatcgaacagcgccgtgcggatggtttccccggcattgccatccaatggggcgccatcggagacgtgggcgtaatccttgagaacatgggcgacaataacactgtggtgggcgggacactgccgcagagaatgccgagctgtttggggtctttggacctgtttctctcgtggaaccatcctattgtttcgaggcaaaacgcgggcaaagcggcgaatgacttactctttctgcttgttcagttacatcaaagcggacaccagtggaaagaagcagtcgggcggcggcaatttgttgcagacgatcgcccacattttgggtgtcaacgacgtctctcagctgaacccggacgccaatttgggcgatttgggcctggactcgctgatgggtgtggaaataaacaggcactggaacgcgacta

SEQ ID NO: 13944 - DNA, 2203 bp, Heterodera glycines
  misc_feature (995)..(996): n is a, c, g, or t
aaatttgggggtcggggaccccgatcgggtagtgatcaactaaattttttaacaaaaaaaaaccatttttttaaatgctcgaaatcttccttttttcactttaaatctcaggttccggtcccggtagggcaaccgagaaccgggaaaaacaagcactggtaagaatggtggtcggagtgtacaattagtgatgaaaattggaattaaaggaaaaaattaaaaaaaaataataatatactttaaaagtaacgcacacaagtatgaaaatggtctagaggctggtcttcttgattttctacttctttcccattgttcaatccctatacagaaattaaaatattttgaattttctttttgtatattcattggtttcctatcgacaaaatatttttttgaatgatttttaaaaaaattctttttatttggacaattttaatttcaattttttcctcatttttttgaatgacacaaattgtatcattttttaaagaaaatccatacaaattgagcctagtaatctcaaaaaccagtcttttttgttgaaaatctgtcaaaatttccctcggcggcgcctatcggcaccgccggacgctaaaaatcctttattttctttaaaattagctcaaaatcaccaaaattggggcaatttttagacaaaatctgttaacaaattgcattaaatttccaaaattttccccggcggcaactttttggaaacttgaggtggggggatgtggtccggcggtgccgatagttccgggaaattttttgaaaatgagtatgatttgttaagagaattttgtccaaaaattgtccaaattttgtgattttcgagccaatttttaggaaaaatttggagttttggggggccggcggtgccgataggcgccgccgaaaagtttttcgaaatttttaattaattttattaagaaaattgttcaaaatttcaaaaattttcaagagtccccaatcccccgaattagtgtcgggggggnnggggggggtcggagggcgggcaaaaagtcgggagccggggacctcggggggcgacatgtcgggggtcgggaataggtccaaaaaacgtctagggtcggggcggggggctcggggtcggggagcaaccctacttttaacattaaaaaaaaaattttttttttaataaaaatatttattaaaaaatgaaaaatttgccgaaattctggatttttttttgaaaatttccaaaaatttacgtaaaaaatcctcaaaatatgtaaaaaaaaatgaaaataagtaagaaaaagttcaaaatatgtaccaaatatgtataaaatcccgaaatatgtaaaatatgtataaaccccgaaatatgtaaataaaagtcccaacttttgttcacaaacacaaaaaggaaagtgtttttcctactatttagagcatggagaagtgtttaaatatgaacacaaatatttttaacgcttagtttaattattagggatgggttttttattttttaaaatattttttctgcagcttatttgttagttatggcgagcgaagcccaaaaatagcattttctccgaataatttttgattcttattaaaacataaaaacacatattttggcgttttggcacataaaaacatgtcgcaaatatttagaggtttggcacatactttggcattttttagaaaaatctgtaagaaaaaatgcaagaaaactgaaaaatacacccctaaaatgtaactttcttgccactgcttataacatttttcaaaatttatttctttatttcgaatgccaaaagtaatttgttcttcaggaaatgacagataaatgacatataaaactgagcaaattcaaaactttcaacaatttttgcaaaaaaaagaaaaacaatggactaaggtgtgttttaatttctatgcaccctccaaatagataaaattcttacaaattcagcgttcaacataatgttttttacggtttttaactaactgtctgtttttttaatatttctgcccgttgaaaagagggttgggcgtaagggtcaccctcgtttgggcgccagccttagtttttggactataacttttttcgctgttaaccaaattcagcattcttggtatcattcgatagcttaacatgtttgaagctatttctaagctattgtttcgcgattagacatttgccaaaaaatttataacatgaaattgcaaaaaa

SEQ ID NO: 13945 - DNA, 2496 bp, Heterodera glycines
ccatcgccatttcgtcacaccggccgtgcttttcatcgctctaatcgtacgccgactcatcacccgtatgcgaatcccgtcgaccgacaccagccccagccttttcggatgccgaatcagcaaggcccgagccgccgacagttccagcgctgaggacatcgcttgtcggagggcgaggatgtcgtaattaataatgacctcattttatttttgattttatgatatttttggcattttgttttaatgtttgtgatttcgtttttgttttcttttttttgtcctcagactttaatttggaattgcctgacataaaataataaggctttattctgtgtgcttcaattgtgtgtaagtgctgaactgttcgacgtgctgctgagtaaaattaaattatttgtacgggtattcccaaaaagtttatccttaggcgtgtatttttctctttttttgcatttttcttatgaaaattaccaaaaaatggccgaaatatgctctaaaagcgcaaaaatggcaaaatatgcttttattctcgtaaccccccaaaatatgcatttatatgcactaaaaccttcaccaaatcaaaaaattttaatgcagaaatgatatttttgagcccctttcttcatagcatatgctcagaaaaaaatgcaaaatcatagaatttgtagcccccctacaaatgatatgacattcagaatttaaaaaaaatcacaaattcgaaattggaggagcaaatttcttttcccatttgtgcaaagttggaattccaattaaaaattaattaagaaaaattaattagtttaataaattattaggcataaaagaatatttttaaaactcggaataaaaccccaaaatctgcgctttactaaataattatctaacaaatttgtgttgaattcgagattttttgggtgagaaaaatagattttttgttaaaaataacagagcacaaattgttaattgcgttaattaaggttttttctttttgggtcaaatgctgaaagcatgtttttttgttgatttattttctaagcaataattcaagaaaattctcatttttccacaaaattgctcgttgtcagtttgattgaactgtccgtgactggccgatggacaattatctgactatagtataaaaatgaaatgcttaacagatctcatgaccatattttcaactatgaattttaaataaagcctaagcataggccttggcccaagcaagcttaagcctaaagctagccttggccttttagctggagctgaatgggatacgtttccatataaatatttccatatttttctataattttagtgcatttttagttttagtccatttgtaattgaaacttaaaatataaaaaattcaaagtaatctggctaatgatcttatccactattaactaaagttaaattagtttttattcgaaatcttttataagaaacatgtatttaagttttgcactttttgtcccttgacatagcactgaattgtcatgagcaccggcagagcaaatgccgaggaaaagtagtgggagtttttttgcacctttttgtcaatattaatttgacaaaaacaaattaatttaatttttattacggtatcactatcactgagggattaaaactaacggcgaaatttgaacagattgtcacccacacaaacaaaggaataaaatgataagaacaaaaattatttttgaaaataaaataaactatttttgcatttttttcattacccggttggaaaaccttggacccggacccggtttttcttgatccggtattatccgaaccctgtttccaaatacctgaacccgtctaaccagcatactttcaatgccaattaaatttgccaacgataaaaattattttaaatttattgaaaacagtgcttgaaaattaaactttccgagcggaattggcacacagcgtgggtgccaccacacagcaacaactcgtgaaagcagaagtaaggctcaggcttattgttgctttgattttcaaagcaccaaagggtaaggatacaccaaacattcatcatattcataaaaatggttatttttctcaaaagatttctaaaaatttaaaaattagtttattttttcttttacatgaaattgaaattattcaatccaatcggaaaaatttaccgattttcaaggatattcttaaatgattaattaaattattataacaaaaaagtttaaaataaaaaattttcggcataaaaataaatttttaaaactctgatattaaatatttgaaaatttaaattttgctttttgtatttatattcaaatcattaaccaattcaattaatgggaattttaatttacataaatggttcaaagcgcattatcagttcgcatttagcaaaggcatattttcaaagaaagcctttcaatctgaacaatgaagacaaatgaaattgaaatgaaatgcaattagaaataataaaaactcgaaatctgcactttcctaaataattatcta

SEQ ID NO: 13946 - DNA, 2166 bp, Heterodera glycines
tctagagtctttttataactaaatgaaatttaagcaaatttatttaaaaaaatatccgaaagaaaaacatataataaagaaagattagttgcataaattgattaaatgaataatgactaagctaataagatcaaaacttgaatgaaaaaaaatttacaataaaagacaaatgaaattaaaaacgtaaaataattctgaatataataaataaaaaataataattaaaataggatataaatgattgggggatttggatttgattatggcggactcgggatttgattatggcggactcgggatttgattatggcggacagggatttgattatggctgactcgggatttgattatggcggactcgggatttgattatggcggactcgggatttggttatggcggacagggatttgattatggctgactcgggatttgattatggcggactcgggatttgattatggcggactcgggatttgattatggcggactcgggatttggttatggcggatttggatttgattatggctttggtgacttggatttgttgtcccttttcttcattcttcttaagcttcaggggaacggaattgcatcatgaatcagttgtggcatttggcgacactgaaaacgaatttaaaatatatgtttattatttatttttattttaatcgctaattttggttattttatatgcaaagctaatttccaattttaaaatgactaatttaaaattttaacattgattttttaaatgaatttaaattcaccatcagcagaggaattcactccaacactcttctccatctgaccattttcgggcttctcctacataagtaaatgttttgaataaaaaaatgaatgtttttttaacattattattttaacaatttcttaattttttaaaatgaggctttcaaggaaaaagtcaaattaaaattatacctcatccagccccgcctttagtgggggaaagaggaggaatcactcccgaaataaaaattaaaaattttcaaaaaaaaaattcaattttcttaataaattagttataagcgccgccggtgaaataatcgggaactgtcggcggagattaaaattactgtaaattgaacagaatttccagccggcaaaaaaacattggcaattgtggttaacaaatgaattaattatgtttatataattaattttctaattgaaaaccaaccaattcatcatcggctggaatttgtttgaaggtcttcttctgctttttgcaggctttttcctttaaatggaaaagagtaaattttgaaaaagaaagattttgagaaaattctaacgatttactactgctgtttcgttaaatatgttttaagccaatcaataaatcttgtttcttgtttgtttataagtgagatttaatagagaaatttgagaaaaatttacctgcattttctcgtatccctccgatggtacaaaaacatatgttgtgttgaaggggcaattattatcgggcttgggtgggcttttcttaaaaagtttttttgattgtttaattttaatttatttttaaattagttattattttcgcaaaccactcaaatggaaaaaagtgaaatttttaaaataatataatatcaattaaatacattccagcaaatgcgattttccgcatcacaatctgcttgcttgttgcctgccacacgttgagtagcagctaaaatagaagaaagtaattaaactgactgataaaatttcgtttcatttttacataaatattattgtgcataattatatataaaacttactcataatgctttgcttcgcacttgcgtgcctcattttcataagctaaattataacagaaagtttatgaattagtattacaaaaattctttgatctttttgactaagaaatattaatttaatttttttaaaataaagacccgaatgtgaaaaatttactttttaataataaatatccatttgaaattgtgctttaaaaagtggtattttttgtccaaatgcccttttttaacctgatgaaatttgtgcagtgcaaattaatttgctaacctttgcattgacagatgtatccctaaattttgataaactttttaaataattaaggtgtgaaaataagagaccgcttttgcaagcgatagtgttattaacatgccttaaacta

SEQ ID NO: 13947 - DNA, 3564 bp, Heterodera glycines
ttatttttgcataattaattcataaatatttttttcagaccttgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcgggggggggggggaaaatccaaaagtgataaatttacaaattcttttttttttgtacatttttttggtaaaaatgatgctttttctattactcacaacaatgacaaggattgacaggggttacagtatcctcgtaactaattttcccatgccgaaacgtcaagaactgtccttgcttgccttcaaggacgaacagcgcatggtcgaacgggttgcctactgtataaagcccatcggcggccaatcagcgctcgacacgcacgcgtgcttgctcaggcccgccccttttccactcaataaatactcgcgagcgtgtcctgactccgcccacattccaccatataaataccctgtcaattcaagcaaaacttcttttccgtcttcatttttaaaatttcttcctttcattcccttcatttatattacttaggaaatttctttcttttttttgaaattcatttcgaaattcgggttatttaaatttatatggctcccgagaaatgcattaatgaatatataatattgtaaagtacaatagggtggtaagttactatattttgtctgagaattcagtaccaaatcaccaggaaagtagcattaacttaccaataatttcagtcgatgattttttttcaaacaaattggctgccgtttttttttgaacaaacgactcgaaatgccgtaactctgttcggctaccgtatcaccccgacgccgtttcgcagactcagtttactgtatttttgttgcatcgctaccaaaggctaattctgatcactccccatatgtcgaggagatttattcgtttgaagttacgaaggacggcacttttgcgtcatttggaaaagccgacatgttccggtgtgagctgcttgcgcggattggatacaggtggaaaaactaattttttaggcccgataccccaactcggtattttcccaaattgtgttaagaaaagaaaaacaatcacaatttaaaattagaataaaaaaaagtcgaaattaataagaaattgaaaatttaaaaaatactcccgaagttttctaggataaaatagcaaaaaaaaaaacaaaaaaaaaattgaacacatttttgggaaccaaatgacactaataaatttccaatacccatttggggggtggtcctatatgaaattttctgcatttttgtattaaatgataaacccaaattagttttattggttgacaaagttttctggatatttttattaggcaattaattttcttactacacagctcaatttgttcaatacaattgaatgaagtgaaaaatgcttaaaatatttgttgcctgttcggatgaatccattcataatgagagatataatttggcgaaagggcataaattaaccaaaaaataagtaaaaagctatttccttttgaaaatactgatcattaacgtaactgctctcactgacaaaatttcccagagagccataaaatgcttcatcggcataattacccattgccattgccaactctatcccttttatcatttcgttttgttccatatgctaatacatatttccttgatttaaaaaaaatatttagcaatttgctttaaatttgaaatatttcagaaataatactttaataattactatttaaccgagttcgaactccatctttactcaccggctcatcactcaagttagtgttcggtaaagtgcttcaatgacaattataattaaaattagcacaaagttattattaattaaagcaaaaacaaatatttaattttggagccaaagctcgtttattccctatgaactacacataattttttaaataagaaaatgataaaagtaattaaatttaaacactttcagaattctctgttgaaatgaattcaaaaactgctgaaaaccaaaaggttttgatttttttacacgcattttactaagagagtttagccttcgtcgctgataatgcgtttacatccttgtgcgaaatccggcggctacaaaattgttcaatcggtaaatttatttacagttaattgtttaaaatttttttaggtaaatgggcggccgaatggcaagagcaagaaaataaataggccgaaaaggaatgcaattggaaaagaaaatatcgagccaaatggagacacaaatcggtaaaaaacaaaatgaataaatttattacggaactacttataatatataaggcattattatttaaaaaataaagcaaaatataaggcataattagttaataaatgactaagatagaatatttaattgtttaaacaaaggagttcaagccgcaatgtgcttaaaaattaaacatattcatgcgaatatgtttagatatttacgaccacgtcctttcagtgaaattttgattgaaaagtttagacgatcgtaaatgatcaaaaattgtggcttcttgtagcctttttatgggcttaggatagtatcatccaaatttgcttgacatcgaattagacataaaccatggaatagaaattgaaacccgacgaagctgctttactatactatgacaaaatatttgtcttaaagcagtttctatttctgatattccgaaggtcttacaccgacatcatggcaaggtcgatcttgaaagagttttggtacgctgcaaaccgtgacaaaaatgcaattatcaatggttggacgacggcacgggcgttggttgaccaattcctcatgatgtatccaccgtgcgctgaaataggaaccaaggagccacaaatgcgcaaactgttgttggggtttgcagtacgaatttttctgggtgccaagctaaccaagaaaatgccgcgttgccattttttggaaattgattaaaataatgtaatattttatttttatgtcagttaatcagggctgtcatgtatatatttatcagcgtttttccttcttttaaagggggcaaatttgatgatttttgctcgcgcttttcaataacatttaaaaaatgatcataaggtctggtctaaaaaaaatttcatatgggagccttgcatttatttaatctttgtgtcggttttgctttgttacaaaatttacatacatatttttgaaaacataaacttttgaattcagctcaattggttaaatgaattaaggtatatgaagaaatgggtggaaatgttgtcttttataccaagcactttcctcccaccacctaattttccctcattcgttgacacaccggctcacaatgctattggtcatatac

SEQ ID NO: 13948 - DNA, 660 bp, Heterodera glycines
agggaacatgcggccatttttaaattcagccctctttctgattcaggcctttattggcacttattcaccgtgttgtggaatttcttgtacggagtggccctctttttgaggcaattttgatggccagagaacgtcaaaacccaatgtatcggtaatgtctttttttttaccaaaaagatggcaaaaaacaattgtcggttctttagttttctgttcgataatcatcaccctacccatgtctactaccgatggcgtctttacacaattttacaaggcgatgaccgtcaaaaatggcggctggagaagttcaaaatgtttgaaggagggagttggtggcaggttgtagtaacataactttccttatgagacacatatttacagccaccaccgcactcgctttttgagcagggaatgccgccacaactgtacgacacggcgtatgtgccaaagagacgtcgtgacaaaccctatgaaaagagggttggcacctttgtgtttccattggacatcatagaaccttgcaggtcattgctccccgacgccgttcacgcagacggagtgacgggccgagcagtgaagaagaggaaaaccgaagagtggaccgaaggcggagtcgcatggaaagagagagggaacgagagcaaaagcgaaaggaaatgt

SEQ ID NO: 13949 - DNA, 1432 bp, Heterodera glycines
taaagattaatgactaaaattttcgagtaaaacccaaattaactaatttcagattgctcgtatatatctcatctcggatattttggccaattgtgctgcacggataaaggatgccttttacttccgccaacattttggcgaatatcttttgaaaatttttgttgaactgaatgagactctcgaaggcatcgaaagtcgtcttaaggcggagcaggtcataactattgctggatcatttttctattcggcatgactcagtttcggcaaagggtgatgctttgctttcgcaattgggaggacaatgccgtgtacccgaccgacctgctcatacaatgccaaaatgtatttctcggacttgtgaaggttatttctttacgtggtaactaaaaaccaaatcaaaaaatagcatggagaagaggaagttgtggacacttcatcaatcgacggggaaccattggcctcagaaggcggcgatgaaatggacatcgatggagagccaatggcggacactggcaaaaaatacaatccgtcggaagaaaacatagggatatttgcaggacgagaagacattgatggcataccgatggacggagcggaggaagccgcagcggaggaggacatcgacggagtgccgatggaggagggcgaagcggcgatgtccaaaagcgaggcaaccaaagtgaatttggagagcgacgatcgcttcactgttcgatcgtggaacacagtaacgcattttctttgtcaaagataattcaacgttattttaaggttgaaattgaagcgggcactactgctgatacaaatttagccgttggtggagagattggcagcggttcggacgtaaagtcaaagtgggagtccatcgacctgcacagtcgctgggaacgccacgagggagtggcacgcgaatttgtgcagcagcagcagcgggaagatgaagacggggagaactcgccgagaaggaagagacacaggtggaagagcaaaacattgttttgaattatatatgcactctttgaagactgtctcgtttgtctcccgacgacgagcattcaaagccaaatggagcaacagctgctgattctgtcacgtcatcagctgtctcaactgatgacgaggatcgccgaaggattttgcgtgaaattgaagtcaatgggtggaaaatcggcgaaatttaatgactcttgttaaggtgaaagtgatgaagctgcaggaccaattggagacggagggcgaaatgccatcctcagagattaacgcggaattggcaaaataccgacaacgacttatggcgaaattggacgaaaagacaacaaaaaccaaaggagaacggaaaaaggcaactgaacagaaggaaaacggtggaaaagggcgggaaaaggagagaaggcatgacgagaaagacagagaccacgacagaggaagagag

SEQ ID NO: 13950 - DNA, 1490 bp, Heterodera glycines
cgttggcaaagtgttttcgcttaaccattcattcttcattgttgtcaacacctgctgcctgcttctaaaggctgaagaacaatgggcggtcgaaaagggcggagggattcgaatttaaatggcatttaaaaataatgccaaatgaatcgttaaggctgtgtgttaatttgattcggtcggcttcatcctctttctctatctctcatcatttgaacatttcgacaccggcggggatggcactgatcggcaaaatttctttggtgcctctatttcgaaaaaatttccaaaaaggggagattttgttaaaggttgccaaacagattaattttatttccaacatattttacagcaaaaaaatgaaaaaaaattctaactttatgttaatttattaattttttttctaattgctttctctcccctaatttttttttcatatatttttattgctttttcatttcctctccgcttatcacccattgcttttcctttcaaatgccattctgagcgtctttttggccaaacttttgccaactttggcactccctgccaatcaaagtgccattgtctctaaagaaatcagcgccttatatcaaatttcagcgccattcctttggtttgtcaatgcgatgaaaaatgatcaaaaaagacgaatgaattcccatttcaaaaggccgcaattcaaccgaatgctttcccccccccccccccccgcttttcgtcccattatttcttttccccctttttatctcccattttatcgtccattttgtccgcttcctgtcgatattgtctctatctgcttacttttaacttcgtttatgcttgtttctatgtttttcataatgcttttccaatttcatttcacccctcctttcgctccccaaagtgccaatttgcccccccccctctcttctctttcttctctctctctccactctttcccctctctctcactctctctctccctctctctcttctctctctttcttttcgtccgtactttcattttcctctttcatcctctccttttaccccattcaatcatcttccacctgtttttacttcagtatataagtgccttttttgtctgtccgctctctttgttttccactgtctttcaccccaaaagtgccacttttgttttcgccataaaaaacaaaagtcactaatttgcgagtaaaaggagtcaaaagtaaaaaaggagaaagctttttttctcgactttcttttccttttggactcaattcattttttgaagaacactcacaaccaaatgaccaaataggctttcactttattaaaacacacaaaacaaaataaaacaaagtcggaagacgaggtgggaaccaaacaatcaatcaaatccaaaaattattgagaaacagcaaaacatgacaaaacctttaaggagggagaagaagtgccataaatgtgaatgaataaaacaaatatcaataaaaggttcaaaatgccaaacaattacgcactaa

SEQ ID NO: 13951 - DNA, 2397 bp, Heterodera glycines
tttttttttttttttggtgggggggggggggtttttttttttttttttttttttttttttcccccccccccaaaaaaaaaaaaaatagtgggtgggggggggaaaaaaaaatttttatttacaaaaaaaaattttccgccaaaaaaaattttggaaaaaatttctcctttttgggggggggggggggggggaaaaaaatttttttttttgaaggttttaaaaaaagggtttgggccaaattttttttttaacaaaggggggttaaccgtaatccccaaaagtttcaattgggggggaaaaccccctttggccccaaaaaatgggggggggcccccccaatttgggcggggtatttggcccatcatttttcccgggcccaaaacattttccaggcctggatttccaattgattgcccatcttttcggcccaatcccatcaataaactccctggatttgattcagggggcgggggattaggtaggcaataattcccgcagtgttcaaaattactgacacccaaattcgaaattgtttgacaaaaatctttcgtttgtctctcccaaaccatttcctctcacatttctgttgttcacgcttgaactagaactcacaaccggtgcattcatcgccgttcgctcgttttgttcaatttcatccaccacaatcaccactgagttgccggtgttccttgtcgctggcaacaatctgtttctcaattgctgctcaccgccaaaattttcttgccgtgttagtggtggcgttctcacaaacattcccgtttaaccgtcttggttcaattccaaaatcaattagacaatcttctcagtctctgagcaactttggacaaatttcaacaatttaaaaatttcggcactatctcagtctttgagcaaaatttttatgcaatttctcaatctttgagcgatttgcaatgccgtctgctgcgtttattcccggtcttcgggctctaacaacgccgcagatatgaaagtcgaagtcgaaaaacaaaagccaaatttggtctcctaccaaatttaaaattcaagaaaacctgcagtgagcttacccaaaacgtcaggagcgccacgtaatattattttggtccaccgcacttgaagaacactcacaaccaaatgaccaaataggctttcactttattaaaacacacaaaacaaaataaaacaaagtcggaagacgaggtgggaaccaaacaatcaatcaaatccaaaattattgagaacagcaaaacatgacaaaactttaaggagggagaagaagtgcataaaatgtgaatgaataaaacaaatatcaataaaaggtcaaaatgccaaacaattacgcactaatttaaataatatcacagccccggccgctgacgagaggcgtccctgccgatcagctgcacatcccgcatccggctgtcgaaaggtgaggtccgtttgggatcagctcactgccattgcaccgaagtccgcgcatcattggttgtcgatcagcagaagtcgaagttgaatccggacacgaggcggtcaactcgacccaaccccgatcaaatggcaaagtttcacggctcatctggtccgcttccgctctcattggccagaaaacacattttcgtcgaaacgaattcaaatttttgccattttccccaaaattcgattgagatccgccactggagacatttagtctgactttttcttgctgattctttctgtccaaattcatcctttttctcttcaactcctccccaccttccaaaatttcaattgtccctaattgaacttccgattttttgccaagaaaaattcgtccacatttttccgaattttcaccaccaccctttctcacttcaaaattctttcccagttgttcctttgggctgaactttttgtgccctttctcatcacaatttctgataatttggttctccacattgggcgggatgttctttggtgtccattcaaccttcttccacttttgacgaaaacttggccgatggccgcttttggtggcacaaaattccgacgtccgtttgctttccacttcacttttggtgcccgaatttgtgaaaattgccgtagcgttactcttaaatttcatttgctgggccgagtgaaccaaatttttgttacgagatggtatggtcgcatgataaatgacgtgcacagaattgcgttccacattattaacttccgaaaaactgaccaattcttcatattgcctcgtggaaaagtttaaaacttagtccgagacaatggatttgtcccaataacaaattcgtagccccaaagatgcgtgtgagacgtgaaaaagaatccacacaattttgattctcctgacaattgcgacccacgcaattcccaataccctcaactgcatttccattcatgtcgatc

SEQ ID NO: 13952 - DNA, 907 bp, Heterodera glycines
tcgcaaagtcagaaaaatcattcagccgaaatgaaaccaatggaaatatgcagcagaaaatataattagagaaacaacaaaaacaatcaaataaaataattaagatgcccggaggcgaagaaacggcaaattagggaggaattaatgtccaaatagggggaaagaaaggaccatttgtacagtttttatccaatcggctcccttgaaaattaggcaccaaaaaatgaacaaaaatataagaaatgagaatgaaacaaataaaattgcttatttattagagatagtggacgataatcaaattaattctgaatgagaatttatttaatattctgccattttttgtgccaattatttctttaaacgaaattttccaaatgatgtcgaattttctggcactcaatttttcggcctcattttatcaaaaaaaggggggaaggaaggtggttttatgctatcattggaaagcccacaaaaatgctaataaaaattatttttaaaatattttttcgtttattttcaaaaataactagagatcgacattttgaaaaaagcctggacctggacctggattccatgttggacctggaccttgatttcctggacaaaaatccaggtccaggaaaaatccaggctcctcgagacctggatccagaggcctggacctggattttttgaaatttattttaaaaatcaaaaaaatgtttgaaaaaattaattatttgcttagaagcatctaaaaatatctaataaataataataatgtgtttttaaatttatttaatctgtttttgaaaatttgaaaaaacatcggtcacttgaaaaaataaattctaaaattttgtccaggaaaatccaggttttttcctgttttgcctggacctggatttttttcacatttgacctggac

SEQ ID NO: 13953 - DNA, 2945 bp, Heterodera glycines
ttcagcattttttgatttttggaaattttttaaattccttctaattttttcgaattctccaaaatcccgcaatcccgcacgggatcccgcaaattttaaatgcgggattaatcccgcgggatcccgtcccgcaaaaaattttgagttccagtcccgcagcgggatccgcaaatttgaaatttccggtctctagttaatagtatgatttattaaattccaaaatattgttttttaaaaataattttctaattttaaaatgttaatgttttatgatttcttgctaggccatattcataccagagatagtaattctttaaaataaaattttgaacataagtgttttaatttaaatttaaaaatttgttttaattttttaactaaatatttatgtaaataaaaaaacagctttatgggcaaaaggtactttaatattatttaatttaatgatacaacaccaaacaatgaaaagcggtaaacgaaaaataacacaaatgacggaataaaacgtagaaatttcaaaggtgtacacataagcccctgtgtttatttaagtaatacgcaaatttggatgagatgggagaaaaagcaaaacaaaaaaacaaactgattgttgaaatgaaataagttaaattagcaggcactaaaaggaacaaacgaaagaattcgggaccacccaaaggagggacgaaaggggacgcaatttggtcgaacgaactaacaaagcattggaataccggaagaatgggatcttcaaacattcacaacattaaaagcaactgaattttatgaattacggcaaaactattcgaatttcgaatggaagggacggcggaggcattttgggatggaaagaaagtgagacaaacaatggtcggacattatcaagttacgcaacacaaagtgaagaattgggaagaacacaacgcaaaagggagggaatgaaatgaattggtcagaggcagacggaaattctcttttttggggtcagtcactcctttccgctgctcaccattttatcacggagttcctttagctcgtcttgaagtgccgccaatttgcgctcctgctcctctttgtactggtcgaactcagcccgactaatgaagttcggctgctcatccggtggcaaatgcggcgattgtttgttgccgaagtgcgtgggggagcaggaggaaagtgaacgctgttggggctgctgctgctgctgctgacggtcgtcggagacggcgcaaagaatgggcgtgggctgaagaagtggcgaggacggacctgtccacaatgaacggagttggacagagaaacggggcgacatttgccaaggcattcgccctttgtgaattagcgcgtccccaggtccgtgaccaggggggggcaaagggtgcagttcccccccccccccccgaaatgaaaaaataaataattttccagtaaaaattggcaatcttaaaaacttgttcaacctattttcttaacaaagtaaatgtacaaaaatcccgggggcgcctatcggcaccgaccccacttaacctgatacaaattcctgttttttgctctctggcgctcacattttaattaacatcggagaaaaaaagctattcggttgcccctcccggaatttgtttctggctacgggcctgcgcgtcaaggtccatcttccatgtcccgggtacaattaccccagacaatttcaaaaataataatttcgaaatttttaagacaaaaactcacgggttggaaaaacagtcgttttaatggtcggtgccgcggaagaaaccattgccacaggacaaacactgacagtcggcgaagtgacgtcagacggagcgacgacggaagtgtcggacaaatgatccgaaggagtggcgacttgcgactgtgagggtttggaggagacagaaaccgaagaaagggcattttgtgggtcaaattccgacggattatttacagcttcggccaaagtggcggcggaattctgaagaccgaaatgagagtttcaaagaaggagttagggacgatcccaggatttcggctgggagattaacgacaaccctttttaatttgaagaaatgaattctacaaaatttgtggccaggggtcttggaggagatacgaaaaagaaaaatccaaatttgtaacaaaaaaaatgcttctcttaaaaattttgggtggggggggccttaaaaccaagattaatttttacatcgacaataaacgccccagttggaatatgttttaacacctttgacaatgttgcttaaataaaattgttatcaatatttttttctgaatagtgataagtttttaatgtatattaatcctaataccgccattgggttctgactttcggaattggtcttttacaacttttgacgggggccgtttgttgctgggggcaatgtttgtgcgcgacttgacgatcgacgaggaggagacgaggagtttcgccggcatttccccctccctctgcagcttcggttcggcgttcgcttcaacgcccaccgtcccaattgttggacgggccgcgcccaaattcggttgaggcggtcgcaccggtggcaatttgccattcggaaacaattgcttttgcagcccctcaatgacagagcgacggtttgccgcattcgctttcagagaatcggtggcggagttggccagcagcggtttttgcataacaactaaaaacgacgaggagaaaggataaaacgaaagatacgaagctattgactttggttggccctttcgacgaccatcgattggtgcatttcggtcgccgttcctttggcgttttcagcggggcctttgatcaaagcattgagagaatttctcgatctgatcggaggagctacggcatttttcagcgcattggctgaagggttggctgttgcgctaaatttggagggtttcgccggcagtgacggcgtttgtgcatttgtggaatcctaaat

SEQ ID NO: 13954 - DNA, 1108 bp, Heterodera glycines
  misc_feature (1089)..(1089): n is a, c, g, or t
  misc_feature (1101)..(1101): n is a, c, g, or t
attaattgaatttgtaaatattaaaaaaaattataaatatttatgattagcgaaaattcgtttattactttatattttccattagtgagcggaaaatctgatgattttacgtgagccgattttcatttcaaaaatttgttgtagggattttcttgaattcctgaaaattcgccatccgaaatgattcctatggcctctgaattttttttagacgtacttagaaaatagaattttcatttataaaatacatagaaatttttcgatttccctttactacacgcaaaaaaaacaaaacaaaatttatgaaatcgaaaatcggatatttaagataaaaaacttcggatccagatttaattttcaatgatttaccactggaatttttagataatcagaaaaagcgaaacccgaaaaataaatatgtccaaaagtagtccaattccgttcactgttttttactttctcaaattttgattcattattatttttttcaattccttacagcctaaacagcattagataagtgactgaaagaattgtgtctgataccttaatggttgtaaatttttttgaaaaatcatcaattattcaaacagcagaattgacggaaaaaaaacttgatttaaaattttttaatttttctaaaaatttatggccagcatgaaacacataaggaacataaatagttttagaatgagccattaacgtaggagaaaatttgacttctctataaattaatagctcatctaccaagccatttcttcagaaagattacccggaaaaaacccgacgaaaattttttgcaatttattaaaggttttattctaaaatgaaatttttaaagctatcaagaaattctttttgctttttgtcgtaattttatattatttaattgttcagaatgtttttcaaaattatgatcagaaaaatggaataataaactgtgtaaaataatttaatattataggcaatttaattttatcgattagttaaatgaattaaatttattcatttttacaaaaaaataatcaatcaattgagtcatcgtcaaatattgatcgaaataagagtcgttcctgattgctcccgatntccttgtcaccnagcggcg

SEQ ID NO: 13955 - DNA, 1443 bp, Heterodera glycines
aagttcgttgcccatcgggggcagttggtaacggcgcacatttgggaaattttgacaatacagcatataacagcggaatagagcactggtgagatcttgaaaattgtacctgtcagggctggctctgcagttgaaaaaattgccggaatggagaattttcttgcgacaaaaaaattttgcggaatttcggtgccaaaaattgccggaatggagaattttcttgcgccaaaaaaatttcggaatgcggaattctatgccaaaaattgactaacaaatgagcgggaaattatagtgcaaaaaaattcccttatgcggaattctggtgccaaaaaattaaatcggtgtgcggaaatagagtcatccccctgaaataaagcaaaccttctgaggaggttggaaatagagccctcgggggctgtattttaggaaaaacggtaatataaaaatttagagctcatttgcaagacggatttatttgtgttttttttaaattcgtttgtgttaattatgttctttaagaacatttataaaaaaaatattgtaaaggttcaatgatcaaaattgtagcaaaaaaaaagtattgaaatttgaactatgctaatcactgatcaatgaaataataaaaaatttaaaaaatctataaaaaaatttcttgtcccaatgctgatatgcgttttatttgagagaaaaattaaattgagagcacaaacaaattagcaagaaaatcattggctctatggcttactgtacaataataatttaataaaaaataaattagacttttatttttatttaatttaaaatttagcctgatttgtccataaaagaagcagggaataataaaataaaatgtaaaactttcgaatgccaaaattccatgagacttttatattgaacaattatgaaagaaacatggcgcttaattaattttacatttaaatttaagatacatttattaattaaaaataataatgtataaaataattatgttttttctctcaaaatttataatccaaaatagtaaattgtttaaagatcatttttaataacaattttatttaatttggaacgcaaataaaagatgttagagtatttggcgcctttttgcttacccatttcttttaaaatttaaaaaacttgatttgatttttcacttttaataatattttttattttccacttatcccatatttcttttaaaatttaaaataaccaggaaaattctttaatttggcaacaattttccagggattcgttctttatcagtgataaaaaattaaatgaaatgacatcatcgagtccaaattagtataaaaaaatgtaaaaacaatgctttcatgcggggatgtgagaagatcgcatattccgcaatggcacaacaacatttgatccatgttctgttctgcaaacatatttgcgaaatgctttgcggtattcagtgct

SEQ ID NO: 13956 - DNA, 1088 bp, Heterodera glycines
taatcatttaactttaggctaatatattttaaatgggcctttgctcaacagactgtgccgacagaatggacgccgaagatgcgaacggaaaacgcgaggctgaatcgttgcgcgttatcgccttcttcggcgtgtgtctgtccacaatgtgagggggaataaaatttgtttattttttttaattttctatattaatttcctttaattttatgttttatttagaaaaagcaaataaataagaccaataaagaaaatataattaatattaaactctttttcatttttttaaattaacaaatttttatatcaaaatattatttcattgtttgtttttaaaattaattttcagctccatgatgatctgtgtggtcactgtgccgttggcgtaccaacactttcaacagattggttcgctgatgcaaaatgagctggacttttgccagtcacggtccggcaacatttggcgagaggtccaccgataagcgaaagaaatgattaatttataaaataataattttatttttctttgtttcaataaaattattcttttactccattaattaattcatatacacaaaatccctttaatttaattatgcaaatttaatttgaaattcccataataatcaattaataataataaccaatttaagattgcccgtacacaagcttattcccatgcgtccggcggtgtacggtacacgcgtcaagccgctgcttcgggttacggtgccgctccacctccaccagcggcaccttcgtccgcaaccgctggaggcggttacggtggcactgctgctgtctcagccccggcgccgtctcctccacccgctagttatggtggcattgcgccggccgccagtgcaaagccatcatgtaattaataattataattaatattaattcagcaaggaaatgtaaaaagcgatgataaagggttattaatctaaaaacataattaaaagcagatctccatgttttttctaattaagaaaatacggccttgaaaatcagcttttccaaaatagcatgactttttgggcggaaaaattcattgaacggacggttgggggaggggtggataaatt

SEQ ID NO: 13957 - DNA, 1579 bp, Heterodera glycines
gtactatattagtgaagcagtactgtaacatttacaataatgctgagagatcgatcgctgcaataaatttctcgttctttaataaattaaaagaaattaaagaatgcaccaaacaattaactttctgagcttgtttgattttatacatacagccaaaaactaaaaaatctcaaatatagcctaattgaaaatatattttggagcactcgaagccgaaggcgaagcctaatttttattcgaaagctaagtccgaaactcgaagcccaaaagcccgacgttttcgaagccaaagccgaagttttcccaaaaaattttaacaaaaaaatatttttatcccaaaattttcggtgaaaataaatttaacaattgacagaatggctagagatcaacgccttacaatataataaatattttgaatttttttgatcgaaatattttgaatacgaaaaagttaaaaattgatcaatgacccgaaaaaccggtaaaacggtaaatttttcaaaagttcataaatttgtgaatggtatataaacataaactttttcactgattagcaagaattcctaaatcaaaaaattccacccgaagccgaagcacgaagttcgaagctcaaaaaaccccgaagttttcgaagccgatgtttcgcccagcccggctgccgccgtttaatttttttgttcactgaaaagccatccgtcgccacatccttgtcactgcgtacaacaaaaacaaataaggaaaatagaagcagcagtagatgatgcggtagcacagcatttttatgcattctaatttaacccaattaattaaatactaattgccctaattaagccctttaaagacaacaatggattttcttgggcttcactctttatgtttttaaattcaatgtaaaatttaaaaaaaaagtgtgaactctttttctaattctcaaaatttgaaaatgaaatttcctatagatttaagctcgtgctgagtcgtttcgtaaattccgctaacaaaaaataaaattcatttaagtcaaacgttttcttaaaaagtgatattttcaatttaccgatttaataatttaatacatttgagatagagaagaagaagcttccccgagaggaagataatggatcaattgagcgacattgatcctatatgattgaacaaagtggggagctgaagagggcagggtcggtagttcagctggtagaacactggtccggaaagccagagatgccggttcagagtcggcccgctccatagtttttcaatcaaaagcttccccagctcgtttacatatttcacatgtataaaaaaaaccaacctaggcttatttttaagagaaagattgtttttcacgaaaattaataaaatttgtcaacatttcttatctgccaacattatcgcagttaatattaaacaaagtaaaaatcaaaatgaaattttatttacaaaaatttttaattttaatattaaattgtttcctaaggatggtaatttagacacaaaaaatcccaaaataggcacctaaaaaggaaaaaaaatacttcgcaaaataggcatcaattaggtttaaaaataggcactg

SEQ ID NO: 13958 - DNA, 3772 bp, Heterodera glycines
caaaaaacatttttggaagttggccactaaaatagttttttttgccacaaatttagcattttgccacctatttttcactattccgtcatttttttgaaaaatttctcaacaaaatgcaagaacaaaaaatacacccctaagaatgggtccacctcgttttggcgccagcccagtttttggactataactttttctttatcaaccaaatctaacttttggtatcattcgaaagccctaagtgttctctattagagaccggcgcgggacgtgatatgttgaaaagtaattaattaatttatatgaaagtttgcaatgtgtatgctgttgttacggtatgcgtgacgtttgtgaatatactatatgccaaaattaggttactgaaatggagtccaaaaggggacttctagtgaggtttaaatctcttgaccaaattagtttagacgggaaaaaatttctcttccatactgttttttgtttcctctacatacctatcggcaatcgtaaggaatgggggtccctaatttaacttttttattttgggttcaaaaccagtttccgggggttttcgagggcgctgattacgaatctgaactcgaatttgcccaattccgaatcccagacccgaattcgaacaaaaaaatagaaaatttggcgctactgtaaaagtggtcccttttgaaaatttttttcacttttttttcatatatttttattattattttttattacaattatccatccttcctttgacttcgatttatccgagtcatatagtctcaacaattttggcacaacaatttgttttggataagtccgttgtgtgccaaaaattgtaaaatctcttcagtttttggaaaaaagccatctcaaatttatatcgtccaatgttggaaaagcgatgagcggcagattgttgtaatcattagggttgtaaattatatggattaacatattttttctgcgcatatgctataaagaaaggggctcaaaaatagcatttctgcgttaaaattttttggtttgctgaaggtttttagtccatataaatcagggctgcacgcaattacggattacggattgcggattacggaaattacggggtttttagagttacggattacggattacgggttacggatttttgagaattttccgtaattttgatccgtaatttgacttttggattagttttcgagacgatttcttgtaagattattttttataaaaactattttttctattttttatttaaagaaaatatgttcatttctttaaattcttatttctttagcaattaaaaatgtcaaacttaaatcctggtaattggtggtattattttgagcgtcaaggcaaatcaactgctaaatgtaaagccgatggatgttcctactcaaagacattaaatgcttctctcagtacaacagttcttgcttctcatctcaaaaatcaccacccacaactttacaaacagcgtgaagattttgttcaagaagaaaagcaaaaaaccgaaaagaagggacaaagtggaataaacccattaaaaagggcttttgcaaatgcattttgtggttcaagtcaacaaattactgatgatgaagaaaaggaagagccaatttcatcaaaatcacctattttaattgggctaaatgcaaaaagtatgatctgatttttctatccgttattacattttgattaaggccagtggagcacggacggagatgcaacaattggcgcaaatcgcgcactaatggaaatgctggccactcaattactgccatttaatctcgttgacggtgttggatttcgacaattcgttggaaaattacagccaaaatacaaaattcctaggcgcaatcatttcgctcaatatgaattgccaaattgttttaaagcgatgaaagtaataatcaaatttgcgctttcataattctaaaatttagaaaatagtcactgatgaacttctgccagttaacaaaatcgctttgactgctgatgggtggacttcaaaggataatcgccattccttgatttccgttactgggcattttttggaccaaaaattcaagccaaaattttttgtattgagcacaaaaccaataagaggtaattactaaatctggagtcgaaaaaactaaatttttaggacgacacacagctgaagcaattgtgtcatttattagagaagcattaaatgattttcaaattcaagaggagaaaatttcggccttgacgcgagatacagaaaatacgatgaaaaaggttggaaaggacttgggttttgtgtcggtggattgtgcagcgcacgttttgcaattggtctgacaaaataatataattaaatattaaaaacaaaaattttagtgcattaaagagggactgaggtcaattgaagaggaagaacgtttaaaaaatcttttggaaaatgtcaaaagatttgtaagaaaagtgcgaaagtcaagagtgttgacggaacaactcgctgaactccaacaaaaggaggaagtaccaccaacagttttgattaaaaatgtcgaggtgcttttcttctatatttcactattctcataaaggcaattaatttcaggtgcgctggaatagttcatacaaaatgattgaacgttttatcagaaacagatctgcggtgaatttgctgtcaattgaacattaccagcttccaaaatttaacgctgatgattggttgcttttgtcatcaattagcgtactttcaccaatttacgaggccactgttcttttacaagatagaaattcttcttgttcaactataattccgctttttaaagtcagcattaattttttccccaatttattttaaaatttaggcaatttcattcggtttacgtgaggacaaggacaatcgtttttcaaatattaagaaaacaattgcgaatgccatcgaattgcggcttaaacaagccgaagaacaaaaaaacttagttcttgcgactattttggacccacgttttaagaccatttaccttgacagcagtcggctaaatcagtacaaagactggttgataagtgaagttgagagttaccacgcaaagacagatgtgattttattttttctatttctgtaaactatttttttaggaaattgatttacaaaatgacgtaagagactgcagtggttcaagttcgggggacattttttctcgctttgaaaaggacgcagaatttgatcaactaattaataatgtaaaaaactttatttactgctcaaatgattaatttaaggcaacatcccccagtccatctgcattggagacaagacaaaaagccgaagttgaagtgaatgaatatttacgagatcaaaaaatcaaatccagggccgatccatcattatactgggaaattaattcacaaaaatggccaatgattggtgccgttgtacggaaatttctttctccgcctgcaacaagttcagaaactgagaggcttttctcaacggccggtctaatttcagatgacttgcgaaagagtttattaccagaaaatcttgcaaaacttttgtttcttcatcacaatttgcttttaaccggtttctcaattgaatgattttgcttttataaatttgctttttaatatgcttttaaattgctttaaaagatttataggattttttaaaataaaatttaaaattattaaaaaaaatttttttttaattgcggattgcggattacggaaattgcggggtttttggacacccgtaattgcggattacggatttccgcaactgagaaaatcgccgcaa

SEQ ID NO: 13959 - DNA, 1310 bp, Heterodera glycines
ttcgaggggcatctgggtggataaagattaaattttatttagtgtgcaagaaatggagatagaccttttgtcaagctttattaagttataacaaatgtcatttatgttttctttttatatttgaaaaccaaatgctaatacattattttaatctttattttaaccgtacaaaattctaatatcggcaaaataattggagctgaattctgtgagcctttattcagagagccttttgaaaggccaacctttttcaaataaacacatcttagtagaagtacacagttcattatttcgaaattgaacagtaaatttggggagttgaaaattcttttcttgcaacattttgaatcattttttatccggtgacagcttataatattccttattttcatgcattcgagggcatctgggtggataaagattaaattttatttagtgtgcaagaaatggagatagaccttttgtcaagctttattaagttataacaaatgtcatttatgttttctttttatatttgaaaaccaaatgctaatacattattttaatctttattttaaccgtacaaaattctaatatcggcaaaataattggagctgaattctgtgagcctttattcagagagccttttgaaaggccaacctttttcaaataaacacatcttagtagaagtacacagttcattatttcgaaattgaacagtaaatttggggagttgaaaattcttttcttgctacattttgaatcattttttatccggtgacagcttataatattccttattttcatgcattcgagggcatctgggtggataaagattaaattttatttagtgtgcaagaaatggagatagaccttttgtcaagctttattaagttataacaaatgtcatttatgttttctttttatatttgaaaaccaaatgctaatacattattttaatctttattttaaccgtacaaaattctaatatcggcaaaataattggagctgaattctgtgagcctttattcagagagccttttgaaaggccaacctttttcaaataaacacatcttagtagaagtacacagttcattatttcgtaattgagcagtaaatttggggagttgaaagctatattctggctacattttgaatcattttttatccggtgacagcttataatattccttattttcatgcattcgagggcatctgggtggataaagattagattttatttagtgtgcaagaaatggagatagaccttctgtcaagctttattaacgtataacaaatgtcatttatgttttctttttatatttgaaaac

SEQ ID NO: 13960 - DNA, 2523 bp, Heterodera glycines
  misc_feature (2456)..(2456): n is a, c, g, or t
tgtgtttctgctgctgaccagcagccacgtcatttccctcctcattctttcgttttgttttatgatatttcttcgttttgttttctgctctgaatttaattttttgcctcggactttaaaattgtaaaagtaaattgtttggattttgaatttgggatacaattctccatccccatttggctaattgtgtgtgcggcaattgcttcttctcgccaattcaccgccgaagccttttgttgtgttacgacgcgtgtcctatgctgcactcttggcttcgctgagcagatcggccgactgataactgatcggaatgttgttgtcttagatgaggcgagtcagggctcattcgttcaaatttgttcgactttgtcttctctcgtcgagatgaggaaagttttaatcacaggggaccgttaccaattagccgttaatatgcaaagcatcccagagccagtacgggagggatatggtaatgacaccattttgatcaatctcgacaatgccaagactcacccattttgctgattcaccaggacacaccaatggagcacgacttgaccagctattcggcaaccaaccgcggacaaacacgcacagtgatggaacttttggagttgttggacaaatttcccggcagcattcgcatcatttccttgtatgccggtcaagcggcacaaattggaatcgagctgaaagagcgtggtctcgagtccaaaattgcatcaatggcgtctgatgcaatgcaggcgcacgatgccgacctcaccatcattatagctacagtctcgagacacttggaccgattggcagctatctaaccatgctaaggaccgtaaaagcgaattttgggtgattcccagagggttaatgttgcattaagtcggggcaaacatggaatgatcgtgataggaaatctgcttcagcttggtaacagtgaaatttggtctagattcttggagaaggctctcaattcacagtcgtgacttccccagaggtcattagatcattgaaaaccccaaaatcaaggtatatgcgcggtgtgctggttgacaactttggtgaaattccgtcagtgggcaatccgtcagtgaaggacaatccgtcaataatggacaatccgtcagtggataatccgtcagttggacaattcgtcagcaaattttttttgagcaatgatcaaaaatctacaaaaatgattgttaaatttaataaatataattttttatatattctttacatttctagttactttatactttaattaattgttaaattatcatttaattcttttaaaaatgattatttcataatttttataaaataacacaatttttaattcacatttttagcgacttaaattaattttcacacgatgattttaaataaatcttcgttgttttaatgtttatggaattgtccactgacggattgtctgggagccttgccaataagtaacgtgagataaaggccctcaaaaaaagtccaaaactaaatgttgttattattaaattattatgaactgaattactaagaaaaaaattaaagaatttaaattaattagacaaataaataacattcaaaaaatagtcaaaaaacatctattattacaaaatctaacaaaaaataactcaaaaatatctttaaaaataaacacagaacatacgtggataaataagtaaaaagaacagatattaaaatattggagcagttaatttcaaattttatccagcatgaacatccaatgcaaatggtaaagcttacttactgattggccacctaatggaccgaaaatttgacgtcgcttaaaaaaatcgaagctaatgaagataaatcattttagttagaaggccttttaaaagaatataaataaatgcaacttttaaagtcaaactcaaaaaacagccaatgataattaaaaataataaaactaaatggaaaatataaaaattagaaataaaaaattaattaaataattacaaaattatcctttgcggcctacgcagattttgttaggaaaaagactgaaatgctgccgaaaatttttaaaatataagtctaattaattaaaatctaataattataactcaaatattcgaattccaaggtttttcaggcttaaaggcattaaaaaacactttttcgccactgtaccaacccacggcaagcagaaacaatagtggacatttcagcgactatcggcaccaccgggacctttctattttttgaagtttgattcaaaaaggcacccagaaatcgttaaaacatgatcaattagtaaaaacatatttctgaacttttagataaaaaaaatatagaaatgaaaaaatttattaaaataaatctcaaaaagaatgtattgaaaaataactttacacttttaaacaagagctaacttatttatttcaacttaatttcaacgtataatttaattaataaacatttaaaaacaacagggntaataaaatagttataaaaatttaactgaactatttattatttggatatatttgaaaaaagtttgat

SEQ ID NO: 13961 - DNA, 1933 bp, Heterodera glycines
  misc_feature (76)..(76): n is a, c, g, or t
tcattcgaaagctctttttgagctctacaatatctgtgtatgagttttaacgcccgattaattttcttaaaatttntggaaaaaatcaaatacttgatgaaaaatcatatataaaatcaatgattttgcaaaatcttagctcagattcgtaatcagcacattttttcatcctaggaaaaatgaaattaaaattttttaaatttatttttcgtcgggacctcagttctgcaggattaccggattcttgatcagcgacccagggtggggcaccatcgataccctttgttgttgtcatgttcaccggggatggaattctgacgcccaaaaagaaaaggtcggaaatccaggcatttttttatttcttctctcatgtcagtgttttttgctctaaagtaaaaggtggcggtgttgtggttttttggcgagtttttaaaatgtcgcgagtgtgtattcacaatttgtcaagacaattaaaacaaattgaaatgaaataaataaacaaatgaatggttggatggacatagaaatggagagagagaggatgatgattaattatagtaattaattgctttttgtttgcatcatcggcttttcctcttcctccttcagcaggcggcggcagcgggcggttgcgttttgagggtggtggtggcactgttgttgctgctgttcctggtcaacaatgcccagtgcaaactgtacacaaccagctcatatgtgccgatggtgaacgccgtgttgggcaccgaacggaccaacttttacgggaggaaggggggggggtgaataaattgttgaataaaatttttaaaaattgcactccgaaattaaattaaattgatttgctatttaagtggtttacaaattagcaacgagtgcatttggtttattttcttttttttttttgctttagtgcactgaaattttttgtgatttttcaaaaatgaaaaacgttatgaaaaaacacaaatttttttttgaaagaaacaatgcttcaaacaatggcaccccaagcccgaacaacctaaatcactgtagcgctgaagttcctgtttttttttttgctccagtgctaaaagttttgaaaaaataacacccgagaaaatttttttatgatacgaagagcaaaaaaatccgatttccgccctgacagttcggaatgtgcccttgtgagccatcaatcttaaatgaaaaaatacaaccaaaatttaggttttttgaggccccgtaactttttttcattattaaaaatccgcaatagaactcgaccctgcactatacaatggtatataaaacggaggcacgacatttttggtccagacatttgcgcctatgtccaaaatcggactcaaagttgaattttttcaaccctgatagcctaattagcattaaataagaaaaaaacacggtcattttttttttgattatgttcaataatttgttgtttgacaatttaattttttttcaaaaattctttgaagatcaaatgatccgatacaatcactttcaatcgcatatttaaagctgtttatgcgatcagggattgaaaaaacttaatttttaactcgatttttggccaaaggcgcaaatgtcggggcacgcgtaaaacatatgcattttccgacttcagttcacgcccttcccttgttagcgtaagcagttttatggatttatttatttttgctgaaattggtttcttcaccattattccttttgtgttgcacctgcaaaagaacgccatgccaaagtgtctgccagccctcgtggcgcaaaatgtgccgcagaatgtcacgcaaccgatttgttgagccttcctcacgtaatcgtgtccgaatcacctctaaagaaggcaaaaaacagaaatgttaaaatttttctgtaagaaaatccaaaggaaaaaattttgaaaacttttgggaaacttactattaat

SEQ ID NO: 13962 - DNA, 2548 bp, Heterodera glycines
cgaagatgggcaccagacaacgttgccatttcctaacgttttgttgcgtcgcctttgtcacaattgtctttcttttgttccttttcccgagcgatgaccagcggagagaggccgctgacagtcgaacatacgcccaaaaaaggcattccgccgacggcggtgcgtcgtctgccgccgaggtggacaatttggccccgttcattttcattggtggcattccccgttcgggcaccacactgatgcgggcgatgttggacgcgcatccggaggtgcgctggtgagagggcattggaggagggaagggtaaatgcgtctcaatttttgtggtacagcggagaggaaacgagagtaatcccgcgaattttggcacttcgagcccagtggaagaaaagcgagaaggagtggcgcaggctgcaggtgaacccttttgaatggcggagacacactttcgaattggcctatccaaaaaacaaataattgcctttttcgtcgtctccgaatttcactgctggtttttaaatattttattttttggtgtccaatttgtgtttacgattaattttgctaaaggaagcgggcgtcggtgacgaagtgctcaactcggccatttccgccttcattgtcaatgtcatcgtcggacatggcgccgctgcgccgcggctgtgcaacaaagacccattcacactgaagtcgaccatttatttggcgcagctgttcccgaaggccaagttcattctgatgatcagagatgggcgcgccactgttcattcgatcatttcccgaaaagtgaccatcaccgggttcgacctgaacaatttccggcaatgtatgcagaaatggaatgccgggattcaggtaacggacaaaaaaaaatcgagtcgaatttgcaatggttttgtactttttcagataatgtacgaacagtgcaacgcggtgggccaagccaagtgtttgcccgtctattatgaacaggttggcctaccgtttggaataaatttctctatttcagctgatttcagttggttttgcatcccatgcgggaaatgaaacggttactgaacttcttggatttgccgtggaatgagtcggtgctacatcacgaaaagtttggacaacaaattgtaaactcttatgcgcattggcatttgtttgttttttaggttcatcggaaaggacatttcgctttcaaagtgggctctcaattttaatgaaaaattcaaaaaaaataaccgattttttcaattgttaagggtcgaacgcagcacggatcaagtgattaagccgcttaatttgggtcagacatacgttattcaatcgctaaacatagcaaataatgagagtcagatgcacttaacaaatgggtcggacaagtgcccgaggacgtgctcagccaaatggacgaaattgcgccgatgttgcgggtgttgggatacgacccggtgggcatttgacaaccgtttaatttcattttgtttgttttttcgactgccaatccgccgaattatggacaagcggacgaagaagtgcggaacaaaacggaacagctgcacagagaagagcaaaagtggaggcaaaaggcgcaggaagtgctcggggagcagacgacggagcggccaatttgaacggggagagaaacggccgattgaatgggtttggcacgcactaattgggcattattttgctgttttgtcactgtgtgatattctcctagtttcgggtacctctcatccttcacattcgatgtttttattcttttcttaaccttaactgttcccttctccgccagtacttttcccagttttcatcttgccaatttctctttcaccttttcacatccgccgatcttttcatatttttttgatcttttgatttacataatataaattggctgataattcgtctcatttatcatcggaaacggtgcgcaaataacaaaaatacattttaaattaaaaaattctttatttaaaatcgctagcggggtcagcgccttcggcgcatcccccgctaggtagtacgcttgtattataggattatgaatagggcccggatttttatgtttttacatattttttttgcggcttagttatggcgagagaagcccaaaaatagcattatctccgaacaatttttgatttagagcgacttataaaaacataaaaacacatattttggcgttttgtcacataaaatatgttagcacatattttggagtttggcacatattttgcacatattttggcatttttgagaaaaattgcaataaaaatacaagaaaattgaaaaatacaccccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatg

SEQ ID NO: 13963 - DNA, 1303 bp, Heterodera glycines
tttaaattaaaaaattctttctattaaaatccattttatacctaaaaattatttatatttaaatttattattaatctgcgtcaatatgtgagataaatatcgaatctcaaaaatacattttaaattaaaaaattctttctatttaaaatcattttatacctaaaaattatttatatttaaatttattattaatctgcgtcaatatgtgagataaatatcgaatctcaaaaatacattttaaattaaaaaattctttctatttaaaatcattttatacctaaaaattatttatatttaaatttattattaatctgcgtcaatatgtgagataaatatcgaatctcaaaaatacattttaaattaaaaaattctttctatttaaaatcattttatacctaaaatttaaatttattattaatctgcgtcaatatgtgagataaatatcgaatctcaaaaatacattttaaattaaaaaattctttctatttaaaatcattttatacctaaaaattatttatatttaaatttattattaatctgcgtcaatatgtgagataaatatcgaatctcaaaaatacattttaaattaaaaaattctttatttaaaatcgctagcggggtcagcgccttcggcgcatcccccgctaggtagtacgcttgtattataggattatgaatagggcccggatttttatgtttttacatattttttttgcggcttagttatggcgagagaagcccaaaaatagcattatctccgaacaatttttgatttagagcgacttataaaaacataaaaacacatattttggcgttttgtcacataaaatatgttagcacatattttggagtttggcacatattttgcacatattttggcatttttgagaaaaattgcaataaaaatacaagaaaattgaaaaatacaccccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttggggggtttttagcacatatttcagcattttttagcacatattttattacctatttc

SEQ ID NO: 13964 - DNA, 4164 bp, Heterodera glycines
  misc_feature (4074)..(4074): n is a, c, g, or t
  misc_feature (4113)..(4113): n is a, c, g, or t
  misc_feature (4128)..(4128): n is a, c, g, or t
ttcactcatttatgtaaaaaatattattaagtaatttattatattaaaaaaatagaaatttagcattaagaatcttcaaggaattgtaattaaaaagttgttaatattttactcataattatgttcatttatttgggcataacaaagaaaatattatgcagtgaccgaacgtggagaaggtcaatggtattttatgcaaatgtcaaaagagacaaatcagaaagggattaaaacatatgtttatacttttgcactaattgtgtttgattctcatatttttgctggttttcaacgacaatttttcagtaaaaggcatttaatcgttaaaattcaaatttcaataatattttttgaaatgggatttgtccttttttgcctttaacaatattttcgatttgaactcttcctttggtcacaatgcttcttcaattcgcctttcgataattttaaattattcgtttttcaaaggctttctttaaatttaaattattctaagtttgattaattgcgaacattaaaaatttatgtaaaaaatacgatggaattggctgatttggcacataaatttcagaaatatcatttttccgtcatttgaatgactgaaaaataaaatttacatttaatttggtatgtttaatttgcgtttttttaatttaaattaaaaatgattgccctgaattaaaatttatttgaacagcttcactgtaattatgctgaattttttttttttttttgctattttggtaatgaaaaccatccaatcttttggtaagtccaaaaattaaaatttaattggaatttgtctattttactatttttttaataaataattaatttaattaattaatgttttgccatttgcaaatgtccataatgagaatcatttgccatttttttatgttccgccattttttgctgtacaattgtcggcacatccatcagcttcaaaagggaaacaaggtgtcattaattaattaactaagtataattattctgttaataaataattaattaattaattacttttctatctttattaccccttttaagctttatgccattgttcgcgtgaagcgctttgagccgtcacaattggcgggctcacaacttggccagcaaatggcatccaaaatgggccaacagatggccacacatattagacaacaattggccacaaaagcgggacaacaaatggctgccgaaatgggcaaaaaaattggcacaaatttgggcaaaaatatagtgaaaaaaggcacttaaaattgaaaataaatttttgtaaatttaaaaatgagcaaagagaagtttaaggcgtacaacacattaacaacatgcagcagaataaatacaatgagcaggaagaaagtaatgaaaaaaatgaaaaaagaaaaattgaaattgaaaatacaattataaatttaaatttaaatgcctatttaggcgatgagttgggaagaataggcagaacgggtgccaaaaatgtgaagaaaaataaaaggaaaaaacaaaatgccaaaaaaggaaaaggacgaaacaacggtaaacagaagaaaggtgataaaacgataatcaattaataaaatcgaaagattttgaacggattaaaacttaaaaaaaaattaaaattgaaaattgaatcacagattttcagataataatgaccaaaatgtacttgacaataaacaccatagagacaatagtcaaattgaggtgaaactgtaaattttgtgccaattaaaaaaaaaatttaaaaggaggattacgatagtgttgtgagagagcgcaatggttaccgtaaccgtcgcagaaaatcgcttaaaaatcggagaaataaaaatttacgtccaaaaaagcgacgaaaacctcgaaaaagccgcagaagaaacggaagtggagaagaagaaaaatacaacgaagaaaagaaaagaaacagaaaaaagagaggacaaaagcagaaaaaggaaaagaaagggtaaaataataaataataattaaaataaataaattaattaaggaggaaaaatgtatggataaataaataattaggaagaatttttcagcagaactcatcggaaagctcggcatggcaccaatacagatgaagaaagcgatggcacagaagagggagaaaacagtggaagagaaaagaacttgaacaatttacggaataaaaaacggtgagtcgaaaaggtcaataaatactaatcattggttaaaataaataataattacgaataataaattaaattagaaaccatttagagatgaagaggaggaggaagaaacggaaggggaaaaggaagaggatggtgatgaaaatgatgaggaagatgatgaaagtgatgaggaggaggaagatgatgaggaggaggagcatcgccggaagcgtcggccaccagccctttccgacaaagaggaggacaacaggtcatttgatgagtttaattggtgggagggaatgaaatagcattgggaaatgaccagaaaacaaatggactaattgatttaagcatttaaatgaaaccaaaattattaatgcgaattgcatgaatgtttaaattttttggttttagtgcgccggcaagtgccccaaatgctgacaaaagcgaagtgatggacaatgaatttgaggaggacaaaagtggaggagaagaggaggaggaagaggtgggaagaaaagtggaaaacaaattaattagaagtaattttcaatttagagccccaaaagaaaaggcaaacgtcgacaatcgtccaaaaacggtaaatttgttggagaatgaggaaaggttttgtagggataagttgcttaagataattcgggtggtgaatcgaagccggcggaagaagaagaggaggaggaggaggaagacgaggatgaagaggaagaggaagaagtgggaaacattaaaaataattaaaaaataatttgaaaatttagcgccccaaaaggaaaggcaaacggcgaccatcgtccaaaaaaggtaaatttggagtgaaaaacaaaacaaaaagaccgtcgcggaggaagatcaattataaatatttgataagcatttgaataaatcttgacacaaaaagagcaaatcccggcagtcgcgcgggaccccgaaaaaaagcctcgggattgaccgggatttggacgggatcccaactcggttatccctccggtctcagttgtccggtttctattgtacatgtgcttaagatgattcgggtggcgaatcgaagccggcggaagaagaggaaaaagaagaggaggaggaagaggaggaaagtgaagagcaattcaaaagcatttaaattatttattaatttatttgatttatttaatcaaaatttattttcagagcccaaaaaggaaaagcaaaaagaaaacgacggaggaaggtgcatactgtaacaattgccctactgtatgcatttaattttgtattgtaaatcgaagattcgaacggagaatcggagccagaagaagaacaatcggaagaagaagaggaggaggtggacaagaaattaaataattaagtaatttaactttatgtaattaaatttaattgtttagagtctaaaaaggaaaagcaaaaagaaagcgtcagcggcggaaggtgaactttatctattttagctataattaatatatattatgttttttgataagatgattcgaatggcgaatcggggccagaagaggaaccatcggaagaagaggaggaggaagaggaggaggaggtgaaaagtgtgacaattaggggttaattgaattttaattaattgtttagagcgaggaaaggaaaagcaaaaagagaccgccggacaaaggtaattttgaaataaaatgaaaatgcataagcaaaatgaattgaatttaattgaagcccaaacaaaattggataacggcaggactttcggggattctgatcctgattatctttcaaaaatccttgtctctataatttgtgcctcattaaattttagatgattctgatggagaatcggaaccagaaaacgacccatcggaggaagaggaagaaaaggaggatgaaaaagaaaaggaagaaaaagcggaggaagaanaggaggaagaaaaagaggaggaagaaaaggaggaagaanaagaggaggaagaanaggaagatgaggaagagaaagacgacgaggaagagt

SEQ ID NO: 13965 - DNA, 3377 bp, Heterodera glycines
ccctcccccattacttttctgtaaatgatgtgttcctcaatgactttgctgcactttcccgagtcaatctccgctttatgcgcgaattgaatgtgcgaagagcaggccgaacggctataagaagtgaaagacttttggcagacggcgcattggtggagaggaagttggagatggcttaaggaaggcaaaggcattgctaacaaaggacagagggattattcaattaccgaacgttgacgtggttgagtcggttgaccgtctgattccacaccatttccccacactttttgcacggaatgcgctgattgtcgccgttctgccgtttctcctttcaatttcatcgttcttcccatattaattactcatttttctgtcgtacctttatcgaattttgttcttcgccgttttgaatttgccgctcgaattccgcaaaatgtctgtctgggcacgaaaccaaaacttaaaagtaaaggaatttatcttcagagccttctcctaacatgaatatttgtcgatcggaggcattgccgcaccgttccctttttctccttcctttttagggcgacaatcgttctaaacggtcgctgattgcttttattttgcaactaaattctgttgttttcacctcattgctgctcaaattcagtttgaaatcgtttttcaaggccactattcctttacattggctttctgaaatttggtcaaaaattgtgagtttttcttcatattgttattaaaacgaattaccatatggattcttttaagcctacttcccaacccttgcattttttgatcattttatttttgtattttttttgctctcagttcgatgtccctttttggtgccttcgttttatttttggggtgcaccccaaaatatcgccgcagaaatttaaaaagaaaattttaataaatttcctaagaatttttttatgaaaaatttctagatttgaaaaaaaaattttaaaaatttctgcggcaatattttgtctcggcgatatttcaggcggcggtattttgtcccgtccccgtattttgttgttcgaccaatgaatgattccttctcacctttccgtccatttttcttcccttccttttccagcggtttcccattcaaatccttgctattaacactttttgtcgtcgattttctgtccgcttttctatttacatttcgctgccctttccctccaaaacattcgtcacgtgcggcatgaagaagggcagaaaactcaaatattgcattattattattttttaatttcagtgttaattcctcccgaatactttgtgataattgttgaccaaatgtttgctgctgcctttgtgctgttcgtgcatatgcttagtaatccgcgtgttggaaacttcgaaaaaatctctaaaagaaaaatgataaagcaaaacaaaattggagcagtgcttttgtttctgcatgcaatatttaccttttgcaaagttcgcaatggaacatcggcaaacgcaaatgcctaagaaattaaaaccaaagggataaaagaaatagggcgggggaggaattgcccgtttttaaaagtgccgaccgtgcgttggtgtggtggctgagacacccgccgctcgcgttcaccatttctttgcactttttgcaccgaattcgaccaaccgttttacttttgcttcgtttccgttcactttttgactgaacaacgcgggtttgaatttatttagtagcgaataaatggttggttaattgaccggcgatggttccatttcgggcgagtcttcagcattttggaggacgtcattctcacaatcagtgagaatgggaataccattgtgaagcaaagcgtacggtttgaagcggttgggacgaagagaataactctgaacgggaaggaaagcgcacataaattggcgagcaaagggacaaacattgttggcagatcgtcgcttatttgtcgggggaatgatttgctttttaggtccaccaaattgggacaccgccgccgcagtggccctgagaatctcttggacgttggcctgaattttggttcggttttcggtctgtccgtctccaattgcctgttgttccttcagctcgtccgttagactgctcccctcgccctccatgtcctcatcctcgtcgtcctcctcctcttcccctccaaatgaaacgacggtcgtttcattcgcactttcgaaattcttcgctgtcgtattaccatcagaattgaatggacgcggacgaaggcacattcctaaaattaatcttgaccaaaaccataatccaaacacattgaggaaaggaacaacaatgcgcaagggcaatttatttaatttatttttttgctgattcataaggttcgccgtttgcttggcattgcctacgctttggcttttcctcctcctttccgtcattgcctttgatttgggcattttttgtctgcccatcttttgcttttcgcttcttttccacttccattggtgaagaagcgaactgttctttttccgctctgaaactttgaaaattactgaagttttatggggctgacttatttaaaaagcgtaattctcgcctcaaagcccctccctccccccacaattttcgtttcctcacctctcatttaaatgtttttccctggtcaaaaattctcgcattttgctgcgtttttccttcacttctggcgtaattcgacaccgaaactaaacaaaagttaattattgagcgattgaagccaaaaattacagaataattacgactgtcgtggtccaattcattgtgtttcatcacagcgaattcggtgggaaactttgcgaattggcaatgttcgcactcatagggcaacagactgaagtgatcagccgcaagatgcgcttccaactgatcaaacgaagaaaatcgctaaaagaccaagcaaaaatggccaactgacagcggaaacttaccggcgaattggaggcattggcaacgcactcactgatgcaaatttgacaattgaacattttggaaatgcaaatcaaaagcccacacaaaaaatgaggagaggaaagtaaaaagaagtaaaatcacagatcacaatgtattaatactaatcgcattccaatgctctaaagtggcaagttgcagcagcagcacaacagaaactttaaaaaatttatcaatcatttaaaaaataaaatcttgatgcgttttttaaaataatttttggttcgaaatatctattttaatctgatttcacggttcctcattttccacttggtcttcttgagaataatccgaaggctttccttaagttagcgggcccctcccaatagccattgagcaaaaacatccaataaagagaaggcatccaatagcgcttcatcagataggcaaatctgaattaaaaaaaaaaaaa

SEQ ID NO: 13966 - DNA, 1777 bp, Heterodera glycines
  misc_feature (1698)..(1698): n is a, c, g, or t
  misc_feature (1761)..(1761): n is a, c, g, or t
tcacctcgacaatttgccgttgccccgtgcctttccctttttcgtcgagcaattcgaactccgcctcgtgtttttcggggttcactttcactaaattgtggcgcgggtgaagcccaaccccacgttctttcacaatgcgctcaagggaagcggcatatctgaaaggcatttggttgatttgctgataagtgttgttcgtcgctttactttggtacgccgaatatccgaccaagtgcggtgtaataatgcacggaacaattcgaccggactcccttccttcgtaaaatctgaaattcaattcattttcccctttaaaagacagtaattactcatacttcttccgccaaaaagcaaatcttcagtggagctccagcgcattttatatgcgttgatggaaaggtaaaaactgcctcgccggttgaaaaatttttgagctcttctaatgtcttttttgctccatcgggaaaataaatggaactgatggaaggagaaagaagaacagattctgtcccggatggaagaccttcaatctgaaaaaaattaagccgaattttgtctcaaaaacttactaaatcaaaacgaagttcaagccccgtagccaaaactaaaaaatcataggaaatggcttgaccgttttttaagaaaagttcatttgaatcggagtagttactccccccctttttgggggttgcatttcagccccgccatttcagtcccagtggaaagggacatttcagtaccagatttaaactttaaaaaacacctataataaatatatccaatcccagaagaggtaaataattgaaaaaacatctgaaggataaaacccaaggctaaatcctattagagaaggaaagggaggcagaggataggcgtcagctgtcatgccttatagggaagggaagggacgcatgccacctgagcgcccgcgtgtgtgccatttaagcgctcgcgtatgccacctgagcgcccgcgtgtgtgccatttgagcgctcgcgcgtgccatctgagcgcacgcaggggccttttgtgagcccgcttgttaaatttgagcgctaaaaataaaaatcgagttaaatgaattagaattaaaattgataaaattaaaattatattaaattaataaatgaaattagattaaaataggattaaaattaaataaaagttaaagttcaaattaattgaaataaaaaaaaataaataaaaaaaaaagattaaaaaataaattaaattaaaataagattattaaattaaattaaaataagattaaaatacaaataaaataaaaataagattaaattcaaaattaagttaaaatataagtaaaattaaaattaagtaaataagaaaaaaagttaaaataaaaataaaaataaataaataaataaataaataaaatattaaaaaataaattaacttcataattattaaagccaaatcctattagataagggaaagggaggcaaaggggaggggtcagctgtcataccctttggggaaagggaagggacgccataccacctgagcgccgcatgtgtgccatttaagcgctcgcgtatgccatctggcgcacgcaggggccttttgtgagcccgcttgttaaatttgagcgctaaaaataaaaatcgagttaaatgaattagaattaaagttgataaaactaaaattatattaaattaataaatgaaattagattanaataggattaaaattaaataaaaagttaaagttcaaattaattgaaataaaaaaaaataatanaaaaaaaagattaaaa

SEQ ID NO: 13967 - DNA, 2892 bp, Heterodera glycines
attctgtcccgcgctgtccgtaccggtatggatacactccgcaaattgcgtgatgggaagggtagcatcccttgctgatttgtcgccacgcctgtcgccatgttgcttcctctcgttgcttcgtttactctggcaactttttgttgctcttcgttcgttgaagcgacgggaccatccccgtcctgcacattttcgtcgtgctgtgcgccgttgcgatggtggccctcattcgctgggtccatgttgctttcgctcccgtcctcgaactcgaattgttgcatttgtcgtctctcgaaatgttgagctggagccccctgctaacggcaccagtttgccgttagcttctcgaattcgtgctcgttggtcgctcgtagaccgattggtcgctcgtagaccgattgttggtggctgcagttgccccctgctaacggcaccagtttgccgttagcttctcgaattcgtgctcgttggtcgctcgtagaccgattggtcgctcgtagaccgattgttggtggctgcagttgccccctgttagcggcaccagtttgtcgccaatcttttactcgggcgggccaagtgtgtggcttggcccagctgaggcgggattggttcccgctcctcttcaccgctctcgtccctttttcctctgctcactccgctcgctgtgccgtaaagggaatggccccctctttcgccgttcgtcctgatgggtctgatgctgctgaccgatccgatcagcgccaaagggggacgagaatgggaggggggaggggtgacaaaattgaactggtactgttggatgttatacagcgatttgctgcttgcttaacggcaccaccgacaagattttggtgaagggcttgtcggacccctttgagcagctccgaacgggcgggagttgctcgacaagattggttgtgaagggggcttgtccgaccctttgagctgctccgaacgggcgagagttgctcttcgctcttgactcgatgaaacgggttttgactcccgtttcctgcggcggatgctccggctggcgggagactgagaccgaaccgcgagactccggctgcgggaatctgaactgctcgaacttcgtgacgttcgctctcgacttgatgagcacgggtttcgactcccgtctcctcctgtggatgctccggctggcgggagactgactccggcgatgcgcgcttctccggctggtgggattagcggcgacgaacgggcctgcccttcggtggacggtttggcaccgctcggctcttccttccttctctgccctgcttggtttcgtcgacgacgggaattcgccccgtccctacggctgctccggctggcgggagactgacaccgatccgcgagactccggctgcgggagtctgaactgcttgaaattcgctgacgctccgggccaactcccggattctccaatgccaaagggaaaggaactgggatcgggaggattgggggagaacgacgagggctgccaggaaagggagggggtcaagacgtgaatgggcgcctccgtttggccccgcacgagaatttgccgaatgtgatggagtgtggagggtgcttttccctcctttccgagtcctccaagccgtttcagcacgaatttattaaagcaaaacgaataatgaataaaagcgacgaattgatcgaattgggcgatgggacgggggaattggaggaattggtcacaggcagaccgaatatgaagcgaagggacagatcccttggcaaagaatgaagcggaagaaaaggaggaagagtggtcacaggcagaccgaatatgaagcggaggggagtggaaggaagagaagagagcgaccccttggccgggggcgcttaaatagacaattttcgaagggggcgggcaaaaggccatgcacgtggacaaattgtgagagagacaaaaaatggacagaaaattctagaagcgaattgcgaacaaaggaaatgggcgcacaaaaattgaatgtgaattggcagatgtaaaaagtgagaaattgtgaaaggaaatctgagcacaaagttggccgaagatgagccaaccgatgagaaaagatttgaattgtgaagggatgcgatgtggcaaaaatgggacaaaggaacggacaaatgtgaatggtacgaaatggagaaatgcatatgagaaattggatggaaaaggggcaaaaattaggaatgatcaattttgaatgaattgatgaatcgggactcgccccgatcttctccaagaacatccctcattctttttgcttcgattgagtcccgtcccgttcatttgtgcaataggcggggattgacccgccttctcgtcgccaatgaaaaaattggcgacattgcccgcggcgccccttgacagttgaagctccgaagcgtgtgtccatgaattgtagcaacgggttttcgaacccgttttccgattggcattgcgcctcgttgtgttgaaaggggcattgctcccccaccaggatttgtcatggcaaggatagccatgcatcagctttttcgctggcagtccgtagttcacatccgtcgactttggcattgttgcccagcatccgtcatcgcaacgaatctcgattttgttaaattcccgcccactcacatttgtgactcctcgttctgcacactccgtggtgcatggaactcttgggccctctcgaaatggaaggttcgggtccattcccgatgctcgaatggatggttggcagccgaacgttccgacaatgctgatgagcatgatcagcagtgccatcccagttcttggttgaattgcgcctcgttttcgtggtacatgacgctccggggaccaaattgcccggcttctccgagcccttgccgatttcctgatttcaagtgcacgtactgcttgaactcctt

SEQ ID NO: 13968 - DNA, 2312 bp, Heterodera glycines
tttgatttattgaaaatgcataaacatttaaaataaaacatatacgtttaaaattgttaaattttctactcgcattcctttttgtttctatgtctttgagttaatttatcttaataattgttaattgatgaggaatggggtcgccaagcaaagatattaaaaacaaaggattaattaatccaattagtaattttttgagtaatgtaatggcgcggatagagttgtgagctgcttattttacgatcgtttcatagaccatttgactattttacccatttgctaagtttttaaacgtgggtttaaattccggggcccaataattgcttgtattttaatgtttgtttatagtttaatttcatttctctttttttgtcgcttttgtgttcgtgtgactttgtcacatttttttcctccgcgcaacatcacacgaaaatgtccccctttccatccaaaacaaaacataaaacgcacgaatcaaacgaacaatttttcagctgcgcctttttcagtccgtttttgccatttttgttcacaacagccaacgactcgactgagcacaacgaccaccacactatcgaccagtaaaaccattacagcggtggcgggtcgacgagtctttcccccgccgccgttcgccaccgccgccccttctcttcggctggcctctttttcaccactctcttcgcccgcctcacctctcccgccacttttatcaaaacttatcatcggtgcgtttgttggccgtaataattctccccggcgtttgctctgtccccaacagcgcagcagcagcagggcactaacattggccaaaggtaaatgactataaaagccaccaaccaaactgaattctttaatcatcagacagtttgacttttcagcttaaacttgtgcccctttaattgaatcataaatttattaggcttcttcctctctacatcagccgcttttatggcggaaaggagtggcgccggacacataaatcacaatggaattgccacactttccgaacgtaatgcgcacagaacatcggtgcaacaggtgatttttgagaaacagagggcgccataacattacaaataaaaataaatttatatttcatacaaattttgtatatttttatataatcattatactttaaatcctactttatctatgtttgtatatatcattttgtttgtctttcttcagtgtccttcgtttgcgccgtttaaaccaaatcgggcattaattgtttcaaaatcttcgctgcttgagtatgaatttgatcggagagggcctaaaaatgaatacagcggccttgacgacccgcgttttctcaaggaggtcactgattataaaaaaaaaattgggtaatacatctttaaatttagttgcatatacaacaaataaatatggaagaccttagaatgaggcataaacttcagttacattatttggacacaatcgttgaagaattggagtaagaaaagaaatgaataattaaaattagattttacaaattcattttaggaggcataaaattgagtggaaaattgtccggcgtcggcagtattcggatgcacttgctcaatgggctgatttaatcatttccgcgggtggcgatggcacttttctcaccgcgtccaaacgaatttcggatggccggaagccggtgattggcatcaacacggaccctgtcgggtattctttttcggttttgattttaaattcaataaaaacttatagatcctttcagttcctttacttttcttgtaaacgagtttttaatcaactgctgtaaaatgtttgtattttcttaggtccgagggttttctttgtcttacgggcaaatcgcgtcggccggcggacgaagtgatcagacaatttctcgaggagagttcaaaaccgaacttccaatggatgcatcgccagcgcatccgggtgaccattttgaaatcgatgggagcccacgacgaacggtcactttcctcctcatccatcaaccagcaggtgaactcacggttagccgacatttgcggaccgtcttttgcggaccgacatatgcggatcactatttctgggttaaactgtctaaaaacaaaaaataataatttttttcaaaaatctgtgaccaaattagttttatttgtgattttccgacttgaacaccacccttaaagagtaatctgatcaacttctgcaatcaacatcgaaataacctatttttttatttataagaagtttagtttccattaataaaaatagtctgtagttgaacatttttaattttggatcaataattttataacagcaaattacggacaattttt

SEQ ID NO: 13969 - DNA, 1578 bp, Heterodera glycines
ggaatattatcgcattgacgtttcttcacataatacacacatctatagaggaattgttatccgcaaaagtcggtccgcaaatgtcgcactcacggaactcacaggcccttaaccagaaaacaaaattcggaaagggggggggggcgggggcgtcagacccaacgagcttttttttcttttgctcttcgccccagaaaaattttctttccggatcccaatttagcccactttggagcgaaaattattttttcatccattcgagacaaaaaatgttttcatttcggagtagccctgcccctcctggttacggacgttcagctcttatcattcatgactccttttttaacaataatttttttagtttttcttttcttaaaaattatgttcttttaaaacagaaaaaaacagtttcttttggttaaatcttaaccaaaatttcagatggcacagtgtgagcaaatggaattgccaaggaaagattcgatttgtgatgaccagggagaccaaacggatgacgacgaggtgtcgaacatgtccaaaaaatcaaaattcaggtaattgaaaattgttgggtgtttgatgtaatacgtgtttgtgctttattttagttctgacgatgaagaacaattgaacgaaagagccgacgcttacataaatggggaaacttcgcacagattggcactgaacgaagtattcatcggtgaaagccatgcggcccgagtcagctattacgatgttcaggtaattttccaaaattaattgttaaaataaaatttaaaaaacttagaaggcaatgaaataagcgaaaggcttttattttgcattaccattttatagattctgtttcagtttacataatcaaaattaatgactgcttaaaactgtgcaaagccataataggaaagaggctcttactgattgtgaaaataggccattattaaagcaaaattcgatttgttttcagggggggggagcacactcattgtcgataaataggacggttttcggacaagtaatttgatgaaaatgccaagggcatacacattaaaaagcagaaagaaccatctccaccccttttcaggttgacaacggaccactgacaaagcagaaaagttcggggatgacaatttgtaccggcaccggctcaacttcttggtctgcgattttacgtaaattatttcaaaaaactccgttcataaacacaggcattacaacataaatcggctgaccgaacaaactttgggtgaaattttcacggagatgtcactgatgggcatttcactggacagagaagtggacaatgaaatggtcgaggagatttgtcgccattttaatgccaaactcaaattcggccctgagcagaacagttcggactttatcatatttattattactctaattggatcaatcgctcaatttgttgctaaatgggttcgtttatcccattttcagagatggcgttcagtgttcgtgaccccgtgttcaatgccactttcccaaagacacttatccgtggatttgctcacaaaatttttttaaaggtatttccaaggattgcacttcattttttcccctctg

SEQ ID NO: 13970 - DNA, 2312 bp, Heterodera glycines
ccaaaacccgaaaaaattttcaaaaaatcatttttcgccaaaatttctcgagaatattgaataaatttaaattttcttaaaaattaataaattttggcttttatgttttttttcttttaaaatgattgcacgtaattgccgaaaaaattcgagaccaatttccgaatgttgaccgactaattgcaagacgaaagccgtctttgtcaaagcgccttaccgagtcaaaaaatttggaaatgtatctcatatgcaatttcaaccaataaatttgaagaaattttgcactcaattttgaaaaatttatgtccatattttgacatttttgccatttatttccatattttgagatttttgccattttatgtccatattttgcgatttttggtccatattttatggccatatttcgcgattttatatccatatttttaccatccctattgataacgcttcagttggttctcctcggcgttcatcgtgctttcatcggcggcattttgttcatttctctgtgcacaattgcacttgggtgagtgccagaattgttgctgagctaattacgaattattaaaagataccgtaattaacggataacggttgttcgggtgccgacctttttgagttccttctggtcataacttttttgaaacttaacgaaaattttttaaatttagcctattaatagtaaacacataaagctatcgaacaacaccaagaatgcttaatttgatttacaatgaacaaaattatgatccaaaaagtcttccggcgacgtttcggccggcgacgttttggggtgcccccttaattttctcccccgtttttccccctcagtttgtccccatgctttccgtaatgaatttaggattacgggatccggaatccaggcattaaaaggctaggaattcagggatttattccggaattgtttccaatttcggagtccagtcccactccaacccatggatttttttaattttgtccatttttttgctcagtttgtccccatgccttccgttcggcacgcctttctttgtcggcgttttgcttctccgagtgggcatagcaattggcaatgcttcatacacgaccagctcctgggcactcattggccatttgtttccgcaacggattgtgctgttcacggttgggagacgaaggcattctcatgggaaaggtggccttggcaaattggccactaccattcccattcaaccaattgaatttggtgccaattgtgattttgggctaacattgattgagatggcattgaaatgccataatttgttttttaaatgtcatctctggcactttgagggccttttggaagtggcatacggacttggctatgtgcttgggcctccgttgggcagcgctttgtttgaattcggtggcttcggactgccgctgtactcagttggcctttcattcgttgtcgtgctcgtcccgtccatcattttgttctctaatcgacggcggcattatctctccattggcatgtgtttatccataattatgggatgggaaggccaaaaaatgcaaggatatgaaaatctggcgacaaaaatgccgggataatggcatcccatctctagtctagtccattcaatcagcagggttggagcttagatcagaatgtcacggacgcgacatagccaccattttttgtgtccaattatggcattgaattttcctcttatcagaaaaccaaagtgccgtccgttcggatgccgagtcgggcgaagaagtgccacctcgggtgctccaattgttggccatccccgacctgtttctggccgttacttccctgttcctcaactcaatctgctggtacttctatgagccttcgttgaccactttcatggccgatgtatgtaattggaccagggattatgaattttcaaaaccaaaaatttcccaagattctcgactatccaattttaatgaaattaatgatttttcaattatttttccttaattttcttcggcaagatgattacccccctaattgccttctctcggtccactcctttgatcatttcgaattcctttgcttcactgattggcataacaaatttccaattttcattccctaattacccccattctcggtccgtttcctttgatcagttccgccttgactggtccgcttcaatgatgtccggcattttgatcgctatcactgccgccgtttacatagcatctgccaccatttggactttacttttacaacgatatttgagtgctcaaatgagaccgatgatggtgctcatttcagtgggaatgggtagtgccgtggtttttgatcggcc

SEQ ID NO: 13971 - DNA, 1100 bp, Heterodera glycines
cagcagagccccgccgcaattggcgacaattggccatcgccatgcttctcgtcggctccaatttgttcatcaccattgccgtgtcgtgcattgtgcccattttcccaatcgaagttcggcttttggcaaaaatttgaaaaaaaaacaattagttgtttagtgaaaatcaagggctattcgatagtctcagccaagaaaagtcgccttttcaaggtcctggtttgagaccgaaagtagagagtaaatgttgttcaaaagtatcgagacttggatcgaggcctgatgactgagcctggctttttgaaatttgtttaaaaatctaacgaatgtttgaaaaaagtaaattcaagccgggacctggatttattggacaaaacaattaaccatcattggttttttgtgttttcaaatgaaacaatccattatttacgatttttatctcaagaatcagagaataaatccattaaaatcccaggcaaaagcgaagggactcagcaccactcaggtccggcttggtgttcagcatccaagtgtccggcttcttcttttcgctcgtcttcggcaaatatgtaaactcgggcgaataattgtgagcccggctagttggattcaaatttggggcttgaaactgaccccgatcggatcgtcagactaattgatatgatccatgatcgaagtcactccttttagcacttgacaattattgaattttcattttccatccatttctgtttgataactagggatggtaattatatggaaatccatatttttttcctggaatgtgggaggcctgaaacgcacgaaaaacatgtttttagcttggtttgaagcttctaggaaggatttctatatccatattttccatatttttccatatttcgcgatttatgtccatatttccatatttttccatattttggcattttggtccatattttatgtccatattttggcatttttcaaaaaaacctctattagaacggcccccagcagctaaattagcccttttgagcccaaaacccgaaaaatttttcaaaaaatcattttttcgccaaaaatttctcgagaatattgaataaatttaaattttcttaaaa

SEQ ID NO: 13972 - DNA, 1075 bp, Heterodera glycines
ataaacttgtcaaaccccttttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtaaattaaactagaaaaaattgaaaattttgaaatcatgtttccccctcccctttccccaggggtattattttgaaaagtttttttttccccaaaaaactttttcaaaccccttttttccccccgggaaggtttttttttttgaatttctgaaccggttttggaaaaaaataaattaaaaaaaaattaaaattttttaaaatcatgtttccccccccccttttccccgggggaattttttttgaaaagttttttttccccaaaaaatttttaaaaccccctttttcccccccggaaggttttttttattcaattttcaaaccgttttgtgaaaaaaaaaaaaaaaaaaaaaaaaaaaatttttaaaa

SEQ ID NO: 13973 - DNA, 1566 bp, Heterodera glycines
cctaaaatgtttttatcgttgtctctctctctctctctcttcccttgtctctcctttctctttcatcttcgacgcactgtcctctctcccctcctctcctctcctcccctctctctctctctctctcaccctccctctctctctctcacttccatcgtttcttttggtctctccgaatttacaattgtcgcgtgtcggtcggtaccattccattcattcgtttgtgtttttcattctttgccccgtcactcaaaaggtcgagaaagccgaaaataaagagttttaactgttaattattggaggcaaagagaaaattgagaaaatggacgaagtcattgaccatttgagaaaaggccaaaaaaagaatggccaaaacaaccaaaaagaaaaaatgaaaccatttttaaaagcaatttaaaaatgaaaagggagtgagggacaagggacgaatgaatgagtttgttgtgtgattgatccttcgcttttccgtccgtttttcttttgtctgttgaacttttcctcttctttttttgttttttccatttttggtaaaaataaaataggaaaaacaaactaaaaaatatctaacagaggtttttcagcctttggtggacagtgtaaacgcaagccccggcggaagtctcagcgacgagccgtcggtgggcggtgtcgcggggtgggacgacagcgccacccgttcgagtcccggctctttcacttcttcgcccgccgctgccaacaggcattctcatttcggcgtttctccccaacaacaaaatgtccgtttatcgtcacacgatggattggcggaacggctcgacaaatgggaagcatttgaaggaaatggcaaaggatggcaagcgaaggaggagagaacggccaacaacgccttggaaatgccaccgaaacagccgaagggactttggtcggaaagggacaacgaagccatggcagcccaatggagttgccaaccaacaaaaacacttcaacagaaagtggctaaggtgatttaggaggaaaggaatggaacgaaaatggcggctcatttccggggggcggaagggacactttcatccatttaaaacgagtcaagccaaagtgccgatgagaatgccaaggagcacaaagaaagtcggaagtccaaagatgaaaagatcactcacagatccaacggcccatccccacgcgattgaggccaatcgttggccaaatccacggcagtgcctgccactccaacggctctcagcccgcttctctcctcgactccgagcctttgttccctcagccgcctctttcgcagccaaaatcactgcttttctctccgatttcgcctccgcctcggcatggaatgcctccgttaattggcatggcaaaggcacccgtgccattggagcagcgaacggaagaccaacaggagcaaagcatacggacaaacgcgaacagttgcgacgaaagcgaactgcgattgtaccacaaacacttggaattgcaacagcacatttacgagcatgtgtacgcacagatgctcagcacagcacaccaacagcagcaaatggacgcgtacag

SEQ ID NO: 13974 - DNA, 1000 bp, Heterodera glycines
  misc_feature (8)..(9): n is a, c, g, or t
  misc_feature (27)..(27): n is a, c, g, or t
tgcaggtnncatgaggaaatgggaccntgaaaccaaaacaaaaagccattcattcgtacagaaaattgcggcattgagcagcacttccaactgcaaccctttgtttttccaacggagtgcagctgcgctggagttgcaccattggctggacgagtgtatggagcagtaccgcctgttggagaaggagcgcaagaagacggaggccgagttggcccgtcaccacctgggcaagcggatcagttcggccaattctcttccaatccctcggcttccgcccgccccttcgcgcgtcgaccgcctcatcgtcgactttttccgtgagcacgcacgcgtggtaacgcttctcgccaaaatggaacagttgagaggcgctccgatgtgcgaagaagtgcaccgtgtgagtggcgtttgcccgcggcgtttccttcactccgtccctccctcagatccatcgccaattcctcgactcaattcgcatgctccagcagagtcgtctcaacgaacgcacggccattctgcagcaattgcgcggcgaagtcggccgatactccgaggacagaggcgagcacaatccaacggggtgaagaagttcaaaatgtgttttcagaaactgccaatctgaccaatgcgttggtttgcgtgtgtaaggccgtgttgcgcagtcgcagtgccaattggtgctctttggcgtggacagtcgaggcgaacggtgccgagcagcaggtgcagttgcagcggattgtggccagcggctttgagttggcaccgccggagattaaacttcggcccatttgagcgatgtgccggggtgggcactgtccgtggactgtccccgcatttccctcgcttggattttcccctcacaatccctccaattcttataatttcgttcgttcgttttgctcctttccgtgccttcgcttctctcctcctttttcctttgtatttatccgccactttcttcactaattaccataacaattcttaaacatttgtcgct

SEQ ID NO: 13975 - DNA, 2028 bp, Heterodera glycines
ctgaaggcggactttggggcggagacaaaaattgccattcaatcgaaaggggcgaattatacggacggacgaatgcacctagtgcgagtgatcagaaaggacggggaagtgcacttgcaggtgggcaccgactgatcaagcgggagcggacaagaacagaatgagtcgacgattgttgcaggtcgacccgccggagggcgaccatttatccatcactttgacggacagcgaagcccttttggacatctccgagtccgatcactttgtcggcggtgttcctcccgactttccgcgcgctcgctttacccaagaccatgacattcattttgacggctttttcggttgcattcaatctgtccagcccaaccaagtggccgagttagacttggcaaatcctgagagagcacagcgcaaaggcaccgattgcacttacagagaggggcgactgagcacaacggagagagtgatcggattcaaagtcggactccccggcccattttcattttgtgccgctgaatttgccccgctttagggattaaacggtggatttttaaaatctcgcgggattttgctggacacttcctccaccttctcctttaaccttcgatctcgacgcgaaaatgccgttttgttttaccaatcgaaggaattgcaccgcgcagaagaggcacaaaaggcacggagaaggcgacggaggacaatgcgggggaataggacgagcggacggaaggaacggcaaaagagacggacagaaggaggggacgaagaaacgccgcaggtaggccatgggacgtacagaaagcgacaggcgattgattggccgatcgatcgatagattaatcggacgattttatcgattcgatcgattgatatccgattcattaagcatagtttttcgttcagtcatttttggccatttacttgctggacggccgtctgtccttccacctcggcttcgaatcgcaacactcttccaagcgtcctttggtcgtctcctcccaccgttacaacgacggcctcctccactcggtgtttttgtcccgtcttggcaaagagtgcgtcaccatccttttgttggccaattttatttggtttcttattgaagagttcaagttcgtattgatgaccgagaagtgttggccacagttttggacgacgaccgaccgattggtggcattgggtgggccatgctaatcggcggctttcccgcccgactcaaagagttggccacgcgcgcattgaatggcaaattgggcactttggagccgatggaaggctgtctgtccgacttccaactcaattacgagtgcattttgttttggttcgctttcccaaatggtttgctcagatggctgcccgttctgctggaggctcatcgcggtgccgttctcggctcgtgtcctttcgaaggcggcgatttgcgcaccccatggtcctccggcggcggcggcggcacttttgccacttcgccctcctcttccctttcggatgagctttcttccgatgaatcaccgctttcgatggatgtcccaatggatgaagcaaaggaagagcaacaaatggaggaaaacggtggccatttccatcacaaaaagtcgcgccaattgctcgagcaggcgactcctcagacgactttgtcgtcccaacaacacaaaacgaatggccaaagtctcccgaaagccttttaattattggctttacgttcccttcagttcacgtgccaaccgaaccgcaggaacttcgtctgaccacctccgaattcgttcatcagtccccgcagtgtttagcaagtgaattgttggccaaaaatggcctcgatgagaatgaaaatgacggcgttcactttgggctgggcgattacagtcactctcggcttaacttcgaccagaagccctttcccgactatgacaagtgcctgccatttttatctctctttctccaatcatttctttcagcttctccataacttttgaaatgcgctcaaaaaagcgcggaatcgacgggttactgtggacatgggccaactac

SEQ ID NO: 13976 - DNA, 1457 bp, Heterodera glycines
cccccccccccccccaatcttaggtggaccaaatgtcagtcgaaaaagtatggacagtccgacgcccaaagtgatgcgtcgacgaatgtatgtggggggagtgatcagcaaacaccggcgaatgttcgaagatcagctgaagggcgacgcattggcaagggcattttcggtgggtacctgaagaattgcaaaagaaatgagaacaaattttgttaaataaataatgaattctttgacttttgcgctaatgcaaaattttgccaccccaaaaatgctaattaattaattacttttaatgataccctttcatttcgtcaaattccgctctctcaaattgcctttagggatgcattcgccactttcgcatcgacggcaaagagcagcgtttgcttcggcacagtcgtgatttggtcccttgcgcggattcgcccgccgtcgcttacatccacgagggcggatacgccacctttggcacggcattccatttttatgagcatcagaatttttgattaaatttcttttcagaatctctgagttcgcatgcaaataaaaaggcgaagtctccgcccgaatttatcgaattgagcgcgcaatttcgcatttttggccatttacgacagaatgccaacggcggcgccaaaacacgccttttgatggctcttttgttcgcctccaaagactcataccaaacgaatcgacttctgctgggtgcggactcagtcagtggggcggtgagtgcgcaaacattcaattgaccagggccaaatcaaatcgcaattggcctattcagctgtcactgtccatccatctggtcaaatggcgtgtccatttcgactttctcttcgacggctccactccgtcgaatgagtccctctctctgtcctctctctcctcttcctctctctcttcccccccatctctctcctcctcttctctctcctcctcgtcctcttcacttcctccattgatcatttgtcctggccattggggccaagtgcgtctccgtctctcccactcccttttgaccctttctctcgacggcttaagtgccgagttggccatgtcacttcctcgtcccgctttggacactttgcgttctttgccggtcaatttgggtggcaccaccggtaaatcactgacttttgctttttttacttttctcttttccagcgcctgtcggcatttcgcttggcgtttattctttgaatggctgcgttaagcttttctcaatgaatggcatgccggtgaatattgagcacgaaaaaacgaaatggcacaaaatggtcgccgacggatgtccgaagccaatcgactgatcaaatgttctaacagagattaattatgcttacaatttgtttccttttttttacctttttttagaatttgttttcgtgcattattttgaaagtgttgccattgttcaaaatggcactttccttccttaccgctatcgtacg

SEQ ID NO: 13977 - DNA, 2330 bp, Heterodera glycines
aaaaaatttgttaagtttaaaaaaagttcgagccccatagttggaaaatttggttttttgaattcttctagcaataactatttttttaaattaacgaaatttttccaaatctttcaggctaatagagaacacttagggctttcgaatgataataacaatgttagatttggttgacaaacaaaaaagttatagtccaattggctggcgcccaaacgaggtggaccctatcagaatgactttgcttttatgaattacaaaaacactccgtttgtgggactttccgcttttttaaagcaatcttttaggtttccggtgttgtgctcttcagttttgctttgtggcttcaatttgaccctgcccgtgaatttcttctccgtctcgtccacttctccgagtccactccctttttcgagatcgctgtttacttaatgttgggcacatcgctcttcatttttattgccgtcgggattggattctcgggaatttggaagttggagcggtgtttgcttagcggagtgatttttttattgcataattaacaattgccataaatttgagttaattgtgttgcctttgctgagaagttgggctttgataacactaaaatcactcttctgaattcagttctctgtgcttcttctgctgttgatacattgcaaattgctcatcctttttcttttggttgcctatcgttttaaggtgactttgtctctttgaatctcaatttttggtttttagttccctgatgacactgtaatgactgagtacctcagtaaaatggcccaacatcactaccatcgcgacaaatgggtgaactcggcaattcacacaaatgcattcccacaaaatgttattttaggcgacacctctgatggattccatccaattctatgtaaattttgtttatccatttcaaagcatattttcatgcacagcacaaatgttgcggaggaaacggtgcgcaagactattcggagtcattttggtacaaagcgaacgcccaaatgggaatgccaacaaacggtgagttcttaacatttactagagttgtttttttcttcagttctcacttattttaagtgccttattcttgctgtctccaggcgcaggacgcccgggcttggcacttgcagcccattgactcgatgtgcaatcagtacaaatacggaagtcgcccattcaacgactcagtgaattggacggtaaagtgtccaacgcgttcaggagagaacattagccccttttagggctgcggtaaacccacctttgaccatttgaattggcttctgcttatgttgtcgatttttctcattgttttaatagtgcttgacgtaagtctttgtcggcccattcattccgaacccttttcccttctttaaggcgcttggacttttccttgtggtgaaatgcctccgtctagttttgtcgttttacacttccatccgaagcctgcgatgatgccaattgtgattgcgttatgatctcacaacaatgccttcatgctttctcaaatacctcactcatttccttcacacatcaatcacccttttgttttttgtgtggctttattttctctgtcaacgattttattcattgtcagtaaaaagcgatggtaaaattacaaaattagtgaatggatagcaaaagcagcatcgacaaagggatttgaagatcaaatgaaagtgaagataacggaatatgtttaagcgaaaagtctaaagtgaaaaacttgtgacaaaaattgcaaagggagtggatataaatgccgtcgaattagggaattttgtccgttgttttcactttctctaaactgggaaaggacattgtacaacaaaaggttcgacttttggttttccgttttcactgtcctttcgtccgtctattccaagctcagcgagtgaatgagtaaaaaaagggagggggggggggagacgaataatcactgaaacgccgtctcaaaggatttcgcacttggacttctccgcccacggattgcgtgctttgtccaccggattgaccagcgggtcatttggctggtgctgctcaatgtacgccttcaattcggcggcggatcgcgaaattggcactcgctgaaggaaaagcaaaaatgttaagcaaaaaactctaaaaaaatttatttttgcgatcatcgaatttcccagcagggcccaatcaagggccacccaattttacatcaaacttttgtttaaaattgggtacttatacagtttgacccacataaaattttttttttgtttttaatgataaaaacgtgtttccaggggttttcgaggccactgatcatgaattgtaactctatttgacgaatt

SEQ ID NO: 13978 - DNA, 3335 bp, Heterodera glycines
ccgaaataaagaacgcatacgtaaatatgattctttattatttgtgcgacatgattggaaaattgcaatttattatcaatatttatgcctaaatccctaattgtatccacaacatttattatatttccatcaattttatatatttctttggggtttttattccccaagtaaagtacaaaagtttttttaattgagattctgatttgccatttatttgcccattctgataaattatgcaatgctttatgcataatttctgtgtcaactctcgctttataacaaatatacaatttaacatcatcagcatataatttaattcttactcctgatggcaaagcatcaggaagatcgttaatataaatcaaaaataataaaggtccaaggacagatccctgggggactccagaggtaacttttttactggaggataaatcatccccaattttaacacaaagtcctattactcaaaaagtcctttatccacatcaaaagtttgccccttatacctattttttccaatttgtataaaagtaattcatggggcactgagtcaaatgctttttgaaaatcaatataaatacaatcaacattttttccatttattattgcctcgtaccaatcttccacaactgttattaattgactcgttgtagacctatttctaacaaaaccaaattgaaattccgaaatttttttgttttttaatagaaaattgtaaatatctttgcttaaaattctttccattaccctgcagagtgagcaggttaatgaaattggcctatagttttcgggattatttttgtcacccttcttaaaaagcggaaaaacaattgattctttccagatgtctggaagtgaaccagtgtctaatgagatcctaaacaagtcagtaataacagttgacagagaagaatggcaaatttttaaaattttataactaatattatcgggagaagtgccatttttattcggaagttttttcagaagattttgggtctcgatgatgttaaaatttatatccgatataaagcattgatcaatttctataatattacccaagcatggattgcttgggtcggtttcactattattaaatgaattggcaaataaggtggcaaataattcacatttctcagcactgttatgatagcatttattttcataaattagattaggtatttcaaagggattgacattgaatttttgtatatatttataaattgaatttcttccctttgaaatagcctttttctcaatttggctatggtatttatttgtttgtatttttatatgtaaagaaatgctatcgtatagtgcttttttggatgggtcagttttagctagcctgaataatttagccttatcacatcgaatactgcaataacacccttctataaataatttatgtaataaaataataaatttggtaaaataccaaatatttaaagcactttttgcgctgactacggaaacactcgaattggtaacaaacaggaccgattggagtccgcttcacattggcaaataggcagactaatggcacgaaactgatcagctcgttgttcaattcagccggcaggagtcgacgaagttttggctttttctcactcattggaaggttcaaaggattagagcgtttcatttttccagaaattgaattaagaatgatttcgatttcttgctgggaataattttggtgcgcaagtgggcgtggccaaagtgcgcgtatcgtacaccctgtcattttccagattcattttaaaaattttgcactttttttttgcacatctgctgtttttctgcgctttatgggcaccgtattatttaattgggaatttagggaaccgtataattaaattttattaaaattatatgagcatgcctaaatgtttattcatcttccgtctttcacctcctttattcttcacactatttccatgctttgcgcatataaataccgaaattttgttcactcctcctcaatccctgcacagatttaaaaatatggacaatcatccccgaaagcgcttcactaacttttccattgaccatattctctccgagcccaaaaaaccccgacaaagcttgctgatcaatgaacatggcatagtacacttccaagccgaaggagcatcgaaagtggtcaaagactacgttaaaaaattggagaaaaacatcgagcatatggccaaattccactatgtcaaagtcaagtcaaaattcatcattaccgacttgccgagcacgcctgaggcaatgtggacctggactttcaaacattatatcgaggaggcatttgctgacagtcgtgagcgcaacatcgaacctacacacctcggctgtatgatcagcagtcctatgttggaaggcggcgacatcccaactccagtgcgacagatgactaacaacactctcgacaccattctcaaccagttcaaaaaagtggcgcagtccaaacaacagaaaaatgtgtcattatggggggagccatttaccgtcaccatcacgactctcgaccgtaatggactaccatccaaacgtcgagtcaacgggggagctcgtcgccctatcaaaacggctgtccatcaccgaattaacgaccaatgcctgattaaaattcgtaataacgacaaccaatactgcctgttctacgcgctgcaggcaacaatggtcgccaaaacgtgcaattggcctcgctggaagtttttcgactatgtgaacgacagaaaatgacagcagggacaacttcacatgatgcagttcagctaatgcagcaggttaatgcaccaatggatttggttggctacgacgcggacacatttgtgcctcaagtcgttgactactggaacaacgcgcagcgacaacaccgctttgctgtgttcatctttggatcgttgggacagtataaaccaatctacaagtacattgacaacacctacgacactccgctgctgttgtacttcaatgaagaccatttcgatggtgtgcagaagcagggcggtttgttcggaaaaccgtactgtttggagtgtgaacggccatacgacaaaatgtcaacacacaacaaaacatgtaaagcgcgctgtatgctgtgctcacgtgttggaccgctgtttccatgtccatcatctgccggcttcatcaaaaagtgtaaagagtgcaacaaaaaattcaccaacaacggctgctaccagcatcacctgctgtcaggcttctgcaagcggtcgaaaaagtgcaaagattgtggtgctgtttgggatgttgtcaacaacactcagaagggcagaaaaggacatgtgtgtggtgaacgcttctgtaagatggtgcaacaacta

SEQ ID NO: 13979 - DNA, 3182 bp, Heterodera glycines
tgataaaattgcttggcatcgggcgggaatcgaacccctttgaccatccaatccgttggcaaaccctgccactgagccaccgaatccctggcgcaattttgtgccaaaaattacacttcatttatcttcagaaactttgccctacgatgtgactttgctcaaaatggattttgagcctgactttggctgcacaatcatatcgcatagccaccgttacattggtcagttttttcaatggaaatgagacgaaaaaagcgcgaaattgcacaatgcctaattaatggcaattaaatttgggccatttttttggcacattttaaatttgggcattttggcacactttctcttcagctgatattgtgcccggaagcgctgcgcaccgttcggcccgtctccgtgtgggcgattgtgtggttgcggtcaatgggcactctgttgccagcatgggccaccaagtgggtgcaattaaaattaattaaaaaaccaattagcgaactaattgggcgagcaatggcaccgtccaattcagtcccataaacgaaatgaccaacaggaagcgattttgccatcttttgttgattagcatgtgaaaataataaaaatacgacgccattttggagtgaaattctttaaaaaattcgacaaaatttccaattattttttcgaacggtccattagaaaaatttttttttaataaattgactcaaaaaaatgcaaaatacggtctttaaaaaacaatatttgttaaaaattggttttttgagtgatttccatggcaaacaaaaaatttctttggtattttttggcatcatttccaaaatgcatgccatcatttgtaacacccttttgacatctgatttcgcttccctggggcaaagccatcgaaaaaatgttttctcgagacgatactcgagaccaagtcttgctaaagcagtactcatccaaaagggttggcgcttgactcaaaaatgggattaattttggagtggttattcgagtgttttttggcacatttatgggcctcaaatggcacgctaattagtcgcgcatggaaagcgtagaattttaatgggttattttggagtaattagtgcaaattacgaaactcccccccccccaccccccctcattcagcaagtgttgcaattcatccgctccaccggcaacacgttgacgctgaccattgagccgacgcttcgtctgatggacccgccgccgtccgccgcttctccgccatcattagcagctgcagcagcggataatgcgcagcaatcatcatcctcattatcatcaaattatgcactgttaaagcagcagcaccgattgtcaaacggtgcggcggccgcggcggagtacggtaatggagtcgttggcggtagtggcggggccgttggtggtggtgggtacggtgttgttggcgcaaggagtactgtagtgcagcagcaacaacaacaaccgcaacaatggcggcaacagcagcagcagcaaaatgtaattttgttttttgccgttaggattctgtcggagagtggttactgtaacaattaagcatttgcccaatttgttcacggttgagttggtgcggggcgagcgcggcttcggcttttccatccgcgggggtgccgagtttggcatgccattgttcatcctcaaggtgggcggcggcatttaaaacactaattaaaatgactcaaaatggtgtgtggccagcaatgaaaagccagagagagtcacaaattgaagaaaaatgacttctagactgggcctggtccccggcactcggggagagaaaagatcggggattaggggggggggggggaaattgtccgacaaaagtttggcacaagcctacaatcagaaaatttcggaggggggggggatccctattttattttattttttgctctttaccccaaagttttcccatgtaattttacatgagggtttttggcagatttgtggcccaaaaatgccaattttgggaaaaaatctaaggcgtaattaggggtaggggggggcggtgccgtgccgaaaggcgccgtaatgggaaaatttaacaaattttgaaattcgtatgcgcatagattgccgaggttggcccagcagcgggtagtgccatgcaaattggcgatcaattagtggaaattgacggcgaaagttgcattgggatgagtcacgagcgagccattggcatgatcaaggagaggcaatgcgtgaggctcacattgagccgacaaaagctgtaacatttgccggacaaagaaagaaaggatggatgaatcgacgaatcatcatcatcaatcacgcgaacactcaattttaataataatttatataaataaatcattaattttcattttgtttcaaatcgattcaaaaaactggcacaacccaagggcgagggaggggggacaatttgtcctggaattgtgaaaagttgtaattgtttgatgattgagggatttggcatttttttttaattttaacaatttattacgagattttttagtcgaaaatatattgttttaaactcaatatccataaatatagaaatttatttgggctttctttcataaatgaaatatttagtatggaaatattttaactttttaaatcaatttttatcattttttataaatatttttgggttttttgaaattttttaacaaaaattcagtagcaacgaataatttacactctaagaattgctaaaaaattggttccaaatggcatccatctcaaatctcgcaatcggaaacccgcaaatttggcattttttgattgggaatgaatgaatgcattagttttttgaatccgttttttatgctaatttaaataccaatacattcaatcattcatcattcgatttcagggtggcaatttgtccctattttgaggacatttgccccattataacaggggtgcgatcgaaaaattttcaaaataagaacatcaaggccaaaaataagatttttgggtccaaaataaggacattttgcaaaattgctttaaatcgcttgtataacaaacactttattcaattaatatagcacatcaacttttgtatttttcgcctccaaccaaggaattttggagaatgggggggggggagatggtccggcggtgccgataggcgccaaaaggggaaaattttttgtaagttcgttatgatttttaacaaa

SEQ ID NO: 13980 - DNA, 965 bp, Heterodera glycines
aaaaaactgttattaattgacaaaattcgggtaggtgcacgcgatgacaatgagattcataaatcaatgagagtcaagagaaaggttcacaaaattcgacactttggctaattgttgcgtcatcagattttttttcgctcattcaaataaatggagggtcagaaaaagtaattttcaataaaaataaaataaataaacgaatgattgacggtggcaaagcataaatttgcgggaaaaacaggcataaaagttcaaaacgtaatcagaaacaaagagtgaaagtgaattgggccggaggagagagaaaaatcaaacaaagtcagacagtcaacccaatcaatcaatatctcggctttcatcatcactgttggctgttccgagccgactcccaattgttgctggtgtcaccgtttcccgtcgcgttcagatctacttcaagctgctgctgctggtagtggcgaactgtgcagcaaaagggaggagcgttttttggtatttcaatgggtttgtgactaaagtttgaattttcgtctttttgttcgaatttgagtttagggctctgaattaatagaaaatgggtaccggtctcggactccatttttcaaaatgaatttgaattaccaaaattgggctgctgtggcgttccgccgccgtccgccaccaccgcactccgtgccgagcgttgcgacggattgcgcacaattggcgtgcccccactgctgctggtggtcagtgtgcggacagaagtgtcggtccagaagtcgtcgttgcctaaccgaagcaattgggctatggcactgacgcagcggtggcgcagcagcggcggacagtcaggacgagcggagccgaaaacgagcggaccgagcggaacggacagcgcgtcgatggtcaacagaccgaacttgaagatgttttcaattcacagatttgcccgaattttgggggtcggtcaaatttatgcaaaa

SEQ ID NO: 13981 - DNA, 2791 bp, Heterodera glycines
  misc_feature (47)..(47): n is a, c, g, or t
  misc_feature (2760)..(2760): n is a, c, g, or t
ggaataggtcaaaaaagtcagcaaatggaaacacttaccactggcanatcctcgacaatgccggcaaatccctccaaaatgggcccatcgatggccaaacagcggtccaaaagtgcacaaatctccttgccatatgaataggggatcaacgggtcgcggatttgcatcaaaaatttgttgacacaagcggaaatgacagcgggaggaaaagcgtcctaaaaaggggcaaataataattagtataattaagcaagcattgtaccaatttcgggtagcttttgtttggggcgagaaattgctttgtgacggcctccacttcagcggggcttctaaaaatgatgaaattccactaatgatttgtcgaaaatgcaatttttacttatggcacctatcggaaccaatgttttccttggaaattttcaattaaggcccaaaataatcaaatggtcatcaatttgccctccaaatttctttttgcccgtttcgttaaagaattacccctcaatttggtacaagtccctgtacggcatgtatgttttgcagtggtccaagaagtaagtgcagaaaatgaccagcggaggaaccatcgggcgggagtcgggacagaaatcacctgaaaataagcggatttcttgtaaaattggcaattttgagttttctttgatttatgcgtctttacatggcttttaaaggcgtcattaaaatcagtttgacaattttaacgcgtaaaatgccatgtaaccaaaaaacgcaagagaagacatttgactggcaaggcattctaaacaaagacccaccaaggcgaggacgtccagccgatttgttgccattcccagccactttcggcgtgttgtgccgacggacgcagggcaaaggcgcaaaatggcggcacgactcgtgaaaaacttctaaaaaatccgttttcatcccaaatccaatttcttagcttacctttgcaccgcgtgcatttcacataaatgacattgaaaccgatggttttctcgcaacgagtgcacgagtgtttgaggaggttgcgtctcttctgaaacccatgaaccatttggtcggcgaacaaccacggactttcgcacaccgacggcagcaagtcgtccaccgcttcgtccgaattgtttctactaaaaatgggaaacgaacaaattattgcattcgaacggcatctgtaggcactgcggaaccaccaacttcactagaatttgccaaaatctctccaaaaaatcataaattcgtgtccaaaaattccattaaaaacgaaggattctcggataaatcaaatgcctccccttttcggcatttttcttggtccccacccggtcaagtcgccatgcgattggctgatccgactgtttttgaccaacgccggcaccaacgcccgtcggcgtttgatgcccccgctggcgttgacggtcagtgcctggcgtgcggcgccggcggtggtaacgccggcacgaacaacgctctgtcccgcagcgattgtgccgatgatgcccagcggtgtctccggcggtggcatggatcacggagcggcgaaccgccgacgcgtcgccgcccatccgcgagcagtacgcgtcctcatcgttgtcgtccgcgtacggaaactgcgacttgcgcttcttcggagttcgcggatagaattgctgcgattggctgtgctgttggctcagtttggtcttcagctccttgttttcggtcatcaaaacgctaaagtttttgtttattttaaatgctcaaaatatgccatgtgatgggtggttggaccaggcccataaacagggtttatttaaaagttacaccttttctttaccggactgcttaaaatttgcagcatttttctgtttaccgcacaccggtggacgcgaacttcccgagaattattgaaattagaaagccaaaaattgaccaattttggccaaaaatgtcattggccagcccgggtctgtgtgctgtgccctgtactcactcgttttcgcgctcgagttttctgttccgcccggccaattcgtagctgtgtttgcgcgtccgctccaactcggacaacaaatggtcaatggtcgatttaaggaaaaaggattctgaggagtgaactcattttgtttggttcagtggtggacaatttgagaatgaatgtcaaccgtttctgctgttgttgccgatggaggcgtaaaagtggcgaagtcgtaaaatgtcggatgtgtctgagtacaaaaatgttcgttgcattttttggcaaaaaagttgattcctggtggtcaaaagaaacaaattgtcgtaatataacaaatctaaacttttgtttattcgagtggcctcaaagagttacgagatgagtacacatattagttgaaggtaatcatattaatcaacatcatagctcaagcggacactaaaagattccggctctaatgcactttacacaccgagtcaaaaaacgagacatgtgtcaataaagagagagtgcagagaaaaaaaaatctcttattttggcgtactatttctttatctctgttaatagagaaaaactgaatttacttcgtgacgtttaactttttttcctaacgttaaatccacacccaattttgcatgccgatagagaaaaaaattctgcatcgattaatgcaaaaagtatttttgtttatgcgctagatcaaatgttataagaaaaacaaaatttcgaatgctcatatctttttttctaactcatcaaattgcttagcatttgcttagaaaaagcttctccttccncagagctttcgaataataccaagattatcca

SEQ ID NO: 13982 - DNA, 4591 bp, Heterodera glycines
  misc_feature (41)..(41): n is a, c, g, or t
  misc_feature (4555)..(4555): n is a, c, g, or t
caaggataaaccaaaatatgtagatatcagttacaaatgcnaaactgaccagagaatagccaatttgtccagcccgcaccagtgaccaatacgcgaatgggttgtgaggtcatttggtagaaagtaagtgtaccttttcctaaaaatccttaatttatttaacaatataaaactaataatcgtgcaaataatatgtattattaattcttatggttgttttgttcatttcttagggttgggaggaaagggaaatgaaagaaggaaaaagtcagcagaacacaacagcaaaaggacgataagaaagtgtaatgatcaattagataattaggaaagggcagcaaaaaggctaaggagttggcaatgaggggcgggggagggaaaggtcaaatcaacgtcaaaacagggcaatcaatcaatcaaaacccggacccgaactcgaaaaaattgaaaaatacaaattttctaaaattctcatttttgttccttaattgatcatgtcaagctaaatttagtaaaaagaagattagcatggcccctgcgcaaggatgacacgcaaattcgtgaagcgttccaaattttttttttttttttttttttttttttttttttttttttttcaactagggatagcccaattaaaattttttgttcgaatgtcgcagccctctgattctctattccccaaaacttcttcactcttaaccaacccaaataagcgccttgccaacatcaccccgccacaaacaaaaaaacaacatctctctgataaactggcggcggcacaaacaatcatcgggggacttcaacctggacagtcggacggggcacctcaatgggccaactccctccttggcttctgtgctgaaatgggggaaatctgccgcgagcttctctccatggtcaaagagcagcagaatgacaacatggacacgcgagagactttggaggaagaacgccgactccactctgtcgtggtcgtgaacctgccggaaagtgaagaaactgtgccctctgctcgtgtaaactccgattttgtgaatgctcaatcaatgctcgacacttgtgacatcgaatgccggccatgtcaggtttaccgaatgggaaagaagtccgaccgcccccgtctcatgaaaatcgaattccccaccaaaaaacacgcccaaaattttctgcggaacaagacaaaactcaaaaatcacaataaatttaacaatgtcttggtccgtccgtctctatccaaacagcaactcgctgaacgttccagacttattggcatttgcaaaaatgaccatatgagtaatcccaattcgaattctgtcatttatgccggccatgttatgtttgcctcttacattccccgttacaaatccaaccccgactcttttaaatgtatttgtcatgtgcataatgttgatgactcttaatgtgtaattggtgaccactgtaacacgaaatctcttaaaaagcaagctcttttacaaactaataaaaaatatgaaccccccataaaaaatccaattaccttaaacaaaaaacaagtcttttatactcaacattgatcaatacgcgatccctaaataataagctagaagaattttctgctatcatagctctaaaagattttgaattggtttttgtaactgaaacttgggcaaaagaaaaaatacctttccaaccatatatcactaacaattacaaaatatatgaagctagcagaagcggtaaaaatggtggtggagtaatgatcttgataaaaactaacctaaattctttttctgttttatcctgttctaaattcaactgtgaaatccaaattgtacagataaatggggcaaaaagactaagaatagctctactttatagaccaccaaacacttctgctagtctcactaaaaagattctgaacatcatctgtaattatttagaagaaaattttatcattatgggagattttaacctaaatgcaaaagatataacctggaccagtggaacaccttttgctaaatcggaaaagggaaacattttttgtgaattttttaataagtatggcttattccttatgatgaacggaccaactcgaggcagtgcttggcttgatctgattttctcctctagtcctgattttgttaataatgttttaattgaggatatttttagttctgatcatcttaccactaacttttcccagtaatagaactaaaacaaatacatttacagtacgcaattataattctacaaaacttaatctattaaatttaaacttatcttcaattttaccctacaaattactacaaaaatttactattgaagataagtttaatcatttttaccatctttttagagaatatgtagaattatacttgcctaaaatcactgtcggtcaaaaatccagaaagcctaactacccattgagccttaaactgtcaattaaggaaaaagccagactttataaactacaaaaaataaatcgtgataaatataagcatttgtacgatagcatttcattacatataaaaattcaaataaataacttttttcaaaaaatgaaaataattttttgaataaaggaaaaaatgctatctacaaatatattaataaatttacaaaaaattttgaacaaattcactctattaattacgagaaccaaactatttttgatgattacttaaaagcagaaatttttgcaaacattttccaagaatccttttcaaattcagatgttccacaaattagcagttgtccttcccaatggaccatttatcactgatgttgaatttaatgccaatgaaatctctaacattctaaaaagcctaccaaatcgagaatccacatcccccgatgaaatttcctttaaaatcttacgtaattgccaccttacgctttcacctgtaatttccgaacttttcagaatctcaatggacacgggcaaaattcctgaaatctggaaaaagtctattgttatacctctctctttaaaaaaggtgaccgaaatgacccacataattacagacctatttctcttacttgctgtctatgtagagttatggaaaaaattattgcaaaaaagcatttataacttccttcatcagaataatttaatatccgaacatcagttcggttttgttaaacaccgatctactaatactcaactaattacagtattagaagattggtacgacagcatatacggtaagaaaaatatcgactgtatttatgtggactttcggaaagcttttgattcccttcctataaacattttaataaataaacttcataacattggcattaagggaaaactgctaagttggtttatctgaatttttaagggataggtcttacagagttaaaattaacaataaatcttctaatttacatccgattcagtccggtgttccacagggttctgttcttggcccactgttatttttaatatacattaatgacctcccgcaggtaatcccttcgggagttagcatcaagctttttgctgatgatgtcaaaatttatgtctcttacaaaactcgtgatgaaagaagcaaattaaatattgcattagaaaatattggaaaatgggctaatgcatttggtttaaacatctcccaaaataaaacatttattttatttattggcaaaaataattcaaaacaatataaattatttaacaatattatgtattaatgaggttgaatctattagtgatttgggcattttgattgataataaatagggaagcaacttttagtgaaaaaacttttttttgctcaattgtttgaagaaaggagctcaaaaaacgcatttctgcgttaaaattttttcattcggacgtcacttttcgtcactagaaatcactatttcggcgtttcgtcatattttttcatttcgacatttttcggaaaattctttaacaaaaatgcaataaaaccaaaaaatacacccctaagaatcgacaaaaaaaatttcaaaaagcactcctaagaaatgaaaaaaattttctcaaaaaggtattttcgtggcaagaattttaatttaaaaaattatttttttatgtacctattttgtttttttcgcccttaaaaatcccagccctactcatttgcaatgcaatcagtgaataaaaattatttttgcttaatttttggctgaaaattatgtcactattcgtcactaatttcggactttttgtcactatttcttcactcattttggcatttttactcactaattttagttaactatttcgggatttttcgtcactaaaagttgctaccctaataataaattaagattttctaatcattatactaaaattactaaagctggcttatttaaggattcgcaatatggccaaaattttaaaatcccgtctaacggggagaatttttttttgtttgtggcggaactatttttgggggaaaaaaattttttgcggcgccaacttcttccggcgcccagtcaaaagaactcttggcggcgccgacacttgcggcgccagtcaaaaggacatttgcggcggcgcaaaatcaacgaccccaaaaatatttcaacaatttattanagttaacagaattgttattttaatagtttatatttt

SEQ ID NO: 13983 - DNA, 2927 bp, Heterodera glycines
atcacatctcttcgaatttctgtgtgattccattcagcttataatagagctagagatatactacgccaaccacaatttccctcacctattattgtttctacttctcctggtccatattcagaagaaacgaaattaaactgagctggatattctatagtggctgcgccttaatttttagttatttttttagattttctcaatttttctaattatttgaaatttaattttttttactgtaagtgtaaaaccatgtttgacatagttcttcacgttcgtcctccgtaagtggattaaacacaaagtttaaggtagcccgcgccatggtttcaacatgtttaacttgtgataattttttatttttaaattattttttacttataatattttttattcattttgtttgaattttttagaaaattaaaccttcttggctttcattactgctttggctttttggagatatttcttcttcagaactttttaattttttctttattatttcagcaagaatttgtcccttagtttttattttttctgcagattcttctgtgcgtaattttctttttctctaaaataaaaaatatatggctacttcaagaaaaagttgacctctctgattttttgatcttttcttgttgagatccctttatcatctaatgtaacagcagataagataatctatttaagtaagtttgggtgtgcacaatacaaccataaactttattaactccaaaagtttttattaacgcattaatttctgctgtttcataatccgtatgaattctatcaattcccgaaaaaacttgtgttccccaaaggtcatttaattgaaataaaactttttcgtatgacttgggtactaaaaaatatttaaattaaaattttaaatatgtttttgctaccgtcttttcatcaaagccattaataatggtgcccattcggcgccactagttgtttctatcttaagaatacctaagtagaaatataaatataatctgaccaatccatggattgtccaaatttgctgaaaattcagaggtgctaattcaaaggtgccatcagaaaccaagactttacaattagcgacagctcttttctgtgtatgtgtcataaagagcataacacccatatctttatctcgaaaccgtagccatctttaaaatatgaattttttttagattttttttaatcaaaaattatcagataaaactaactcttacatatcttcagaagtcagcttttattgaagaattaatttaattgtccgcgtttagttagctgaaatttttctcgcacattaaatggatcagaacaatcccctatttggttcatttttcgtcggttgtaggcacgtcttacgctttgccaatttggataattaaatgaaattccactgggatcatcaatttcgatatcctcagctgtatcatgctctctagccctgtcagacccctaaatttatcgtaccaattggattagtttttatgaaatattcaaatcacttctcgccaaatagatttagaatctgctgaacattgaattaattctcttctttgattcctatcaatttgttcagcagtaagttgctctagtggcacacctttgcactgaagatggtgcatgatttgatgagttctatctaattggccctctctaataatagcacttccaataactctataatctaattatatagaagaatcactaaataactgaaaccaacccagcagaattctgcttattatagttctcacagttcatgcaatagagataaatcgtatccgttctttcatttgtttttttgaattttcgatattgattatcatgaccaattataaataggaatttattgtcgaattttgaaaaacattgtgacacttcagcgttttccatgttctctttgtttccttctgttgattttcgattttttatttttgaaatatatctttccagcgtcctgaagcttaggtcaactttaatttcggctagtttttccaacaattctcctttggattttatttcttttttaaggtattggtcaaccaagccttttgcgccattgtttgaaacaaattcatcaaagctaatacaattaataatatttatgaatgaaaagaatataaatggtaataacattggattaatttattaaaggaattaaggcaataatattttttataataaatgtatgttaaagaaatttagctatttataccatttaaattgtaataaaactgccagcctcatatttcctgctgacacctattggtacaaccaaataaaaattaagtaaataattgtaaattaatttaataaagatttttagtctgtcactgctagactaataatatttccggctgacacttacttgcacaacaaataaaaattaatagatattattgtatatttaatttaacggatatacatacataatcatatgagttggcggttttaagaaacgccctagcaccattatagataatattttacctctttcacatttctttttttctaaagattcattttgatatcaaaatgtttccaaaactaacatatagtattttagaattatctttgttaatttttaattttttaaataaagattaaaattttaattgcttccaccttctttgaaatatttaaaaacttcagtataaaaattttagttattttttatataaattaaaaaaaataatcagtgcttttcttttcctctaattacaatttccttgattaatttatgactaatagcaaaaattaattgcattccaatttgtgattttaataaaatataatttaagaaaattaaattaaaaaaaattaagttttatttatataatggaaatgtttttttttcttgcatttatgtcaactcgccaaaatagtaaaagaggatcgaaggtctatttcaagagctgtaaactaat

SEQ ID NO: 13984 - DNA, 1153 bp, Heterodera glycines
aaatctcgccgcaaaaatttcaaaaaaaaaaatttcaaacagaaatttttcaagaaaaaatcttagaaatttttttataagaaaattaagaaaaaaatttgagatttttcagtaattttttttgaaactttatgattaatttcaaaaaattttcaagaaaaacttaacaaataattttttttttcttaaaatattataaaaaaaattttctaataattttttccttgaaaaatttctaagtttgaaatttttgcgacgaaattttgtcccggcgagatttcggcggcgagattccggcggcgagatttcggcggcgagtttttggggtgcaccctgtttttaggtccaaaacgccaatcccatccctagttatgactttgagaaactcaaaaaaccaaattttttgaacttttttcgtcataactttcttgaaacgaaacctaactaaactttttgaaaatttgtaggctaatagaaaacaagaaacttcaataaaaaatttaaatttatattttagcatttttatgtagaaattttttgtgcttttctattgaaaatccaacgatctcaaaaaggagcatgtaaagattagttggagagacggatggcggagtggccagttgagtcccggctgggtctggtactccaattacggcgctttttcagcctgaaaagggcaagcgcgcccctaagtctatttttcctacccatttctaacctttttacatcgattccgaccacttttgagcaattttgagtttgggccttgtgaccggcactttcctttattaataaatcttatttaaattccaaatatttatcccagctgcgcctggcctgttgcacctaaatgacaacgaaaaaacagaaagttgcatgcaagatttatggaaaatgtcgacagtatacgattctcaaaaagaaatgatgtaagaattaatttggtagtaaaaaagtcaatagtcagtcagtcaaatcatccataatttgatagcaaagtttggctcattttcgggcgttggatcgtcgtcttccgccacttttgtttccaccattcatcttaaaagatataatttaaaaaaacatacattaagatatatatttttgattgcatattaaatacctaaatatttatgcaataatatattttctt

SEQ ID NO: 13985 - DNA, 1310 bp, Heterodera glycines
attttttaattaaatttactaaaaattataatttattaatttttactttattaactttgaaaattaattatttgtggaaggaatattttaggaaataaatatttatgaataaatatattttttaaatttttttacaattaattttaataattattttaataaatttaaaaattatatttaaagttaattaattgttatgttaaaattcaggcccaaacaattgatgagctattcggagggtccttctgccggcgcagaggacggaggactaacgaggcccttgtaaaaattgaaaatctccaaaaattttcaatttttttttagttttattgtcagcgcctggggcgaatgttccgccagctgtgggcccggcatccgctcgcgtctcgtcgaatgtatggcaggcgccggcggcactttgcggctgcccgactatgaatgccaaggctcgtggcaaattttaaaatgccaaaaatggcacaatgtgccaagccggaaattttaaaaatgccacaaaactgcctaaaaatagcgccatgccaagagcaatgttttgaaggctccaaaattggatttatggacacaatgccaagcgtggcgattttaaatatgcctaaagagggcacaacgtaatgataaccaattaactcatcattaaagcgcttggaatctcatgttctttaatataagagaagaaatttagaatttcttataatattttcaagacccgagcgcccagacgcgagccaaaatccagcaaatttcagatcaatcgaagccggcacagttccaaccgtgccatttggccccatgtccgatcaaagcgacgcccgcccaatcggccatccgatcgctgtccaaaccgttcgggggcgagccgaatcggtgtttaaaatttaaaaaccaattttaaatggattttaaatttatttaaaataaagcaatggcacgtcgaccgtttttcggtgggagcacggcgattggaccaaatgttccgcttcatgttcggggggtagagaaaattaattttttaagtttgaaagttataaaaattgaggcaagcaaagatcgccggtgatttgtgtggatacgatacgcagggttacggtagcgtggacaaattgtgaggacagcactgctgctggacaaaagccgcaggagctgttgcggacgtgcaatcgccatgcgtgcacgccggactgggaggtacggagagggagcgggagagagagataagggagggaagagagaaggggaggggaagagagagaaggaagagagataaggggagaggaagagagagaagggaa

SEQ ID NO: 13986 - DNA, 3337 bp, Heterodera glycines
tatcaaaggacgagccgctttcggaagcggacgacgaacctgtcggccgcggaaacgtcgtcaagcgagcgcaaacatcgcaatttgacgctcaaagttggcggattcgccaatttatacgaggggtgggtcactttttgagcacactgtgagactcgagagtgccggactcacccttggcgcacagttggcccagtctgagtttgacctcaagagtcccgagccttttttgggccctgctaagcggagggtttgtccaacggcatgttcggcattgaatttgcggcagggtgttgagactcgagagtcttgagccggccaaggccgataatttgcccttggatagcttaggactgagttggcgatgcgttttaaaaccgagagtctcggtcttattctgaataagatctcaagagtctctaacctcgtttggccccactaaattggaagctaggggttttggcactgaatttggggcagggcactgagactcgagagtcttgagctgagcaaactcttgtcacaaatctactgatgattattgatctcaatttggcccataatttgctaatggatagcttgggactgagttgggcgttgcgattaaaatcgagagtcacggtctcacatttgaccaaaaaataggcgcccagactaaacctagattttttgggtaattcaacagtatgcctagcacccaccaaataccgtatcccgtttttcagaacttcggtcaaagtcaaatgcccgctcaaaggtggcggtgaccggcgacgcattgtgtggacaaaggacgacagaagggtggagaacagtcgtaagcaaatttaccgtaattagttccatgggggagtactgtaaaacgaagattacggtattaaacgattttgtagcgcgactcaaagtgagtgccaacggcgcactgcgcattttccacgcaacgctttccgacgcgggcgtttacgcgtgccgaacggcggacggacgcgcgcagggaaatgtgacgcttcgctttaagccacaccagcagcaaaaaacggaaaaagtgaggggaaaagcatgattaaaaaactgaaatttaaatgctaaaacctcgagattcagtctggaaaaatcgaatcccggcaaatggcacaaaattgagtgaatttgaaaatgcaaaattattgtggaatgccaaaaatggaagttaaatccgtaattacgaaaatgatttttttggggaaaaaattatgaaaaaataaattaaatttcagattccatcaactgaaaatcgaacaaaacaacaacgaaagggcattgaattgctgcaggcaaattaatatgcagatgaataaataaatgtgcaaaataaaatattttaatcttttcaaataattgaaaagcggaacatttgaatgattaaattatataaaatatttttataaaaagataattaattatttaagattaaaaatttatttaaaacatcattttacttttaatttgataattaatattcataacgaaatcttagattttttcaataaaactttaaataatttgacaaattataatcccgacattttaaaaggaattttattttttttaataaataatattttttaaattaataaataaatccaacaaattatttttaagcgaaataattgaacttattttaattattttaaatatggttataaaaattgataacgtggaatatgaaaattttattttagaatttgagttttaccatttttaacttcaataaatttaaatcaaatttaaatattgaaatttatcaataaaactttaaaatatatgctcaacaaattataacccctatatttaaaaggatttaaattttttaaataaataaaatttttaattaaataaataattttaaaattataaaaacattaataaattaactgtttaatatgaaaactatcttaattttcattttcatttttctaaattaaagaaattttaatattttcaacaactgacaatgcgtcataaatttctcaaaaaaccttaaatagatgcacaacaaatttaatttatttgcaataaataaatgtttttttcattaaataataaatatttaaaaaaattttcatttattttaaataaataaattaaataataaataatttaaacattttttgccgattttcagcgtgtccgggacagtctcatgcggctgggccctgccggccgagcactgcttcagcgcatgtcctcaatcactgatcctggccaaatccggctcgactatggcacctcgggctgggccgactgtcgccaagcgcaatgcggccatggcgaaggcgttcaagtacggcacggcggatcgagaatttttggcttttttgtcgagagtgaaatagttacatccgatagctgtgggatttgtttcccgcccgggatttcggagcgctgtaatttgacgattcgaaaccgaaaagccgggaatgttcgagagagaaattctgaaaattgaacccaaggggggtgccatggaatttcgtacaatggaatttcatataaattaaaaaatattgcataaagacctgctcgaaaaattggaaaacccgaataaaaaatttccaatttttcatgttttgtattttttgaatacatttgttttggaaaagtttcaagttcacaaaaaattttgaaaatttttaagagaaaattacgatttttttttctgttttttaaaattttatacgaaattacattttacgccacgacattaaatattcccgaattttgttggccgggatcagtaaaaaccggcattcgataatcagtcctatataaaatggcatgctttcatttatttacatatattctcaaaaatatctggaaaaatgaaaaagcaaaattttgatttatcgtattaaaaaaaataaataaaatttaatgccattttataaaaaacggtgccaatctttaactgaatttggcttcctctaggtgcgtttgttgaaatgccaactcaatgtcgacggcaccgcaactgacgccttggcggtggacgaaaacatttgcgaggcgttcggcgtgccgagacccgccgcggcacggccatgcgcggacgagcggtgcccgcgatgggtgaccggcccatggagcgatgtgggtttaaatcaaataaattaaatttgtatacaataattaattaaaatgacaattcattatgtttaattattataaattattattgaaacaatcaattaagaattattaaatgagcaaattaatttattatcattaaatcatcaaaaatttatgaattaagttgcttaattcttaggacaattagaactcaataattaccctaatt

SEQ ID NO: 13987 - DNA, 3489 bp, Heterodera glycines
  misc_feature (2143)..(2143): n is a, c, g, or t
  misc_feature (2178)..(2178): n is a, c, g, or t
  misc_feature (3472)..(3472): n is a, c, g, or t
atgagaaaaattcaatcatttctcaagtgaccgcatccctccacaaggccaaacattttcactccgatttcgatcatttcttcatatccctcattttggtcacaattacgaaaatgtaattatagtttaataactcattttcttttcaatatttttcattttaggaaggatcgcaaagtgtgcaattggctgatcgccttcgattcgctgtgccaacttttcgttgtcgcacctttcggcgtcaatttggtcggcgtcattttccagtacagtaccattgactaccgtatctgtctggccactctcatgggcgctaccatagcctcgtatgcctcaataatggcaatgtttctgatttccgtggagcgattgctgatcattctgtacccgatcaggtgactctttatataggtatgtatagttggaatatataaattttatgtattattgtagaatgaattcgatcaaaaaaacgacagtttgccaatgttcgtttgcttctgccattctatgtactctttttggcttggtcatgaatttggaagtgttcaatgtttggacaattatcaacatctcttacgataggcgattaacatttgaaataaattaaaattagttttgaaatttttcaattttattacgatattcagatgggtttactgtaacagtgggctttattcggatgttctgaactccgtccccgcttttgtcgtcctttcactgtgctctttaaattacgcggcaatttttggcctaattttgtggcgcaattttcaaacaaaaagaaagaatcaaacgaattcacaaagtttggcaatttttttaatttcaattttactctcattttgaacatttagctgctgatcagtcagtgcgcaggatgttgcgctctgtgtttctgctgcttttggtccttctgatcggctggctgatcgcatcggctgcacgcaaccaaatcaccgattttatcagttttatcacaccgcttattgtaaatttgttcatcgctgaacctgtggctcattcggttatgtgtaccaacatcaaaagtgtactgatcggcattgtcacttgcgtgccaattttggcatccgccagtggggcgcccatccttttgctgaacaggtgtaaaaaggacaaaaattcaattaaaaaaatattattaataattttatttatatttaatttagcagcgattatcggactgcgtacaaaaaggcgattatgcgaagaaaaggcaattcttctactgttggaccgctttttcgtccacgccaaattgtggtggtttcgaatgagcgaaaatgatctttttgggcacacaatttttggacaaaatttaacccaagcttaattttactgaatttattgattttcagaaaaatgattcgcttcaaaattttgtgatttgttcgctaagatttttgttgtactattttttaaacatttatcatttctttcaatgtcaagaatgtttaatttggttgactctgacaaaagtcatgggagtttttgttcaaaattttcatttgatgatttttcatataaccctcttattcgagcgtggtggtcgcattctgctgactttaacattacctttacatcatgaggaccggtaaattggacaccaaaggaaaattggacaccggaaaactggacaccatcctaaaataaacccaggaattgagttgaaaaataaatttgggtagggtaaatggattaataattaaggcacttagaagtagatcaggcattcaacatgcaagatgattgatcaatgtgccaaaaaaaatgcaagaaaaagggcaatgattggtcaatgtgctaaaattgcataaacgatgggaatcctatccaaaagaaaacttttttctttatggatgatggttgttttttttgctgaagttttatgtaataaaaacattatttatttccgttttattacgcttataaaaacataagtatgtgcagactaaaaaaatcttttggccaaaccaaaattttgttttatttattttttatttatttatttttatacgatagtgtccacttttcggtgtccaaatttaccggggagcctaaaaagaccagaagcgctcgcttttcttgtcaatacttaatgagtgaaatggtagtgaaaaantatattcgatcccacgtaaactgaaattgcgtttncataatttctgagcaatggcaacccatccaggaaaaaaaagttgtagccctaaatttttaaaaaaatcggatccgggtattgccgggtcccgaaaagccgggtccgggtccaatttttaaaccgggtccgggtatcggctttttactatttgtcataatcatgaccttcaaaattttgtcgtttgtcatctctgcaacaaaaccttcctaatcttctttcaattgatttctttaaataaatagtaattttgcactttttgtaaatcttaaatgctgcattgactatgttgcaaaaacacaaaatgcgaaatagagattttataataattataaaaaacgaacaaaataatccatgaaatgctatttgtgctggaaattaatagaaataaattaataaaaattcggacgttaattgacgaattgaatgtgaactcaaatacaattggactcatcactttaatatattaagaaaatttagaaaattaaatttattttggaattaattcaatgtcttttttggtattttttcccaactccaataaatcccaaaatttattcatctgcagcagctattatgtccttaagatttgctcttattgggtcactgactgtccacaaaaactttccgagaaggaataaataagtattttattgctgattaatataaaaattaaaaataattccattgctttatcgctcgccgctcttctatccgttctccgattcttcgactgactcccgaggaaaaagggaagaatgaagcttaaaaagggggcggataagaagaaaaaagtgataattgattctgctttctacacacaccaacacaattttggcctcaaatgccaaattaagtattatacatggtccaatattctgtttttcattttccccagtcccaatttgttaatttgttttgtcggctttgattcagagctcttagtttgaagatgcctatagatagtatttatccttcaagtggatatttgattatgaattttgaaaatttgtatttttttattaaaaaaccacaaaacatgttttttttatacaatccagaaaattttttgaactaaataaaaaaaacctatcgagtctcccttctaacaattttacagcaaacaaacgtaaaattttttaatttaaaataattataaaatgttaaacggtaatccgaaactgctcggcctgcacactctgccggtttagcagcaacaaatttaaaggaataaattaaaatttaattaatcaaaagaaaatgtttttctttatattcgattttgatttttttggngtttttgtttgactttc

SEQ ID NO: 13988 - DNA, 2785 bp, Heterodera glycines
  misc_feature (94)..(94): n is a, c, g, or t
  misc_feature (104)..(104): n is a, c, g, or t
agttgtatacctcaaaacattaaaatgagtcatatgaatataattaaaccccccagggctttctattttaggaacatgaaaacatgtatttttntaggcaaatntaatataaaaaataaaaaataatttaagttttattaaaaaatttgaaaaaattcttcttttccacccaacccaccccagctgcacatataatctgagtttgatgttcgggttgatacatttaattgtttgacgccgttctttgcaaatccgttcgcatttttgtttctttgtcgctggaatttttaaagcaccatcgtcgaacccaataggaaagcattctttaaaattaaaaaaatttaaattttaaataaacataaaaatttatataattcattaatttttgatttatcgggatgtaaataaaatattcccgaattgaaattcagggcaggaattgtggaagatggggtttgggtagggacgttcaaagaaaatttcgggtcgtgaaaaaatccaggtttttttaaacgtgggtttcggtcaacaatcctggctaataacagttcaatttgatattgattttaattgtgactaattccatttttatttaaaaataaaataaaattgctaaattcatttgaaattgaattgagtttacttacggataagcaatctcgaaaaaggcattgaaaatgtgctggcataaaaactcgaatcaaaaacattcggtacacaatgatgtcgaacagtaaagcaatgaccaaaaaatgaaaaacagcatagtgacagccaagccacagagacggcatgctttctccatgaaaggaatgtacggctcctgaaaatgcaacaaaatttaaattttaatttaggaatttggcaatttatgcaaattttatttaaaagtaatttttgaattattagaaatatttaatttaaaaaaaaatatatagacaaagactcaaaaaattcaggaatcaggagaatggggaagaaaatagctggacatattaaaattaaataagagaaaaaatttcaagaccgaagagcaaaaaaaaaaatcttcatcttccctccggaatttttttaggtctggggcctgcgcacgataccaattttcatagcagaaactcgagcattggcattgagaagaggtggtcatctgcgtggttgatttggcagcactgacagccgacggcacagaaaatcgaatagggacacagaaagtcaaatggctggaaagggaaatggcgacaattagcaaatcaattcctaattaccctctgataattagcaaatactgcctgcccaccgttgtatcaataatccttttccgttggccatccaatggcaccacatatttggcactttctatgtccgttgcgccgccctttgcggcattgatttgttcctgcgaaaaatccgtgccaacggcggaggccttggcgttcagcagccaattcatctcgtaagaacatttcgttgccgttcgcctcaatgccaagaattgggcaccattccaactaatttttatttggatttcatttggttccattctcttttcccaggtttacctattccattgcatttttgctgacattaacccattgaagtgaggccaatccgagcagagcttgcaattcgtagagtccatcgaaaattccaaagggcaaaaaatggaggaaattttgggaaaagtccaactgaaaatggctaaattacataattggtttgtctattcaagttcaatttcctaattttgcctgttttaatgcgctgaaattggccattaatttcggttccatccgttcgattgaaatcgccgccaaactcaaaattttgagggaatgcaattaatgggccaccaatttggtcggcactctgcgcaaggcattggatgaaagatccaatttttcgagggaagcactgcgcagaggcagctgcagaaacaaaaaattaaatttaagttttaaaacaaatttgcctcggcgtctgccgtctctccgccctttgcgttgtctttcgcccctccgccgatggcattggcatccatggaaagttgtcagagccgttccaatgcatgaagaccggctaagaaatgggcactcagacggagcagagaaacaactgctgaaaaatttttcaatgttcccttgaaattttctcggattttttgaaaataaaaaattggaaaaaatttttttagtgttgaaacaaatttaatattttttaatagaaaaacttaagttagacaattgaaaaaattctcattttatttatttctcactttttgtgcgtgccgttgggggatgatcgtgaattatcgcgttgtttgttgtcatcgcaattgttgttgtagttgctgttcgtcatttccttctcctcgtagaccaacacgtaatcgatgatccgtctggcatccgaaaaatactccgttttttgtcaagggtcacgttcgggaagggtgggccgatgcaaagctattggaacaaaaaaaaaataataaaattaaattttgaaaaaaaactaattttatacaccggtgctacttggcaaaacaggacattaattattctcaaaattctgtccaagatttaaataattgatttttttttggacccatttttcatgataagtcaaaaacaagtttttgaatgaaattttcgtatttatttgctcatttaccgagaagtgcacgcttttctcaaccggacgcgaccataaccaacttgcgcgggtgggcagcagaaacaatacgacaaaaggcaacggcgtgggtcttgaataagaaaaaaaaatt

SEQ ID NO: 13989 - DNA, 3925 bp, Heterodera glycines
cggggacctctagagtttgcatttgcgagaaagcaatggaagtatataaatccttaaaacaaagaattttcaatatttaactaatatttttacctttatttctcagtgatgaaatgatcggacacctttctttttcgtaatatagcgacttattggcaattataaaaaaaactacaaatggtactaattaacggcaaaataggctttcttcgcgtcaacagtaagatttttgcgcttttacctgttcaacacaaaaaaacgataaacgaactgaacacacaatccaaacaatgaaaagaattgcaaaattagcaagcagacgagcattagttgtccaaactttgccgaaagtgacaaatattcggagaattgtgaaactgaaagaatcatggtccaaccgttggttgatagagtaaacctataatccaatataggaagaattacttaattagtatcaaaattaaatttgtgcgtttaatactcacagcttgtaatagaaaggaaaaaacagacaaaacaatgtccacaagcgcagtttggagcaaaattcgcttgtacactttcatttcctttggcgaccgcttcaaaaccaacaaaattaaaattgcatttaaacacaatgccataaacaggctgattgaatgaatttggattagcattttaaaggttgtgaatttttggatgcgtaaagtcacaatttgtgttctaaaatgagttttttgagttcattaatccatagagcccggttcgggacgggattccgtgcgggattttgcagggtcccagtccgcggtcctgcattttttggaaaatgtcggattttcaggatgagtccctgcggaatcccgtccagcaaaattctgagttccaataccgcagcggaatccgcaaatttgaaatttccaatcttgacacattttcgccaactagactaaaaccaatttttaattgtggaaacaataataaaaattcaatataaaagtgcataaatgaatggaaatctttatattataaaaaataacaaaaaacgtaaaataaaaaatttcaaaagaaatttcattatataaaaaacgtttaataaaaattttaaaatcaatttcagtagtgacccctgtacttttgttacaatttttggcgctaaattcaaatttgaattttcgcgtcaatactcggtgggtggagggacgcttgctgggggtatgggggggggggtgtgccgtagggtttaagtgttgattttgcacattaaaattggttatttaaatttatattatttaaatgtgttatttttattgtacataattgtttttaatttagatattccaataatgtctttttcccatgccgcactgcttttcatcgtgttcgccatttttgatggacaatccggggaaacctttgcgtttcaagcggagattgcgcagttgatgtacaatatggacaacgccacgaccaaggtttgtttgacagaattggtgactaattttttacataatttttgtgaaactttttttaaaggcgcatgacatcgaaaacgacccgagcaaagccgataaaacatggaccatcattgacactggcattggcatgaccaaagccgacctcgtcaacaaccttggaaccatcgccaaatccggaacgaaggcgttcatggaggctcttcaggttttgtttttcgtttggtcaacccccccccccccaatctaaaaaacacttgttacttaagaccggcattgtcgctttaatgcccgggcattttggcgccggtttctactcggctttctctgtggccgaccgcgtcacatcaaagcacaatgacgacgattgctaccaatgggagagctcagctggtggctcgttcatcattcgcaattgtgccgatcctgaagtcacccgcgggacaaagatcgtcctccacctgaaggaagaccaaacggcatatttgcaggtttgttgtactttggttcaaaaagtgcgtttttgacgctcaaaaattttacatttttctttcgcagtaaatgcgcaattgtcaacaaattatatttttaattaaaaatcatcaaatttttattgagttcaggtgttggtgctggtgttgtgcgtgttcatctgtgaatgcggtgtggggagaaagggcggccaagcagatggtgaaaggagcagccgcggacgaccaaacaatgacggcggggggacaagcggcggagcgggacagaaacggggaggaggacgtgtcggcggtcgcggtggtggaaaaggcaatggccgcggtggtggacgaggcggcggcgggcggggagggcggtcgccgcagcccccacaggaggctgatgaggaagaggtgggggcaaggatgagaaatcaaatctcatcaatttgaattgaagaaatggtttttttacaatgtgccgtattttcccataaaaaatcgttttatgaatatggttaatttggtaatcggtgagggacggggggggggggggggttatcgagggtgctgatcccgaatctcgggttatcgagggtgctgatcacgaatctcgggttatcgagggttctgatcacgaatctcgggttatcgagggttctgatcccgaatctggggttatcgagggtgctgatcccgaatcttgggttatcgagggtgctgatcacgaatctcgggttatcgagggttctgatcccgaatctggggttatcgaggtgctgatcacgaatctgacatctcatttgcaatattttaattgtatctattattttcgcagtacctaacatgctaattctgtaggtatgataacaatgatatgttaaagttaacatggtaaatgaatgaggaacaaaaagagaaacgactttcccatgtgcccttttatatgagacgggagcgtggccatctgtgtagcgaaggtccgacgcttcggtgaccgatgcgaacggggtcagattaaataacaaagggatgtgcggcatttctgcatcggcacaaaagagaaactaatgcatcatgctgctaaccggcgatgcgctttcacatttacgggtatattcaaacaccaaaggggattaaagaaatttaaagcacacgaattaatattttattagaacaatatgaaatggtgattaaatgcaatatttagcaaaatgattagtctgttataaaataagtaatcaattcatccatccggcattgttgttatgtaccatttgtccactttcattaccattgttgtatgggttgttttggttagtcccagcgctggaggagcacaagtcaaagtgcgtgcgattgtttccgaaattgccaaaagttgagctattattagtaaagctgcttctaaagccattgttgttgtaatcgttgtttttatttgcacaattcatgtcgctcaacctcatattaagcgaaacacacccactgcacatatcaaattgcacttttacccctcataaggagtcgaactcaaaagcataattaccgccgctgttgttgttattgttttttgttgaattgaacaattattgtgagtagcaatgacaaagattgaaagttagaatatacttttttcgtaaaagtttccataactgagcattagcattgacgctgttattgttgctggtggtgttgttgttgtttttgttctgttctgctggcgcgttttgttgattattaaaagtattcatttttatattgcaaaaaaaaatttcttgtgattaaaatgaaattttgcgtcatatttgcgtgcttttatatagcggaaatgtacagtgcgcgcttagagaaggattaagttacggtgctcttacgaacatactaaagcgcttaaaatgagcacaaaatctcacttgcgcgcaatgcatttgcttatcgcattctctcgcattttgggctgtccccctggtgaagtgggtgcgcgaatttgctgta

SEQ ID NO: 13990 - DNA, 2127 bp, Heterodera glycines
  misc_feature (186)..(186): n is a, c, g, or t
  misc_feature (284)..(284): n is a, c, g, or t
catcagtggcgcctccgcaactttggacagactaatttcatcgatgggttcagaatttgaggtggtcgaacggcgcattcacccgggcgattgttcgtcttgaagagattgagcagcgatcccgaagcttacgaatgagcgaaagcgaaaagcaacgcaaggaaatggcatggcgcgggtacactntcatcagtgaggaacagagtcgaattgtgctgggcgaaggggtgacggacgacgcattggcggaggaggaggaggaggctgacatggaacgcgtgtgngagcaggacattcgcacaatgcgcaaaatgggagacggcggaagcaaaaacaacgccgaatgagggggggacggaaatggcaacgccgagtcgggtgagagttgctaacgaagcgaaggataagaagcggaaggcatccgttgacccgtgcagaaagagaaaggcggcccaaacggtttttgcgcaccgaaccctttggccaactccgtctgctgaacccgtaccttttcgccaaccaaatccacgacggtgcggtgctgcgacgagtcgcactttcgccgcgtgcgttcagttcctccattctgtcgcccgagtttgggcaggtaatgccaattttgttatttttatttaattttgttgctcatttgtcagctcgaggtgctcagtcctcgcgcttttttggccattattttgtcgccccgtgctgccattgccaacattttgtccccttccgcgttctctctgcgcctcctttccccgcaggcgtttatggccgaagtgctcaacccgaaggcgttcattgcgcgggaatagcactttttcactgtttgccctgcgtttctctgctactgatgctaattgcatcctttttccctttgcttttccgatcctttccccccgggcgatgtccgccttcgttttgtctccccgggcattgatcaccacaattttgagtcccaaaatgttagagcttcgcattctttctccgaccactctcgccttcactgtgctaagtccaagtgagccaatcttaccagtgttttgaccaattgttttatttgactgatggccaatattattttgtcattatttgcagcgattggaggtgctaaagttgcgtctccccaaagtttttcgatgtccgtcctcagtccgagcattttgtccccgtctttcctcaacaaaggcaccggcaatatcaaagtcagcttattgagcaatagcagcatttattcacatttgagctgactaattagtccccgttcagattctctccccgagcattctgtcgggcggtgggggcggaggagaaaaatgaacggaaaaccattttaagagaaatgatcagtcaaaacattgttttctttttttatgtgtcataataattggttatatttacaatgaattaaattcgtttcaaactgaaattgaataatgaatgttcaatcatttatactgtatgacgtaccgttctcatttctcggcttctgaggggaataataataatatttacttaattttcacttttcttttatttgtaccctttgatgttttgccgactatccctgcggcggtttgcccttttgttggaacggactttcgaagatgttcacagccactggtcccccaaagggattcattaatgccgatcccttccgttcgccgttctctgacagttttgctgcatgtgccggatggaaggtattggcattagcaaattgtgccggattggctgagtaatgcggcggtggctcattgcccgaacttcgtccgccgatcgtttcctttttctttttcaccaccgtcactttgtgcgccgttcgatcggtgagaaaaacgatcagctgaaagagcatcaaacaaaatttgagtaaatgttgtttctagtcgcttcacctgtatcagactaagcatggacagtcccaaccacatgccaatggaaccgccgatggcggcgatgaaagtccaaagggaccacacgtaacactgctccaactcgaggtactcgaaggcgccccagatcaacttgacagaagtgaccgctggggagggcaaaaacaatgattaatccatcaatcaatgatcagcaatcctaactctttgccgtcccctcccttctggt

SEQ ID NO: 13991 - DNA, 1547 bp, Heterodera glycines
tgaactgatcagctgatgggtgctcatccttcagcctcttcacctgatcttcgatgggttgaaagctctcttcgtccaggaaaatgggccgaaagcacaaatgcgtattggacagccaattgaccgaagttttcatatggaaagtgtccgactcatttagggattggcgcgagaacagtttgattgaccttaattaggcaattaattacaaatgaacaccagaataaattgactgttcagtctcgttttcagtcaccttcgcaacacttcgagtccgactttgtttgtgaagtcggctaatgacacgtttcttttgtcgatcgcttccacccatttctaaaacgcaaatcctattcatctaatgtctttcaatcgtgttaattaatcacctttacgagtgtccgcagtcgctgctttttgccgctttttgcgaatctgttcaagtcccgcaccgcctgttgtgccacactttcgcgctccaatccgttcagagtggcaatcgcctgacgaaattcgaaaaagagcaatttaacttcattattttcaaatcactgtatcccagcaaattgcatgttcattatggtatacaattcttttatattattgagaccagaattttttaacaaattttgaattcgtttgaatttgatgccggtcatctccaaattgtattggataattaggaattctgatgttcaaaatgtttttgtcacttttatataattaatgatcttttggcattttaacacacctggtacgcactcatcaccagctcaggtggccattgactgctcatgaactccgttcggttcttcagtgccgccaattccttctgcgctatcgtaccccgttgaattccgtttgtacagtacccaatccccaccgtatcacctcaatgttcggcccccactgttccaccttttccattgacattttgtctccgatattcaccccaaaatgactccatgcttgtcttctcggcatgcaaaaggtaatattgggaaaggtcactgagccattaaacttcacattctgtgagatggaaaaatacactctgttttttggtctgatcactgatcaaattaccatattcgcctgctttgggttgctcgcgtattccaaagtctgtagtagggttacggtagatttgggaatgagtgccattcgaaactgaccaagctgatcacgtcgtacagtgtcatcatggccagaaagaagatcaaaatgtaaaaggcccagcgttggaacgactttccgtacaaaaagctggtgaactgtctttttcggtcaaccattttcagaatataaacaataaaaataaattaataataaatgtaaaataaaaatataataatgatttttgggatttgaataaatctcataatttaactgattataaaagaggtgataaaagaagcgcgacaaaattaagggataattatgaaatatgaaattaattttaaaataaagtaatttttagggcaataaaatgggcgaatgagtttataagaaaatagagaaaagtgttgacggacggacgaactgat

SEQ ID NO: 13992 - DNA, 707 bp, Heterodera glycines
ctcctctcctctcctcccccccccttcctccctttttcgcttgctttggtttttcgcttttccatttgctccaattgccacttcatcgcctcccattcattggcttctctcaatgcttttctccttccgctctttgcccatttgcatttactcccttcgatgaattggaggaattaacaagcaaatggtccgagaaagcccactcccctccctctctccttctgttttgttgaaatgtggcagatttggggccaaaggaatcggcgggggggggggggcggcggaggggccaacacattcccttttttacccccttccgtcgccactttttccccgacatccttcggcgacaatttttcgtcgattaaatatttattaatggtccactccttctcaaacatcttaagagttgggctgtatctcttcaaaaagtcgccatttaaagaagaaaattacggcgtatttgtctatcagtgcatttagcttttcgccttggctttcactgtctggcaaatgagtttcttcccccacctcatttaattttattaaaaaaccaaaatttttttgcagtttttctttttaggctgttttattctttcgtatttgcctcacttctctaggctgattgggtcaaatcgcccatcaaattcccaaattccccccccctaacatttatcatatccctcccctcccttcccctcccttaa

SEQ ID NO: 13993 - DNA, 1319 bp, Heterodera glycines
attcctagggcttcggaagaaaaatggcgttttttacacctttcttacaatgttattgtaaatgttgttggcattcgaacgaaactttattaagcaaattagtttctcattttaaacactcatacaacctgagaaaatgtggcgttttttaaatcagttaaaaaggaaataaataaataaattaattgggcaatgccgtctttttcactcacaaatcagtcagtccttctctgttcgtcacaattgacttgagtccaacctttagctgctccattttcccctctatttcttccgcttccatcgctttgtacggtttttctgcgcttccatcggctgacacttttgcgtaattatacctcaaatagtcacgctttattctgtagtcgaaaaggttcaaagcatagttcaaatcgtttgcattttcgttcctcaaatttatgccaattaaccacacgttgcaataagttgcgctggaaaataatttgcaaaaaaaagtgaactataataagaaaactcaatgcttttcctaatgttttgttttggatgttaaggcattttttcatttgaaatatatttcttattttggacattcccaaaattaatggtcgtcattggccatgggatttccagggtcatattttttcaaaatttgcttaatctctagcataagaaaagtcgatggatgtttgagattttagtgttataactagggctataaattatatgcactaaaaattctccaaatatgctttaaaaaccggaaaaatgcccaaatatgcactaaaatatgccttaaaaatgacccaaaatggcttttaaccctcaaaacaaaaaagccaaaattgtgtaaaaatacagaattggctttaaaaatggctaaggagcgtttatagataattgcaaaaaattttgatttctaaatttatatatgcaagttcgaattttttaattttttatcatatactaaaacaaaattacatttcttatatcaacatttttttaaaaagttcttacaaaaaattcaaaatttttgcttttcaagggtatattttttaaattccaaaaaaagtcgatcttaggggtgtgtttttcgtttttattgaattttacttatgaaaatttgcgaaaaatgaccgaaatatgctctaaaaatgcaaaatggcgaaatatgcatttattctcaaaaacccccaaaatatgcttttatatgcattaaaaaccttcaccaaatcaaaaaattttaacgtagaaatgctatttttgagcccctttcttcatagcatatgcgcagaaaaaatatacaaaagcatataatttat

SEQ ID NO: 13994 - DNA, 3488 bp, Heterodera glycines
  misc_feature (2026)..(2026): n is a, c, g, or t
  misc_feature (2086)..(2086): n is a, c, g, or t
ttattgaaatccccaaatgtcgggtccctaaatgtccctcccaagatgtccgtggttttcttaagtgtcttttgctcacttgtcgttcggtccccaaatgtcgggatccccaaatgtcggatccccaaaagtcgggtccccaaatgtcgggatccccaaaagtcgggtccccaaatgtcgggatccctaaatgtcgggtccccaaatgtcgggtccccaagttgcaaatccccaaaagtcgggtagccataatttatagccctagttatcacgaatccaggaacaatgtgagtgatggatatattattgaggcaatttattttgaattttcacttgccgaaatgaagaagtgataaatttgccaatggttgagcatgtttccgtatagattttgttgagcaattgcgtttttgtcccgtaaatttcaatgtcataagcaatttgaaggcgaagtcgtccttccacaaaccgacaaaacttttcaccgacggattctgatgccgaaaagcagttgatcaggatgaagtcatcaaactgttaaaaagataataataggtaattatcattaatttttttaaatcattgccaacttttagaataccttttcgatgaaaggcaatgaatcttttagcaattcttcaaaattgtatgcttctgttcccatccgttttattttgatgagttcttcaaaaagaaatttcaaaattatttattaacatttaattgcctctaattaccgttcatcacttgctcgtggattattcttgcgcctgcggttgtgaccaattgtgcggcattttgagcaggaaaaagtggtgttaaaattgacaatggcgattcatttctctttgtggccgtaaattgatcaaattttgaatcggcgagcatcttttctaattgcagtggcactttttgaggccttaaaatataaaatactagtataaataaaattaaaaatatttattattttattattgaatgtttattaaaataccttagtgaatagaaaagaaagaatttttcaagaagaaagttgaatgaagcattttgataaagcaggacgattttggttgccattatgcttgtcattattccatttaaataaccgtaacggtttgcataaataaaattatcttaataaaactggctttgataaaaggtttatttaaattaatttatttctaactcactttttgcccataattttattgacaaaattaaatatcgcagattttctaaatttttgttatcattttggcaattaactttcccaggctttagaaaatctgttaatttgctattaaatattcttttttcgagaaatagggttgcaatataaagcgttgaccgatagcctaaattcaatttaatttttacacaaaaacatttttaaatttgtttttatgttaaatcattagaatttttgattttttgtgcgaatgattaaaattaatttacaccttgaaaactttcatatttaaattaattcccactttttttgactgacttgaaattgtgcgtagcatttttctgtgctcttctttttcatttgtcaaacagtttatgtaatcagtgagcatttgctcattaagctctgcttgcagcacacttttgccaggaattgccacaaaagtgatgtcaatttcgacattgtccatgtgaaatttgatcagaaagattgagctgtgcattaatttcaagagttttgcgacgcttttattctgaaaatactatttattttttaaattggcacttaaatcaaaataaaatttcataaaattttgacctcgcaaagtttgcaatacaatgagtcattggttccatctgaacatttgttcttttcacaaattgcatttttgttgccaaaaaagttttccactcccatcgtttggccagggacaatgcaaatcaaatcaacatcagagtcagctgtatgagtgccaagcaaaagtgagccggaaatgccaactcgagcatggccagtggactaaattattaagtgcatgcaattaatgataatattaantaaaagaaaaatttaaatattcctcaaaaaattgttttcattgcttattaaaaagtgatntaatgaagctcacccatttatcaatgagtgcattgattttgcttaaaactgttgtgattcgcttatcaaattggcttaaatttaagccgtcgcttcttttttcgtttagcaatttttcaatcttaattagacaatttaaataaaaaaaattttgttttaaaaaaattacctcatttgaatcgtaagctgaatctgagtggtggaaatgaatttgttgagaaatttcagaaaaatttgcacttaaataattgttttgttcatttttgttcaaaaattgttcatataaatcggtgtctaaattaattattatttttaattatacagttttaactttccgttatttaaaatgcttaattaaccttaaaatatgtcttcatttattatctttaaataattcacatattttatttaccaagcgtaatttgctgttttagtttcttccatcgcatttttatcttttcaaatcgttttagctcaaaagtttttacaccaaataaaatgataaattttttatttttccattcttcatcatattttttccatttttcaccaaattgtttgtccgttacaattaaatttgacaaattgttttgatgcatttgcctttttatttgctttaattgcttttccgatggaatttcctcatttttatccttttccaaatttttggaatatatttttaggattttgtaagtcttctgaaagaattcgttttgatcaaattcttcaatttgcatacaatacaataaaaattgggcattttctttttcaatattttttattaaatttaaattgtcaaaatatgaaagttttcgaagttcgtcaaccatttttaaacgtttttgaagttcaaacacaaaaatgccggcatcaagcagaaatttcgtttcatttgcatcattttcattttcgaaatattcttcgtatttctcatgcagaaatgtttcattacggaattcttaattatcgataaattaattttgcacaaatacaaaaatatttaataaatttaccatttaatgcgctaatatttattgaaattttttctgctgaattatgctcaacactcagttcatcattttctatttcttcatcatttccattgctttcttcacattttgtgccattatcatcgttgaattcctcaacaattgtcgacaaaattgtttcattttctgatgggttctgactgatttcttcattctctgaatttgaatttttagtttagccggacccaaaattgaattaatttatttaaaataaatggccacaaatcacaaaatttacattttttgttaaatgaaataattcaaagactctattaaatctacagaccatgcaatataaaaatcgtttttattttcagggaaattttaaattttccttcaaatttataaatatt

SEQ ID NO: 13995 - DNA, 4299 bp, Heterodera glycines
  misc_feature (11)..(13): n is a, c, g, or t
  misc_feature (1946)..(1946): n is a, c, g, or t
tgagttaattnnntattcattacatcttataaaatatttaattatatttacctcatggtttcgtacactgtttgtgttccaggtgatgcgctgtgcatttaaatatttatttgtaatttattttttttgtttatataaaataattttacgttattattactctttataattattgcttttgttaaattttaaattaatttttattaattttttcgtgcagtaaaaacttttgtaaatttttattttttaaataaaatttaccagagtaagtattggtttattccaattttaaatgacttttgtttttatttcttatgaattattatttttttttttgcatgctgttttctctcttatttcgtaaggctcttatttaggaattaatagttaatttttttctcgacttggttcaaatatttattattgattctgtccataataattaatttattgattaattttttcttgtgattttttttattttgccttttctatatattatttttatttatacatgtattctttctcaaaaaaaacattatttgttatgtatatagacgcaaaatattaattcatttttatttttattcattattgtaattatgtaaatcttttatttttttattataatcatttaatttattgtttgttttaaatttgaccaaatatgttattttattaaatgttgtataatatttaaaatgaaattaatttttggactgaggctttctctcttctcatttttgtccattgttgatacgattataataattttgctttggtttaatgtcatttccatgataaaaatggtttatttgatgttttaatttattatttataaatgttttttaaaatataatttttttttattgtatgttaaaaaggcgagtaaaaatttagtaaaatagaaattaaatatttaaaatattcaaaaatcagtaatttatcttctgaatatcaaatgaataaatagttggtttgtcatcattttttgacttcaggagttttttcggggccggctccgcagacaacagtcgccacccggaaaaaattaaaaaatttgggtatattttattaaaaattttgtatttattgattttagttttaattaataataaagatataaaagaacctaattagataaaatgaattattttttcaaaatatttctttccaggaagctaaaatttaaccaatgcgttttatctttttattgaatgtgttgtatttctttgatttatttattatattccttgatatattgttaaacttttaaacaatgtatgtaatccattgaaaacattgtcgttaattaaatcaaagttataaataaattagtgattgattgtatgaaataaatggtattttttaaaattaattactacaaagaattttattagatttttagaaacaacggttatattttttcattgtgcgttttgtataaaatttttctttgttcaactttttgtattctttattaatgttgtttgttgcttaattattcatttttattaatccttgtaaaaatgcatgtagatttttttggactaactttcctaacatttttaaaaattttgttttatttattttaattattattttttatttattatttacatgaatatttattttttcactcctagcgttaaatccattttaattggttttttgcactaaggaatatttgtagattgtttttcattaattccttttacaattttcatttatctttacggaaactatacaaaataataatttaataggataattattagtttaaaatttttttaactcaaaaaatataataaaaatattttattcatttttattttggaattttttataaaattacataattaaaaatgtatattttattcaattttgataaaccttatttatagggttttccacttttattttaaattcatttataacaaattccntattttcatgtttctagttagataatttagcttgaagtcattaatttaaaatatgtatttcgaagttaattattcatattaaaacaaaatatatataaaaataattattcaaagattttaatttttatgatttttatttttctcttaagaattggcacattataagaaaatttccaaattagtccagaagaaataataaaatgtaaagcataacaagcgagctttaatgtcgatctaaacggaaatatttataaccttatgaaaacattaaaagcggtcatcagcgattcctttagacagattcacttatttcatataaattaacaattattaagaacaattaaaaattacatcaaaatgctgcttaattgtaaatcaaaaaataaataattaaaatttaaaaagacaaatccaattgacaatgcttagaagcaatttcgttcatgcttcaaagagataaacgcaaagagaaattaataaatttaaactttaaaaaaatccccaaagaaattatttgacgcacaaatgaaaaaatatttgaattataaaaacggaatgcaacattaaattatgtattgaaattataatataaaaagaaaattgaaaaagaaattaatttatagaaaaatggactgtgctctagtagtattcaaagtttttcaaattttgttaacatcttttacaagaaattgatcagatcattccttcaaagcgacggtacaacctaaaatacgcagaaaatcggggaaattttcaaaaaaaaaacaagcccacaggaaacaatatatcaaaaaaataattaaaaaagggagctgctactataattattgcaatcctaaagcaaaaaattctctactgaattacattttgaatggtatagaaaaaacgttacaaaagaagttatatttagttgaattttgatgattataagattgtcattatttaaaagtgatctaattttaaaatacaaacaaaaacaccataattctttatttcttttattaaagagaaaaaatgccatttaatgccaaaagaaagataaaatattgcgcgcgctaataaatagggctgtaaaatatttacaaaaagtgggcaaaatatgcaccaaatatgtaaatatgattatttttttggaaaaattcttcgtaaaggatgcaatagatacaaaatgcataaaaataatctaataggcttagaatcacattttagtaatttaaaaattattttttggtcgattttaagaaaaaattttatttttaacaagatatttctatgaattttcaaaattctccaaaattttaaatgccttttttcatgccttttttgggattatgtgccttttaatgcctttgtatcaattttttggtacctattatagtgcctttttcgagatttttggtgctttttttcgttctctagtaataaattcagttggagaagagaataactcaaaagtgagagagtgctgctgactttcagtcccagtcatatgaaggagggtagagaaaataatttaaatagagagtgctatgggaagaaacggcataaaaaatgaacaaaaacgtcaaaaaaggcacgaaaatttggaaaaggcagcagaaatccaagagaccttttttttgttcttcgggcctaatgtttttttctccttgttatgtcaacaatttcaacaccggcggagcaaaaaaaggaataaatttttgctgttttggtattcaaatttaaaaaaccaagatataactaggggtccggcggtggataggcgccgctgggaaaaatttttttggaaattgcagtgaaatatgataagaaaaattgcaaaaaattttaaaattttctattttttccacaaaatgctgaaaaaggcatgaaaaaaggcaccaaaattgcaaaaaaggcaaatcaaaagtcattaaaaaattgcttaaaattttaaaaattatcgaatttttaaaaatatcatttatattacattgatggcttaatgtatgttgatattaaataaatatcaacgccagtgttgatatttattaaaacaatgttcgctaagagaaaaatgttgaatttgtgttaaacaattgtcttttatgcattgctatgatcaattttaatgtctatgtcataaaatttaaggctcgttatttgcatacaattaagattttataaagcaaaaatttatgataaattaaaaaaataaacttttatataaagtttatttattaataataactatttaaatatgtatttaatataccttttgttattttcgaatttgtaaaataatttatttaaaaataattaatttatgaaaattaattattttattagatcataattcttgtctcattgttcg

SEQ ID NO: 13996 - DNA, 3294 bp, Heterodera glycines
  misc_feature (169)..(169): n is a, c, g, or t
  misc_feature (235)..(235): n is a, c, g, or t
agtaacttcgtttttgctccgcccacaaaaattaaccagtttttaaattgaaacaaaaattcgcttttgatgtacataaaatgttcacatatatcctgcggcttggttaaaaaaatgcttctgaaaatgaggaggcatacccgaaaacccccctccaaaaattaatctntacccaaaatataataataataataataaaaaaaattctcgggtggaattatttttcctcaccggngtattgatgaatggatgagtcttaaaaaatggtgttttcaaattgcagatcatcttgggtccagaaaaaagtccaagcgttcacgtgttgtcagcagcatttcgcaagcatccaccataccaacaacaacaacaaccacaacgattgtagcaacggcagcggcggatgtcacaaccgcatccaacttcatttcttcatccggacactcgtcgttgtacaactacaccaacaataataacaacaacagcatcataaagttgaatggtgccgaactgaatggtcattgtggcaccggcggaggcgtcagtagcagcaaccatctgcaacaccaccaccaccaggaaacggacaacaaccacaacagtagtaatgaatgtgcactgttgcgcgagaatgctcaacgccttagtgagatcagacagctgcagaaggagcgtcaaacgtacgcaatacaatatacacttatacattgctattttcaggcacatgtccaaaaaaattaattttcttttttgtgcaggcacccgaagggcttttttccggctcaattttttttgtccggtgaatttcaccaaatttataaaaacaggaatctgtatttttagtgtttataatcgcaaaacaaacccaaaaatgctataaaaaaagttggaaaataattttccaataataaatttttaaacccccctcaaaataggtgcaaaaaacaaaacaaaaaccggtcataaaaaactaatattttccggctcgggtaaaaaatatccataacctttttaacccttaaataataccatttacaattttttccaattgctcagtttggaactgtcgcttgacaagacgaaggtggagctgaagagtgcacgttcagcggagaatgagttgcgcgtgcagctgaagaatgtgcaacaacgggagcaaagctgtcgcgaggaatggaaacaatttgagcgggaacagaaacaacgggtggaccagctggagagcaagtgcaaacagttggccaagcagaacgattattacaaaatgaacacgcaagcgttggagcgacgggtgggcgaactgcagctgaagaagtcggaagttgagcgtgaactgaccaatgagcggttgcgcaattcgacacgcgacgaaccgccggtgggaagacagcagcaacagcacaacaacgcgtaagtgtgttttcttgctgcagtgttgaagtgttacgcaattttcggttccattttttacaagaaaaaaagaatggatggaaaaaaaatgtttttttgaaaaacaaattgaaaaaattaaccaaatggaacagcaccttcctcccaaaattggtcctattagggcaacaatgacaggcattgtagcccaaaaactggtcctgggcccaattagccgggactcattgtcagttgtcctccgtctggtaacaccgaattttcggttttttttttgtgaaacgtaacttgaccaaattcttacgaaaatgacgtaagaaagcactttaaaaagacttcattttctgtaattaaaagaaacatacaattagtatcccaaatctaataaatatatatatatataatgagcaaagaatatttagaagcgagaatggcgagctaaagcaaaaaatggcgaaccaggaccgagaactgaaggcattgcgcaaagatcttaaggcaaagaatgaacaatgcaataagtttgatgacgaactgcgtcaactgcgaagcgcaaagactgacgaggtggcaagtggcaacaaattatttaacaacaaatagattatcttggcaacagctcaccccccccccccccaacctcgtttcgttcctcgctccaaaaattttttcttaaaattttcaagaaatttttgtaagaaaattcaataaacattaagattttttaacggttttggaaatttcctttaaaaaacatagtaattcgtcaaaaagttttgaaaaaagttcctggaaaacatttttttaattaaagaaaaatattttttgtcaatttccagaacaagcagatggatttgatgcgggagaagaatctgattttggagcaaacactttcagcggagaacaaactgaagcaggacttgttcagagcgctcaacgattcaaaggcggagattgcaacattgaaaggtggggaggggatgggaaggggaaggcgtgtcatttttctaacaattgtggttcgttttgtcccccgtttcgggatgctatcatactaaataattaacgaggcgtgtgtcgagctgtctaccaccgctttccctttacgggcgattcggtggattcactcctttcttccttcctcgctcaccatcttcgttttttccaccccgacaaatttaaagcaaaaataaaaaataaataaataaaacaaattttttcaaaattttttttattgttttatcgagtcagtacacattacgctggttaattttttgcagctcgtttccaccccaaacagacgtatgaacagcaacagggcggatcattgaatgttttgtataattttgatcaggcgccacagttttgaatttgcttacggtttaatgaatacagttacagtacaataactcaatgttcaacaaataaaaagctggaaaatgaagtcccgttatttgttcgaattctcttcttgtccaaatttgtttaaatgttgctgttgaatggccgcaaattggacgtatagaataaagaaggaaggaaggaacccagcaggtccgaatgttaagaaaaaatgaacgaacgagctgctccctttctttttgtttcccctaaataattaaaagcacaacaattgttggctctgtgttcgctcgcccggttatcgatgccggcttttgctggttgctttaaaatctttaaaaaaattttccggaggaccgagaaacgatgatgagagagagagaaaagagagagattccaatccgtttggttttgccttcaagtcccaacttccattcttcatttttcgggggatataactaactaaaaaacacgctgttcatcattcattcgttctttgtagctcgtctgtacccaaaacagaccaac

SEQ ID NO: 13997 - DNA, 2436 bp, Heterodera glycines
acaaagccaactgaaaaattggaaacgaaaatttaatttttcaaaaatttccttaccgtcggttcattttggaggctcaattagcacacttttccctttaaaatctgttgttatgtaacttaaaaagagacagttaaaatgagaaagcaaagtacaaatcaatcaatgatgcataaggctgggaatttaaggcactaaaaatcgccaaaaagtcgactaaaaaagtcataaaaatcgccaaaaagtcacgaaaaaatggaaaaaagtcctgaaaaattaggtgaattaatttatagaataacactttgatcatatttaaaatatcttaattttaggccattgtcgccatcagcgaaagaaaaagaagaagcgggcaaaagcaacgaaaatgtcgtctaattatatttgaggcatggccaaatctcactaccgtatttgctctaattatccccaaatctccattaatcccccaatatccaattatcccccagtctaggaggggtcattctcagttttcccgaaacaatgaaatgccaattattattattatttatttattttttgctatccgcccaactcaaattcctatttttaatattcatcgccaaaatggtcatcagaacaggaaacaaaattatcatcaaataaaacagtcggacatctctcaaattatcactccttccgctgatcactgggcccgggagtcgagaacactttttcatcgctttgatcttgcggagacagcggcctaaataaaccaaatttgaaatgaatgaacatttaaagtactgtacggaggacactacttactgtaccctcctgtccatgctctattcaaaactagagtgccacgggaccgggacctggtagcggacaactgagtacaattgagtaccaaggtcccctgggactattcccggttttcccaggcaaaaattcctgggttttcaacccgaaaaggtcccggtcccgggtttgcccaaaattcccggtcccgtggcactctattcaaaagtaaggccaatctttttgcttacccaatacaatcatgataaagatggaagatcactccattcaaattgtccaaattttcgtctttttcccattgaaccgccgccgtctccccaacaattggacaccgtttcaacagccaaatctcttcgtccttcgtcagtgtcaacttttcttgggtcatttcgttcaccaactcaaatggctcaacaatattcatttggctagccactagaagttcaagccgaacattgtaagcgacagaagtggtggcacggagaaatgtctaaacaaaaaagggagcgtaaatcaaatggcgcccggaaaatgcgtcagtggaaaaagcgtcagcagaaaatgcgtcagcgaaattttattgtcttaaaaacaagttccttgcgttttcgaggtcactgaccacgaatccggtatccattccggcctatttccgaatctcgaacccggactcgaacaaaaaactcgaaagtacaaaattttctaatttagcatttttggttcaaaaacagcataaatgatctcttatgcagtattgatggcttatagtttgtttccgtgtattaaaccgatttttaagaaaaaatctaatttcgaaattttgacttttcgattttttgttcgagttcgggtccggggttggaaattgagaacgattttcttatagaagtttagtcctatattacaatactaatgccatagaaatttattttaaaatatttgtatcactgacgcattttccactgaccgattttccggtcacgaatcaaatgcaatcaatcaataattagtcaatcgtttaatgaacaattaagtagtctcgatcacctccttgaaagtgttgttgatccatgttatttcacaaaaataagcacagcaatacaattcattcgcttttccatttttgctcggcgtgtgcaaccatttggacaacgcttgggcagcagttgcttttggcccatcgtcagaaattccatcggggcacagttcataggaagtgattgaatacaattgaacaagatcagtgagaagtgtcggtgaaatgcggcgacgcaaattgtccaaagcatcggcaccggcaaagctcaaatgccgaatgtttgtcgcaaaaatgggccaaatttcacggacaaaaacatcccaaatttgatccgtttcgtatgaatacacttccaactcaaatttggtgcccattctgtcccaaattggcttgtttgaacggagaaatgtgagcacagaatggtcaatgtagctgataaagtgaaaaaatgaagattggttttctgtatattttttgatttactaaatctgaagcttcttaaaacggattttgtttggcagcgaatggtccggcaatggaaaatccacaaatagcaatcgatcagaacagacagtttcgcttttggtcct

SEQ ID NO: 13998 - DNA, 5787 bp, Heterodera glycines
aattttatttatttaaaatataaataaataaaactgacttgcaaacatatgagtccgtgacagcaaattccaccaaatgttgtgagccggtggtgactcgcaactgtgtgttgacgggcacgaattggtgccacttccggtcggcgaacattccatgtttcgctcaccgctactgtccttcaacggctcgccggcactgcataagactgaatttaattgtcgttggcattagactatgatcagggcaaaaaaagacgaaatttaattagtagtaaattttgaattagcgaatttgccaaattgatccgtcccgcactttccctttacaacaagcacacccatcgtgctctacactaaggctgcttgagcctcaaaattttccgagactcttgagccgagaccgataaatgacccagagacccgagaacgagaattgatcaacaacgagagtagagagtgagagtctcgagcagctctagcgctaacctataccgaaaatattttcatggaatatttttgtttaatgggaatgatttaaaaatactcaatgccttttttacaacttattttaacacatataactgaaatacttcaaaattttttagttaatgtaaaatcttagtctaaaaattttctgtacttcttgagcagaatttttcacaatgatcttgggacaagaaattgttgaagttaccgccttggccaagaaactgaagcagtgaaataaatcccaaaaaaaacgaaaaaaatgagcaaaacgcacagaaaattgaatgcatcttccctctctggcatcataataaaatcgtggatatgtttgaccgcttccttagaaaagtttaaaaaatacgaaatttcatgatttttaattttattttcaatactgtatttcctaaattagagccccctgaataccactcttttagagaggttgacaaataaagcccccccccccctcaattagtgctccctccctgaaataaagcccccttcctggggggaggggggttcaaaaaataaaacccacgggggcttattataggaaatacggtaacttttcgctaccgtccggcactccaacatcaaaatattctgtaggaaggccaccggcagtgttgtacacttcggttggaattgcaccatttcgtgaacaaatatgcacttaataatttttgtttttttttattacacctaattaggtaactgaaagttggacagcactgttgaagggtgcccattgccgtgcaaaccttcaaattttaaaataattttaaattttgtatttcaaatttgcaaatcccacatagtttggacttgtacaaccattgtcagcaccctgacagtatactggctcttgtttaacacccatggtacggtccctatacagaggaaggcctcggctgcaagctgaaaatttaatttttcttacttcaacaaaaaaagcactcactttgtttacaataactctaaaaaattttaaaattgggtaaaatatcgtaaatgagataaaagctacttcgcaatggtctttggtggcaaaattgttcgcatttcctccgtatccctggtacttaagttcgcggcactcgccttaaattctattttgatagattgaattagatttaaaatataataattggaggggtcatttgacataataaatggaaaataattaaaatagtcgatgtagaattctattttattttaaaataaaatttgggctttgggatttcggcacaatgctttttaagcttacctgtgatcggatcatggtaccagtgattcaaacttgatccaccgcccgggggtgtaaagccctcattaggtggttgaatacaagcaaaagctgaaaatttaaacaatgaaaacggcaaaaggattcatccgggttaaattatccaaagccctgaattctcaaaatcttgatcagcatccttgaaacccaaagaaattttgaaaatttttgagcaattttgaggggtggcataacccttaagtagcaaaaaatattagcattaccccttgacggacaacagaaactgattgggttattaacctgaagaaatttattcaacaattaaatttaatattattttgtataaattattttttaaagtatttttaaaaattttgatttttatttttattccatttttacagtgcaatcttcactgtcgcatatgcagtcatatgccaatgcaccaatggcctcacaagtagcatctgcgccacctaaatattttacctacgcgttaattaaatcttaaaatatttttttaaattaaaattgaaatttaatttaattgtatttaccataacactgttggacctgaaaatttcaaagcataaattcctttagcataagaattgttcaaattttacctgattttcaattcgaaactttgggttgttaccattcaggggacaaaagccgtagttaagacagacaaggccatcccgggttcgaaatggcggctggttgttggcacaacggcattcgcccgaccgacagtatgaaccaggccataccttacagtaagaaattttgaaaattatccattcaaaattgattcccaaatatgcttacagcttcgcactgacggttctaaacaaaagaggaagttgagttgtttcagataataaaatgctaattttttgatcattttaggcaacattttggcgggtcgggagttatttcggctccaaatgcaataaaaaaaattttaattgtccatcaattttagaaaattgatatcttttgaaggagctagactttctcttgtagcctggaaaattcaaaaatttcgatatgaaaaaaaaaattttttttcgttctctttggtaatatataatttcctttatgtccaaaataaattgttaaattgtgaagttcaataacaaattattgtaaaaccaacctgtgtacagccagactcgccaggattgatctctgtttgggaggaatggttttgccataatttgccaacaaattgatcatataaatttgggttcctccccgattcgatgcgagaaattgcgaatttttagtttaaaaattagtttcttagactttttttttagaaaaatttcctccccgaagaggatgttgctcccccgatacattttttaaatttctacagcaatcccccaataaattttgtcggggaatttgctcacaattcccgacttttctctccccaaaggtcggggaggatcccgaatataaaaaataactaacttcgccaacagtacgaatcaatctccacatatgtggtaagacatgcacaacgtttatttcctgcacaataattcccggtgccacaatcggttgaaaccttttgtaggaatttaattgaataaaagtaaatcaaatattaaaaaatgatcaatttacaagcttctgaaaatcaacgaatttttaatattttcttttcgattttgttgatgtgaaaaattattattttatttttgttttcgaatttttttggtttgcgtgcagcgctaataccaccacaataccaatagttttgatcattttccaggattgatgagtaaaatttttgttaatccattcattaaaagactctataacttttttcgaaacagatttcaattttggtttttaaaagaataatttggtcgaaatattagcgtgttgtttttaagtgtattttattttttcagactacattatgtatgattattcctagaatttggaccctaaattaagaagcggctcttctcaaaatgttcgattctcgtcaaatttggctccaaaattatgttgtttttttcaatatattttattgctgtgttaattaattatacgatcatccaacttcacatggtcgtcccactgttccatggtgtgttaatgattcaatgaaccgtatattcgagtccaacatggcaaaaatgtagcaaagaaacaaaaaatggcattttaaattgccaaaatttgtgataaatgaagtaattatagtcattaaataaatatatgaaagcgagtaaaaatgaaaattaaaaagtatatatatatttatatttaattaattttaaatattccaacatatcccaggacgggaccggccgatatagtcgagaacagcaatcgaaggattggaatggaatgtaaatatacggattgagggtggatggacgatggtgatgatgacacataaattgagcaaaactaactttttcaatgggaatgagaccaaaacggagggaacaaatgcgactttaaaagtacgtacatataatgttgtccattaaacaaatattttgaatgtttgaagagtgtgtccaattttttttaaattgtcccaaagaatgaacttttaagataaaattgaagtcagtggatcagccgaattaatcaataaattttatttccaattaatttttagtttttctaacaaatcttacaaattatgtgtgtataaataactcttttcaaaaaactgtaaatgacactcttaaaaaatattaccaccatagcatgagaggtgacatgagttttattcaaataattttaatttatttaattaaccaaacctaataataaagataaaagttaacaattagtacataaccgtattttatacatctaatacaggtaatctttaagttactaaagcaatgatggaaaaaaaagaaaaaatattattaacacgcatcgtaattaaaaaccaacaaaagttacatacacatgatgacattacagaattgatcaaatccatgtgtttaaacccgaataaaattttttttgacagataaagagagagctgcaccaaagttaacacatattgtagaagtgtggcatttgtgtggtggatgaactgctttaattcaattcattgagaaggtggcggtggaggagggtaaatggcattgagtaggaaagccgcaaggtccatgttcgtcctgcaaattgatgttttaagtatgtttgttatacacattggcaaattaagcaattaaaaatatgatgattaattttatattttaagaaattaccaataagaaaaatgtgagcgcaacattgcccaatatccgttcggcacagtgcccggttgaatctaaaaaaagagacaaattttatcataagaaaaaagatttttcgaacaattttatggtgagttacaaagtatttttcaaaaaaatttcgaaattttttttctttataattttgttatgaaataaatttctagaatttttttcttaaaaattttctaaattagtaatttaaaaaacaaattcccgggggaaacggcggggaatggagggggggggggcgtagtgccaaccagcagcagagggtaggagtggcagtgacaatctcaggtggtgatgtgacaaacactgttctagcaaaatttcgaagccttattcgaatccctgccttggaatttcttttccagttgcgcgcctgcttcaccggccatttatcatggctcgaaaccgaaaatttctcgagactaaaaaccaaaaaaaaaaaaaatccgagacttttctcaagcagcaactagctacgtcctttgatttgcaaacagacaaaaatctgtgcctgaaaatcgatgcgttgcgggagtctccgttctgtcgggatctcttcaattaaatgtgccgcatcgccaaattttgtttcatctaatgatgaggaagcagtggcagcagctgcgattgctgaagattgttcaactgtaaataaggtcgcggaaatttttgttctaagaaaattaggaagaaaaatgtttaaattgtgccagtgaatcgaacaaagct

SEQ ID NO: 13999 - DNA, 2405 bp, Heterodera glycines
  misc_feature (34)..(34): n is a, c, g, or t
cagatcacaaaaaatgataaattctacccaattntggggttaaatttcaaaaaaaaattaaggtaaaatgagggtccggcggtgccgacagccgccgccgaagtaaagcatcgttttaaaaatttaaatttccaaaatattcgttcttaggggtggactttcgcattttgcgccaaaaagcaaaatgcgaaacctaggcccatccctgcttcacaccgaggtaaagatgcatttgacaaatttgtttcaatttaaaattaaaggtcaaaattgggatatatgtggatacggtataagcggggaggggtagctacggtaagtgccacgtaacttttacaaaaatcaattttggtgtaattacatcttttgcttctttaaatcgacgacgactgaatggcttcaattaaaaacacagagacaggaagatttaaagcaaaatattacaaaaattccgagtttttctcaaattcattggacatttatacaacgactcacaaattatatgtacaatcagagatatttggaacatattacagacaaatcggatcaaatgggaatgatgagcataataaatacaatacaattagtgatcaattaatgtcttccgaagaaatccatccgccgcttttggccattgattcgctctctctgtgctgtcacatctgctgttgatcgttttgctgtctgaaaatggaaaaaacaattattattgatcaaaaacaatcaaatttttctttacccatcggtgccctccgccgcgtgtcgcccattgtccgtcgccgtcgtacgaaaaatggccaccatttcggcatttccgctctcttccgcgaaatcctgtgcccgtttgcctgaaatgggcgaataaaacgctcgctagcacaacaatttggccacttccgctgctgctcaccttccatgttccgttggttaatgtccgcgccgatggccaccaaatgccgtgccatttcaatcttcccattcttcactgcccacatcaaagcattgtgtccgtccacgtcaacatgttgaaggtcggcgccatgttcgacgaggaaattcactgaaaattagggagattacatttttggcactttgccacaattctctcccaccgatggccaaatgtccttcactggcggcgcaaatcactggagtgtattgctcttggatggtttgttggttgacatctgcggcccactcctccaccagcagacggcacacctccaaactgccgcccacggcagcatttctaagtgcaaaatggaatcctgaaattaggagacaacatttgtggcatggtatttttggctactgtaacagtaatcccccaccttctaaatccatttgctcgacatttgcaccatgtgacagcaacaagcgcacaatgtccacctgaattcaaatggaaaaatgtcggaaaacatttcgccaatggaaatttttccctacatttcccgtgtaacacgcgtacatcagtgctgttgccccatcaccagtctgcagattgatgttggcaccattctcgacgagaaatgtgactgtgggggaaaaaatgacgggaaaaaattacgcattttttcaaattttcgtctctctaccaatttccgtttgcgatcttttgcaagcgtgcatcagtggcgttgtggcagagtccgtgcccaagtcaacgttggcaccacgcgcgaccagcacacggcacagcggtaaatgggtattgcggacagcaaggaaaagaggagtcatatctgcacaaatggggaaacaccattattttccgggcaagcaaaaatataattattccacaacccactcacgcgtatttgttgcgttctcaagggccggtaccggctcatccggatcggcgcccttctccaactgaaaatgccatacaaaattagtgccgacggataaaattgttcatttcactaccaagagatcaacaatttcggtgtgttgtcgtaagaaggcagtccaaagagctgatcgtgattggatgttgtcgcgctccactggatcaaccgtccaccgcagcaaaatgttcagttcgtcggcgtccagcgaatcgatcagcacacgaagttgttggatgttgccattgttgatcaagtcgaagaagcggagagtgagcgtctcaaagttgtccacaacagcagcagcagtgggatgttcagtatctgccttaattgtgggggaaaatcagttattgaaaaagaattctgagttgaaactgtgcaaaacattttttcagggagggggggggtcattatcacggatcagtgaccccaaaaatcccggtggaaagatgatttttaaaaactaaaaattcaaaatatgaaggggaattgcacttgttgttcgtgttgcaatcataaccaaaacatcaatattaaaaaaggtttcatgga

SEQ ID NO: 14000 - DNA, 1257 bp, Heterodera glycines
  misc_feature (1192)..(1193): n is a, c, g, or t
  misc_feature (1216)..(1216): n is a, c, g, or t
tagccaaagatcgaaaaatttgcttattttttgtacaaaatttgttaacaaattgcattcaaattttcaaaaaatttccccggcggcgcctgtcggcaccgccggacctctcccctcgcacattcagcaaatttttttgaaaaatgtaccgcaagaaaaatttaaaaaatctgagttccaattttccttgagtaaatcatgattagggctgctaattttatgtaaatacatattttttcctggcttctccatagcctaatcagtaggaaaaacactttcttttttgtgtttgcaaacaaaagtttggacttttatttacatattttagtagatattttgcaaatttgaatatctgctagaaataaatttaaaattcgctcctatcggcacgccggcccccccccccccccaaaaaaaacctttttttcttaaaaaattacccaaaaatcgctaaatttgattatttttagtcaaatctgtgcaatttatgtcaaaataaatattatcaaggcgatcaacgaataaaagaatgtggagccaaagaaattattcataaaaaatattttttttgtgagatttttggagttaattcaaagcaaacccccgcccccgcccccgcgggggcggaattatcgtgcccccgccaccgccaccggggctccgagatcacggcaccccaaaaaccccgtgatttccgtgatccgtgatcacggccagccctggtagtgagccaaaaagcacagtaatcaaaatggtaaagcaacgggacaacaatttgtcgtttgctgtttcatgtaccgttccggacggaactgttcagcgtcctcgccccacacggcacggtttctgcccattgtgaacacatcgacctccaccgagtcgccgacattcagcacaattttcgaattgagctgaaccccacacggcgacgatggcgtcggtgtacagcgacgggaggacgcgcttaaaagcgaggcatttaattaacagggcaaatatgatgtcattcaaataaaaatccaaaatttttaaaaattagttgactaagtttggacccagtttttaatgtgatttattaatgaattttgtgcaaaaaatgacaaattttgccttttgagcaatttttcgcagattttgatttaaaaaatgtggaattttttttttgaaaatttagcgaaattttttttggaannatttggtgaggctagggtctggnggggatatcagcaaggaaaaatctaaatttttcatactttt

SEQ ID NO: 14001 - DNA, 1710 bp, Heterodera glycines
  misc_feature (29)..(29): n is a, c, g, or t
  misc_feature (1688)..(1688): n is a, c, g, or t
taattgcgaaaaaatttataacttacacnggataattagttgttaagaactagaaaaacacgaaaaaataaagcccaaaaagatgaatttcagtttgaaaaaataacatcaaccttaaaaaaatgtgaataagagaatgattacagttttcaagaaaataaaacattattcttatacattgtaagcacataatcatttaatatgatttaaacaatcattaaataagaatttacccaatttttttaagttgagcattatttttagaattaaaaaggtaaaaatcttataaaatcaaataattgtcataattggaaaaaactcttttgaataataaccagtgaaaattttgtatttggggaaaatacattctttcgatttaatttaatttttaataaatagttttagtgatcaagagaattgaaaaatgcgtattaaaagaattgataaaaatataatataataatatcaaataaaatttttgctataatataactttaaagaacagcatagtagaaccaatataatgaaattagtaaaattattaatattccacaataattatttctataaatatttattaaactgtgtcataaactacaataaagttgcaaaatcaaattaaaatatcctattaataatacttcaaaggaataaattactgacttgataatcgaataaagaatttcaaaaaattattttaaattatcagatttaattaaaaaactaataaaattaaaagatataaatatatcttataagtatcaattaaatgaaaataattttcaaagattagaaaaataaatcttatattaaatatgcttttcttggatttcttcttgaccgataataacttaaaaaacaaactataatcatatttttcaccaagggaatattgcaacaacacgaagataacaactaaatacaaataaatggaaaactggtaataaattatttaaatgatttttaacaaaattataaaataaaatttaaaatttctcctagaaattaatgaattgaacacccaaaataaaaagcaatctgacaataatgagggcaaaattaacgaatttaactagaaaataaagtttttatataaaaactagatacagaatttaaaaagaaaaagtttaaatacaaaggaattttaaatactaaaaaatattaatacaaattttttatcttgcgaaattcttattaagtattttaaaccaaacaggtagttttatcttcggaccgggaattttaacaacaaccgggaccgggactttttgggctgaaaactgtgactttttgcttggaaaaccggtaaaaaacctggacttttcccgggcaaaacttgtcaaatcctggacttggtcctcagttgtacgtgtttttcaataccagttcccggtcccgtactactctacttttgtcacttcacctacatcgatacttttgtcataacgtattattaaaacagaattaagttaagaccacatttcctgtttaagctataatcataagattaatggaaaatataaaaaaatacaaaaataactttttttatagaatttaatagagaagttttattattgcaagtatcaatttacaaagaaaacgctgtactgttacatgagattaaaagaaaaaccttaaaacttgttatatacaatgaaggcttcaacaaagttaaatttctccatcanatacaagttaagacaagagtag

SEQ ID NO: 14002 - DNA, 3855 bp, Heterodera glycines
gaaataaaaaaatagattttagggtcgaaaatcagaaaaaaattttcaaaattgcttcaaataatttttttaatcaatttattcgaacaaaagggtttaaactttatatttccgaatcctttattaattttaacaattttttgcgccgtattttttgaaaaaaaactttttgaggaccagggaggaggaaggaggccggcggtgccggtaggcgccgccgggaaaaaattgatatttgaatacaatacagtgtcagattttgtccaaaaatgaccaatttttgcaattttttgaacaaattttttaagaaaattaaggattttaaaggccctgtggtgccgataggcgccgccggaaatttttttttgatattttggctatatatttaacagtttttcgatcaaaaattattaattttgccaaaaaaaattcaattcttaccagtgtaattttactcccgtatttgggtgaaaatttacgggagcgggagcgcgattcctttacccgttgcgctcgcgtgaccataattgtgcgcatttagcgccactactcgcgaggtgccatatgaccaacacatgcagtcgtgcctcatggatagcacgacacgatgtatcggaatcttgcctatcgtctgctgtctagccagatcacagaaggtaaagctaaccgacgacaattgaacacggtgttttaaatattttatccatttgatattgtttcatgctttatccaggtggtggatgactgcgtggtgctcaatccgggccgcttcgacagagggaagggcaccggcacattttccgttctcgacttggacctttcgagtgccattggcgccacttcggtctcaccgttttgcgaagtctcactcttttcaacccaacaacaacaatgacaaaaatcacatttttgagtgtcgcaattgcccattttaacatttttgacaaaataaattttcggatatttttgatgaattttattggctaacaggaggcatttcataacaaagcccatgaggggccggggcatttaaaaaaggacgtggcggcagacaccgtttactgtgctaatttccatttatccttggtgtcttttttcgttgatttttttctgtccatcgttttccgttatttttctttgttttgcgaacactccacacattcactgctttgactcttatcactccctccccatattttatcagcagaattgactaatcaccgaaaaattttttggggggggggttaccccgccaagattttttttttattttttatttttcagtcccgtcatttgagtccttatggtattagaaatttcagttccgtctctaagattgactgattttcggaatttttatcacaaaagtaaattttgccttaaaaattgtaaaaagtcacaaaacgcaaaaaagttaaaaaatcccaaagtgtaaaaaagtcaaaaaaagtcacaaaaaatgtatgttagaagcttcaaacaaagtgtagaacacttttgcagtcattttaaggtcatttagagtcagcaaaaaaaaagaagtcatttgacttaaattcccatccctagtcattaatagggctggtaaaaatatggatataaaagcgcgaaatatggccataaaatatggaccaaaaattgcaaaatatggacataaaatgccaaaaatatggacataaatttttccaatttgaggtacaatttctcaaaattcttcaaattcgctaaatgcaaagtaaagctttttaaaatggttaaatatggtattataaatcattttaaaagaaaaaaacacgatacagctaaaaattactcattttagcgaaaaatcgacttgaaaagcgaaattttcgcttttttgcttatttttaatataaattaattaatttttaagaaaatttaaatttaatcagtattttcgacaaaattttgctaaaaatgcctttttcggaaatttttgcggtctttaggggtcaaaaatgccaatttacctgatgggggccgttggttttttggaaaaatgccaaatatggacataaaatatggacttaaatgccaaaatatggaaaaatatggaaaacatggatataaaaatccatcctagaagcttctaaccaagctaaaaatatgtttttcgtgcgtttcaggcctcccacaatccaggaaaaaaatatggatttccatataattaattaccagccctagtcattaattaaacgccatcaaaaaggatgttgcgtaaaatcatcaaaacaaaaattgcttataactttgctcaagagttacctaattaaatatttttaaagtttgaaaacaattaatttctttgctaagatgctattttttaaacattgaaaatttcaaaaaagttattgccagaagaaatcaataagttttctcgaactgccgtcgaagtcctccagcagcgatggaggtttagttgggcattgatggcgacacaacattctttgtgcgcgtcgaaagtgatgaggaggaagacgaacagcagcagcagcaacagttcaattcggatatggccaagtgcagcagcagcaccagcagcagcacgcatttgcacctcccccggcacctctgccgttgtgtgatgttctgcaaacggtagcctaaacccccttttacctataaatgtgaaataaacatttacccaattagtccccttcgtcttcacggcgcattcctagagaatgcatacgcactgcttataaattgctctcagtccagcaaattgatgtagcgaaggcagtgctgtttggagacagcagaccgggaaccgcgttttcctcttgctcttccgcttcttcgtccacttcgtcttccgcgtcatctgtctcgaagcacaccgaccgagacaaaagaaagcgccaaattgttgcatattataagcagaaatgccgcacggattgcaccaactgttaatcccctcccatctgttctcatttttcaatttatttttgacatacaaacatcatttcttataaaataaaaaatttccatctcttcccccctaagagcggccccctcccactgatgggaaaatcaatttgagattaaaataataaaattaaaaaatcgacgcgaaaattcaaatttgaatttagcgccaaaaattgtaacaaaagtacatgggtcactacttaaataaatcgatgaaatggtcaatgaaaataaaaataatttttaagaaaccgaaattttaaatttattttaaaaaataaaccaaattacctccgacaccatacaagaaataaagctgaacagaactcggtaaattagtcatagtaactcaaacttatcttttcgtcagttgcagcgtggaaatgttgagtcaactgaaagaaacttaataaagataaacaattaaacagatttgataaaagatgattggcttattcagtgttttagtttgtaatgcttttgttttgctgccatttgcaattcatttactcgtactattgattcacaactgtttggtacgtatgcttagtacgttggaagagtatgacattgaaatgaaaataataaaataaaaagacaacaattaaaaatagattataaaaaaataaaattgaaaatgggaaaaaaattaaatcgaataaaaattcatgcatttatgaacaatgatatcaactaatcaaattattaaaaaattacatttgaaattaatatattccatagaaatattcgacgaaaaataaacaattttttagttttataagaaaataataataaaattaatttgctattagattttaagtgtattttatatgattattatagaaatattctaatttctataaatttatttaaattaaaaataataaaatacctttgaat

SEQ ID NO: 14003 - DNA, 1034 bp, Heterodera glycines
  misc_feature (10)..(10): n is a, c, g, or t
attaaaattntctgttgtattaaaaaatcctatacataattttaccattttcctcattttgttttggtttgacattggtgtctaaatcaatgtaaaattaaatatattttaattgatactttaatttttcaaaaatatatttaaaatatcaaagaaaacaattttacccataatagctttgacttggtcaatgtataaataaatatgtataaaggtttataaatttttatgttaataaatttttgtttccgggttccacaattgtatttcttaattttaaatttatgtttcaaattttacccatttgggcaatgtgttcagttgtgtccataatgtttaaatctataaaaaataaataataaatttatttattatttaaatgtttacttattttttcgccgactttttctttgccttttctgcctaaattcatgttaatttaattaaaatttcactttttatttacaaatatttacttgttgcgatggcttctttttctttggttccatattcacttggctcattaatacctaaattttacgaaataaataaataatttatttgtatttttatgtttacttattcctcctaattttctttttcccttgtccatgcaatcaccaaacagtgccaaaatggagatcagtagagcattcctcagcataatgttcacggttggtgatgatgttgagtgaatttgatgagtttgaatttttatgatttttaaattctgatttttttccttttcgccgcgcttaaattgccattttttggcacaaatcaaacgtggcatttaatgcgtgcagcatctctctttctcattccctttctctctctattcagagaatttgtaaaatccaattgaatggattttataaagtgtgtataaccatcaaccctacaatgttttcacctcatccccccccccccccccgttaacaagcattacgacgaataaataaacggagtgctgctgctggcttatgccatgacaccacccacaccaacgcttacttcatgtataatgtatatac

SEQ ID NO: 14004 - DNA, 2614 bp, Heterodera glycines
actagcgggggcgtgaaccgtcggctatttagctgggataaagcgcttcgcgcttcttgagcttcgctacctagattagctatcgggttgtgaaaagatttggaatttaaaaaaaattatcagcgatttttaggccgcttcgcggcctcagacgggcgcttcgcacccgttttttaaattcggtgatttttaggctgcttcgcggcctcagacgggcgcttcgcgcccgtttctaatttttattgtgcttttcggccgcttcgcggccgttttttaaattgtgttgagtcggacggacgcttcgcacccgttattaaattttgatggactcagacgggcgcttcgcgcccgtttctaatttttgttgtgcttttcggccgcttcgcggccgttttttaaattgtgttgagtcggacgggcgcttcgcgcccgttattaaattttgatggactcagacgggcgcttcgcgcctgtttctaatttttgttgtgcttttcggccgcttcgcggccgttttttaaattgtgttgagtcggacgggcgcttcgcacccgttattaaattttgatggactcagacgggcgattcgcgccctttttgtggcctttttaggccgatttgcggcctcgaacggccgcttcggccgttttttaaattttagaacagatacaaaagtgattagaagaggtacaccagtgattagaagaggtacaagtgattagaagaggtacagcagtgattagaagaggtacaacagtgattaaaatttgaagaaaagtgattagaagaggtacaatcatggtttaaaatgaaataaataagaaaattgtattattggatgtattataaatttatcaaattaaaaaaatccttttacttattaaaaataaagttagaaatttataatatcgaatatttattgaaattgaacggaattaatttctcgaaaattcaaattaaataaaacatttattcatcagaaaataatttaaaataattaataaaacaatattaaattaaataaaaaagtaaataatttaaattaaaacatttgttcaccaaaataatttaatttaaattaaaattttttatttattattaataatacaaaacaaattaattaaaaaatgtaaaagtaagcaaaaaatgcatagtaaattaatgtacaccgcccggatccgaactcccccccccccccctcaaaatgatgtctcagaatccccaatcacacagggattctagggcttaacgatgtcaaacgtaaaatctgatcacgtattcatgatcagcggcccaaattacccctaatgacatgtttttggaagatttttgtgaaaaaattttttcaatcaaaaatcctgtccaccccctttggacccgaatcacaaaatcacttttatttttatatctttttttaaaaatgtgataaaaatttaaaataaaatttatattatagagaaaaaaattgcggatttttgtagtattttacttttctcaaatagcttttcagaaggcagttacgaattttttactgaaaaatctaaaatttccagaatttctggaataacttttttcatattgatgttagaaaacctaaataaatcccataaaattctcctgatttttctctatttttaaagctttatttgctcaaaattggtcaacccttttgctagatatgaattttccaatattagcccaaatttccaaggaccaaaaaattgccaaaaaataaagaatttttaaaatattccaaaaaatctgaaacttaaaataaacatcatatttgtgctcaggaccctaatttaccccagaaaaatatttttcaccctctttttcaacccaaaaaaaatttttgaaaatttctagggggcctagctcgaaaatttttgaaaatttccgtccatatggcacaccattcgatagcatttaaaatgctctacaaaaatgttctaaggcattttttggctaaaaccgacccctgacgagttataggcccgggactcaaatattttcaaaattttaaaatttggaaaaatcgagctcaccgagctctacaataagtctgctggccaccctgcgctcaggtcaaaccctaatgagttattcgcctggtactgaactggccaaagttggtactgaatttctccgcgcttctacagcccttcctattataggtagaggcctggaattttttttgttttttagaaaacacttcaacttagtttcctaccagcaaagactttttgattagagttttagaaaaaaagttatgggccgtcaaacgcacgaaaaattgagaaatccgtccctgggactcagtcgtccgcgctgaatttttttctatagttttcccggattctcctcaaaaagttgtaaaacccttccaccactttcagggcgctcccggccttcggccgggagattttgttttttgaaacgaaaccccttgtcaatataacgtatatataactagcgcgtgcgtgaaccgtcggctatttagctgggaaaaaagcgcttcgcgctttgggagcttcgctacctagatttgatcgaattggttggagagatttttttgaatttttaaaaattattaggggtttttagtccacat

SEQ ID NO: 14005 - DNA, 2315 bp, Heterodera glycines
gatgacacaaatccttgcttaaaaatgattcatcatttattgccagcaggcgtttgctttttgatggagatgagaatgtgcgatgacaaagcaacccaaaaaggaattgaataacaaaagctaaaaatgtgggggaaaaggagaaaatgattggaaaaaagggaggacaaaaatatcaaaatttgattaaaattaatcaagagaccgggtctacaatttcccgggctgggtaggcaaacccgagaatgtcgggcgggtatccaattcagtgtctaattgaaaggcattgttaatagggaaatctataggtcttcggcccaggcttggttttcctgcattcaggccaaggccatttttggaaaccttgggtttttcctggacctgggtttcctggatttttgtccagaaaaatacaggtccaggcttttgaaaaatgtcgaattctggttatggtaatatatatataaattagtttaattttgaaatttttctggcggcatctgtgatcattgatcatcataaaaaagacaattagagtagataaaagtatagaaaaatgaaaaaatttaaaaattctggacaaattttagtcttcgcctgcatgaatcaggcacactaaattaaaattggcaaatgctgattcattttatgctatttgcctaattgaattttgttttaaattctcaaattttattcaaatatacaaataatacatgtttttgtatataaatttgggtgacaattcctttcctttccgtcctttcatttactcttttttttttgctttttttcttcaatcacccatttcgaattcactttttttttctgtccattttcggcttgatttgttggcctaatgaccattgaaaagtgtggtggtcgtcacatgaactgaaattgtgtgtttattattacaaatgaattttcaacaatttgttcatttttgtgggtttgttttacccgttcagtatatacgctataatgatggccagaaatggtttttagcgaaaaacgagaacctaaaccgagaaatcgtccggagaaccgagaccgataccccagaaaagccgataaatttcttgagtcgagagtcgagaacaaagaattttcaaagtggacttttgaatgagatttgtgcaaaaaataaaaacttttctctttttttctttatccccgccgaaaatattcgacaatttgagtgagtgttgttaaaaggatttggccaaaaaccattatcactttataatatttgcagcgattacagtgtatataatttttctttcccagactaaaaagccaatatcgagaagcaaaaacccgagaaacttctcgaatcgagaatagcaactctcgcacatccctaactttcagagaattgggcacccgagaattcagtacctgtttttgaaaacaattggaaaaattttcctataaaaatatatacaatttgcacactttttcatattttttcccttggaatgtttaaatatatttttcctattgtttgaaaatttaccaattgccaatggcaccaaaaatgccacaaataaagacaattggccgacgcggagacgagcagcgaatgacggagtggttttggcgaccggagtgtaccaagaagggtagtacttcgctggacagaaatgaaaaaataataattaaatttgctaattaattataaatttgggaggggattttatgggtttccacttcccccccccccttttcgacttaaaaatccattataaatcatttttcgttttgattccagaatcctctggacgtttttaaagacacagagaattctcaaagtttacattcatattcctattaaatttaagattagttgacaatttattttcccaatgaaaagaaaatccatttttcagacaccaaatatttaaatttatataatatttttgatatttcgagaatcaaatatatattttttcattttaattaatggcttaagagttttgtgaaaatttgaaccaaatttctgaggaatttttatccatatattggcaaattttcagcgttttgtccacatttgcatttttttccatataaatccgctccctacttttttcgcataattttctttaatttaataaatgttgcactaaaagcttacatggaaggccgagagcagacaaatctgaaaatgaaaagaatgacttttcaattgtaataaatttaatgtatagcattcataaatgtgatgcttttcacccatagaaaatgcccatttggaaatgttatataattagggagcctatttgtaagctttccataaacaaccaaaatttacaagg

SEQ ID NO: 14006 - DNA, 1031 bp, Heterodera glycines
  misc_feature (4)..(4): n is a, c, g, or t
  misc_feature (38)..(38): n is a, c, g, or t
  misc_feature (42)..(42): n is a, c, g, or t
tatnaacaaaataagtaagtttgtatgtgtttactacntaanaagcattaattaaaaattttttatttgcctctttttgtgcctattaatgctattttgcgggtttttgtgcctaaattctcatatctctatttatgactcggctactactgaaacgattgggacatgattcatgcatcttgtagagaattcagtaggtgagttgctcatttgcgccccaattaaaaagaaaaaaaaatttgtctgctttggccagagttaaaatgcctcacttaaatgataggaaattacgaggaggtagcagacattgggtccacacaaaccacaatacatttattttttgttttattttatttttttatattttctttatttttttattattttcttgtttttttttattttcttatgtttttttaaaaagatgctctaccgagccaatgagcaattccttttgtggtaagtcgaaattacagtgcgtgtaaatgtgtagaaattgccttgcccaagggctaacgggactgattttattagaaaaatcatcatgcacatccaaataactcttgttttccgtctcctttgacggcataaagcatcagaaggccaaggtccgccttcgaatttttcacttttcgtgtcgccatcgtttttgctttttagtttgtaagtatatgaaatcttaggcgcaaaaaccgcattcctttacgtgtggcccgacagcagtatcagacattgcttgttccacttagcccaagcaatgaatagacgtgtgcagcaagcaggcttgcttaacgcaactttacttacgagatattgaatttcgaaaagcaattagatcattggctcgattgagcatctttttaaaaaaacataagaaaataaaaaaaacaagaaaataataaaaaaacaaagaaaattaaaaataataaaatgaaaacaaaaaaataaatgtattgtggtttgtcctaacttaatgtattataataaatattttttagtatttaaattattttatataaatagctttttca

SEQ ID NO: 14007 - DNA, 4630 bp, Heterodera glycines
  misc_feature (3785)..(3785): n is a, c, g, or t
tttttgtaataatgcataatgctcggcacgtaatttaataccttttagggatgttgccttaacaaaaacccattaaaaagaaagacttcttgaaaatcgacattttgcaaaaataaacagtaaaaaagcaaaaaaaaatctcctaacaaattttatgcattttttagttttttgatataacatgtatacaacatagttttacatataaatagtacctggtcaattgctttgcggacaaatcgttgggttggccttttgcattcgcggaaaacgaccgtttgtttggtgccattgcgctgttggctttccttaggcttccgcccaattgctccttctttttctcctccattaaaacttcagaaattgcgttcaacaaataattaaaaaattcatgtgcgtcttgctgcataaagttgtcgaacaattcttaaaaaagcaaaaaatcttagaaccgtttaaattttggtctttttttaattgaaactaccattttctcgctttaattttgtgacgaatcttttgggagcaattgttccaacccttctcttctgactcgaaatgtttgagaacaaatcggcaaggcaagtgagcaaattatcgcgttgcatcccttaaacatttacaaattaaaaaagactaaactgaaaaattctaaatggcattttcactaatgcacaaaacctgattttttgtgtgtttgtttgtacgccaaaattttttctctgaactgtttgcaaaaatacagagcttggatcactgaatttgcataacaagtgttgccgaactaaaagtgaatgattgaaaaacaatcttcaaattaaagtaataaaataatgcatgcctacatttatgagaccatagaaatgctcgttcgaaaatacgtggtccgcactgagttctttctcaagttgggaggacgcagtggtacccttaagcaaccataataaatacacagactttttaaagaaatactcaatctataccatttttcacgagttactgttgacaaagaatgtttgtgtttacccgctcatgcatccaaatttattttattttttattttgctaaatttttaatcacatgcaacatatacttatttgtagctatgtataatagatatgtataatggaattaggtaaatgccgactcgcatgtcgcacaagtggacaaaaacaaaacgaaaaaacgcgacatttatgggtaagcttacgctcactatgagtcaagcccagtgtgttagacaaattaagtcatttcgccaaaagtgtaattggcgtaattttttgcgcgctaattcaaaaattatactgatttgtccatattggcatgtttatccatattttatgtccatatttggcatttttccaaaaaaacctcaattagaacggcccccaacagctaaattggctttttgaccccgaaaaaccggaaaatttccgaaaaatcattttttaataaaattttctcgaaaatatgaataaattttaatttccttaaaaatcttaaatttaggtcaaaaaaaaaagtaaagtttcgctttctagttgatttttttgctaaaaatgagtaaattttagatttatctatttttttttcttctaaaatgatttttaataccatatttagccatttttgaaaattttactttgatttagcgaatttgaagaaattttaaactcaattttgaaaaatttatgtccatattttgacatttttgccatttatgtccatattttgaaatttttgccattttatatccatattttgctatttttggtcaatattttatggccatatttcgcgattttatatccatatttttggatgccctataatatgtatttaagaaaatagggtcctactttgttagacttcaaaaaaaacactatttttatttcattttcttttatttaagccctttaatttaagaataaaatgctagaacccgttcatcagcggatgctgctgtcccaagaaacagactcattaacgcctttctcggggtccaaatatccatcacttcttgtgcaggcgacaatttgctcaatctgttcttcaaattctgctaaatacaaatgtccgaagtgtttagttcgcacatgttctgttccgtgttttacaacacacaaagagtcgggaaaggtaatctggaaaatcattgacattttccatagctttgtctaatattgatgttgggggcaaatatcaattttagctttgtcttatttttacttacttttattagctttattttgttttgtttttttttacttttttcctttcagtgtgtttttcaatctgaccaatggaagaaaattgaaggcttttccgagtttaatgacgaagtcagcataaatgatcaacaatttattcacagaattgacgaaaaaatgaaaacggacaaaaaaagagaatttattccaagaggttagaggttacaaaataaatattgccagcgtttatgtttagaacaaaacattccaaccaaaattcaactctcaagtgaccaacgatttctcttgcaaaatgccaaaatgcgcagaatttggcttcatttggacgaaaaaaatagtgcatatttcgttgattatgattattagctgtaaaatttaaggttcggccgggtcgcgtcatgaacgtttttccgacacaattttttggacttgtactgtgaaatttgtcagtcggtgctattcaaagggacatggactttgtcaaggaccttctgataaagcagttctggaggtctatttgtagttttcctgtggctatactggccaattcataaaaagactttttatgcaatttcgaccctaaattctaaaatttcatattcgcgtttgaataattagataaatcaaatgctcacttttatacattgacctagtaaaaagtggaaccccttctcccggccatgcggcccatccgtgtccaaacaaattttaacttttcccgggttttctacaaaaaaatatctccagctctcgaatgcggactctgcgcttacttcgccaactcttgtgcatttcgttaagcctattgtcgattataacgggtccgatgatgaagaaatggaaaaagatgcggggaatgattttgacgtgttgcaagccgagtcctcccttaaattggggctgagtcaccacgacgatggcattggtgcggaaactaacaattcggatggctcttctgctgacagtacaggggatgaagacgaacagcaaacgccgttggaatgggtggacttcactgtatgttttttgtccacaatcggcttttcctatttacaattgccaggtggaaaatatcccggaaaacatacgagtcgcaactcttttacgccaatttctacgccctaaaccccacgggcccgtggtcacgctttcgcaaattgacatggtcaaaatggcaccattcatcaggtaagagtacctgctattttttcattagaattttacttaccatcacgtttatttgagtcataaataggaactgaatttttggggcgcactcttacgggcctggttatctgaatgcgtcagaaggttttctgacaatgggtcttcggctacaaaaggatttccgattttcccattagcccgaaaatacttattcattattatttttaattttttctttttagtgcatcaaaatccctgctttcctcgccaccattcgcttcaacttcgtccgataaagaaactgcagacaaaattgtggtgtattggaggtttctctaagcgatgaaattgaaaataaactgaacgatgaccaatcagaagatntaaggttcataaaactaataggttttatagctaattattcatttctaaggtattatgttgttgacccgaatcggactattttggataatttgcgaaacagacacgtgagtcatccattgtacgcataaagctaaagcgattcaactgacaagggaactgtagaatgggtataattttggaatcattgggtacgtgatcgatcctattaaattttaatatacacgcccccaatatcataaattaaaaagttatgagtctcgaaaatacaaaaacaatcattggaaatgttggagaatcattaaaaagaacaaaattggaaatggaatggccacacaaagtcaggcaccaattttggattttttatgcaccataactatttggtttctcgatatggaggcgtaatattaaaaattgcgatagaatagactatttattctctctatccaatggaaccaatttatactcattttccgttcgggttaaggaaggagtagatgttcattttatttcaaagggttgtttggattgcgtatttaattcaatttttatttgcttttaggtcaatggccatccatgttttgtagttgtgctcagcagacacacagaatttggcgagttggaattgccattaatatgcgaggaggaacagaaacatctgcagaagcgaaacagcgaaagagaacagacaatgaatggtcagcggggggagggacattgggatgatgccgaaccataccaaaatgggtggctggtctgtacaccctaaaacgtcactgaaaaaacaagcgccggtcgaaacgtcgcagaagattttttgtttccttgaattttcttaataaaagcag

SEQ ID NO: 14008 - DNA, 1487 bp, Heterodera glycines
tgctaaaataaaacagaaaaatccaaaaatatataattttgattcttcaaagatggaattcttcctgattctcaagcagaagcacatcaaagtgcaggtaatacctgtgagtgaatccattttaaatttaatttcctaaatctcaattgctttaatcctccatcatttttaggagacgtacgtttccgagttgttggtgaagattctcgtcgccgcggacatgttcaaccgtctgcagcagttgctccaatattcggtgatcgaaaaatccaaatttttggcctacgaactgatcgctttgtcctcgcgctgtcccccgctgtaccaaattggattggacatgttgaaaaggcgtaacgactgggaacaaattgtggaggcaagtggaatttgacgaaacatttaatggcaattaattcaaatgttttgttggcattcttaaggtgttaatgacccgtggacatttgctggaggcacttcgctttttgctcaaagtgcaaatggaacggacggtgttcagcaaaacgttgcggcgactgctcgacctgacgtggaaaagtgatgaccggcagctgatgttcaccgtattctcccacctgctccatgtgcagggccgcaaacagttggccgaagtgatgtccagtcagtcagtctcagtcgatgaacaataccggggcaaattcggaaaatgggccttttatattgaccagtccttgggaagcttatctatattttcaagccatattttaagtcaccagcaaatttgtcaatttttgggcaaacctacttgataaatggctctaattattgaatatttaaggtgatgatttcgagcggtacgacaaggagttcaaactgttgtacgacaaaagcgaagttgaggaggcggcgcagcgtttccgcgaagcacgcctctcatccatccggcgccgttccgacacttatgccgcgcgcaacgattcattcacttccgtgtcgggcaatgccgaagacagcagcggcagcaacagcgggggaggacttgggatggataacacgctctaaactgccattttttgaattctattgtacaaatttggaaaaaattcaattcaattatcgttttaacttggagtcaaacaagcgaaggatgaatttaagtcgtgaggtttaacattaattgttaaaagaatgtaaaattttacataaagaaataggcgtgcaaaactgcgattcagaaacgaaaaaaggtggaggttttacgagaccgtcaaacgcctcaaaactaaaatataatacgattttcaaaacatccttccgacgcatccgatcccttccctttgctgctcagctcagcttccgctctatccattggtgtggcagcaaatgtttgcacaacagacaacaaagggaagggaaaatgtgcgacggttggcggctatcggcggtggcattttttgggcggagaatgcctatttttattgaatacttccccattttttattatg

SEQ ID NO: 14009 - DNA, 2167 bp, Heterodera glycines
agtcatcatttgcagcaattctctcccaccccttccgctgctggcacaccttttaagctaatgcatccaaacagggcatcatttgctgaacaaaaacattttcattttatttatgcgacgaatttaaatttataaatatatttctgttttttcacattatatcaattttgagtccgattaatccactgaaaacactttattaggattcatttaaaatccacaattaaaaacttcatttgtcagttataataaaataaaataaaactttttttataaaataaattaacctttccaatggggctttatcttttttgcgtgtaaagatagattttccgtttgctgctgctgatgttttcctcacatttttcttccgctttttctttttcttctgctgccttttccctcctttttctctttgtttattccaccgtatatctaccgtattccgtggccaccatttcaccagcattcagcgactttcttaccgtggcatacggtgacaaaatcgaagaatcaatcgcccgcagggacctcggttcattgggcagcttcggaggtggcaccaaaatgccaatgtttacgcgaaaacggccgattgtcatggtccacgggtgcgaatcgtttaaaattaattaattaattaaaaatcaattagcgaaataattatcattttctaaaagacaatagaaaaatcaacagattgagcacttttgcggcagagtatgagaacattcgacagtactttctgatgaacaattacaccgatgcggaagtgtacgcaagcagttacggacatggcccggtgaattggactcatgacgcgatgaaatgcgaacacgtgcagagggcaagtggggcaaggaaggcgccggaagggggggggcgggggacggcacaatttgctttgggaattaacccattagcggtggtctctttcagttccgttggctaatgctcgccgttgccaattacacaagttcgcaaattgatgtgatcggctacagcatggggtcgccaattgcgagaaaggttttcaaaaaagagaaacagttctgattaatctgagcccctaaaattgacatttctttttggtcggttttttcaaatcgctgctaattattggtttaattacccgtgcaaatgcttgccgtgctgagacgaagtacgaaaagtgcaagtgatcaaattaaaagcaaaataattatttaaaaaattaataatcaaatgttatttaatttaatttaataatttactatttaaaacattctttacataatttaaattttatgttaatcataaacgtgtgagtcgaagtttaaaatttgaattttcttatattttagctttgttgactttggcatagaggctatgaacacttccttaaaatcaatatgcatttataaattttgctataaaatcggatatcgaaatcgaggtttttcagtatttagaaataaaattaacgcaaaatgtgaaaagttatttgatgctatttggtatttaaataaattaaccattaaataagaggctcagcacaatatgattaatataaatatagcgaatattttaaataactaatcatattaaatttaattaactattttttaaattgatcacttgcacttttcgtacttcatcattacaccaattcttgctgctctgacaatgaatttttgaatttttcaattttcggcaatttcgggcggcgtttgcgtcgacaccggcgaacatttgggcgttccgctgactccgttggtgcacactttcgtcggcgtcgccggtgccaaccgcgactgtgtgcatttgtgccgctttttgacaaatgtcaccggcgatgcgccgtgcaattcgatcaacggaatggcgtgccattcgcggtttcttcgcgacattaacaacgcaccccgggggtaaaagagggcgattgaaataaaatttatttttaaaatttactaaattaaagtcaaatatgcatttaattattagccattataaactgctgtctaagacgacagcatttcgaggccactcatcgcgtgtacacaatttactcccgccatgacgacgtggtgggctatttggactgcgatggacttttggtcagctccatccctttgcaggacaatcacattgaggtggaaaaagttcattaatgacctgccaggcc

SEQ ID NO: 14010 - DNA, 3286 bp, Heterodera glycines
tttagtgtatttttctctcacatttgttacatttcgcttttcaccaaaaattaaaaaatgtattttaaaagcgctactgttattttattctttttggttgtttttattggtattggaaaatgtgcatcggctaatgcaaacaacaaaaccaaatcccgaggggcagtaagcaccaccaccaccgccatcaccaccaccacaactgtcaatccacagaagattggtgtgtttcgtttggcatcatctactcgtatggggaaaggcagcgtgactgggaaaccactaaaaattgtcaccgcccacaccaatatcagcaggaacacaaccaccaaaaacaacaacaacagcagcagcaaaatcaccacccctacaacaaaaactgcaaaattggctgtggatgagcagttgccagtcgcaacactcctcccaacattgattcatcaaatgtgcaaggatcgtcccggggaagaaaacttttatcagcaagccgtttgctgggcactttttgcgctctatttaatggtgattgtcagtctggtacttcatcagctttgttctatctgttggttaaagaagaaggaggtgacggctgctcagtatggacagcgcgcagatttcgactattttgaggcaaagtcgggaaaccgaacgagttttccggggctgtttcccaagtgaccagctcccagcgccggacacgctacggtacccagcggcgctagttgtgaacaatgacccacactacaaacaaggatcccattggtgcgcgatttatgccccttcgaagacggaggaagcggtcatatattttgatagtctcacaaaaacaattcctcctattgtaaagacatcatttatggataaatttccaaaaggttttgttacaaataagcacccgtaccagtccccacttactaccacatgtgcaattcactgtatcgtgttcatctatcacatgtccttaggtcacccatttgacgcatttctgcgtatgttagacgctagtgaaagccccgacatgtattctttgtgcattttgaataaaatgattaatccgtatttatgtgtgtgtgccaattttaccaccctttgggaaagggcatagggaatgattgattaatttattataccacggcgcacatcgcgcgctgttggtgcctaccgcatatatacagcgagctcacgcgggaaaggctcacttttttcgtaaaaaataaattaaaatattaataaataataataatgtcgttggaagatcacaattattgcggcgagttgggcggcaacgaagcgcccacaaagagaagaaaaagaaatgatgatgtggagggagagccgaaatttcaaaaaaactgcattcgcactctgagcgccgacaaacagtacagccaaaagttcaaagtgcagagtgtaaagtcgactttatcattgaaaatctgcccgccaaccccgagtcaatgctgcgcgcattgttcgctcactgcatgtcaaccgccctggacgagtcacagcagaacgggatcacaccggatcaattgggctctacaatctcttcagatctgctaaatccgagcatatggattcccatacgccgcatttccgacaacaccgccgactcaattatgaaccgcttccttgaggtggcacagtcaaaatcgcgggagggctctctgtggggctcgccgttcactgtgaccatcacaacgcttgatgttgcgcagctacctcagcggcaacaggtgcgtggcagtgggaaaaggacaacgaattcagtacaacatatcatcaaagagagtgctcttctgcgaatcaacaacagtgatgatgcctattgtcttttttacgctttggagacaagcaggaagtaccacagcaaagagatgagccgacagaccttttctaaatatattaatcggcagaatgggcgacgactggaagacgtgtttggactgatgagcagcgcaaacattcgcaccgatctgagagaatatgacgcggttgtctatgtgccgatagtcgtggactattggaatcggaaatacgccacagcaaaccagcgatttaaagtgttcatttttggcgcaacaggcacctatcggccaaaatttcaatatgtgccggacaattacaacgtcgaaatcccgctctaccatcacaacggccatttcgacggaattcgatgcggggtgggcaaagcggtgtttgggcgtgactactactgcttttcgtgcgagtgcccctacgataatgccaatgatcattcttgcagtgtaaagcaaagtgcataaactgcggtcgcataggagtggggcgaccgtgccgagcggatgacaacaacgacagttattacagagaatgcacagcatgcggcaaggatttcatgagccaagactgcttcagtcaccatttgtcgagcaatgtgtgtcaacagttcaagaaatgcaaacagtgcggagttgtgtggaatgtcaaacaaaaccgacgaaaaggacgcagcggacacgtttgcggtgagaaattctgctacacctgcaaatgttaccataagccggagcggggctgcttcatacagcagttgaaggcgcgccgccccataaagtacagactgatcgcctttgactgtgaaacaacacagaacacgcgaattgagggcgaccgcagacttcattctgtcaacttcatctcatgctatgtcgtctgcaccaagtgcataaacgaaaatttgtggcgaaattctctacaagtgccatgctgcatttgtgggcggcagcgcaccgtcacattctcccaccgtgcctatgaacgcacccaaaccgatgcccaattcatcactccgtgtccaatggcggcctttgctcaatggctgctcagcgaattcgatccgcgctatcccacaatgctcttcgcccatttcgggggtcgctttggcaacattatgctgtttcggcagttcttcctcaacgagttttgtccacagatgatcgatccgtcggggtaacaaattatacgaaatgaaaattgcgaggggcgaaaaaaacccggaaatcatcgtaagagacagctggaaccttatgccggtgccgctcggcgctctgcccggagcgtttggactcaatgtgcaggttaaggagttcttccctcatttggcgaatgttgagacgaattatgggcacattctgcagtcgctaccgccaaaagctgactacttatacggtggaatgacgcccgaccggcagcgcagatttgaccagtggtacgcagaacaccgccatcagcagttcgacct

SEQ ID NO: 14011 - DNA, 1020 bp, Heterodera glycines
agagtattaagagtggataaatatgtattttatagaaccttacacagcatagaattgtatagcaaattcgaatttttgttatttaagattttcttgagaagtatctttaaagggggtggcatttaatgggctcgaataagtgagtaattaagagtggatgaatatttgctttatagaaaactacacagcatggaattatataacagattcgaattttttgttatttaagcttttcttgcgaagtatcttttggcagattcgaatttttggtatttaagcttttcttgcgaagtatctttaaagggtgatggcatttaatgggctaggaaagtaattatgagtggataaatatgtttaaaggtaatgtccaaaattattcaaaaaaattttttttgctgaactcacaagaatattaattttaaaaaataacatttctaaaaattgctaatattatgtcaatgagcccaaaatggaaaagtttgcaattattttcttttttgaaaattaataaattttcgatttatttcatatttttcttataaatgatttttattgctattttttgccattttcgagaattcaatttggaaatatttatgtgaatgttttcaattatgtgtatattttacggttttatttgcttataatttgaagccatatttattattaggaaccagtgttttggctttattaaaagcatatttttcgtaaatattttggcctttttagcattttgcaaaatatgtcggcatttttcgattacttcaacgacaatgcactgcaaatggccgatcaaaccttttctttaaatcaccttaaaataaaaaaaatttccaaaatttacccacaaattttttttttataaaatttttatttaaaattttttactaatttacgtaaaattcttatcattgatcatgattttctttcacaagcaaggttggttagccgctctccccctgatcaaactcgaaattgttttgaataatttttaaattatatcatcccgtttttctgcaa

SEQ ID NO: 14012 - DNA, 1681 bp, Heterodera glycines
  misc_feature (94)..(94): n is a, c, g, or t
  misc_feature (1670)..(1670): n is a, c, g, or t
ggggggggggggggggggggggggggggggggggggggggggggggggggggggggggggggggggggggggggggggggttttttatagatancaataagcatctcgggtaagtgttgagaggaattgaaaagaatgaatgttaggctaatagtccctgggaataaatttatctgcacaggggcaggggaataatgaaggggggggcgtgaggtggtatgtggaccggttcgagagggttggttggggtgttttcaagggaggatttagaaaatcaaaaataggtgcgagaaaagggtgtcgcaggtcctctatggctatttctttgtcgttatttagctgctgcaaatcattagtattggtaatccacttttacggttttaaaacccgaaagattaggaatctcttagacttaccgtagtgaaatttatttctgagagacaacacaacttggttttaaaaaaagttataaacatttgtcagagtatatttgttaccagggtcaagcatatatatttatggattgtaaagtccttaaaatgtttattcagtcaaaatgaatttatattcgatagccctaagaattctctattaaacattaaaatttcaaaaaatttcattgagtttcaaaaaagttatggccaaaaattctgactcaagattttttgaaattttctgaccataactttttgaatattttattaaaaaatttttaaaattaatattccgttagagaacatctagagctattgaatgataccaagaattattaatttgattgaatttaagccaagttatgaatttatatgtcttacatttttttttgttttactaccccttggcggatttaagaaacgccctggcggatttaagaaacgcccaatgtggcggatttaagaaacgcccaatgtggcggaatttaagaaacgacccagcacgtgcagtgagttgacgcgatgacattttttgcaacatgttgaaaaaattcaaaaatttacactaaagtaatctgtcgaaaaataatcccccttctccattgtcctcccgtctctaattatccccccccctttctgaggaggttgaaaaataaaccccccgggggataattagagaatatacggtattttgttttaaagtatttcgttttcgacaatttaggtaagtaggcactacacaatatattatcacagcaattgtttttgtttgatttgcaatcactcatcgattttgcaactttcagcattggcaaaccaaatataataatttttttcctttttaagctaaattgtactaaaattgacctcgcctcaagtgagatatgaattttcaaatgttttacgaaatttcaatcgacccaaaaattgaaaatttttcaagaatttaaaaaaatttaaaatttatgagacttaaaattagcttcatttcgtgctaagtacttcaaaatataccagtaaaatattttcacctcctctttggcctaaaaaattttcgacaattgcttagggggcttagctcgaaaatttcaaattttctaggcgtatagttcaccactcgatagagcttccaaagctctccaatttcactcagaggagatttttcgttgaaatcaacctctttcatctaaaatagcacatgataaaaatgtttttcattttttcaaaaatattctnttaaatattta

SEQ ID NO: 14013 - DNA, 1190 bp, Heterodera glycines
  misc_feature (21)..(21): n is a, c, g, or t
ttattgcgagagctgaaaaantcgggagatttctcgcttcaaggcaccgaaaggtcaactaaactcaccgcttccatcgcctttgtagtgaattcgtaagctttcgttgccaaaaatttcgagctcgttgctacaagcggtgtcttcccagcaattttgctgcgggttggcaaacttctgaattttttaaaaataatttgaattttattaaagtttcacctcagcgatattctgacgaacatccgaatggacagccgttaaaagttctgaaaattgaaaaaattaatataaaaatctatggaaatattcaacgcctaaatttttacgttacttatttgaaatatttttattgttttattttaccattttgaaatctgtccttcaaaatgccaataaaattgtccaacaccgaaaatttgtcccaaattttcttttgctgtctgtccaacacttcaacttttgttttggtggcatttgccatcatatcaatttccatcttcaattggtgcgcgaactttgaaaaaaaattgttaataaagcaatttttcaatttttttttaagaattattttcacctcgtcaatttttgcataaatttccgtttgttgagcattttgcatttgagaaaacaggtcaactaaacaaagagagaataatgaacaataattaagcgttaattagtaaagcaatttgtcatttccgccaaattttacttaccaacaaaattttccaacgacgccattttttcacataatttttgttgtgcggtgtccaactgttccaatttctgcttctgttgttttagcatttcgctgacttgaccaaaagtttcttctaatttctccacagtcgcttaaacataccgtaactttatttgttttggttcccaatggctaccgtaagtttccctaccgaatttggcggcctttgcttcctgtttttgttgctgctgcatttgttttaattgtttctcgagtttttcagttctatccaagactttctcaaattgaccagcagacactgaaaagggaattcgaattttttggtttatttatggcattttgttctccgttaaaattatttgggaattttaaaatgcgacaagtgatgtatttttaattttccaaaatttatttaatgaatttttccttttcaaattttccttatttctaccatatgcgtttacttacc

SEQ ID NO: 14014 - DNA, 2551 bp, Heterodera glycines
tttatcccaatgatttttgttatctttcaacaaatgcaatttttcaatcggaaaatggaaattatcggaccggccttttaccgactctccaaaaaaccggcaaattgatcagatttatcattttaaattggtcagattttgtccaaatttgggtatttataatttattactttttaatgcattgcgttattctcttaattttattccattttaatttctgtcctccaaactcactttctctctttccaatttgccaattctccgttcagcgaatgtttctttgttttccaacacctcacctttcacttcttctgaaatacaattaaacatttgaattttatttaatttaattaattttcaatatttattttaattttctctttaccctcatctgctgctggtgtgaaatcgtcgttacttgttgaattaaaagaaatcgacattttaccagtttaaaatctcttaaatatttgatttagaaaatgccatttctatacaattctttcggttctatttcaaattttcgaatttctcagtgttggtctagaaatggttgaaatgatcttttattagagggtttttgacttttagtttacttccttccctatatacatatgtcatttaagcccaaaaatgagaattataaaatttgaattttcgactttttacccggatccgggttcggggttcgacataggtcggaattaatgtcagattcggattatgcgaaattaaaacccaaaataatcttttcgactcgtaaataaaatttcgattaagtggatcaaaagaaatgcgaaacagcagagatgcaaaatgaaagccaaatgaaaatgaatgatgcaaaacgatgggaaaattgacggggggggggggggaagataatcaaataatcattagtctttcttagcttactgtatggcgcgcaaattcaaataaataatcaatattctctacccggaccgaagcgacaattaaccgggcccggtcttagtaattaacagtgctttttttcaatttgtggaatgataatagggatggaaatttattaagttaaataacttttttttccagtgactcgattattcagcactttgtttcaaatatgaaaaaatataaaaatgcaaaaatgtaatataaatgccaaaatagaaaaaagccatgcttttcagaagtttcaaataaaattaaaatgctttttaattcattttaaaggtattttgaaccagcagaaaaaaaatcatttgacttaaattcccattcctattttaaacttaggcttatgacgaattttacccaaaagtactggtgaaatttaagaaatattaactcttattttaaagttaacgttgggctctgaattcagtgatttttgtaatcctatataataaagttgagtgtttgtatgtgtcactgtttgaattagtgtggtgttttgtttgagttttgcgttaaaaatgaatttgaaaagagatgaaaagaaattgttttgaaaaagaagagaatataaagaaaagagacgaaaataaatagttaagaagaagaagaagacaaaagaaatagcacagaaaaagaaggtaaaagatttctccttctaggatgtagaggttagagggagggatggtgggaaaatagtgcactgtctgattgtctgtctacgcgggcagcggcgggtgagaggggcatacagtgaacagacgcgtgctgctgtgcagcagcagtctgttggacgcgtgcgtgtgtgtgggagaaggagggagtgggaaaaaaagagagtaaattgcaatggaaaagaaaagagagtaaaagaaaggaaagggagagataatgggaaatttgtctcgcatcccttccttatttataacccatcttttattatataaaataattaataaaataatgagcacatttttgtgtttgtttgagtggaaaatccggtatatgaaggttctgtttttgtgtgtaagaaaaaatttatggttttgctgttattattattttttgtctaaattttcgtttttgttaattgatttccattttgatgtgaaagcttttgttttgtttatgtaaacgataatggagaattgtttgattaaaaaaatacattagaattcgtttgaatgaaaaaggtttgttacttaaaaaagttttttgtacttttccttgcttataatatgaaaagaatctgatttggtttttgatatttgttttgaataaaaagcatgttatgatagtaataaaaaatgaaagaaaaatcctttgatggatagaaaaagcaatataaatgctacatctcatgttttgctctgtgttcgtagtggtaatattatatatgcagattgggagtattgtacgtgcctatttgcggcgatcagaatttaggtggaaagttttaaacaggtcagttttaatttgaatttatggggtgggggcaataattatacaccatagtgttttgatttatgggttatatttcaatttctggattccttttaaatagttctgtattccgttgctgaggttgagttccgagtgattgaaatgtcggaga

SEQ ID NO: 14015 - DNA, 1302 bp, Heterodera glycines
tctccgaccccctggaaacctaaaaaatttgaaaatttccttttccaaaaatggttggactcataaagtgcatttagaacatcatcatatatttcaatttccttttgcaaatttcattgtttgtgcccctcaagatcgttccatacttctcgatggttggaatgccgtgctggacgagtctttgctgccgttattcaacaagaaaatgaatatggccgagacgtccgacagcaaacggttcaaacaattgcgcgaccttttgtccggcaaaatttcggagaatggccgttgcgatgtcattcttgctcaagcaaaggcattcttcgattttgaaaaatggcaatcatactgaagaatgggctttctgtttcccgcggtttttgaggctgctgattacgaatatgaactcggatttcctcaattccgaaccccgggccggaattcgaaaaaaaaattcaattttttcaaactaatttgaagcttttctacagaaaaatgcatcttttgaaaaaaaaatttcaacttttttattcgaattctggtccggggttcggcaattggacaaatccgagttcaatgattcgtgatcgtcgccctcgaaaacctctaaatactcatttgagaccaaattgaaaataaaaaaaaaattttaaattaaggacccccattcttcaggattgccgaaaaatgtttcaacagttttaaaaccttaaaatccccatttcgtaggatcatttgaatgaatttctcttcggcgttttggacggcaacggcggcggcaaaccctgtgaagatgaggcggagcttatgcgtcaaattgagcaattagaggaggaaatcatccgtctgagggctactcttgagacttagctgcgacgatcattggaaaattttgaccatttattgtattgacccactcttgaaaatggtctcggtatgctgacgatggtaccccccccccctttcggaaaaaaaaaattttttttctagaattaaagttgttttagtggttttcagggtcggaaaatccgattctgacatcaattttcgatcactttcgaacaccacggacccggattcaaacaaaattcaaattcaaaaattttttattcaaaaaaagggggtaccctcgacagtattaccatggtcccatttcaaaaatattgccgcttttgtaaattttatttcatttttcttttccgtttgcatcataatgtctcctttccctccgagtgccaccgatatcttcagttcttctggatgccattgacaaattaataaaacatttaaagcggaccgatt

SEQ ID NO: 14016 - DNA, 2916 bp, Heterodera glycines
  misc_feature (2887)..(2887): n is a, c, g, or t
ttttgcattttttttaaaatattttcttcaaaaaagttacaaaagcatacattctaaagcccgatggtctaatccgtgtgtttgaatttagcacaaaatgccggtgcccgagtttgggctgtccgcactgtcggccaaacaactgttttggcacgagattgaggagaaggtgtcggcacggaacagtgaccatgtgttggtccaccggtggacgggcacaacggacgccgacttttggacggagttgggatgtgacatggatacaccggtggtgctcacactcgaggccattgaggaggacccgaaccatatcaaggtttaattggatacggaatttacagggttaggtaggctcttatatgggttgtcccccataaattaaaaaaatatatgatttttaaagagtcgcatagaatacttttttccttaggtttccgtggtccgctaatcacgaatacggcatctgttttgacccatttctctagacccgaattcgaattgaatcgctttgtgcaaaaaatttgaatttaattgaaaatagagtttttcactttttgttcgaactcgggttcggagttcgaaagagaggaaatggatgttggattcgtggtcagcgacccccgaaaacctaagaaaagatgtactcaaattgcggcttttatgcctcctaaataattttttttgcacaaaacttgcgcttttctcccttttttttaatttgggggggggggggcggccgcataatggaaaagtaaccaacaaaaaaaattttttttttttgaattgtccatctttcaaccaatgcgctagcatattccatgaattcgttatttaggtatatttttttaatcatcaatattttgcagataatgttcagctgcggctccaagcattcggccttcattttcaaactttgtcccatcatcgaggatgcttacctgatattctttgtgccctaccaaaaattcgtaatttttttttgttattgttgaaaaacaaccattttttcattccaaattttcaaactctaaatttgttggaaaattcagagatagttatttggctagagaaggtggcatgggttcaattggtttgagcattttatctttcacggaacaaaattttttttttttgttgcgcagttgcgaccgttcacgcaaaaatttgcaggagaggggaaaatgatattgtttcgcaactcgagatccaaaaatgaaacaatttataattgcatccgaattatttgtttgctttatgcaccttgaaacgacatcgcaaaaaaaaaattttttttttaaattttttgaaaaacaaaaatatattgtactagtaaatgaaaacaaaattgctaatttcaataaataacgagaaaaaaaaaattcttttctctttaaatttgttttttctaaaaaaaatgttttttttttgcgggagattcattttgtctttttggcatgctccgctaaccattaccctgtttcctccattttttttctccagcgtgacggccacctgagtctgctgtcctcgctccactttctggaggagtacatgggccgcatgcgcagccgcacgttcgtcgccgagcagaaccaatgcatcatctgccaaaagctcaccgagctggtgttccagccatgcggacatgcaacatattgcaaaaagtgtgagcgaaagtcggccaaggacccgcgctgtcccatctgtcgtctgcacggtttttatttttgcatatttgttttggccaatgcctagccctggatttgaattaaaaaattttttaaattacatagaaggcggtcggtctctttcgggttcagaattaaataaattggataaacccattttcgtacattgattaaatgaatttttggtgaggtcttattgttacaggagggatacgaataaggaaaattgaaaattttcaaccgcaaaaattttttaaatttttaacagtttacgaccggtacgagtaccatctggcgcccggcccgcgctgcgtggtgtgcccggcccggttcggctgtcaccgcatggactgcatggtgttgccgtgccgatgtgtggtcggctgcaagcagtacacccagttggctgtccagccgggccgtgacccgtgcccggcatgcaatttcgagccggtggaccagctggtcaaggtgtttgtccaacaggaacagtagcaccgggcgttcagcgagtgattaattgtaaagcggcggactgaccggggggggggggaggcgacggcactgattgatcaatttttgccttctttcttttttgttgcaattttcctattttgtttcgtaggtaaaagtggagaaaatgacggagtatgtgtatgtttatttgaaaacagaaatgggaatctgtttgcaaatttgtagccataattttcaaaaaaaaaattttttttttttttttttgctacgggctcggcttggaaaattccgtcttctaccaacccagtcggtcacgttatattaaaaagtttttggattggataattgaaactgtttccttcgtatgcaaaaacaacaaaatttgtcagaaatacacaaatttttgtataaataaacatactccgtcactttattctgcacttttctcatccaaattcctattgttgctgttgttcgaatttacgggaaaatgtcgttaccaattcattccatttttggtaatctgtagtttgcccccccccctttttggaaaaaaaatttaaaaaaaaattttgcactaaaaacaagtttgcagaggttttggaggtcgctgatcacgaatccggcatccatttccactctttcgaatcccggacccgaattcgaacgataaatcgaaaattcaaatttttgaatttcgaatttttggggcggatatcgantttaaatacacgcaaacgtctaaaagtta

SEQ ID NO: 14017 - DNA, 1551 bp, Heterodera glycines
attttagcatttttaaacatttaaaaatatttcttccacattaaattatttttcatttctccaccagccagaaaactatttttcaattttcgcaatttaatctaatctattttggcttttcatagacaaaaaccattcaccaaatccttgtggcgattttatttatttttttttcgtccattacgcgaaaaatattttctgtttttccattttccattattatttttttttaattgtataaaagtgcacaccgtccaaaatggacggacaaaacgcaaaataatttgttgcacatgaacacccgaagagcaagcagcacataccacataatttgtacaatctgtgcatcaaaataatgaatgaatgaatgctttttcgccgccgtttattttgcgggaaaatccgtcgccgcttttcctttttcgatgggtccgtttttggcgcaaaaagtacgcgccttttcattccgtccgaaaccaccaaaaagcccccccccccccgctgtcccccgagggcaaaaaacacgccattgaacgcacagcacaacaacaaacaacaaaagggggtggtgcccggagggtgcaaaatgggcaccgctaatgtcatcattagtgctcattagcccctccggttgttaattggcttaaacaacagcgcgcttgcagaagtgaagaacacaaaaacacggatttgtgcagataaaaggactttctctcctggttttcactcaaattaatttggtattgcatagtgttgggattttaacggagtgccaattttaatgtttttacattttgttaaaatttaaaaaaatcggaaagggccgggatgtttcaaagcctaaaactaaggccaaaacgcaaaaatatttacgtcaattattaaatttcttaatattatctaaaactatcgcagcaaccattgttccatcctgaaaattccaataaaattttttacattaaaaaaccgaattttgccgcagggaaaacggaaaatttctccattttataatacaaaaaacaaatagcttttgcaacgaatcacaacgaattccggtgggcgaaaacgaacgaaccaaaaacgggggcgcggggggggggggcaaaagcgacggagaaaagtcgcccgaggcggcgaaagcgcttcatgtccgccaaaagttggcgaaatgtgcgcttcatctcatcccttctcatgcccatcattatcatcatcctcttgaacatgatggagaacatcttcatcttcatctgctcacatcccatcccatccttttcatattccacaaccgccgccgccattctctcattaatctgtcgccgtcgccgtcgccgaaaaattgcaacgaaaaccataacgctcggccggcgccaactgttaaacccccaaaaatgtcaattcccagtatttatgtaaaagttttgtagtggaaagctttctaaatttcttaaaatgtaaaaaaatccgataaaatttgtgtcatgggattagctaacccctaaaatggcaaaaaatattaattttctggcgaaaaacggcgaaaattttttt

SEQ ID NO: 14018 - DNA, 2422 bp, Heterodera glycines
ttagttttttacacacaatttgggacagaaatacaaaattttttccatttggacagaaaccccaaaatttggtaccatttggactgacatttgtgatcatttggacagaaaacacacaattttttgcgcaaatgatataacactcaaattggctaatagaacacccaaatgtccaaaaaaagataaatcattaatttgtctctttccgttaaatgagttctgctggggctgaacaactggcgacggcaggtttttgaacacgaacagtggcgcgatcactctgtgatcagaccagtcagcgatcactctgatcagtctgcgagcactttgatcagtcagtctgacccaatcgacagccctctctcccctaatgggtggacagcaggacaaccaactgatcgatgatgagtatcgacgcgatttcttgtttttggcttttgtggacggactgttacacattggcgtcacattgttccgcctgccgcgtcggggatataatgatatccatcagtttatcaccttctttccaactgctgggcaattattattataattatcccctcctaccaccagttgatttttgttgttgcgctgcacgcgatcagatcactcatttcagtaattttctgtaaaaaaacagctaattatcagactacagatcattcatttttgttaatctgctattctgtaaaaaatcagctattattatcacgaaaacttgaaccattcaatcacttatctcagctaattagtgttattagttccattgggctccaatcactgaattatcagttttaattcttatcacattcaaatttgaactgatcaatcactcaactcagttaattatgattattattacttcattggtttccaatcactgaatgatcgctgctcagcttaattgctaccacattcaactgaccacttaattgaacaccttcagattagtgatcaaatagttaccagatcatttaattttatattgaaacggattaaaatcactcattagtataattattaccacataagatgtggctaccgaaatcggattgtcaggaaatatgatcacaaatatttcactaaccctgatcacattaagcagctaattataagggtcagataaatgactacaaaattccatactgatcactgaaatattcagataataatattttcaagatcacaagttttagatcagcccaatttttaatataaaaatttcacattgcttattatttatttccactaataatgtctcccaatcattgataatttagcccatttatgaatttaaaacttccttaatcatactaatttgatcactaataaattttcaatcattgcctcaggcaatctgatctccaagtctcgcgagcaccaaattgcgcattccaagcatgccaattaaatttcaaggtcattactgactaattggtttcagcgactttggtcagctaatggaccattaaaaatcattttgatccaaaacccacgacaatggtcacataaccaattctcggttttcttatcattggtcaaggtcactcttctaaattatgccgagaatatccctttaaatatcccaaaggcttaatgatcagttagatcagtccctatataatttcatataactaattgatcaaaggatacttccaagaagctaactcagcttcggacactgatcagtcaaaaaatccttagggtttcatcgctttctcaggcattgatcagcaagcagactgatcagtgatcggataaaccacattactaactgttcagaccgaccaaactgatggcctcgtattttcataccgatccttgatcaggaccaaaaacccttgcaaatttggtggggacaccctgttaatgcggcgccaacgtcaccaaccattcaacaaatccccccccccccccccctaaaaagcttgcttttgctgccgactgatcaattgcgcgacgctgctgcagagatccgtttgtgcgctggtgtctcttgtaccatttgagcgcactgatcagcggaaatgtcgtcgtcgagaaaaaaagtgatcagtcattagaatggcagtggctaaggagcggggggacttaatcccactacaaatgtcctcaataaggctttttattcataattattctaacagccaaatattgcgcatcaattttcaccgaaaattcctgatcactttggcccttgaattgctgttgatgagtatcctattaataaggtcatgcattccctgatcatgaacaatcgacatttttaatacctttgtaattcccgaattgcctgttaccccttctggtccgtgactggacaatccgacagtggacaatcggacagtggacattccgacagtaaaacacacaaaaagatattaaaaagccgtcgccgaagtggaccgattgtgccataatc

SEQ ID NO: 14019 - DNA, 1344 bp, Heterodera glycines
caacgaacagttcaaactggacaaagtcagtgcaatggctgacgaaatgcacaaagcgttcaccgacggagtgccctttccggtgcttaaagttctcgaagtgagtaaaataatagtagtgatttctcgaaaatatcatgcaaatgtcaatagttacgtgatttaattttaatcaaaatttgtgtcgcgggacaaaaaaaaagcatttttagtagatttttgccaaaaattaactagttttaagcatatgtatccattttttcaatttaatggaatttggtggttcggcaatttcaccggggaaaattcttcaattttaaagaaattagggaacattaaaaaatccatggaaatttaacaattacgagttcgtcattggatgccaacaatatccacgtgaaataaaacttaacatcttaacattctcaattacataaaattttcaaagtaaggacaaaaaaaataaaattctgctttatgccaatttatgcattttgcatccaatttcagtacttttctatgggccaacaatcattcgcatggggacgacagtttcggaacgcaggcaacttcactggcacaatgctttggttcgattaattttctaatacatccggacaatccgtcagttaaaacttgatttttcggcaattaattaaaaatgccgaaaatttttttaggatgatatgccattgagcagtttcattgaaaaaaatatgcagagaaaaatatatgacattctcactcgttaattagtttatcataatttaataattaaataaaataattttaactatttaaaaaattactttttttcatttatttaatatttataaaaaataaagccattttcgttatgtttatggcgcttttctactaacagattgccctcgagccagttaaatttctcatccataaaataacaaatagtttttctaaatttacacaatattttattactaattaaaaattaatataaacaaaattccgttcccaatcttttaaatttgattcccgacatattagcaccaattatcagaattgaatatgaaattatcacagggccgccttcttcgtgtggcttgtccagtgccttttgctgctctttttgccgcaccattttgccaaggccggcatattctgtggcctgttgacattgttggcggatgtggtgagtcagccgcccttttttattaaaaaatcatttttaatacaataatttaaattgtgttcttggcgagttcgaaacagcaggatacgaaagaatcccgagtttcgacatttttgggccccggaattccaactttccaaaattatttggacttcagaatccattcctggctc

SEQ ID NO: 14020 - DNA, 2375 bp, Heterodera glycines
ctttatgcactaacaaaatctgtggaacatttcgcaatgccggagacttttataaaattaattataaaatagaatgcatgccgttttgtgcactctttcagctgttcctggtgttttgcccgtccgatctgctgatccctttcccgtctgctgatgcccccgcatcaatcgcttttctccattttcggcaagtacattcctcccccgggggttgttttttgtttttccttttaatacttcggcccctcccttcccgagaacagccttggtgcctgcttttggatgagcatcgcagcaggtcagtcagtgtccaatcactgtttttgtgaatatttttgttaccaaaagtgatcgtacatgaaaatgaaaattctagtccctatctccccattcaatatcaatgtattttaatatcgatgaccatttaataagttctcgatcaaacagatagaataggtcaaaagaaatattccaaaaattagtaattagtaatgactaattactaaatactgttttattgacaataaaactcataaaaaattgctaatatgaatattaaaaaattgcttaatattttaatctttcccgacttgtttcagccattctcgagttgctcttctctgccactctgtgttctctgcaatcacttcgtctgtactctctgaacaccgttctttctgcttctctggacaactctgtcggcccaccaaagtgccgtttcggcggtggaagacaaagcatcgacgccgaaaatgggcaacaccgcggcggtagtcaaaagcgccgctttggccatattttgtcgccgatcactccgtgcccgtctggcaaaacgtcgttgactctgtcccactgttctctgaacaattcatcgccagccgtctcgtcacgaagcactgcccggatcagtcctggccgccaccagcgcacgttcgtctcagccccgctgtcctcctcctccacctcggacgaagggccggtcagcaacagtgcggacagcaacaagcaatccgttgcttcgtccatcttttccatctctggcacgtcgtttggctcgacggcaccgccgacaatggcgccggagagcgacggcaccggcagaggggaagtgaccaacagaagaagcagaagcagcctgatcagcagtagcaggagaacaaccgcagctgatcagcaacaacaacggattgatatcggagacgacgaagaagatgacagtgatgagctgatcagtgacgacataaagcatttcacaatgagaagtggggcaaaaggggaggactgttggcactgatcgaacggaggtgccaatgagtgacaatgaacgggtgctaatcgatcagacagtgccgatgccggtgaataaggaaacaaatgaagaggaaaagctcagacggataacaaacccaaaatttaatgccaattagacgggtaattaattcatccaattatttcatatgtaaaagcaatgtgaagcaggaggagagtgagcacgaaacgaatgtttcttctcctccctcccctcaaattagcaattatctcaccaaaatacaatatatttttgtactttgcttttcattttttgcaataaatttgaatttataaacagtggcttactgtatatttctgttcgtactgtattacaaaaagattagtaaatgggaattgcttcggcgagtttctcgtaactagagaccgaagttttgaggcatatgccttttttctgcgcacttgttccgatatattaagcataaataacacattttccacttggtttgaagcttcaacgttgaattttattatgttttttttttgccttttttgggattttcgtgccttaagtaccttttttggcattttgtctttttggtgcctttttggctttgttccgaaaattccataaaaaatgtatttaaatttgaaaaaaaatttcccggtggcgcctaccggcaccgccggaccccaatttagccttattttttttaatttaaaccccaaaatggcaaaaaattagtcgtttttggccaaaaggggatacaaattcctattttttgctctccaacctgaaatttccaaattacacttttttcacgcttttagtgccttttttgctgtctctactcataactcaatgaaactaatttatcaattacctattttttaataggataattttttacgaaatgattactgctcactgtttagaaccggtgtctaaaaaagttctaaataaaaaaacaacgaatttttagtgattggatttttattttttcaaatcgaattattcattaattcgtcattggatttcgaaagatttgttcaactgacaaatgagaacttttcaatttacagaacaaattttcataaaaagacca

SEQ ID NO: 14021 - DNA, 5280 bp, Heterodera glycines
aaaattaattttgaaaatattttgtaaaaaatattttagaattaaagaaataataaattttcggtttatagcggtcataaaatcctacgtaatattttgatttatttgtaaaatgaaaaataaatatttttctggaaaaataattaaacatttaagaggaaaaaaattgtccaaatttttcgtcttgatgcaatttattgccagttttaacggttggttccaaaaaaaaatttgaaaatttgagccacatttgttgagagattttgttcaactatcaaaaaacggagtaatttagagctcgacaatgcgtaatacataaattccggaattcagtacaaaagcccttgaattcgggtccaaccgattgcgagaggggggggggcagcggcgagcagacattcttttttgcttttcataaccctttttgcgggatgagctttttgaaacaattttataaatttttgtttaaaaacttaagttttgtagtttgtaagtatcaaattcttagatttattgtaaatgttgaccgatttccaatttcttaacagattttgcaccagaatgggttcgtccttcgatgcacccttaataatttgaagcaccccactttctcattgttccctatttcgccatttctttttccttcaaattgcaattgtttaaattatttaattttaattttatttaattttttgattttttgtcaattttttgcgatttttgggtttattttctttcatttttcattaaaaaaaattcaaaagaatttgcctttttgtcgcaaaataaaacccaaaattttatgtttcctaatgaataaccaaacaatccaacgaaaaagcgacaattagtcataatttgaatgagcaatgatacaacaaaatgacatttaaaaaaagagtttggaatggaaaaacggagaatttacggagcccaagaaagcatcgttattaaaaaacataaaaattaaattgtcgaaaatatttttgataaaattcagagaatgtccaatattattttttcacatttcccatgggaaaaattgaaatttgtttttgttttgccgtctttgatgtttctttctgttatttataaaaattacagtttttcatatgacaattcgacgttattcaggtcattcaattaaaattattcgtgtttaatacctttttaaaattctaattaataacttaattagtttttaaaaattattaattttagaaattaattaaaagtcaataattaagggccccactaacaatcttttcctttttggtgccgaatgtatctgttcaaaaatggcaatattctaaattcttataaaattttttgtcttatgtgtaataaaactggtgacttttacattccttttattggattttattaagaatttgacagaaattaaatatataaactttagtttatttttaaacttaaatataaaattggccaaattaagtcaaaacactcaccgaaagattttttgtatcataaatttttttttcgtttttatccaaattaagcatttatagtatgttcgatagctcaatgtgttattattattctgccaaactttttccaacgcccggaggagcaaaaatgcattcttataattcatttcataattaataatttagctttgcctatttgcaaaacaatagcggtgaattatcatcagaagaatgctttggagaaaaggtatttaatttaataattttcaaacaatttaaattattaagatggtttacactttgaaaatgaacgactcgcgaataattcgtggcaaaaagtttaattgctcattaacatggcttttggagcgctacaaactttcagacaaatacgcaattaaagagaaaattgaagtctgttttttaatttatttttaatttatttttattaattttaatcatttttatgtcaaataccctggccatcccaaatttgtgttcgtgacagccgcaaataataattatttcccttatcttcggacgttcattgcaaatattaaagaaatatttggatgccaacagaaaatcattgcttatgatttggaaacggtgacaaaaaacaaagaatgggtaaaaaaatgtttaattttactgtaatttaaattatttttaaaataaaatattttaatattaaagaaaatatttaatttaaaaatttaagaataaaaaattttattgtaatccaactaaaattatttacctatattaaaaaataaatttaattcattaaatgaatggataaaaaaattttaatgtaaaattaagaatttattcaaaaataatttttaaattaaattaattcatttaataataaatcagctagttcaaacttcgtgaaatttttgtacttaaaaatccgttttctaataatgtttttttccttatttctgaagatgaatgaattggattcggtgtgcaatttcgaatggcgaattttcgatttcggtcaaatggtggaaggacgggttcgccaccccaaatgacactgtcgtttggattgacacttcagtggttttccataaaaatgatttcaaacgattttttgaaccgatgcaaaacggcaaaattggcactgtgcaaatcccaagctgtgagtgaaatgaattgaccttttaaagttaatgagtgaattataaactaattatcatttttttagttgctctccacacaatgaatatgtcaactcatcctggtaaaaaaaaaaaacattttcaatggccttactttgtaattcaccccatattcccaggaatgtacgaatatttgccaatgtacaccaattttgagccgaacagaacatacgaactgattggaacttataagcccatcatcaaaaccgacccgccacagttcgagacaaactttgtgattatgcacaaatccgagcaaacgcggcaagtgatgaaatggtaaagaggcaataatttggaaattaataatttattcatatgaaattattcatttaatttagaattgaaaattaattatttctagagcccggacgggcccggcgggcttttaccgggcgtcccggtcccggccccgtttttttttggagaaaaacgggcccgggacgcccggtaaaacgggcctttttttgaacgggcggcccgccccggtcaattttcgaagcccggtcccgggcccggtcaatttgaccgggctaaaacgggcttaaattccgccagcgaaactgcccaaaatttaaataattattttggcgaaatgtctttaattcaaaaatttcaatagaactttggatttttgaaatttttgggcaatttcaactgttaaaaagaccccaaaatccatatgaaattgaacaacattttcataactttctttttacaaaaaaaaaaaatttcaaatttcatgaaaaaccaaaaattttcttaataaatttcattaaaagtcaaagtttttcttcagcgtcgcctagtacaaaaagctaaatttttttctaaaatgtagctcaaaatagcaaagttttgtcattttttcgtgtaaatctgttaacaaaccaaactcaaattttcaaaaatttacccggcggccctgtcggcactgccggacccccccccccccaatgtcgtcaaaatctttttgaaaaaatacaccttaaaattcttttgaagagtaaaaaaggtcgatttacaatggcttgacatttctaagctaaaataaaggaatataaaattttttcgaatttttaatcaaaattccaaaaattttgaaaaaaggccggtcccgtagggcgcccggtcaaaattttggaccgggcccgggacgcccggtaaaacgggctttttttgaacgggcggcccgccaacggtcaattttcgtgcccggtcccggtactttcaaaattccgggctctactcattactaagaaaaaactgtttacaagcatttagaagcgaaacaaattcatcgaatccaattgaaaaaataaacggattttatgccagttatcttgacaatgatttaataaaaatataagaaattaattggtttttctatcgtaaataattattttcttagaaatgtatcctttttttcatagatttctctatttttgatccttcaaaatttcttctccaaatttcttcttccattttgaaatggtcgttctatcaattttcatcattaaatgaatttttgcacaatttcaattttttcttcatccgtttttgatttatagcttttcttttttgttgattaagtcctaattgcttaatccatttataaattttgtttcgatttgtccccaattttttcgctattttatgttcaattttcccccattcttttgctgaatattttcttcctttttcctttattttctcttttattttataatatttttcaatttttttgtcacttttcaagagagtattatcgaatttgtgccaatgataccaatcgaaaattcatgtttaggattttaagaataaaatttttccaaaaaatgactgaatgtcgttattttattccaaaaaaacaattcattccatacaaaaaaaacattttattcatttggatgtaggtagttagttatacaaaaaatgcccttaaaactgccaaaaaatgaatctaaaaaacctcataaaattgtgaaaatttaaaattgactaaataatatttaacgaggctaattgcatattttattaattactccatttttaagatttataaagatttttaaaatacttaataaatagaaataaatgcgctttttggtttttctttgattatttgcaacaacagtataaaacaggcaaataattagaaatttatttaaataaatttaaataattcaattagccaagataataattttataaaataaaagaattggtcaattttctatcgaaataattattgatcccttttctcattttctgtttttaatactttaaatttcttctccaaattgtttcttccaattgaaaatgctattttgatggattttcaaaatttttgcaatttcattatcactcatttttggattttcactttttattttccaataaattttcattttttccattttttctttcaccattattctcttacagcgaattccgaattgtttcttccatttttcaattagtgaacggcttactccaattttattacaaatttcgttataattttgtcgccattctttggttgaatattttcttttttgtttatattcatttgccatttcaatgaatttttgtacaatttcgcgtttttgttcatcagtttttgatttgtagctttt

SEQ ID NO: 14022 - DNA, 3147 bp, Heterodera glycines
agtcaatgcagtcgaggagaggacgcgggatgtcgaattggaccggctgcccccagtggccacacgttcgacatgacgacaatgacggagaagtcaacgttggatgttctcggctgctaaaaatggggtaaaactgtctcaatgaaaatttaaatttcgttagccacctgcttgtactgctcggaatggtccctgctcagcgcgacatcagtcagcagacgctccaactttgaggtgtactcgaacccgcacatgtgcttcagctttgcgatcatgcaccgctcctgctcctcgctggccgacgtgtcgtagacgaggcgcttgcacaaaaacttgtggaaaaacgcgtggaacatgtccttgtcgtcgatgtatttgaagacggtcatctgtgacaatggggatattatattctcatttttaagaaaacagaaattatggaaaatttcaaactttaaagaaccaaacaaacccaccacttggtccaggtactcatccatcttctcgtcctccgtgttgcgtgcacttttgcgcaaaagctgatcacagtagaggaccaacagctgcgacgatttggacgcattccgagccatcgccgtaatttcgttgttgttgatgaacttgcggaaggcgcagtccattgattgcacaaagccatggtcagttttgaaggagtccaccaccaagcgattgtagagtttgtgcctttaaaatggttcagtatttccaaaaacccacccgctactcactttttgaggatacagtcgatgtactgcttcggattgttggacgcttcacgcgcaatttgctgaatggccgccttgccctcctgttcgatgtacgccttcaggatctccttgagcttggccaacccgttgggcacacgcgaacaaagtgtgtactgaaaaaaaaacgaatttatgcaaaaattgtgagaaaagtggtgacattctgcaaatctcaccatccgtccaagatggtcattctgttgacgagtgagcaatgactgaaaaaagtgtaatataataaaatggacaattctctttctgctacctcaaatttgtcgtggaagagctcgaggtgctgcttgatcaacgccgtgtcacatgcctccatcagcgagtccattgttgtgttgtccaggtaaatttggcaccggtcccgctcttcgctaagccgttgttcaacctgaaaaaaagagaaaaacatgaagaaagttgcgctcgtaaacgagactcccccctgttcaccacccacctttttcatatagtcctgcacattggcactgttcgactgcagaaaattgttcgactccgttgtgtagaagttgcgagtgtcctgtttgtgtgggaaatgtaaaaattttgaaatgcacaaaaacccatccaaccgacctcaaggaagcgctgctcaaagttgttgcggtacacttggtatttgacgctcggacgatgcaccaccgaattctgctgctggcccaccgccggcgccgggtcgagctcgttgatgccaagttcaactggaaacgacaaaaatcaacaaatttttggggtgacgaagcaaaagtctgactgtatgaggcgaccacgccgctgatcagtcgcgtggtgatgcgttccccgttgcggtccttctccaccagcgccagcgcagcggacgtgatgttgtggtgcagttcgtcaaagatcaccgatttccagatggagacagccagctgaaattcggggaaaatttaaaaatgaaactcatcccccttcgtgtacgaccgtccccacaaactcacattgtacacttccaaaatgccgggacgcgtcgcctcgtcgatgttccgtttgatccaatgacggttcaagtaggagaaaatgccgttcgccacggtggaggagaactggaatttggtccactgctcggtgtagtagtccagcagctggtcaccggacagacgctggcattcctgaaacaaaagcaaaatttgagttcggtttcctggacaaaattccgcccctccccccattaactacctgcagcaatttccttgcgtactcttcgacgaagtggcgcagtcgcgtgtagagctcctcgccgacaaactctgcaccagccgccgctgccggcgtcccgcggttgccccgacgcgcccgattgttcgttgtttcgtgcgtgaagttgctgctctgctgactcgtcgtgcagtggttgaagaccaatctgaaaacagagggaagggaagtcttacataacagttacacctctgctcaaactcacgtgtaatactccatgtagcgctgcggtgccattctctcctgcgtcttgaagatggactcaaggccgggcgaaagatccctccaaatcgtgtcgaatctgaccggatgattattcatccttgattggcagcggacaacagcaaattagtagacaaatatgtgtgcttaagtatcgctgaaaaaagcaattagaaaagcgttttgttatttcttttatggttcaagttttggaaaacaaaaattgctaaatttgggttcaattgcactttaggcgtccaatttaggtaagctgaaaaaaggacagtctattctagagcaattagcaatagcatattccaaagttttaattccgggaatgaatgtttttggaattcaaaaataaacacagggaaaatttggaactttacaaggaaattgtatgattagagaagacattaaataaaataaacggaaacgacatttgtgcagtttaaaaaaagtaaataatgacaaaaaatggagtttggtcgcgaatttataaacaaatttttgcagcggattacctacttttcaaaaaaggtcgcaacttttttttctctttgtcattcattttccgtcgctatattgaaagttaccctttttgaaaattttttttaaaagtcatgaaaatacatttccgggggttttcggggccgttgattaagaatatgacattcatttcgaccaatttcgaaccccggacccggattcgaacaaaaagtcgaaaatcgtaaattttcactttttataaatgataatttttttaattcctttttagcaaatggttaaaattgcaagatattccattattgattccaacaatctgccgctcctcggctttccaacatgtgggctctaattcatt

SEQ ID NO: 14023 - DNA, 3420 bp, Heterodera glycines
cctgttggcatttctcatgccgtgagtgccttcaccgtttaagtccggctccacaatgggcaccagcccaaaacgtccggcaggtcaccgcaaaacgggccattacctttaaatgtttttcgaatggtttaaaagcaatctgcgaaaccatcgcattttgctcaagtgcccatttggaaggtgttcgttgcgaaatgcgataagcacaacgaaacttcgcaaaagagcagcccccctttttgtactcagcgcaacgcgcggccaatccgtcgaggcctaataattgtaattattaatgatcatttagggtaataattcataatccctcccttttccccaccttgcgtgattgtctcccctttccaacttttgttgctcttctcaatgtcttccgttggcattgggaacagcggaattgtgtcctcgtcaactttaacccccacagcgatgcccgtccgtctgagaaggtccaccagctgatcgccttgatcagtcatttgccgataagtctaacaattaggcagggaattagaataatttgaaattaatctccaataattggttctgccaatccgaaaactttgaaattgctgaaacagattaaaaggagggcgacacctcatcctgaacaatgactgcgctaatgtgcttgtgaatattgggagtggtgaacaacaattgtcgaaagcgacggcgattctctgcggaattttccatgccaaaaagggtcaatcgcgagtcgagagcaactgaaaaggcaagtaatcaaaggtgtgtgtggtgtattactcattaccgtccgaatttgccataattagctaattacccccccccccccctcctctccgcccccattcattcgacctgccgggtcgtccgctgccaaaatgcctttgcccggctgaagcattctcgccacgatatcgcgcagttcgcactcatttttctcactcaattcgaaagtcattcccatcgtttgctcctcctcttcatctttgttcttttgtccattttttaactccattgaattttctttcaaagtcatttgaaatttgaatttgaattaaatgaataaatcgaatcacttaattattgcattatttttgcaccaatcgacagaataataataataatataatataataataatcaatgagtgctaatttttgttactgaaaaaaagaggagaagattagaagaaagattttttattaaataggtgggattttgatcgaaatttttaaattaatttttaaatattctttgatttagtgaagggtcaaatgggaaaaacaaaagcaaaatgcaagaaaatgaaaagggcagaattaattaattaattaattaatgggcggggggggggtcgagggaggccgaggtcagcgaaaatgaaaacattgctgaaaacccaacggatttcacgtgcataacagccgaaggataggacaaatgatcgaacgggcgatcagtgcccccaccgctcccccccccccccccccccgccacagccgccgcttagtccgacaaaacaaatgcttaaatattatattattaactattaccagagagaaacaccagaaaatggctgatgagagcaataaaaaggacaaaactcacagaataattaattcactaatgcataattaattatatatttattatttgcatgttttatccgtccaaaatcacttctttttttaattcaaaatagcattgtgagaatcgctttcgtcccaatttgggtcgttaaataatgtaaggaagaagctggctgggcggttaaaacgcggaaagcgggggttgataagatccataaaagaaagggcggatgtgcctcggtagcttaatggtagagctgcccacggaaagggtgcatgagtgggttcgattcccacccgaggtttaacattttgcccatttcttattataatttcaatttataattcgcaaatgtgcttaatgaggacaactccaaagtcgaacttcgtcgtttttcaaaatccgaatccgtcccctcgacgacaacagaagtgccgctttttaacttaacctcgtcaaatgcaataaacttcccgatttttgtgctgtgaattgactgaactgcttgaactaagcatttaaattctatgccggatgtgaagatgataatattttgccgaaagggtgaaaaaaagaacactaaacaaaaagataattaatgcaataaatgatcaaattttgcgagaagttttcttagtcggttgaaatttgtataatattgttgaaatgaccagccaactttctttttacactcattaaaatttatttgcccaaatacacaaaatacaataattaaataataaacaattaaaaaataacaataattaaaattcgtagtttcaaattcctctctctcccccaaaagattataattattattttcttcgtcctttttttcttatcaatgggccagtctttgattttgggctttgcaaatgaacggagagggaactccgatcatttgaatctgacaaaggccaaacgcagtaaatggccaaattgtggctgctttccctcgcctttggcattggcatcgccccctttctttttgccgtgtccctccaaaaggccaaagggacgacgcgaaaatggttggccgaacacatggacgaagtgatcagcgaaatggacttggccaaagcatacggagcacgtaagattttgtgaaaagttttatgcataattttacgcaaataaaaagcgtacgatttggtcgaacaaacgcttaacaaacggcggaaaatgctgcgaaaaacggcgaagggaacgagcagaaacattgggcccaaaaatgcgaaggatgccgcgtacgaccacaaaatgatacggcacaaaatatttccgatggcagccgcttcttatggggacacggaaaatgtgaagaattgcattcggaacacttttcgaaatgccacggtttttaaaagtggaggaaatcaacagaaatttcaaattcagttgtaccgtaattcggtggtacagtgtaacggtaaggcttatgaattgtgttcggcatttacggcagtgtcccatgaggacaaagcgatcattttgtcatttcggtattacaaaatgaattgtgtcggaaatatccaaattgacgttttagtgggacggacacgggatatcaattaattgaagaaacgattcaaattgcacttttcaaacgatcccaatcacctgacgaagaatgggggaaagtaagcagaaaatgagacaaacaaagcacaaatcgcaaaattcgaaaggttggaagttatttcctgaagattttcaatcagctcgtcgaagagggaaaaatcatcgatgatttggccaaattagtgaacacgtacaacaactgggacgtgggtacgattttaggaaactaagaaattgaaa

SEQ ID NO: 14024 - DNA, 2607 bp, Heterodera glycines
  misc_feature (55)..(56): n is a, c, g, or t
  misc_feature (90)..(90): n is a, c, g, or t
  misc_feature (105)..(105): n is a, c, g, or t
taaagtaattaactgttattattcccatgtactaataataattagtcaaaaaatnntaattgtttaaaccacttttgaattagtggaatnaaaaatataataatntagttttaaaattaatccgatgaaattaaatttgttttactttatcagcgcaaaagaaagaattattttaacacaacaaaaccactaacaattttgtgctgcttcttctcgcccttttctcagtgcccaacttaaacttcttccatccgcaaatggcaccgctttgtttccaagtgaacgaatattacgcgcagatttcggagttggtgcccggcctgtacatttgcggggtgaccggactgacgccggccaacatgaaggccttccgcatcgagttgatcgtgaatgccaccagggaggtgccgaacctgaagagtcttggccatatccagcggatgaagctgtgggtggaggacacgacggatgaggaccttttcccgcactttgacatcgtggcagatcaggtagagtctctatgatcagcagcactgatcgctggattgatcacccatggccgttgcagatccatgccgtcatccaagaccgtggtgccgttctggtgcactgcgtcgccggcgtttcccgatccgccgccatctgcttggcctatctgctcaagtatcggactcggtctctgagagccgcctaccatttgatgtgctcaaagcgtccgatggtccgtcccaatcttagcttttggcgccagctcatccactacgagcaggtcactcgctcaatttgccatagaatgaccaaggcatttggggtttcagcaggtcaagggcaatgtcggctcggttcgcatcgtgcgggacgaagcacagcccgacaaattgctccccgacgtaagtctcggaagcggcactcgagaatccggacatttgttccctttcaaggtctatctgaagatcgtgatccccgaccagctaagccgccctctgtcgccgaccaatgccaccgatgcgtcgtccccccaatccgtgccaaagtctcccttttccgacgagccggcaccagtctcgcaactgccgctgagccggcatcgcaggaacagttccggcgggtcggcgcgtgtcaaatttgtgcccgtgctcgaagtgctcactgaaatggcggctgagtccccggcgtgatgttaaagttttacccaaattaagccagatgtctttttgtattgtttcttaataatttacacattttaataacccttctcttccacttttgttttagaactgttcgtttaaattaaccttttacccttccgggtaattcaacgggtataaatattctcaacttcatttttttcgttttgttcagaattgtcattttcatttaatatgaattttttctggcttgaatttgatttggtaaagattaaatcttttaaaattattaaaaacccaaaaataccaattgattatttataaaatattgtgggagaggagtaatgaattcataaaaaataatgtgaggaaaaaatatgagcaaaattctgggtatggatcgtttcggcaatgacgattcggcattgatcattcaattttaaaatacccccaataagggctattttagtgaaaatcttatgcaaaattttaccctgcggcgcctatcggcacccggcccgcctattggaagcatagtgcggcaaaaaaaaaagcattttcatttcgagtttttttagcagtctcatcaaaattaaatgatttcaggaaaacattaaaattaataataaattaaattactcatttttaaacaatgagaaaatttttggaaatttgaaaaaaattgacatccgaaaaattctgacactttttacttttttgttcttttttttttgtttttttaaattaaagacaaatatttttttaattaaattttttatcacttgaaaataataaaattaagatttattgatttttgtttatttattttttggtaatttcccggttgaaaatcgaggtcccagaccggcttttctagttccggcaagtggttacatgacatttgcgcctatgcccaaaatcggtttcagacttgtttttttcaatctctgataacctaaacagcattaaatgagtgatcgaactgattgtgtttgatcatttgataataatgaatttttgaaagaatcataaatattcaaacaacagaattaatgctactaataaactaaaaacagtattttcttattttaatgctgcttaggcgatcaatgcttgaaaaacttaaaatgtccgaggcgcaaatgtcacacacggcaaatcacagtaaagatttttcttaaaattccgggtcccgtgttacttatcgctaatctcaattgaaaataaaaatcacggtaactaatgataatattttagggaaggccaaaagaataaaaactcggaattattaaaatgttagaatattaattaatactaattattgtaataaaaatatgacaaaatgagtgttcacatttttattcattcaaaattaaggatggtggaataacaataaaatgaaatatctttaactttcaggggttttaattcatttaaaataaatgttatgaaaaaaata

SEQ ID NO: 14025 - DNA, 1506 bp, Heterodera glycines
cattccgaggtatgaacgcagcgatggcacatctgtgggtgcgggcatttcactaattgctgagattttctccgggtccggtctccgtccgtttctgtagatgatttgtccgagatatttgatctcttctcggaaaaacgaacacttttccaatttgatccggaatccccactcttggaatttttccaaaacatttttcaagtgatcagcgtgctctctttgacgcttttgcttacgatgatcacatcatccaagtaagctgtggcgaattcaaattctgccaagatttggtccattaccgattggaagatggctggcgctgatttcacgccaaaaggaagtctcttaacttcgtaattgccatgatgggttgaaatcgagcatagttttctcgattcatcatccaattcgatttggagatatgcatccctgaggtcgatttgcgaaaaatattttcctccatttagggttgcgaaaatatcctcaggtaagggcagcgggtgttggtggtcctgaagggcgttgttcagaccagtggagtagtcaatgcataggcgtgcacttccgtcggcctttttcaccgccaaaatcggagcagcccattcggtgtattcgacttttccaatcacacccattttctcccatcgctccaattctccatcaatcgcttcttgagcgttgtatgggactgggcgagcctttctgtagaccggtgcggcgtccgctttcaaagtcagatgcgccttaaatttcatacaacggcccaattcgtttttgaaaatttcggggaatgacgctttgagatggtcgatgtgcgattggactgtcgaattttgtggcgattttggagttttagtgaaacctcgtgtctcttctccgactcggcacaaatttaccggcgcattgattttggccttgagttcgttgagcagtccaaaagcatccatcatttgcacgcttagcaaatttagcgatcccctttttgccacataatattcgcttttgatgcaaatatcgcggaatttgaaatttgcgactccctttccgacgaatttgacttgtgttccatcgaacatgcatccactttcggtgcatttgcggagtcgggggctgccgatgacttcatgtgatagttcatcgatcacaattatttcagccccgctgtcgagtacgaatttgatgtctttgccatctaccgccacgtcggttttgaaaaggaagcggagttcactttcatggccgttccaattcgtaaatttccaattttcctttttggaattggcaatttgtttctccgtctccattcctgcaccttgtcgcattggccttccaaatgtccattttggaaacatttttggcactttgctgacttatgcttacactcccagtggctgtgatttgtccaaccacatcgccaacattgttgtgccggagcggatgatgattgagcttgcttgttgtttggccttcgtcccttttcggatttgtgacagtttggcttgactg

SEQ ID NO: 14026 - DNA, 2041 bp, Heterodera glycines
gacgaaaatcttctccttcggttttcgaggccatcaagcactcatatctatcgatgaagacagattgaggctttgcaaaaagcttttgcagcctttcaattgattgggtgaagtcgaagtcggtcacttttgacggcaggcatgatttggaatattcactgaatgccgtttccgacaatttgttcattaatgcctttactttcactgcgtcagttgcgtttggtgccgaacagtccattgcaaaagaaaacctttcgatccattccgaaattcgtcccttttcgtcggtcggttcgaagaccgaaatgtcaggcagcaccggaacattattgttcggattcggttgattgttttgttgctgctgctgtgcggtgacgagttgactaattgcgtccagcaattgttgaatattggcttgtgccattgtcggtggttatcgatcgcttttcagttgagtgttgaaattggacgatgaaaaccgcgcctagcggaacctcacccttttagggtctattggttttttgacgcgttgaaaaccgcacctggcggaacctcacccttttagggtctattggttttttgaagcgttgaaaaccgcacctggcggaacctcacccttttagggtctattggtttttttgaagcgttgaaaaccgcacctggcggaacctcacccttttagggtctattggttttttgacgcgatgaaagtcggcggtcgaaatgtggacggtttgttttcgtccacttgaagaccggcggcagaatgttgaaatccaaaaattactctcgtctggagatgtaataagtggataacaaatgcgctttatgtcgtatgctttttagctgactgcgccaattgttcggtccgaggggttttgttaaagtccaattaaatatttataatttattggagaaggaaaataaagtcacaacaatttggggaacaaatatataaatgcaaaatgaatgaagggaagacaatctaaaggggaatgggagcatatttatgggcgagggaaggaacatgaaatggaacagaaatcgattggcattatgtcatgtcattcaaacttcggcggcagtgccccgaacagaattttaaacatttgcaatgcaaaaattttaaaaaaacatgaaatgttttattacaaataaaaacaaaaaaattttcatgtttaaaatgaaaaacaatcgtaactaaagaacaaatttccaaactctataagaaataaaagtttatgcaaaaattaatccaaaaatcaattgtgtttattgtttgcaaaataaattgcatttaatttaaaaataactataatttagtagctttatatagataaatattatttaataaatatctcagaagttgtattatacatgttaaaatgaatgccaacctgcaattaacaaagctctacactgatttgaataaatatgatttaacgaaactaaatgactcttacgctgctaaaaaacatttaacgaaagaaaatttttaatatgccataattaattaattactttttaatatgctattttaaaatttattttgaataaaattaaaaaaaaaataaaattaaaatattataaacgaaattttcggctaaagattatatcaatatattcattcctatttcggaaattttatcactattttgtaattttctggcattttttctcactatttggataatcattttgagatttttcgtatttagaattgaaaatattccaatgttttcaaacccgtttctgcgtaatctgcttaaagtactttacagaaaaatatgaaaaattctaaaaagagttttaaattataaactagcaaaaattgctcattaagaataaaaatttaaaaaatttaaacacttaaaataaacggataaacaacaatgatatatatatatatatatatatatatatatatttatatatacacatatatatatacacatatatatatatatatatatctatacatatatatatatatatatgtatatatatctatatatctatacttatctatactgggaaaaat

SEQ ID NO: 14027 - DNA, 2743 bp, Heterodera glycines
tctgaaagtttctccttatcaatcactatttgcattggcgaccaaaaggtatgttctttttaaaatgtgctttctataaatctagaaaatggaacaatcgcagataaatactgctgaaaaatcgcccctagacgaataaaacaattaaaatttatgcaagtttgggacgggtaatttagctgaggtttaaaatttaaaatttctgagaagaaaaatcagcatgaattgtggtcttttccattgtttcagatgcggccaaaggagaggccaaaggtgtaaaaaatggattcaaaattttgtaactgcaatttgtttataattgtgaaaaaagggtgcgaattgaactcaatgtccattagcaaaattcttctttcaaaacttattattattgtaagagtccattctataaatttgcttcgatatgatcagttttttagaggatgcataaaactatttcgctttttgacatttcatgagatgaattatagcaaaatgttttattttcgaatttatttttgagaaattgctattttgaaatgtcttgtcttaaaaaaagacagactttttattttcaggtgccattgaaattttggtacagagaaaattagcaatataatagaaagttaatttcaagctccagaaaaatcggtttaggtctgaaagtttctccttatcaatcactatttgcattggcgaccaaaaggtatgttctttttaaaatgtgttttctataaatctagaaaatggaacaaccacagataaataatactgctgaaaaatcgccccgtcgaaaatattcgaagaaaatgggggagaacacaaatgcggggcttttgcgggctcttctcttctcctccgaattcacttctcgtccccgttcgtcgtcaaccaaaattaacaaaaaagaactgcactcaaacaattaaaaccaaaagtgtatctccaacacaaattaaagtccacagcacaaaacagaacaaatttaattcaataaaaatcaaaagtcggggagagcgatgagaataaaattaccatcatttttgaagccaaaatataatatgagaaagcactgagaaaaccaaaaaaatttagaaggggaacaaaattaaatagacaaaatgccacaaattaattatttaaattaaaaacgaggtcaaatatcacatcccacccaattacgagcggcgtccctgccgttaaagaaggaaagacaaacaaaaataaaacaaaaatgagattcgattcggctgtcaaaaggtgggcgggctcgtctgggatcactgctcagcgacgcggctcgaaccgattgcgacgattcatcggagtcggatggaacgccggacgaccacgactttgctgatatggatggaaacgtgaagacgggccacggaacgtcggaggagggaccgagcggtaacctgtgccgactcgtccaaactcaaacccgcgattttgattggtcattggtcgggcggaacctgtggggccattgtcagaaatgccaatcgttcgagatggggaggggtcacctgggccttctcctctcacatttctctctggtgcattgccacgaattaaggaagggtctcctggaccaccacccttcacggcaccaattttcaccactttcgacttcacggttctgatcccgagctctcgatcgcccggaaaattcggaaccaatgatgtgagccaggcattcagcgttttcagccccttttctgtcatccatccgttatgattaacatgttcattgttaaaactcttcccgaaacgccaaatctccagcaaacttcttccttcttctgtcactgccaccagctcaatttcgcttttcttccgaaacagcgccctcattcttccacagaattcttcagattcggcctttttgttgtagataaaaggcggcaacagccagaagatcttcacatgcgcaaatcggaggcaaagttggcgcagtctcttcactttttcgatgacactgtccaccgaatcgccagccaaaattgagtcctttccaaccatcacaatcagccacttcacttttgaggccagccccacttgatcaaattgtctgatcacttcggcagttgatccttcttgcactccaacaaatgctgatcttggccatagcttcttcaattggtaggcatttgaatcgcctaaaatcactctttcggcggtgacaagtgtcttcttttggatttctgtggcacggagcttctccagcaaaaatggcgcactttcgagcgatttcctcatgccttctctttcagtttcgggcagaagtgataggccttggggcagctcaattgaaattggcccaaatgccgatttttcgacttcttttcgggcaatttggcagtggccgatccaaattcgcaaaacgctttccacgtccgattcggatggaaatgtgccgtttttgacgtcgtcttctcgggcactgcaatatgttgcgagttcccaatcggcatccgtgtccagaatttgcgaaatgagctttttggcagcagatgccgatgcgaccgcttcagacttcagcagaaacattgccaacagcgctttgagcggattttctatcttcgtgagcccgatgcctgatcggtccaggacggcgtccaagtcggccacgaccacatcggagcagcatttgtgctcgtctccggcacatgccaatgtccaagaaagcgttttcgcctcatattgttcctgaatgaccgaaatttggtcttcgtttcca

SEQ ID NO: 14028 - DNA, 2778 bp, Heterodera glycines
  misc_feature (349)..(349): n is a, c, g, or t
ggaaaaatagtcgcaaaaaataaattcaattcaaaatgggcaccccccccactgaagttaaaattaaatatccaccagattatttgtaagggttaagtatttatattatatatgtaactacctccatccttatgcagattattacatatattttttagcaaaactaacaaagatagtcaaggattaagaattccgtctctaacaatgattttttatatttttaaactcacaacctctaacccgcgttctccagacaccctggcgtttgtgcgcgaaaatcatttcgcgctctgcgataagtagggtgggttaactacttatgacccttcaataattctaatcaatgagncctggttaaactccagaaatacggtagacgcggaacttacaataaatggtcaataccaaattgtttatgcaaaccgaactgaaaaaaagggcggaggatcggcaatcctattaaaaaccttgatcccttatcagacacttttctctgggacaaaattccaaagtgaaattatacacattaaattactttaaaaaaaaaaccaacacaaattataaatatatatcgtccaccaaattgtacagttcagaatactaaaaagctactcaaattcatttcggaccaaagcgattctgaaaataccatattctgtggtgattttaatatcccaaatatattatgggatgaaaataaagtaaaaaaaataaatgatccggcgtctaattctctaattgagtttatgcatcaaagacaattgatacagcattttaaggaaccaaccagagaaaaagcaattttagatttagtaattactagtgaattagaattaattaatgaattgacagttctagaaaatttttcaacttccgatcacaaaatggttggatttaaaataaaagtaaaattcagtcataaaaatcctaaaatttacagaagagattttaaaaatattaatttttcgaaattaagtcaggcgatacttgaaaatcgaattgatttatcaataaactcagtgttcaccgttgaacagaaatataaagaatttttaaataaagttctgaaattatatgatatttttatacccaataggcctctaaaatcgataataaaacaatcgtatcctcaaaaaataagagacttattttcagagaaattacgtttgcataagcttgtaaaaaaattccctgaaaaaagtgatctcattttaaattacaaaattatttctagggaaatgaaaaaacaattgtacaaattaagaaatgaacaagagtcaaaaattatttcccaggggcaaaattcagttaacaaattattcgaaataagttatcaaaagttaatgaaattcctacgttaattgataatgctggaaatatgttttccagcaatgttcaaaaatgtaagatattagcagaaatatttcaaaagtcttttttaagaaaatcaattgttaatggtccacaaactcaatcaacacagaataagattaaactttctgacattgaattgaatgcgggaataatttggaatatattaagaagacttccccggcgtaattccacttcaccggataatgttccttacattttattaaaaaattgtgcagaaccaattacaaaaatattagcagatatatttaggctaattttggattccggtcaaattccggaaatatggcgaacatcattggtggtaccaattttcaaaagaggcgaaaaaactgatccattaaattataggccggtttcattaaccagcactgtctgtagagtttttgaacgaattttgagtagcaaaattttagaatttctgaatagtacaagattctttgataaagaacaatttgggtttttaaaaaatagatcgactacaacccaaatattaaaaatgatggacgatatatataattctatacaaaagaatcaacaaattgacataatctatattgattttgtcaaggcgtttgattctgttccaattgatttattacttcaaaaaatcaaaaagattggaattgaaggaaaaattcataattttttaactaactttttaaaaaatcggagttttaaggttaaaattggcgaagaattgtcagaaagtttcagaatattttcaggagtgccccagggaagtgtcttagggccattactctttttaatttttataaatgatctgccgtcctttattgcaaatgaagcatcatcagttggcataaaaatgtatgccgatgatgttaaattatattatacacatgaaaacgatgaccattcaaatcagttggataaagcgattgaggctttggaaaaatggtcaaaaataaatgggttagaaatagggatgatatttttaggtgctaaaaactggcaaaataggtaggttttaggttctaaaaaacccgcaaaataggtgctaaaaatgggaaaataggtgacaaaatgttccgaatttaggggtctaaaatcgaaaatttttttttaaaagcaaaaatattttgtcaagtcattaaggatatacataattttcaaaatcaaaaaatatcgacaagaaaataaaataaataaattttggagataaatttttgagaaatttttcatttcttaggggcgcatttttgaaaattttctggtcgattcttagggatgtattttttgaaaaaaaattttgggccggttcttaggggtgtatttttcttttttattgcatttttgttaacaaattttgggcaaaacaccaaaataggtgaaaataagttttttaaatttttttaggttttt

SEQ ID NO: 14029 - DNA, 2696 bp, Heterodera glycines
ggaacgtactcgggtttttttcgctttccggtccccgtgggaaattccttttccaatttcttcccccgaacaatatttttcagtttattagaattcaaaaatttaatcgaatttatccgaaataatttttaggtttttggctaaactacaattcgttataataaatttgaatattattggtaattcttgtagggataaaaaaggaaatgaaagtgatgatagcgtaaaaaataaggcgaatttgctgttgccggtcgcttaaatagttggcatgaaattttggcaatgcgtgaattgcacaaaactctcgccacctttgggcttcgctaatgcacgcgcgcggtgatctccagtactttcatgggtgggcgtggcacccaaaaatggtctacaaaaaggcagcaattctacgagtttggcacacttcggatttcctgctgaatcttgttgctttctcccacccttttcaacttttcaaaaatctcacttaactatttggtcattattctgctttctcgaatgacttccacccccccccccccttaattttttttttgtaactcagcaaaatgccactgatcttcaagccaactaaaacgtcaaatagccgtgctctcgttgagccttctcgtcttctgaccgatgatgaaatttggaagcaaattcgtagtgccagtcgtcactttgtccgaccgcaagcgcaaaatgccgtcattgtgagcccaccaagtgcccctcaaatcgtagaggaaagtgaggcggcaattgatcagggagggtcaattcagaatttgggtcaagtttcactgtcgcctgctgtcaattcggtccgcgaagtgcccaaggaatatccggcgctacatccgcgctacttttccccgaatttccgcggtcgctctcccgtccgtcatcgctcgactccgattcgtgctcctcctccgcgtcgccgttggtcgccgccgcgtcgtcgtttgtcgccattccgcaagtctccgcgtcccgcccaacgccatggtcccccgtctcatcgctctgaaatcgacacccgccactcttcggtcacccgcttttttccgcctccgccgatgcctttgaaccgcgttggatcttcaaaagcgcaaatgattccaccgtttttgacccctgagcaaccaccatcccgaattcaaaattttgaaatgacctataaccattgcactatgacccaaaatttttccaaaatgtgatcagtgattatttttgaattgttgtttatgtttgatttaaattttttgttggtgtggtgctgtttttgggtcaaaaacttggttctcattagcgtttttcctagttgttagtcgttttggcacttagtcattgttcatctccaattagtccacactcaaataccaaaatcattgcatcgagcggttcgggcaccgtatttgttgcatttttggattgttgtcatggttacaaagtaagtgccaaacattgaaaatcgtataaaattaagtacaccgtacggattcgaacttgcccctcccccctcataatccccatttacgccatttctacagaattttaaaatttttatttacttcgaatgccgaaaaaactaaattaattcttcattttgtaatgttctttctattgactttaaggtataaaaatctaaaaaaattttttgtaaaaacttatttaaaaattctttcttcatctcgcacaactctttttttgcttggggttgatgattcgcctcagatggtcgctctgtgctaaaaggattccctgctttataaatttctggtaaaataaattatttataaatttttaattaaatattaataatcttcaaacttttcaaattttaaattattaacaattatcataatttattaaacctgattgtttggaactcccacgtgatttaatctagagcgtaaaatcaactcaattttttaataagatttgtataaatataataatattattctcttattttgatattttaccaaggaataattaattacaaatttaattgtttaattgaacattttttttaaattttcaataattatcaatcttaaaattaacacaatattcgtattcagtaccctttaatagatcagaaaagtatttatacccccattttggacccaaaaaaattttcagagaatttcttattttgaagacttgcctcaggatgggcgcttctcgcccgttatttaatttttctaaggacattctatcgtattcctttaccagcagcaactcttcctgctttgttttcacttccacataagatgtagcatgtttcgcgattgcatggaaagtccaagcgtctaattgtgaccatgacacgcctatccgcggactcgggcttaattaatcatttgcgtaattacatttaatttaaataaattttttatggtaattaaaaacatgccaatattttccagtagcaattcgtgcttggcgtcaatgacactgtggaaatgtttcccgcaaattcgcctgccatcagagcgccagtgctcaagcagttcgggtttgctaaaattaagaatttaattaaaaaaccttttttaaataattaataacaataataataccattgcccaggaatttcgtcacaaaaagcgccagagtagccctaaatgcgattttcataaatgagtgattttttttattttgacaaaaaaaaataattttta

SEQ ID NO: 14030 - DNA, 2746 bp, Heterodera glycines
ctagataaatttttcagaatttttttctcgatatttcttattaaaaacattttctcgggggaaagtgctgcttcctccctgctagagtcaatttttcccaaattttttgtgcccatttttccatttcccgggttttttttgttgatgttttcccccgtccgttgcgggtgccgtgccgcgcgtacctccgcgctgaccaagtcgccctcgcgcaaatactcgcgcatcaacagttcgtcctcaatggacttgcggcgcagctcaccgcccggcaaattgacgctgttcagcaacagcacgccatgttggcgagagttgatgtccaccttccaccgcttctgttgcacctcgacaatacggcccacaaccacgtcacccacatcgccgtggtacctttttaggaagggggaggcagtaataagggtgtattacgtacgtttccctccaccgccaaaatttttatttataagaaaacaatgaaatttttttaaagttcgggatatgaaaattttttttgaggaacttgataattcgtcataaaattttcatctaaaaattttttcgaggggagctgctccctggtaataaattgtaaaaaatttgtatgaggtaacaggatttcgggtatttttacgaaaaatgcatccagcccgtgttaagatgcgttattcttcagggtattactgtgaatggtttcctcctgtaaatcattggtattaaccggattttggactggaaccatggtagaattggacgaaaagatcatccagaaaattttccaagaattttttaaaaaacagacccaaaaaacctcgatttttgaatgggcgaatgaatgaataaaaaacaaaacaaaacctgctcttgatcggtttgacactgatcaacttgttggtttggactacaattccggccaattgtgaatggagcgcattttcgtgcggaaatgtgccatggccacgcatataaccggcctaaaaatgggaaggggaggggggctgggatgccttgaaaaaagcactaaaaaaatttcaagaaaaaatggacaaatttcataaaaattaccaaaaaaaatttcgcggatcccattgtacaataattttttgaaatttgaccacaaatgggaaaaattggtcatttttggtcaaaaacggccataaaatccttcttttcgctacgtcactgaattttttgaaaaaaacactggataaaaaaatcaaaaaaacttttcccctcatttttaaacaaacaaaaaaaaaatagcaaatttctgaaaaatcaattaaaatttcgagcattttcgcccacctccggacaaatcattgcacccggcactgttagttggagcaaattttggccaaaactgctagcggatgacgtgccggcattgctgatgccaactgcatcggcaacagcgagcacccgacgcccgggcggcggactgccaattcgaattgaagcgacaaacgccgtagatggaggtgccgttgcgactaatttttgccgttgcgaggcagcatactttggcatttttgttgttgttgccgatatgccaacattgtcaggcgaagtaccatcatcgtcattgtccacaatcattacagagtcattggcattatttttgtcggcgatgactttggtggctttccgtgctggcatttgcgacgaaaaatggaaaaaaagagttttggactaaaataataataataaaactagtttttcaattgggccaagtgcagtgactgggaattacgggattgggtttttgaaaaattaaaagttgaaataaaacttaattttttatttatttgaataaaacataatgccaaaacaaattttaatttttcgttattaagcaggaagaaaggaaaagcgaacaagcgtaaagcaaggaaaagcacaagaacaaacacgcttgaatgctttacctatgctctatgcatatatgtacatttatttgtttgtacactcatttatagcttttggtttttaacgatttgagtaaaacctgaatatccgtaaattaattttatttaaaagcctagacttggacctggcttttcgggacaaaattcaggtccaagaaaaatccaatttggacctgggcctagattttggatcgttgtaatcgagcccaacctttaggagcaattttaaatttactaaaaaatgattcgtcattaattccaaatcctaattcgcaaattttttaggattttcaatttatttcatataatgatgatgcgatcacgttcctccttccactcccttgtattcctactcacatttctgttcctacccaattttttgtccgtaaattcggaaactgaacagtccgacaatgctgctgctgctgctgctgctgctgcactgaaatcggtggatgaaactgcgaaaaggctgaacactgttgacacagcaccaaacaacagtacaatgtgcgatttttttacattttgtactatactatatttccaactttgaaaaaacgaaccctttaggttctcacacctctccccgtttaaaaaaattcattttcatttttgatgggatactacctaaatttgtaatttatttcctggacgctccaccagctggctagagctagacattttgaaaaaatgtctggacctgggaatacaggttggacctgggcctgggcttcctggacacaaaaatccatggaagtccaagtccaaaaaaaacccgggccaacaattcttttttcagccgcataggatggatt

SEQ ID NO: 14031 - DNA, 1770 bp, Heterodera glycines
atatatacactgaaataaacgagttataattaaaatgcactaattaagcagaaaatcttttttgaatgtaagcaattatatacaggcagacctgaggaaagattaaaaaccaaacatacaaactacaaaaaaaataaataagagaaaactttgaaaaaaaataaaattaaaataaatattttcaatatttcaaaaaaaaatttctcagtctcctagattgcttttatatttaaaataactcaatttatgtttttaaccggatcactcaaaaattatgaatataacaaattcaaatgaaggagtttgaaaaaataatgaattataaaacccgtaaaatattcattgcaaaaataattaaaggatcatctcttgaggtaaagttaatcttataaaagaaaatgttgttgatatcagaattatataaacaaataatatttaacaaataataaatataaaaaatttatttagtagatttaagaataaaaagtaaacatatttaaatatttaaaacgaataaattgaattgatagtgttgaaatttataaaataaaagacaaaatgtgaaaacataaaaatcgaaatataaaattaaattatttcacggaatacagtatcggaataaatatctattttatacgtttaactgaaaatgagtcacaacttgtgatgccacgatccgagacctactaaaacatcacaagacaaaacattatataaaaaataattatttaaaacaactatatttattaatctaaatttatttaaatatcatcttaataccgtgtaacaaattattttttaatattttgaaacaaacaaaaaaaaacagaacattatgaaacaaataacaagatgaatgacaaaaacaaattcttattttatataaaataaaaaacccaaacaaacaataaacattcaacttatctgtaagttaagccgattgtagcacaaaatccaactcattaaaaataaataaaaattcataacaaaaatactgatcttcagaaaataaaaagaaacacaataaagcattgtgagcaccaccagagatggcattccgaggccccaaaaattttcggaaatcggaaataggaatttggggatcaaaaaatttcggaaaacggaattcggagatccaaaaatttttcggaagtcggaaatcgaaaattccgaccccaaaaatgtcggaaaccggaattccgtgccatccctggtataccctcttgagcgagtcataattgtttcaatattaggatttaaaaaatataaaaaataacacaaaatttaatccaaaaattaaaattaaaatataaagcacagtaagtttaactaaatgagattaaaagattttagcaatgtttaaattttttgttttaaaataataaattttttataaaatacagtaaagaaaaaaatctaaaagtaataaagcatgtatatcaaaaaaattaaaaaccagaattataattcgaataatatgaaaaaatattaataataaaaaaatatattaatgcaaaaataaaaattggaaagaataaaatgtaaaatatcattgctgaatgagataatatcattaattagcttaaacaattgtcgtttcatctagaagaatcgataatgatgataaatttaatctagaaatttattaacatatttaaagcgaaagccacaatttgaataaagatataaaagatactattaatataatcatgatgagaattcataacccatagaaaaataatgttaattgtaaataacattcttaaatac

SEQ ID NO: 14032 - DNA, 2823 bp, Heterodera glycines
ttatttgtagaaattatttacatcatatataaaaacaaaatattaatgtttttttttacatttaaatatttaaataaacgattattgcttttataacttaaaatttactaaaagttaattttcttaataaatcaaaaatcacaactacattaaaaatagaagactaaattaattatttattttcttgtgaatcatatttaataatatatccagttgtcctatcccgtcaaaaaaccatcaataaagtgtgtttccatgccgagaattaaaggaagtttaataattatattttttaagttattaaatataaaattataattaaataataatataaataatcttatattcttacacaaaattactaatttaaaaatattaatcgataataattatcaaagcaagtttcagattaatatttattaatataaaaatagaaaagaatgtgaagtacagtgcaaaaagcattaactaacttagtttcttaaattttgaaaaaatatttaatttaaaagtgtgtgtaccttttccacaaagaattagaaaagtttcatataagcaacaaaaattatagtactaattgatcagcaaaaggatttttttttaataaaatgatcgttagtcaattaaaaaatctttgtttaaacattgacccaaaattaaatatatttttttagatgactttttaaatgatgagcgctgctctggtcatgaaattaataaataaattgaattactaaataatttattatttaaaaaaaatatcaaacaatatttttcatagagtttaataagtttatatattatgttttgtaatttaattacagtcatcaatatagattttattaatagctatattttgtctctcgatacgcttataggaaatgattggaattattttttatttttacatttttaaatcttaaatttttattaatttatcagcattttcaaatttaaaaatttttgttgtgatttattttttttaaatttaaatattccgccaaaataaatttcttagtatatggaaatgctacattactttaactgcttcttaatctttattatttattattcttcagtatatttaaaaagtattctttaaatattaaaaatttatccgcatataaatttaaaatttaatcattttaattcatcttaacaaacaaaatttttttatcttatttaaaaagaaattatgtttttttaatattgacgaagccattggtctggtcgaatccgcttcggcactttttcttttctattgacgatctctaagcctaattcatcgtacttaagagcatgtcaggaatctgttcgctttcatcattgatttataacttaattttttttaattcaacattaaatcagaatcataactaatgattaaaccctttattgatttattcaattttttcgtaatcttactattaacttaaaatactttttatcataaatatctttcactatatcaaaaaatcatcaaaattttatttatttatcgcttatatattactacgtttcttatagtataattattataatcttcttgcagatgcttattttggaagtcaaacccgcaaatttttatggtaatttattaatcaatatatttttttaaaccttttctagcaagttattaattttattagtttctgttttttatattaatttttagttttttaactcaatttcattttattatttattttcttttttattaattttaattaatttattgcgtataattttagcattagtcaaattaatttaatttctctgtttattttatcttttttctaaaaataaatatttgtttatttagattttctatttattgtgacaaataaaggaattaaggatttctgaactaataattttgttatgatttttttattttaaactttttatgaataaatgatgcgatgagttttgttcataacataactgtcatccttaatatttttatgcaattgatttaaagtaatcttttttttaaattttatttattagttttaacttgctttatttttgtgtgttattgtagcatgtgtgaaattaaaataaatttcttcgtttatctttttttcagaaaaaaataattttatataatatttgttcgaattataacgaaaaatttatcacatttattttaaactaaatttatttatgattctgttttatgcgacactcaatactggaatttaacattttaatttgctttttatttctctcaagatattatttaaactaaagtattcgttttatcaataatttttttcagcttttttaaacacttcaattgtaatgagtttttttagtcctccattatttattttaatcatttttattgcaaataaatgtatcatccgacagaaaatatacattccgatacttttttactgttttgatttgttttatatttaatgatccttaacaatttaaagatttaagtgttcattctggtcgcgaaatttaaaaaaaaaatttgtaaattatttaatgaattttttgggtcatccattgtttatttaatgaaatttattttttgaaatatatataggttcttaatttatcttttttcatgaattaatgaactgtttataggattttttctcttgactttttctcgcaacaataattttctccaaattttctacatcgtatttgaattattaaaaatttcatgcctcatgtttatttatcccagacttttttttataaaagtcgaattttacagtgttgtgatcactaagtgagaatgcgggaccaactgaaatgtcttttatgagaaatttattatttgttaaattaaatccaaaaaat

SEQ ID NO: 14033 - DNA, 2891 bp, Heterodera glycines
  misc_feature (2867)..(2867): n is a, c, g, or t
tggaatttttttaaatttgaaaattttttctttttttgagcccgggaaatttatgcaaatttttggaaattcaaaactcacttcagggttggacaatgttagtggaataaagcttaaaaataaagaaaatcgggagtattttatctaattaaatgcccgggtatattactttgcaaccccctcagaaagggggaaaattcagaatcgggcagattaatgaagacgggaattttcatttttaaatatatagggctcccagattaaaattttaaaagcctcatttggcatgcaaaaaagactcattttgggttaaaaagcctcatttttatatttttttaaaaacacgtttaaaatgttatatgtgttttcaatttattgttataaataagcataaaaattcttaattttgtgaattttcggaaaattggttattttctggtttttgtgaaaaatttaacaaattttttggaaaacttgggtgagattttcgttttgacactcctttaaaaacccaaattattaaatgattgtcaaacattatgccaatttatcaaaattaatcataaaatttaacagattctgacggttttccacaaagcctcaaaatttctcaaaaacccaaaaaaagcctcaaagcctcattttgaaaattaagcctcattgacccatcaaaaaaccaccaaatgaagctaaagcctcataactgggagcctgatttaaatgaatttaaatttagaataaattaattttataaaaatagaatagaagttttttttcgaaaaaataaaaattctatttatccccccgggcagataaatagagacggagagattatttttcaacctactccgaaaggggtagataattggagacgggcatataattagagaaaatacggtatctgataatttattcttgaccagtaaaatcttaatttagaaaaaaaacaaaactggacctaattagcagtgggccaactagccgcccaattgcgccatgcatttccaacagtccttgttccgtggattgcatccgtggcccgatgatgcgcgagaacagtgtgttcatggccacattgatgttgggaaaggccggtccaatcagcagcacaatggcgccgtaataaagccacgggtttacccgtgtcaagccggcacaccaggcgtacttgctcaagtcacagcctcccaaatttgtagtagaattttctgaaaatttatatgaaaatttcagtgttacatccccctccaataacctagctgaggtaagaaaaatgctaaaacttttaggcttaaaacttctatttcggcccatgattccgcgacccgatgctcaatgatcacatacttttccggattatatgtgtggtgatgtcataaggaatgagaatgtggacatggaaaaaaccaggacctctttcgtagttcagttggttaaaagcattccacgatttggaagggcctgggtttgagtgccaccggcgggcgggttaccttttatcttcttattcatacagctaaaggaccgaaaaaattgtataactagaacttaatgattttatttatttacgtataaattgaaaaaaaaattaattcaaaggaattgctcatttttattttattaattatatagtaaaaataaaataaaaaagatataaattaccagtcgttttatgatgcataagttgaacttgattggacagaaagggccaagaatatgtgagcagatggaacagaaacagtgccaccaatgagaataggcacacaattcgatcattcaatctaagcgaaagtgccataagatgggccacacaaatttaattttcaaaaagtcacaaaatttaaaattttaataaataaaagtgactttttcagaaaaacctttataatgacttttatgggtgtattttttatttttattaataaatttcacaatgtttttcaaataagtgcaaaaaattcaaaattgccaaaagcaaaatttgcagctttaattattgaaatattttttaaaaattcttgaaccgattaattaattattactttttcccgcaatcaaaaataatgtatgccacatagacaagcagtgcaacaacaccgcgtacagcatgtgccaatgaatcatagaacaccacatcaacaggtgaccatttgaacatcaacatggcaaaagccgtaccaatgctatgaaaaggttcaaattattaagatttgtataataaaaaacagttctaatgcaggggtgcgatcgaaaaattttcaaaataagaacatcaagaccaaaaaataagtaaggacaaatcttacaaataaggacagatcgcacccctgttctaatgccaaaattgtgtactaaaatttttgattttcacaatatacatcgctaaaaaaaattcatgtatcaaaaaacataaattttcttttttttaattaaaaattttggtatttttgcttaaaaaatggaaatataatatcaacgatcatacggaggcaattctttcggcacattcaaacctaacgaaacatttgtctgaatttgattaaaaattttaatgaatttttaacttttaaaatatttttttgaattttcactttgttttcattgcgctctgttatcccaacatgactttctcgaaagcgcattacctaaaaaattatttgaatttgacattaattatgcatttattttttaattattctggcaaaatgtcaccagcaaaaccataagtaacacattgacgagagaagcgaaaattgccggaatagtgaacattgaaatgtttaagcaacgcgattttgaaacacaacagacggtgaagccgggataatcacaaaagtgaacaccgtttggagagcttaataatcatnaattggtaattattataaataatt

SEQ ID NO: 14034 - DNA, 1175 bp, Heterodera glycines
attaattattagggcttccttttttaggcaaatgcctaaaatttttgcgcacttgatacgcatagataagcacgaaaaacgcgttttccgtttggttttgggtgtctacgatgacttttataatgcctatttttgcctatttcggggtttttgtgcctaaagtgcctatttaaggattttcgaaaaaatccttaacaaaaatgcaataaaaacgaagaacacacccctaagaaatgacccaaaaaaatttcagaaaatacaccaagaattgaaaaaatttttcaaaaaattgttaaaaattttttggtttaaaaatttgttcatattcgaaaaaaactttaaaatattttataatttcatttacaattgaaatatttaagtttgaacgtgttttgttacctaaaacgttaataaaaaattttatttgcctattttagtgcctatttgaggatttttgtgcctatttaatgcctattttgcgatttttttacgcctttttaggtgcctatttcgcgattttttgtgcctaaaaaaggaagccctattaattatgcatttattttttaaattattctggcaaaatgtcaccaacaaaaccataagtaacacattgacgagagaagcgaaaattgccggaatggtgaacattgaaatatttaagcaacgcgattttgaaacacaacagacggtgaagccgggataatcaaaaaaagtgaacaccgtttggagagcttaattaatcataaattggtaatttattataaataattaatactatagcatgtcaattatttcgttaatggaacattctttaataattgaaaaaatagttaaaaattaaacattaaataaattttaaatttaaaaaaaaattattagaagtttgaaaagcatatgtgttatattattttgcttgtgctttgtatcaaaatttaaaacatttttaaataacaattagattcgaaaaatgaaataaattggataaatcaatgaatcaaaaaaataataattaattaaaattttgacagaaaaaaatttaagttagcaaccgatttattggcaatagattcctgagatttagaccggatttgatacttaaactcgagaattgcactaatcttgagtcaaaaactcacccacctggacccaggattacacccatcgcaaatccgccg

SEQ ID NO: 14035 - DNA, 863 bp, Heterodera glycines
  misc_feature (755)..(755): n is a, c, g, or t
  misc_feature (771)..(771): n is a, c, g, or t
  misc_feature (794)..(794): n is a, c, g, or t
  misc_feature (810)..(810): n is a, c, g, or t
taagaaataccgatcagccgatgaacgcatcttcaatttggtgcaaaattacattccagtgaacccgaacaatgatattgatcacaattaccacataaacccaaaccatcatattattttggaatttcttcgaggcatttcgcgcaattatcatatgaacccgtaaattgtttgctttatcattttattattattgttattattttacaattttatgaaaaatttgatgtgaaaaaaatctggtgaaaactttattagtttattgttattctacatttttgtcaaattttaaaaatttttaaatttaaatcgctcaaaaatttcccactgattcatgattttttaattttggcttggcgccgaaacgaccctggcgccgaaacgaccctggcgccgaaacggcggcgccgaatcggtggcgccgaaacggcggcgccgaatcggcggcgccgaaacgatacagactcattattccatcttttatttcattatttccactgataaatttatttgaagttctaattatgtataagtaattggacatttttttttaatttgagtacggttttatttgatttctagataaattgtgaaaacggaacataatttgcaattagaaaaatcaatttttgttggatcaaaaatcgtcaaacaacgcgcggaaattaaaaaaaactgataattctcgaaataaatgtatacaaaaatccgtttaaattaaacattcctaacggcatcatttttgtataacatgngtatcacattccgtanaaattctgataaaatcacagaanataaaatagaattcanatttggtcctacaaattcagattaattagcaaaatgatacttagattcaaaac

SEQ ID NO: 14036 - DNA, 2922 bp, Heterodera glycines
aataattttttcccatttgtattttatttgttcgggggaaataggccaaaacattagaattggcatcacaccgaaagcacaaggttacataatttttatttaaaatcatctttccagaaattttgaaaaaaccccataaattttcttatattttgtgctcctccattttttacttgtgttggaatttccatgaacacggggccgtccattttgtgctgtccttgcccaagcggtgttctcacttcagacaatcgaaagcacacagaatgccaaagaattggtgcagcaattgccaaagcgaacaaaagaataattgccaataaatatttgctaattatttgtgaccaatggcgccgatacatttgggaacaacaaatggcacaaaaacggttcaatgacattaggaaattcagctaaaattttaaatttatttttaacatttcatattgctaagaaattagaataaattgctttaatcttttaattttaaaaatgcctgaaattggattaagcccaatgtccatagcaaacagtaaattaaattcgctgcggcgtttgcatgattcagcggataaaagattgtcggaacataggcccaatatgcgcatttcttgacaatgcacaataaaaatttgctaaaatggaataaaatttaaaaaataaattaaataaatgttaatctgagcttccaaactcaaaatcgtccaaaaatggtctgaatcgattctatagtcacaacatgatgagaaaaatgcgaatcagtgggtccttttttggccattttttggaaatttgtaatgaaaaatataataaaagtgaaagaaagctaatctttttcaaaaaatcaaaattttttaaaattcaaattatttttaaagactagcttttctttttggcatagattgacactttaacgccattttcgtgtgatataaaaatcaattccgactatttctgagctttgttgggaccttcgatttaatttaaatacttttgcatttaacatctaataaaaataaattcataaaaccttaaatccacaaagccaagcgcaataaaaagcgtataaaaggaggaggtgaacggcggacgatgcctttgacacaacaaaaatgccaaatccgacaaataaatgggcaaataaacaatcaaatggacaaaagtggcaaattcggtaataaaaaccaacaaatccatataaatttaacagtgtaaaattttaaatatttaaaattgtattaacaaattcaaattataaaataactaagatcgaaatttgaaaaactttgtattatacaattatttaagaaatgaaaaaagaatatttaattgttatacaaatgcttgtcccaaaaagatatttctttctcttttattccgtgatgagaatccaaaattagtaaattaaattattacgccaaaactaatttttaaaaatggtaatgataagtagggttgtaaattatatggacaaaaaaacggtaaatatggacataaaatatggactaaaaaagcccgaaatatggactaaaaagctcaaaactgtccaaatgtggaccaaaacatggactaaaaactgccaaaataaagttttaaaccccaaaaaattccaaaaaaggtttatatattcaaatttgcttaaataaacttaaaaaataataaacaaccaaaaaatggatttaattaaaatgccaaaatgacgacgaaagcacaaatttttcatattttttggggtgtaatttttaaaaatttccaaaaagtcgaattttaggggtgtatttattgcttttcttgcatttttcttgtgaaaattcgccaaaaatggccaaaatatgggaataaaaaagcaaaaatggtgaaatatggatttattcccgaaaacccttaaaatatggatttatatggactaaaaacattcaccaaaccaaaaaattttaacgcagaaatgctatttttgagcccctttcctaataaatagcatatgcgcagaaaaaatatgttatccatataattacaaccctatttataacaatgaaaaaaaagtatgcatactaaagaaatccttttgtaatttttacacctacaaattagttgatagctttatttttaaatttttctttatttttctattgtaaattttttgaatatatttaaaatattacttatatttattttgttataagttaatgctgtctcctatttttggcatagcctggtttgttcaaatatctcaatttgatcgtccaaagtaacaaggattttttgtgttttatcagttggtgccgtgcggtttcttgtttaattgcggtgccggccaatgatatggcggatttgttatcgatgttcgaccaatgcatttaaattatcaataaaacagaattttattttataaacaataaattggtatgattagttttatattttttgttgaatttcttacaaaattttttaactagcctattatatatgcctaatttatcatttttgcctcatttcaatcgaatgtcatcacttaaaatccaactccacaaaattagtagcattttgagataattaaacatggcgaaaatatggcctaaagtcattgttaatgttatttcaagataaaattgataaaaaataatctatttatgaaacaaaaagatttatttgagttatttcattgtttttgtgttttaatgaaaaaaatttaaaagattaatataatagtttcttttttttataaattttaatttttagcatttgtttatattaataattttttatatttcaatttatgtgtgtgcgtgtttttattttttagttatgtttaattttttattttggttttataatttagtatttttatttgagtttggatcataatggaattggttattatacattaattattaatcggcattaaaattaaatgttatctat

SEQ ID NO: 14037 - DNA, 877 bp, Heterodera glycines
ttgatcaatgaaggacaattgatcaaattaaatgagggacaaatgatcaatgagggacttgattaaaaagggccaattgatcaaattaaaacgagggacaaatgatcaatgagggaaaattgatcaaattaaaacgagggacaaatgatcaatgagggacaattgatcaaattaaaatgggggaaattgatcaatgaggggcaactgatcaaattaaaacgagggacatttgatcaatgagggacaattgatcaaattaaaaatgggggaaattgatcaatgaggggcaattgatcaaattagaatgggggaaattgatcaatgaggagaattgatcaaattacaacgagggacaaatgatcaatgagggacaattgatcaaattaaaatgggggaaattgatcaatgggggacaattgatcaaattaaaacgagggacatttgatcaatgagggacaattgatcaaattacaacgagggacaaatgatcaatgagggacaattgatcaaattaaaaatgggggaaattgatcaatgaggggcaattgatcaaattagaatgggggaaattgatcaatgaggagaattgatcaaattacaacgagggacaaatgatcaatgagggacaattgatcaaattaaaatgggggaaattgatcaatgggggacaattgatcaaattaaaatgggggaaattgatcaatgagggacaattgatcaaatataaatgggacaattgatcaaaagaaaatgggggaaggcattgatcagaggattgggagggatgagtgattaataaatagaaagagatacgactgatcaatgaattgcgcacaatttaaaaaaaatgacggaaagcactgatcaaaggaatgcc

SEQ ID NO: 14038 - DNA, 1033 bp, Heterodera glycines
aagcgatggaacgggagaagcgatgtgagatgggacgggggggggaacgaagcgattgggagaatgcccacgggggtgagaaaaggcgaagagatgggcatctctttgtcactgtacagttagtgctgcgctgccgtgcacgtgaattgcattttcactgcccctctccctttttcgatttaaatattttaagtgtttttatttttgtttgtttttaaataattatttttaaattaaatttcttttctttctttttttttcttttttttttttatatattattgttatttttattattttctctcgattaattgagcccctcagggcaatcagaattcgaattaaaattgaacagattttgatttttagtgagaagaataacatttttcttttttttttttagaccccgtggggttcattaaattttctcatttttaggagacgtaatttaaatgactaaaaatgtgtgctcaatgcacgtatttgcatttctaatccccctctccatctcttcaattaaatttatttgttttgatttcaatatttttcaatttaatgtcattatttatttatattatctttttaattaattgatcccctcagggttaatgactttccgactaaaatcgagaagatttgatttgcggtgagaagagtaggacacattttttcagaccccgcggggttcattaaattttcctttatttttaaggcgctttaaaatgtctaattaatgcatccgtaactttatttttgtctttactttaccggaattaattaaatctccccttttaaggtgttgagaaaatgactaatttatgtgtttattattcacagttctctctccccctcttttttaagggtcctttttgactcactcagataaatttctggaccacgtgtgggatgacttttttttgagtgtaaatttccgaaatcatttgcatggaattttgatttttttttttttttaacttagacttttctgaaaccatgcatggaatttttgatttttttttttgactgctgctgc

SEQ ID NO: 14039 - DNA, 1174 bp, Heterodera glycines
ccccttttttttaaggggtcctttgtggctcccttcagataaatttccgggaccaggtgggggatgacttttttttgagtgtaaatttccggaaatcatttgcatggaattttgatttttttttttttttaagttagactcttctgaaaccatgcatggaatttttgatttttttttttgactgctgctgcagataattcaaaccatgattgagtatatttttcattttgtctgtaaatcattatcgaaccacgcgtgggataattttggatttttttttttgattcccagggggttgctggggcctgatcaggactctaaaattgattagcgacttgcgcaacacagacaacccctgaaaagtcggtctgccactctgatccccctcttcccatggcccaagccctgtaagcatagggttggaaccatccggtgctaccagtaaagccgtgatgtcccatacccagtgcttatgagggaaatagtccagaggagccctcttacgcgtccgtaattaggccccgcagggcttggaagggaagggatgttgatgggtgcctgggggtacctcccaggcggggatcgattagccattccactgaatgactcccgactgaactccgattgtcccttttgctggttatccattgccttttaagcgccccctcgggatgggaggagccctatcggagagataaaatgtggggagggggaagggtaaaggccatttccggtcccggccttacaacagtatcttccttcagttgagattgatcaaatcgaattcgaatttggtggtcccaaagttcgcctcaatttcgtcaccaacaccccacatcgaaacaaatgggtacaaagaaacgggtgaaggcggaaaagcgcagtccaacacggaatctgtgaaaaatatacaatgaaaaaacatgaggatatttgtttaaaaaatactatttaaaatgtttttaaagaaaaactcgttttgataataaaattataaaaaagtgagtcatttttattttaccgacccaaaagcactccatttttggtgaaaaaggcccgccgatttgcaaaatgaatgccaattccgaccacataactgacaccgtattcacatctattttgatcatttgtgaaattggggcaatccatgtaacaattggcatgaccatcagct

SEQ ID NO: 14040 - DNA, 3523 bp, Heterodera glycines
gagaagaagcaacagacgagagacttacaccctccctttttgaggccacataatatggaactagaaaattttatgaaccttcaattgaaataattaatataaactacaaaaaatataatttggaaagatcggtgcacaaatgtcggggcgcaaaaatccgaaaagggcccttagtaaatgggacgcaaatgtttggatacgataattataaattcaaatacaccaattacaacaaaaatattttttttattctaaccttttccagccaatgcaaagaaattcccgtgttccattgcacttccggacaattgaacccgctgacgtgggaaaggtgacaatatcgtacataaaacctttgatcattaaattcgatgccataaattttaactgaaatttaatcttttaaaaccatgaaagattatttctattggtctactgtttttccatttctgctgttgtcattttcagcttaagcctttcctttttcccggggaaagctttacaacgaataaaaaagagcataagatttaaaaaaattattttctcacgacaatttcggaaattgtaaaatggcggagattcaaaatggaagtggagagggggggggggctaatttatgctgtcctgctctgtcatttagccaattggttttttctcatttcagaattgtcgtttactgtgaacagtttttcattgcttttccgttcgacgagtgctaccgtatcccatccacacaatttcatgccaaccataaccttttcttggccaacttttatgctaagcatttgagcgttgcttatgcattggacggcgcttatcggctgttggggaagaaagcaaagtaagcaaaaagagaataataaaaatgaattattatatttttatttatttaaaaaagtaaattttagatttgtgcgaatttactcaaaaatttggcgaatcatggaagttttgcactatttcacttcacgcggatgggttttcgagtcgcaaaatgcgctcaaaatgtgggaacggttaagcgaagaggacaaaaaggtggtagccaaatgctcacaattaagggatgcgccatttccgatagatttggacgaaattccgttctaaaaccattgggataccggcggaattcaatctggatttccgtctaattacggaattaacggcttcctgatgcttttcccctcactcattaaacacatcacttttagctttattgtttcgatgttcgtaaagtcgactgggacaaatatttgtttgactatttgatgggaattaaggtgcctaattttgttttaaataaatttgattaacttttattaaccaatttgggaaaaatgtaaaaaagacaaatgaaacttcacggggcgtggcacggcgtttcgaaaaataaattttgttactatttgaaatgtttcgacacaagaaaattcgagttgggtcaaccaaggtcctatcaatgggcatcggctgaaagttttatacttttaaactcaacgattaattaaattatgtaattggctccaagtccaaattaaaggagaaaattttaaataatttaaacaatttttagatttatttgctccgggaaagtttggacgacgtgccgagggcacaagcaaatcttttatggtcagaaagaaattaaattttgcaaaaaaacttgggctttacaggcaaaaacaattgaatttgtactcaaatggtctcttttttgctttgctcgtccgtctttttgcgtggtaaaaaataattatttttgcttttcatttacttttaaacgataataatttatcacaaattcctattaattaattttttctgagttgtttcttcatttttcattttccttatttttggtgtcatttaataattttaaaatgcttaacccaaagatggtacatatttctgaggattatccccatttgtgtttttttgaggggctcagagtttttttttttgaaaagaggatttcgttacttttagcgttttgactataaaaccagagcaaatttttcatattttttattggtttttttggcaaaaatccttaaaaattagttgtttttttgtcaaaatttgttaagtaatcgaataattattcaattttttccgatagcgcattttggcactgctccataaaattctaattaaataaaaaaatgctcataatcagaaacagaaatttgttcatttttagacatgtttattgacaagtctcacctgaattaattaaaaattttcccggcggcgctgtcaccacagccggcggaaccacccttaagaaataaactttgatgaggattattttgagatacctcttctgtttaataggctcttggtcctgtctaattttaaaaaactacaatatttgaccaaaaccttggaattgtaataatatttcatcataaatccatccgctttaggaggcgatcaaaaagacaacgctgggcattttggctcagcggctttctgctgagctttgcctaccaaaatgccaaccattggttgcgtcctgctgttcggctgcgcaatttggaggagtacaagcggacggcgctgcgcttcttctcggaggacgacgaacagaaaaatgggaacggcggcgagagagtgcggcagcggcggagagcggcagaaaacggcagaaacagtgatgaaaatgaacacaacagtgatcagcagaggagggcacaatcagactgatcaatcgatacccagttactaactgaagcgaatgagagaaagttttgcagaacaaaaaaacaaaataattttttgaatcgcggaaatataaaccagctattaaaatcaagcttcagggatgttgaagattctgtgccattaaatattcggatcaaattaaccattataataaaagactatcttcatatttttcaagtttgccatgaaaaaattgtagaaataaaataaacacaagtatttatttgcacccaaaaattcatttaaaacaaataaagggtgctatgacgaagcacgaaaagtgctgggcgaagcacgaaaaagtgcaagtgatcaaattaaaacaaaataattattgtaaataaatttaatatatattatttcaaacgtaaacaacataatttttcaatataataacaattaacactttataataagacaatcataataaatcataaattattttttaattttataccaacaatatacatatatatgaacataaaagaaaaatatgtgattggaagaaattaaattgtaattcaggaaaattagtgactataacccatatattttctataaaaatattttatccaatattaaatattttaataaaaatgagaaacaaaaagtgtatttttattgaaatttaaaaatattataaaataaacgcattaattaaatagctaatattaaataataataatacattattattatatttgaatttatttacaataattattttgctttaatttgatcacttgcactttttcgtgcttcgcccaaccttgcacttttcgtgcttcgtctcagcacg

SEQ ID NO: 14041 - DNA, 1537 bp, Heterodera glycines
ttccatttgatactgttgttccgacttcggtagaatcgctataaaagcagcgatttggcatttttcgcccttctcatcgactcactctttgtccctaataaacggcaacagataaagcattttgtcataatgttgccaaatcggaccctccacacattggtgctgtcttcgcacctcttttttgaaacggtctctcaacgttttccatcgcgtacgaacaaattccactacaaacggataaaagttaattcgctggctgattatccccatttggctgattatcccctttgcccccccccccaattcctaccactttgctgcatttcttccgccacttctgcccaatgtctattgcgtgcctcggtcgatttgtactcgtcccttgtgaagtcgaacagtgccgggtgtctgctgacctcctccaatgtgtgcccattattcccattctgttctcccccctcccgctcgtcccacctccaccagcgatgaattaaaatttcgcgtgtctttcgcgtcgaatttgccgtgacagtcatttgtcgagtgaaatgtctcttcctcggcattcccccgacgctgcgacggccttttcttttttatttcggtgcgcaacggatgagtgccgaaaagattggaaatcattgcgggaaaggccgagtccaattcgttcgcttcgcttcttctattttcatcgccattctgaaaatgtttattattggatatttcgcgaccaataaaactcctcatcacttccccccccccctccatttgtcccccctttcgactcacttccgctgctccctcctcttcttcctcctcctccctctcttcttcctctttctcttcattgaccactttctcctcttccttctcttccggcgcttcctccatctttggcaccttttcaaacggttcctccccctccattgtcattccgtcatcaatttcttccatcaattttccctttttaacaattttttcgttgataaatcggcgcttcattaatttttgcccaattaaaagtctaaaaaggaaatgaaataaatttgtaaaataagtttctgtttcatgatgattattattgtaagaattggccccacttcgcctccataagttgtggatgggtggggggggtgacgttcagtcggcgttctgctgctgttaccaatggttgagagcacaaccgaagacgacgaggcggtggggcgggaaaatgaaacaaattcgcggctttgccctcgcgttggagaaagcaatgcgcagaataactggggagacttagggttagcgcatcaattatttttttcagaatgtgatcggggtacaaaagatacgggtccaaaaatgggtgtaactccgcttggagatgcgttagaaaagaaagaaaaatatgttcggacagcttttgaagagctgcattgaatgctgcagttgccgctgctgtacgcccacccgttgctgagttagggttgagagcggcatgaaaatagtaaaataggaggaaaatgaaacaaattcgcggctttgccctcgcgtt

SEQ ID NO: 14042 - DNA, 1216 bp, Heterodera glycines
  misc_feature (50)..(50): n is a, c, g, or t
  misc_feature (78)..(78): n is a, c, g, or t
tgcaaaatgtgtcttggttggtattggcacttctctctttctctctcccncactctctcaaccctttttctccatccnccgccctctctctccttgctccgttgcgtttccgcgtccatttccaatttgaactgttccggcacttcgcttcgtcttctctgttccgtttatatgtgcctctgttgccaatgcgcttcttttcgtcaccgttgtgccatttgtggtttcatttgccggcgcttccgcgtttcttttccccaccgtcccgggacctcccggacccgggggcggtgggttaaagttgtaaccaggggcatatacataataggccccgggtgctgtgtattgctaaaaggaattttggaaaatatttgttgtttggaatgcttaattaccgcttcattcagtcgaataagtgcaaaaatggaaagaaatagcataagcaacctaaaaattgcccaaataagcaattaattgatggattaaagaagtcaaccaaccaaccctttgctcaaacgtccgaacattgtcaggttgttgttgtgaagccaaagaatgatggaaaacaattttggtgtccttttataaggccaagtgttgcttaacctcttcatccgtcctttagaaaatgggagggggggacgactttcccttttgtttgtattataactcaacggttgaaaggggaccggtcatccgaacaaaaaacaaaacaaagcgcatccaaagtgatccattcattcactttcatgtttattcagttatttgacatggacagatcagcagcagaagagaatcagcactcattcttcattcactctgtctatccagtcttttttgtttgttaccgggtcaattcgtaattttctcccactttctgcaagtgaatgcccctccctctttttgatcagtcactgtctctttctctccctttgtggtcaggaagagtctctttctccctcattatcttcccctatttgatcattgtctctccctctctcaccctatttgatcagtaatgtttctctctctccatctcttcccctttttgatcactttgtcatcatttgtttcttctgtccctcccttgtctcttctcaaattgctgctgttgttgatccgcttttcccttctgacggaattattcgcttaaccgctgcgtttggcaaatgcgagtaaggaagcgaaaaaaatatggacaacataaaaaaggaca

SEQ ID NO: 14043 - DNA, 1799 bp, Heterodera glycines
ggtaaagccaactcatccatacccaactcatccatatacccaactcatccatacccaactcatccatagcacgatacgagtcgtcgccgtggcatttaatgccacgactaagaccgtacaaccaaaaaatgccacgaccgagaccgcataatcaaaaatgtccacggtcaagaccggcataatcaaaaatgtccacggtcaagaccggcataatcaaaaatgtccacggtcaagaccggcataatcgaaaatgtccacggtcaagaccggcataatcgaaaatatccacggtcaagaccggcataatcgaaaatgtccacggtcaagaccggcataatcgaaaatgtccacggtcaagaccggcataatcaaaaatgtccacggtcaagaccggcataatcaaaaatgtccacggtcaagaccggcataatcgaaaatgtccacggtcaagaccggcataatcgaaaatgtccacggtcaagaccacataagcagaaaatgccatgccacgaccacataagcagaaaatgccatgccacgacgatgactcgcagcgttatggatgagttgggtctatggatgagttgggatggatgaggtcggggggtgaactcgttttttctctctttgtctcaccctctcttttctctccctctctctcttttctctccctctctctccctttttgtctctcttctctctcaactcactttctccaccctgccacacatttggtgcatgtgatgccccaaggctgaccattcttcaacgttaacactgtacacattggagcattttgggtcgaagtccgtttcgcatgcgatacactttgcatagaaaaagcttgaattcgagaagaatgcatttaaagcgtatattaatgctgacttgagtttaaagcattgggtatattaaggaatttgaatgccgtaattagcaattgtcagaatagtttaaactcatttctgctaatttaacacctgtttctctcgtaagtgaatggaatgtgcagcgatttgtcgatgatgcatttcagaaaaaggcgccaataatgctggaattggggagttggcctttggttggcttagtttttccgaccggaatggcatcctttcgccatcggacggcttcgttgtgccgcaaaggttctctcatggcacggcaaagatttgccatttcggaaattccgtagaactgaaggcaaagaccgagtgcatttagtcctccgtttggccatttgcctgcgcttccttttccagcacatcgaacagttcatctccgtcgtcgtccacatgcaaaatgtatccattccgcaagaagttcagcacgtactcgaacctcaacaagtgccctttctcataaatgcggcatcatcctctcctccctccgctcactttgtgccgtctctgtcgataaatatttctgttccttcgttttgttcattttcatccaaaagatgagtcagccttaacaaaagttcgtttctcaatgtcttgagattttctgatttttaaacttgtctttttattattttgaacaaataattacttataaaaagattatgtgacaataaaaaatgaaaaaaatttattagagttcgacatttgaaacaaagtctgggtcttgcacctggatttcccggacaaatttccaggaaaaattcggattgcctaaaaatggactagaaaattgttatttttgttttcgtgttttgtttacgtacaacttcgtttttttccaattttctatttcgttataagtattttagtttcatttaaattatcttttttggttttctt

SEQ ID NO: 14044 - DNA, 582 bp, Heterodera glycines
tcagattttacttttgacatcgttaagacctcagaatccctgtgtgattggggattctgagtcatcttctgtggggggtgggcggtaggttcgaatccggccggtgtaaattatttttctatgactttttacgttattttcaatgtttttaattaatttaaaatattttgttgagttaataaataaaaaattatatttaatttatttttttttgataaataaattttataagtttaaattaattatttttttaattgatagaatttcatgtatttttttaattaaatttgttaaaaaatattttcattttaatttaatgaatttactaatcactgttgtacctcttctcatcacttttgtacctctactaatcactgttgtacctcttccaacacatcttccaacaatttttgtacctcttatgagctcaacaacatttaaatacgggcgcgaagcgcccgtccaagttcaacaaaatttagaaacgggcgcgaagcgcccgtccaaggccaacaaaatttgaaaaacgggcgcgaagcgcccgattgaggccgcgaagcgtactaatatgctaaaaaacgg

SEQ ID NO: 14045 - DNA, 1312 bp, Heterodera glycines
  misc_feature (1245)..(1245): n is a, c, g, or t
tatttatagtgagactgttttcaactcgcttctattattaaagggtttaaagatgcgcataaaggccttaattaaacacaagaacatattcacatattttgtgtaattctatctcggactccctcctgctcaaaataatgagtttaatgcaaaaaagatttgagtagcggatactgcgaagatattttaaaattttcatctcttaattattttcatttaaaagtagttatactttttctgtctgcagctgtttgactttgaatactgcggagtaaaaataggaattttttcttttcactaattgaggataatttttgtcctttcttgattagctaataattttgaaaattactctccaattaaaatatacttgcttttttcaaaagaggtattcataattttaaaataagcacatatttatagtgagactgttttcaactcgcttctattattaaagggttaaaggatgcgcataaaggccttaattaaacacaagaacatattcacatattttgtgtaattctatctcggactccctcctgctcaaaataatgagtttaatgaaaatagatttgactagcggatactacgaagttattttaaaattttcatctcttaaaattattttcatttaaaagtagttatactttttctgtctgcagctgtttgactttgaatactgcggagtaaaaataggaattttttcttttcactaattgaggacaatttttgtcctttcttgattagctaataattttgaaaattactcaccaattaaaatatacttgcatttttcaaaagaagtattcataattttaaaataagcacatatttatagtgagactgttttcaactcgcttctattattaaagggtttaaagatgcgcataaaggccttaattaaacacaagaacatattacatattttgtgtaattctatctcggactccctcctgctcaaaataatgagtttaatgcaaaaaagatttgactagcggatactacaaagatattttaaaattttcatctcttaattattttcatttaaaagtagttatactttttctgtctgcagctgtttgaccttgaatactgcggagtaaaaataggaattttttcttttcactaatagaggacaatttttggcctttcttgattagctaataattttgaaaattactcaccaattaaaatatacttgcatttttcaaaagaggtattcataattttaaaatagcacatatntatagtgagactgtttttcactcgcttctattattaaaggggtttaagatgcgcataaaggccttaa

SEQ ID NO: 14046 - DNA, 3301 bp, Heterodera glycines
  misc_feature (17)..(18): n is a, c, g, or t
cttgcatgggcctgcannggtcatctttcaaaaaaaaaaaattatatcatttaggtgagggctttcttccgctcacccacggttctaaggctgccaaaagttgcaaaatttccataaacttggtaagtttttaggtttatgacccctcagacatccgacggagatttgatgattaaaattaaaaaaaaaaccggcaccaatttaggcttgtttctgtcaaaggttggtggttttacattttcttggctttgcaacctgttgcgcaacagcttgttgcccatcataaacgtccatcaccaggccgatgtaacggagtgtcataatgcaaaagggcgttgtccaagtgatgtcataggtggtggattcagcatgcccaaaatggggggagagggaatttgtttgtttccatgaaatttggcaaataaaagataagcgaaccaatagccgatgagcagatgaccctgcaataaaagaaagaaaacttgatgatttccttagttaaaaaagcgatttctgattgaaaacttacggcaatcgcctagatcattggtcccgaaaattttttctttaaattttttttctaaaaattcttataacacgtttctaggggtgttttgaggcgctgagcatgaatccggcctccatttcgacctatttgtaacaccggacctgacttcgaacattttaaatttttttataactttaaaaatcatgaaaacatgtttccaggagttttctgggttgctgatcatgaatacgacttctatttccccctaattccgaaccccgatctcaaattccaacaaacattcgaaaattcaagttctttaaaatttcacttttttgttcaaccgttgtttacacacacggaaacgaactgaaagccatcaccgatacgcatcagtgctacaataaaatcgtttaaaccattttagactaaaaatcgaaaaattctaattttcgactctgttcgaattcgggtctggtgttacaaacaggtcaaaatggaggccggattcgtgctcagcgcctcaaaacacccctagaaacgttataagaatttttagaaaaaaaattaaaagaaaaaattttcgggagcaatgatctaggcgattgccaaaacttaccaagaaacaaaaatgcccaagtaaaatagagagttttgtgccgggcaaaaaattgacgatcaaatagacgagaaaagtgctcaacaaacagtggtaaatttgaagccctgaaagagggaaaggaaaatttttaagtttatttttcatgtaaatccctattgcattttcagggtctttgactaataaacatttatacactttgataatttgaaataaaacatggtcagtcgaaaaaacaaattctaaaagattgtcaaggaactccagcgtttccctgcctaacctgcacctggatccaggaaaaacccaggcctggatccatgttcagggagagctctaacaggcacccttcaaaaaggcaacactcattgaatgagctcaaatttcaaaatttgaaataccgaagcccaaggggcagcatattaaacagacaaaaaggaacgaaccgcaattgaacagataaagcagcagtccgatggaagcgaaataggaatgttggatcaccgcgggtttgttgaaaaggaatgtgcggtggacagcggccaagggatagccggccaaaacggacaaaatgagacgcaccgcatcctcacgcacactgatataatcggcaaaggtggcaacaatgccgaacatttattacaaaaataatttatttttatttataattaaaaccctgaattgtattgtaaaaatttatataaaaaaatagataaatagcaacagagagtttctctcaaaagcatttacacaccgagtcaattttgagcccccagttcaaaaactaattgatttgttgtctcagtggtctgtgagtttgccaccaaaaagggagtcccaggttcaatcccacctgagttatatatttaattaagcaatatttcacgtttttctcaacgaataaaaataattaagtcatattattctaaaaattttttaagtaaatttaaaaaacaaaacaaaatttgatcacccaataacatcaatgacagcgtcatcttcattttcaccatccgaatgctccaaaaaattgtcgttttctttttggtcttccagcctctaaaatgtttaaaattcaaataattggcgcaaagtctcatcaattacctaattagttaattaattaactttgatgcttccatttacttctaatctattagtaattaactttaaatcgttttaaataatgaccttttatttgtgcacttttgggtcaaaatttatgaaagtttagaaattaaattaacaaatgttttcttttgtaaaaatcacccatcgtttttattccaccgaaccgttggtaaaaaaactaacggtgattggctcgggtttgatgggcgcgggcattgcccaagtcagtgcccaggcaaacgtaaaagttgtgctggtcgaccaaagtcagtcaatcgttgagaaggccaaaagtggcattgaaaacagcatcaaacgggtggcgaagaaacaattcgaagacccgggggtgagtgacccaccaattccatcgaatttcggataaatgttaaattattgctttttttagaaacagaatgaactcgtcacccgcgctctttccaatatttccctgtcgacgaatatttcgcaggccgtgtcgggcgccgatttggtcattgaggcaatttctgagaatttggacgtaaaacggaaactgttcgcagaagtggagtcggctttgccacagtgacttacaattggataattcaacatttattttcggatggcatttgtccctttagaaatgggaaaatggccacaaacacttcttctctgacattggccgacattgcggccaatttgaagcgcaaagattcctttggggggctgcactttttcaaccccgtcccaattatgaaacttctcgaggcaattaataaagaatagtaacccatgctttttaaaaaacaattaggttgtccgctttgatggcaccggcgaagagacgttcaacgttctgatggactttggcaaaaccgttggcgaaacgaccgtcgtttgcaagttaattgtttcgactccgtttttttctttaattggcggagattttaggacaccccggggttcatagttaaccgtttgctggttccttttatgctggaagcaatgcgaatgttcgacagcggcgatgcgaccaaagaagacattgacgtagctacgaa

SEQ ID NO: 14047 - DNA, 2408 bp, Heterodera glycines
  misc_feature (28)..(28): n is a, c, g, or t
aatagaaacttcttaaattaagattttncgggaatttccctttcggtgcccgtctcttggtttgggacagtttccgttgccacatcagcgaggacacaaagaagacgcttcgtcgcttggcccttcactccgcggttatatcccaggtggcaccaccaaatacattcaggtcaaccccaaaattttgcttattgatacagacatttttaggcgccagatgtctgttggaacgcgcccttcaaagaagcgattcggaagctgtacaacgattggatggcccatggcgaaaaggcgacgacatcaggcggaaatctgaaggccccgccaatggaggtttacctggaatggattgccaatgcatgggactcgcttccaaagcaaatgattgccgactcttttttgacgtgtgggattagtaaggaagaaaaaggccgacacgacgacaaaattcacgtttttaaggtcctcaagaatgttaacattttttgaaattcttatttttaaccggacggagcaattcctaatgggctcgctatgttgaagcaacgccgacaggaagaagaagtactgaaactggtggaagaaatcgatttaagcgaagacgaaagcgacgaagaaattgatgcagaagtttcctaatattttttttgttaatgttttattaaaacaaattgttcaatagtttttgcacgtttctgacttcaaaagttttgaaaaaaaaattttttttgacgggggcttatattcgaaggggggcttctactcgagggggggcttctattgttcaaccccccaccaaagggggcttatattcgagggggggcttccattcgagggggggcgtataatcgaggaaatacggtaattatttttttcaaatgactaatattatagaaatgcgccacagagattgaactgagcaatccgctgactggatcatctacaacggcatgcttgtgctccgaagcgaaatcaaaggaaggaggatgaacgaagagaatttgagcgggccttttcctcacattgactctctgctgacacgccatcaaaaaactaattcatgacagcaatgttctgaggtttgagggtagccaaaatttccaaaaaatatattctcaaaacagaaaatcccctaaacctcaccgccaattttcccatgtcaataaaattaattatattgctcatccacctgcgatacccatgacatcatttacctcacatgacgatatttcttttacattttcaccatttatttattctagggaaaaggccgtaaataccaaatccaaaattaccccaaaagtcagatctcccacaaaatctgtacaaatttcaaatgttaaatttcaaaaaaacacacaaaattttaaaggctgtttaacaaatgcccagtctattttaaacaaaactgaccttcttttagcctttctcaacactgaaaaagtcaacttcctcataattaccgaatcctggcttaagaaccaaaatttaataattttaaactcaattttacctgacaattatcaaattttttctgccataagggccgaaaaaaaaggtggaggcgtttcaattataactgaaaaaaaatatcccatttactcctcaacaacggattccaaattcgattgtgaaattgtcgtattacgttttaaaaatttaaaaaacttttcactaattggggcctacagacccccagatattaatttatcgaacacaaaaaatcttttttcttatttggaccaaaaaatcaatggaccgaccttaattttaggggatttcaatttgaatagcaaatgtataaaatgggaaggtaaacaaaccccactttcaaaaattggacaacattttgtaaattttttcgcaaaaaattctctaagtatgcattgtaccgggcccacccgaggaaatgaaatcttggatctttgcttgacaaatgattctaggctggtaacagatgttgaaattaaagacagtctaataaattcagaccatgaatctcttttcataaatctctctatctttctacagaaaaccaaccacactgtaataagttacagaaaatttggcccaaaaaatatccatcaaataaattccttcctaagctttcatctaaatgactcattgcaaactgaatttgacttggatcataaatataataggttcactaaagaatccattgatgcaatggacttattttaccaaaataaccttcaaaaaagaatcaaaaaatgtcaaatatcccatttcactccaagcttctataaaggaaaaggcaaaaatctggaaaaagcttaaagaaaacccgaacaaatacaagcctttatataattaaattagcctacacataaaaattcagaatagaaaatttcaggagcgcgaagaaaaaaaatttcttacaaaaatcc

SEQ ID NO: 14048 - DNA, 440 bp, Heterodera glycines
cagttgtaatcagttgtccgagttttggtcccgttcccgctctacatactctagtttacagaataccgggcccgcttgactttttagcacctggaacctgttcacaaggaacatttcgaactggaagtgttcaaatcactttaaaccaattttatcgtgtagagcatggtcgatttagtattgtaaattttcggcgcttttttatctaagtcgccaaatgagatcagaaaaaattgggcaagtttcggcgataaaagtggttaatttttcaaaaattcataaaaaaatttaaaactgttgttctagatgcaattttttttaaactgatcagcaataaattctctcaattttttttaaactgatcagcaataaattctctatctttttcatcatttttagtcaaagatgcgaataaataaaaaaatgttaaaaaaatttaa

SEQ ID NO: 14049 - DNA, 1979 bp, Heterodera glycines
aaagggtttcatttttcataaaattcatttgaataaggtttgttttgtggtaacagaacaaaattccgccgtcaaaatcactcggctagaaatcttcaaacagtatcttttcagagaaaaattttaaaaaatttttatagaaaaatttaaagaaaataaaaattttaggaaagttttcagcgatttttttagaatttaatgttaaataaattactgttttgaaaattttaaaaataatttgtgttctattgaaatttctagctgcgttacatttgtctcggcgtgattttggggtgcaccccatttgtcgtgcttggcttaccattttgaaaaacattaattggtttagacggtttgtttggcaaagaccgatctactgatgaccaccaaagagcgacttttcggcactatccaatcgcttctcgcaggtcaaatcgctgaagaattgtggaatgatgaagaccaggtctcaacggcctgtgtgcgtgacttgcaacaagcggaaaaggtgaaatttgtcatgtttgcgattattcagtatggtgctgaattcagttggcctattttgcggcagcaaagtgcggattcgataaacagttggggctgatcactgtaaaaaataatttgtttttcttgatttaattaaaatgactcagatccccgaaagaagagagcctggcccggagctcaaaaacaaaatcgatgccgcggtgcagagaattctcaatcattgcaaaaccgaagcgcatacgctgttgttgaacattgaagtaaattgatggatttattataatattaaaatttttgtgtattttaaaggcagattggcaaggattggtccgagaactgtatgagaaggagcatctggaagttcagcaagttttggattttctcagcacaagccgaaattaacttaattgatttgaaataattttgttgaatttaatcgaaaaatgactaccgtttcaactaataaaaatggagtggcgcaaaaatattggaattaaaatttaaatgatagacatcaaagtggaaattcattagcagaatcaatttgcacagttcaatttccattcattaacattaaattaaaagaaattcgcttactgaacgtcccctgcaacgtcatttcaagtcccgttgcagaatggaccaacgatgtctcagaaagggcctccatctcggcaaaacggcactgtgactcacgggcaatggttctggcaacatgagatttgccggttcccgccactccgaacaagaacaatgctttaggcaattggcagccctcgtaatgtcccggatttcggagaaaatcgacttgttttttcacttctttgagcacgtctggcaactgaaaaatcgcacacaaataggcgataaatgatggaaaaatcaaccaaattggagtcaattcaaaaacaatttataaatcgatttttggaaaaattttgaaaaagcttagagttgatataaaatttgaaaaatcgctattttcaaaaaattcacctagaaaccggtagtattattttctaaaaagaaattttgtaaaaaaaagtttgaaaaatatgcaaatttttctttcgatttttcaaatttttgtgacgaattattgtttacaaaaaatttacaaactatttttttgagttttcaggtaaaaaatttatatgattattttcaaacatttcttgaaattaatgaaatgcgcggagggtgaggtggcaccgatggggaggggggaaacaaagtatacttgtacaaggggtctcagcccaagggccatacgacggacgattgtgacagggggggggggtgtctcgggaccgattttccatacgaaggtccaaatttttctccggcgtcgaccctttttttttgctattcaaagtacctttttttgcggcgcgttttttccaaaaaacttttgggaagggggtgccgggcggtccagcggtgccgataggcgccgccgggaaattttt

SEQ ID NO: 14050 - DNA, 1802 bp, Heterodera glycines
aaaattataaaaatccaattaaataatttaatatatccaaattaaaatctccattttaaatatatacctataaaaacatttgctatcattgtactacagaattggaaagaaccaattttaatttcagcaataaatcaacaaagtgcattcacacaaaaaattagaaaaagtattcaatgatattcttagtttaaaaattaaaatttaaaattaaattcgtcgtccattggcatcacctaccccacaaaccaaaatcctgggaccgtccctggtgcaggccagtaaaacgcattagaactatttccggttctcaacaaatttaagacggtaaattagggaattggaaaaatcaaaatggaattatgaataaatgctaataatcttttgaccattaacgtttttgttgctattcaatcaaatcaaatttgtttacttctgtcaatgcgttcgtccagcgcgcgaagcgaacgttcaactgtaagttttttaaataagtcaattatgcaaaaaatcaagtttcccgcccattgcggagaagtcctgtcgtttgaccaattccatttgagccaacttttgagggccataacttatttcaaaagcgactaatttacaaaatgatagtaacaaaaaattctattgaaaaatcaaatcgactaaaccaatggaaaaaactgaaatggaaaatgcacataaatactttttttaagggttttaaaaataaactgtttaaagggttttcggttgttaaaaatacagtgagtgaaaaccaattttttaaaattaatttttggtgctgtgttaattttatcatttcaacttttttagagcccgggtttcgaccaataagtccaaaaatagaaattgacaatattatccaactttcttttttatgctaattgtaaaaaataggcctttttgaaaattttggccagaaaatctgcctcaaatggaatatagaagagggaatttttctatgcttaccgcttcggatttccccctccttgttgtccatacgagcagaaagtgcaggaactgtaaaaagttacaaattaaattagaactgtttgccctttctcgcatttataaattcctgagaccctaagctttcgcttgataccaagaattttcatttttaattaccaactttgaaagttagttttgaaaatgttggccagaaaaatttgtctcagatggaactgatccctaccgcatgctggcggtcttttttttgagtggggggatgggaatctgtcaagactttgcattccccttaatgcccaaaaccattaccgttttgaatttgctgatgttcaagaatgtccatccgagcatgaagtgcagcaactgaaataagaaactgatgatgctcattgatatccaaaattgtactagagcaccaaagttcaatagtttttcacaatttctctcgaactatataaaattaaaggggggggggggtcactaatctgtatttcggaaatttttcactattttcttatcccattcattaaaatttctgagtgatgcctattggcaaagcctggcccaagctctaacgaacttaaaaatgtctctttatgaatagcaacaaactggtttcaaaattcaagttttaaaaatgccaaccggatccaatgggaaattatttaaaaaatttattgtcaaaaaactttactttgctggttgtcgttgttgcccgccccacgctctcgctgctgttcacctccaacgccctgctctgcacccaactgcaaacaataaatgcacgacaatatttattttcgcaccctctcaaaaaccga

SEQ ID NO: 14051 - DNA, 2798 bp, Heterodera glycines
cttttgctcttaacggtgtcaattctgttctttaatccttgcttttcctcctgtattgtgccaattcgcttgttcaattcgtcaattctgtgtaaatttccgcttttcctttgctttgtcccttccctctcaaaacctatttttataatccgtctccatgctaattgcgtaatcatcggcttcttcgtgcgcctttcttttcccttctgaaatggctttttccaactctctaaagtgttatcattataattaattgcttaattattcttttttgcactgtttgagtcgtcgaatttcattttccaaattgttttgtgccgtttccgcaattgccttttcattttgcatgcttttcagcttttcttccgtccgttttctgcttctttccgcttcttccaattgtctcagcctaattaattattaactaattaattaattagtgtcttttccctcctcgctttcctcttacatttctccgttctctcgccttgccccgtttaattccttctccacgcgtcgtcgtgtctcctcattttggcttagcttagtgccgagttcctcaatttggcgtccgtttcctttaagccgttgttccaactgctggatttcgttgtcgcggttccgcaacgcgttgcgcacattccgcaccgtttccgccgggctcagcaccagcgcatttccggcgggcgacagggaacgcgaacgcgtctcgccctcgtgggtgccgtgggtgctcatttcgttcacttttcgaatggctttctgtgggcattttaattggtttccgtccgtttcactttcccattttcacttggcattccgctagcttttcctgcgttttgcgcagttccttctcgacttcggcgacgcgtctcgcgttttcgtctccgtccgtctccaattgaatgttccgttcggttgcttcttcataccttttgatcaccattgtgattttcccaccgatcgctcttttctcactttttgatcagttcccggtacaattccggctcaaccgttgccgtcgtctcccctctgagtttgttcagcaattccaaatccggccccaatttccccgcggcttcagcgcctcccctttctttgatccgtcggatgagttcgattaggacattgtccgtattaacaattgttcctcctcctgtcatttggcttttcctttttctgatcacttttgtccgctttaccttcgcttccgtctcccattgttctcacatttcgcattattctgctgaattcgtgcctttgttcgctcaattcgcgttccgtttggtctctcaaatcggcgaattgccttcggaccctttgcaattcgttccaaaggtccgtcacttttttctgttcttcgttcaaatattgcgttaaattcttaataattatttcgttttttattttgcttttcccttttcctcaactgtttctctgtttcgaaattggttgtccttttcttgcatttcttgctcaaattgtcgctgcaaatgcaccaaatccgctttcagtcggtcgctttgcgtccgttcgctttccaattggacgcgtaactcatcataactgacaaaagcaaaaagcaatccaaatcagcagttatactctcccacaccgtactacgcctttctcctttttaagttgtaggagtaatacggtatttttcactctttcccctgtctctctcaattctttttctctctctgccctcgtcgttgttttaccgttggcgttcctcgtccaatcgcatcagaatggcatcataattgtaattggcatcccgcccgtaacgtgcgctccaatccgtcgtcgtcatgtccccagcccccgcggggaatagcgagtcgcccaacgggaacagcgacgagtcggcggtcgtcgcactcgtgccgcgttgtaagtcggcaatgtgccgtcggtactcgagcagctgtcaaaggcaaaagcatcgtacaatgccagtggcaccgtccgtcactttgttttgcattgtggcaatgatttccgagtattccctttggtgctccgcgttcgtgtcgatgcgctgtctgtacttgcccaagtcctcttgcgttcggcccagtcgcgcccgtccggccaagctcgactcaaagtcgctgatcagctcgtcgctgaatttgcttcgggattttgtccctggcgttctgttctttctctccctttgcttactctataaaatattcgtgcggtttctcttccgacggcgttttccgatgttcttcttccattttgtgccgttcttctgctgcatttgccaatttatccatgtttttctctctgtttttgctttacccaactttcgcacctcttccgcttctttttccctcctttccgatctgtcccccttcaaatattcttcagtttcttctgcgctaagcgctttgatcagtgagtcgtcgccgaggggcacccaaaagccgtgccttagcggacgacttctgctccgcttttccccacgcttctgcccgcgatagaattgcaaatccgacgacgcactgctcgtcctccgctgcggcaatcggttgtgccgagcgaattcggcacttgggctcgaagcggaagaaaggagggcaaacgtaaaatggataggcttttcagagtcagcggagaaggaaaaggggcaaagttcgccttgggctttttgttgggagggaacggacggaaggaaaggaaggggtgggcttttcgattttgggctgcttttacagcaaacgattcgatgcttcggatcggtggcgaaccctccaaaagcatcaaaagcaaaagcaaaaggcata

SEQ ID NO: 14052 - DNA, 1464 bp, Heterodera glycines
tttgatctaatatctttaaaaatgaattccaattataaactattatgcaattttataagatcgaaggaatttttatgattttttatattaattttctatcattgttattttgtttctttaaatagcagttaaaacaattttgtacataatttgaggtactcaattacgctttacccttttgagcttaccatttctttctaattgattattaagtgaaattttatttatttattaaataattgataatacttctaattcagacaattatcaataatttttcttttatttttataaagttatgtacataaattaataaatttcgccttataaacttatttttcttcacataaatattttggtgcaaaattattatttcaattttggcgcatatatttaattatttataaataagaaagtttctctcattcgactttattaattggaatatgaaattatataaaataatttttctttttattgcttaaatttgtaacgaaattatataattattgtttcatgctttagtgctttttataaacaatggatttaattttatcaattaattatttggattaaaatatttttttatttttagttttttttttaatttgcatttattcttacatcacagtattaattttcttgtttattaaattcatattaatgtttttttatttgaatagctgcaatgcagaattttttcaaaaatattatcaaatgtataattattagggctgccaaaagtatgcaaatgcatatttttttcctggcttctccatgctctaaatagtacgaaaaacactttcttttttgtgtttgcgtataaaaatcgggacttttatttgcatatttttgcatattttgggcctttatgcatattttgcatattttggcttgttttacattttcatgcatattttgccattttttgtgcatattttccgattttttgcatattttgccattttttgtaaatattttccgattttttgcatattttgccattttttgtaaaatattttccgttttgaatatcccttaagtaaattttggcagacaataggatgagcttaagggaaggaagggaaggaagggaaggtgttgttgcattgtgttgtgttgtgcttttgcgcttcaattgagttagtgaagtgcttcaattatttagcctaatatattggcctcctcctttatccaattaataatcactttgtcctccgattttgttttaatttccctttaattgcctcttttgttcctttgcttttgctcatttgtttttttttgtttttttttaaattaatcccttaaaactttggacaatgaaaaagcatttcattacaaatattaagccaaaaatatcaatgaaacataataaatggtgaagaaaatgggagatcagcagagaaatcagggctcctaatggactcctaactttttttgccgtaaatttccaagataaat

SEQ ID NO: 14053 - DNA, 2186 bp, Heterodera glycines
tcagaaaatgtctaaaaagagtgcttttttacaaggccgaataatgtaaaatgaaaaaaaaagaaaaacctggctttatgtcgcgatggatgaaatccttgctgtgaatgtattggatcctggccaactaaaaaaaacattttattgtcattaagaaagaaaatgcatttgtagtattgtactactactgcttggccaggtgacaatttttcatgaaaaaatttgttaaaattaaaattctttaatactatgttgcctaaaatataaaccccattttgtgggttgaaaaatagaaacaccagggcttatattttataattacggtatgtggaataatcctcaacaatttccgttccaaaaaatacgtaatttattgctagtaaaatcaaaaaactgaacgcagaaattttaaaatgtcatgtgtctaacatttttgaaattcatttacgtatttagtaaatgttgaaaaaaatatatgtaccatttggtcggcgagcaacagcactgttttcagtgtgaatttccgtgagcaaaaattgaacagatcctcgagcgaagggccaagcagttccatcaccatcacattgtattcaccctcaaaaccacaccaccggacctaaaacaattagaaattatgaaaaaaaaataaaataaatattgcaaatttgccggttattcccatttatttttgctgaatttttggtgtttgactattttttaatagaaaatattgtctgcatcctaaattacacccaataaatataaccaaaaaattttttggttggttttctgaaaaatttttgtcatcattttcttcgtgaaagttagatcactaattgttttggcttattttctttggataacctgtggaatgccgactccgccggacatcattttgtacagtttggcctcaatgtgaagctgtggatgtttggttttgacgcactccaattttattgccacttcctcgtgtgtcataatgttctcgccttaaaaatgaataattaaaaccaaccaaatcattgtttattatattagatttttaatcagtatttatataattaaatacatgccgaaaacaaaaaaactgaggtgggaaatgaaatcccggcgaaaatttgaaaaattttcaaaaaagcacaccattttccttaaaattttttggttttttatttcggggaacctcttggttacaggcctgttgatcattgggtattattattaatttaaaaattaaccacctaaataaatatctccgaaggaaccgctgccaattttacgcccaaggcggtaacgacctccgacccgcaattccatttactggcaagggcaacaaaagcgtgttgaagataattaggtatatacaattatatatatgtatatatgctatagaatggcctagattataattgtaggtatctctggcctctaaatacacgaggaaattaaaatttgaattaaacaaacaaaatttcagaaatttaaaaatgtgtaatattgcgggggagaaaatagggacgaagtggacagtttcattcccgaataaatgacgaatgaatacatagaattattgtgatcacgagaacttggattgatggaacggaggggacattttggttctacgtaaaaaagtgattagcgtttatttggtaattgatagggaagagcgaaaagtgttactgtcaaataattaaataaagaggaagaatggagaatacatatataattccgaggtcccaaaatttctcggaaatctctgatccaatgcccaaaacttgttgggaatcgaaattccgcgccacccctgttgagtgccacaatttgccaaaaactaaattttatttttagaaaaaaaaaattcaaacataaaacgaagacaaatttgctgccaaatgcatctcttttttacatagcaatttctttttaaaacggttaattttatatgtagttaaaaaaatgtttcatctatgaaaaaaaaaattcgccattcaacctcaacctcactcattcccccccccactcttttttctccccttttttcaaagtaacattagaggatgagtcagtgggggtgggggtgtagggtgtattatgtgtgtgtttgtgtttatatatgtataagaatccgaatggggagggggtgggggggggggggaggttgactaaaaaagcatcgtacaaaatgg

SEQ ID NO: 14054 - DNA, 1307 bp, Heterodera glycines
aacactaaaattgtctcccaatttaagtgggctctaaaatacacattggaaaattttcggttcatggacggtaaaaaatcgtcaaaaatgttagaaattttgcatacagatagcccactattttcattcatctatccttaaaaccatttttaaatacatgctaaaaattccaataatgtgcattgaaaaggatttaagggcttcaacctttgattagaaatttgatcacggttatgacactctgttttatatttgaatggattggcgctttatttttatgccacgatttattggcgctttttctttaaatgagctaaaatcttagttttttgtacactcatcagcgctttacatatagccgaaaatgtgccgactccctcaaaaaaaaaaaaaaaattcggcaataggaattctaacggcccgaaaaattaaaaaacattttctgagcaaatgtccgctgaagtgttaaagttaaaattaaaatgaaatggaaagagagcacctttccctgcggctacttagtgaacaaaaatgtaaaaaatttaataaaatagagtggaaatgtgcttttccataatatgaatgtgcctattatctgtcttttggtaatggaggtgtccccattaatttgattcttctaaaagattttcttccttttcccgagcgtggaaatggacaccttttagtggttagtcgtcgggaagagatttgacgacgctcatcctcaaaatgcatcaataatcctctccatctctgcccaaacgctctgaccgtctcgcccacattctttagctctccctttttctttgggcaactgggagcttaaatttagtgccttttgtaagctacaaacgaaaatcagctgataatttttgattttcgagttcgaaagaattgtttttgtgtacaaaagaatggcaaaataactaggctaatgcattaattcaattattaaataaaaaataattcgttaaaaataaatttttggaaaaactgggagcaaacgaaacttaattaggtaattaatgaattgtatgcatattaatttaggaaatatttgggataagcaatttaagaatgaattcaattaaccaattctttaagggaatttcttaaaatattgaatttccataaaatgttaattttaccccaatttcatttctctcgcagtgcttccttccccgggggcacattaatcacaacaaccaaaattcaatctccaatatggggagagagaacgtacaaattttgttaatttaaaattattccatccttacaaaaaataaaataatatattcttacataaa

SEQ ID NO: 14055 - DNA, 220 bp, Heterodera glycines
ttaaatgacgcttgtgtaatttgaaaaatgaaaaatggtcaaagaatctttttttaataaaaattggagtttggccgcgtctgttctccgagcggaacccgtcagttgggccccagcggttttttggctataacttttttctttgtcatccaaatcaaacattgtagctataattcaaaatctgtaaatggactctattatcctggaaaattttgaaaaa

SEQ ID NO: 14056 - DNA, 4106 bp, Heterodera glycines
  misc_feature (4099)..(4099): n is a, c, g, or t
ctataacttttttctttgtctccaatcaaacattgcctccctggggcaaagctgtaaatgtactctattagcctgccttttttgaaaaattatgtaaaagatcaaaaaaattatggccagaacaactcaaaaaaaaacagattttccaacttttatggccataaatttgttcaaaattgacgaatttttttggaaatttgcaggctaatatgtagagcatctgaagggatttcgaatgataccaaaatgtttgatttggatgacaaagaaaaaagttatagtccaaaaacatgctggggcccaactgacgtagaccgtctccgagacaaagacgagtccttcggaattttgcaaaaccttaataatttcgtatgaaaatagttagcaaagcacattttcacgaataattttcaattttaagcgacaattacataaaatttctctgagatttttaagcatccataattcagctttttaaactttaatttcaattaattcaattttattttattttattcatattttaataaaacaaatgccatgaaaagttcttacactttttaccttattcatctgttgctcaattttccactaattcactgattttttgtttccatacaatttaattaacgcattaattgcccattaatactaatggcaatttcattgatcagagacgcggctttacccatgcgattagccaatttgcgcaactcttttgctgatcactcaatttgttttcatgttccattggttttccgctgctgaagcgaaagggatgatttgatctgccgctgtttctgctgggctttttcatccccaattgtttttctcgtctctccgtcattctcgaccactccaaaaagtaattaatgcccaccattaataaattaataattgtgctcttgtttttggctgaaggaattgccaaactttggaatgggtggcactttttgcaggacccacgcgggcattgctcatttgatcacgaagttggcattatcagccgaaactgaaaattggtgccctcaaatgtctttagacacggaaaattcgctgcaaaagagtcggcttccccatgatggccccgtcctgtcaatgctcctcctgtacaaggccgagttcattttcctcggcccatccatctccgtgccatgggtctgaaattggcttttcaacatgcgattcgtcgtcagcacaattttcaacatttgacaccaattccaataatcactttggggatgggtgttcatcaacggcgagttgttcagaagcgaattccgcttctgcttcttctgtcggtggtgagccgacttcatatcgcgaagaggaagcagttcaaggagttgaacacgaagagaactcagcggggcagcagcagcaagcacaaattgagcagcaacagtacttcccggcatttccaattgggccgcaaggacaattcccggcattgccaattgagccgcaaggacaattcgtgccccaggaaattccttctgcgccacagcagcaatcctttgcggttgaaaatgccaacaatggtcccgcggcgccatcctttgtgtgccaaagcaatgaggacgataaaggtggacgagaaaacaatatgatcaattcaataccacagcatatgctattccaaaaagaagtgttgtttgttcagctccctattgttgcaacggcgagttgaagcgggtgatgagggaagcatacgcaagtgccggggtgaactgtccgaggaaggaccaccccgaggcgagctgcttccactgctgcaacatccaaagattggcgaacatcatccaggtggtgaaggctaatcaattccatgataagcatggaaccgaccgataaatttaatgaaataatataaaaaatgggattaatttttatattttttatttgctaaatttaaatcttaaaatatgtgtatatgtaagcattgttgttaagcatcactgcgagtgtcggtttggcgtcactttcgaagtcgtcgtcggactgcgcgacttttccctgcacagccattactacgagaacttgttgtgcaaaatttctgaaggggaaaggttggtttttggctttaattttaccaatttttatcaatttccattcgcattttctcagccaaatcgccgcttttgccagtgcccagggcgtttgtctgccggacggaaggccggcaaattcaaataacggcacaattccgccaatgtgcggccaaggggcaacgagcaacggcgaaatgtacgaggaaaagcaccagcaactgagagacggggacaaatgcgcgggggcggaggaaaagcggacagtgcccgaggcggaggaggactatcagctgacggaggggacggggagaagcgaaacgaatgccgacgagcaatgaatgccgaaaggggaaggcgcgtccaatttatggccaaatgttggcactcgcatttgcttttttctcacattttgcccagaattttttgcttataattttctaattagcatattaggcactttcagctgatcaatccctccccgccactccctaacattgattgtccttgataatttgatcattttccatcttttccccccattgatcgcttccttttgttgtgttcaaagtgtctcatctccgacgattcattcgttcggcgcatattggaaaagcgccgtctcgcaaaaaaggaggtcatcagccgcccgccaaatcgtctcaactgtcatcatttatttgtccatctttgctccgtcgtcggcggaagggatcgatcggtcgttttcgccaatcccagcaaaaatccatcgccaatttttgatccattatggaagtgtttgttgtttcttctcattcccttttcggttggtcattctcggcttggttcttcaccgattgctcaatcatttacgacccaatttttaattattttgcaattaatttaattggctttaaaattttgtctcaaatttaaatggccattgtaatggtcgatgaacagcagcagcaccaccaccatcaccagcagcagcccgtttcagcggcggcgattggtccaattgaaacgcaacaatccgctgaagtgtccacttcttcctcgacaattcagggtcaattagcgttttcttcccttaattacatgtttaatttgtgaaggcttcgaagtgtccttattttacatgatttccccaaaactttctcaattttcattcgacccattgcatctttttgcttaattacttataataattggcaaatgcctttagccgccccattggaagcgaaggatgagccgcccgcgccttaccaattcgaccccaacgacgagttttatttggcaccgccaacttgtcaatttctgcactatcgcgacgcggctgtggtggtcggaatcgtcgagattctgctgctaattgggacttttttcacagcaatgagtaaaaacaattaaaaaattaccattaaaattttgtagaaatttctgtgacacaaattggccaattaattcattcgattgttgcaatatgcacagattattatgccggaagtcgccttgtgggcgtgtgggcgccgttgctcgtcgcttctgtgctatgtatcgcaattggcacaaccatctccatggttaggcatcgatcgccaagttcatggccaaatccacgaatttttaaaacaaccaattaaaattaaaattaaaattaaaattttccatcccttggaaataccattaacaaatcgccaattttaaaaattaaattggctaattttaaattcgataagcacagatttacgggattcggcatgagcagccgcaaatgttgtggccacaaatttactttctgaaggtggagatctgcttactaatggtaatgtaaagacccaattaaaaagtcattttcaatcgttcgttgtttaaggcgggcgcagtcttctcaatttcgtgcatgtgcatgggaattgaagcgaccaatttgatcttttcgcattttatcaggtaaactgaaggagcaaaaactaattaattaattaattattttttaattttttcgccattttccgtttctctcatttttatgcattaatccacaaatgactgaatgcttcaanataatta

SEQ ID NO: 14057 - DNA, 647 bp, Heterodera glycines
agaaaagaatgggcgagggggggcaaaagaggggaaaggggtaaaagagggggacgggggttaatcccccgaaccaaccaacgcgatcggagcagggaggaggaggaagagcagcaagaggtggattagggagtgtaagtgctcgcgcgaatgaaccaaaacgagaaaatgggaaaaaggaaaaaaggggggagggaattttggggagtgttaatgacaccaaaacgaaacttacaattactttgaaatcggacaaagaataccaaataaaaatatccgaattttcaagtcgaaatttttcctaagaattaatgaattactcatttttaaattgatttttgcaagttaaactaattttaaagatattttccaattaatctgtccaacagacacaaattaaccatctctctctgttctcagtatttgcatttctttgcctaatccgtccaaatccaatggtcactgaaaaacgcacagccaacgaacccccggggcaaaatcccccccccccccctcccgccccggacgaagcactacctaattagccccgccagccaaattctcggcgaatgggcgaaatatcttctccacaaacattcacctcgaggggtaaatgtataaatggggctgggagggggtggggagag

SEQ ID NO: 14058 - DNA, 1756 bp, Heterodera glycines
ttgacatttgcgcataatttccaagagattggccaattgtgcgggaaaggcttttgttggcattttcgtcttccacacccataaaaaaacgttgtgccaacaaacaaaactatctgttcccccgaaaaggcaattcattggggcaattaaagttaaatttatgtgcgatgaattttcccttttttattagcaaatatatttaactctctaaaatttaaaatcgaaatggaaataaataaataaataatgtagattttctaatcagtcattttccacatcgttcaccaaattgccgcatcgccccgactgtccatcggttgcggtggccatccaaacccaacaattgctggcactgcttgaacttggacattgccttaatgattcatttcgttcccgcatttttctcttaattatgatgccattaaccaaccacaaccatcgctgtgattgctctggtcattttgtgccgttatttttctgcgctttttcggatgctcagacggaatgccagacgagccgtccaatgccaaaagcttggcaattttgccgccttttatctgtcgaatggcgtaccgcgcactgttgaaaatgttattcctgtccttttccaaaacgttcgcgaggacatcgaccggcaatttctcgcaaggatcatacaatgaaaagccttctgaaaaagagacggcgaattgacaaaaagtacataaaacgcacttcccaatattaggccatcggaaacggcattgaaaaacgcaaaaagcgcatcgccggcgcaaagttcgcccgattttttgttgtccgacaaaactttgtccacaaccaattcgatcatctgacgaataatgaaaaaaagaattgtcgaaacaaaatctaagggaattcaaaagccacccaatcggtcagtgtttgccaagccgacactctccgctttatgtcccgcaaaactttgatcagcgaatccattggagcgagtggagcacatttgacctgatggaaaggtaattccaatcattttgaattaagaaaatacttggtaaaattttgtccgcctcatttccgccagtgccctaaggcacggaccgctgggcaaagcattcggtggctcttcataggggtaaaagttcaaatctgaaaatgatgaatataaatctggttggagaattttataaaaagacctccgggcgaccattggcgcattgctgagcaagtcaaagtcacgaaaacattgaccgatacgccaatttgggaaacgaaaatggcagactcggacacttttttcactacataaacgtacggttcaccattttcctaaaaaatgaaaagttatttccatgaattaaccaatccatcggacatttattgtcagctgaaagtgaccgataattttagagagaaggtcaacagttgggacgatggagcagagaaggaccaagtcagcctgaacaattcgaacaaaaataaattataaagacgtaaccaccccaaagttgtggaattctataaattttgtttggaaaggaaagagtccagcgatgtaggaaaaaatgatgcgattcgttaaaagattaggtatgccaaaaatagttgcgatcaacatttatttcaaagaaaaatacgataaatagattttctttctggttctttatagtatgcatctttttgcacatgcgaaaaaaaccagcgatgagcaaaaaaaaggtcgtcaaaaattttggaccccgtcgtaaggaaaatcgcatatgaccacccccccccc

SEQ ID NO: 14059 - DNA, 1438 bp, Heterodera glycines
atctactgaatggggtttttggctgcgctgaacccgaatttgatgccgccgttgttatatgagcccaaataattttttaggaattttattgtacctgtttcgaggtaggctttaaaatgaggcttttgccaaattagctctcgagaatgtagccagacggatgcagggcctagccgttcgtccagttgattttttatagaagtttggggtggtatttttaccaatcagttttttatactgttattgatcgtatccaactgagaatctgctgaatggggtttttggctgcgctgaacccgaatttgatgccgccgttgttataggagcccaaataattttttaggaattttattgtacctgtttcgaggtaggctttaaaatgaggcttttgccaaattagctctcgagaatgtagccagacggaagcagggcctagccgttcgtccagttgattttttatagaagtttggggtggtatttttaccaatcagttttttatactgttattgatcgtatccaactgagaatctgctgaatggggtttttggctgcgctgaacccgaatttgatgccgccgttgttataggagcccaaataattttttaggaattttattgtacctgtttcgaggtaggctttaaaatgaggcttttgccaaattagctctcgagactgtagccagacggaagcagggcccagccgttcgtccagttgactttttacagaagtttggggtggtatttttaccaatcagttttttatcctgtttcgaggtaggctttaaaatgaggcttttgccaaattagctctcgagactgtagccagacggaagcagggcccagccgttcgtccagttgatttttttatagaagtttggggtggtattttcaccaatcagttttttatactgttattgatcgtatccaactgagaatctgctgaatggggtttttggctgcgctgaacccgaatttgatgccgccgttgttataggagcccaaataattttttaggaattttattgtacctgtttcgaggtaggctttaaaatgaggcttttgccaacttagctctcgagactgtagccagacggaagcagggcccagccgttcgtccagttgattttttttatagaagtttggggtggtatttttaccaatcagttttttatactgttattgatcgtatccaactgagaatctgctgaatggggtttttggctgcgctgaacccgaatttgatgccgccgttgttataggagcccaaataattttttaggaattttattgtacctgttgcaaggtaggctttaaaatgaggcttttgccaaattagctctcgagactgtagccagacggaagcagggcccagccgttcgtccagttgattttttgagaggagtttggggtggtattttcacccaatccagttttttata

SEQ ID NO: 14060 - DNA, 1965 bp, Heterodera glycines
ttagttcaatttttagtgacactttaataaatccatggccatcctccgctgctgaatgagtgacagcctcgtcaatttgggttgggtcaggccaaatgccatcggcacaatcactgcttctccccccccccctccccctctcacttgtattgcgtctcccacagatttctgtagcgcgactctccgctcatgtcataagcagtgaaaagcatccccgcagccgaaaaccttaacggatcgaattcccaagttggctttgtttggattcacttctccgtcgaatagccaaccgttgggacaatattcgtcgattgcgtctcgggcggtttcaactaaacccccatttaaatgttcaatcaattaaatttcgactttgcctggttcaaaaaggtcgtttttccgctattgtccaacccgagaaccaacacttcgacctttaaaatgctaaaaaaaagaagggacggcttaaattttgcctgtcgtccggaagcggtgaagaaggaactcaacgtttggaagatgcccattggaagaacagcagaaggaagaggaagaaacaaagagaaaagcggaaggagagaaagaaagaggacgaaaatgaggaagagggaaaaggagggacaaaaggagagggagaggaaaagcatagtcacaggggttgccatggtaatggttttaagcatttttggaaaaagtttaaaacggaattgcagccttaaaaaggggggggggggacaaacgattgagtgattagcgaactgaggcaaatgacttgtgaaagtgaacggcttcatcacttcaactattcactggtcttacaaacaattcaaattcagtttcattgagaatttatttgagtttcaatcattctttcttgcttgatttttcgcgagttttccaatgtttcgttcaaatttactgatcacatttatttattctttaagtgaagtgacaaatctgaaaaacattcgaatccataaaataactgatcaaattgtggtcaatcactcgtcgatcatttgtccatgccttttttgtctgcagcttctctcatttgtcgttgaatctctccttcgctgactcactctttcctctgctgattttgaaagatcaaagttcccccccccgtttatttcccccctttccccgaattttccattcgtcgattgatttgctcatttatttgttcattcattggtttgctatgtcaacaaaacattgttaactttttttctttttcagttcctccgttttcctttttctctccaaatttttccatgcgttttcaaaaagccaaattcgccatttttcgactgaattcccaccaaattttcattcttttacttttgcttatcaaattggcaatgactgatcagcagaattcaattgtcgggggatggacagagcaaaatgtgaacgacgaaaaaatcaaggcaatgaaaaggaaatttggctaactgttcataaatggcaattacaaattcaaatgtccgttcgcttctgctcaattctctcgctttgttcagtctctcgcttctcgctcagtggccaaaataaactccgagtcaaacgatcgcttcagtcttttccccttggaggttctcagtgccaagtcacaagtcgtggcgggcattcagtaccaattgcgcattaaggtcggaaggtcgaactgttcgaagaatgtaagtgaaagggcaaattcagcaacccaagttcagcagttcccttccaataataaatatttttattttttatatttaaaacctaaaatttttctcaaaaagaatgaacggccggcccattaagggaatgggaaaggattatttaatggaataatcaaaaaaggatgattaatcccctcgaagcagtcaaacttggctgaccacgcaaactgtgcaacggaggatggtcagacagcgcgaaaggtgacactgtgcaaatcattactgtaaattagctaatttt

SEQ ID NO: 14061 - DNA, 1275 bp, Heterodera glycines
  misc_feature (8)..(8): n is a, c, g, or t
  misc_feature (39)..(39): n is a, c, g, or t
cggtaaanaatggcgaaattatcacaatgtcctccttcncagctgatctgtcaatcgatggacgaaagattttcttgtcccgcattgatcacttttattgtcttccactgctgatcagtctgttttccatgtccctttccgttgggtacattatgttcaaaaattacaatttcaagacttacacttgataaaaatgaaaaattcatgctaatataatcgtgcttcggatgactaaccaaaaagcatcgattcgctcggtggaaaaatgaaaagaacaattcatttaatattggctaacatttatcattgaattttcaaaattgacaacaacttgttaatatgaaatgcttttgataattaatgaaatgaggcattgtttttggaagcaattaaccaattaaattttgggcgaatgggaggaaatctaaaggaccaattaggaaataatgagggagaacatttaagaatgggcggaccggggacaaagcaaataaagaagaaaaagagaggggcggagaaaaaagcgcaatcgaatctcattatggaaagttaattaataattatgccgaaagaaaaggaagaaaagttttgagaatttaaagtgtcaaaatatcacaacaatagaaaagaaaagggaaaggtcaattaattaattaattatttggaaacgatcaaatggccctgcggcgttatccgaatggccgaagtgagaagaaaagctgaagaaaacagaaaaccatgaaaaagtgccaaaaggcatttaccaacgaaaggaaaagaggcggtgccgaggaatgcccaattataaccgatggactgcaaaaagaattcgctgccaatggccaatgcgatgccactaagagtctgaagggaaaatgccattcccaaactaaaatgccattaccaaattagggtgttttgtgagcccctggaacattgcttattctacatgggtttttgctggaatttatttaaaaaataaatacacgacatcctgccaccataaattttttttttgttttttggtcattttttatcttagctaaatttttggaaattttgcagggactgtaagcgctttaaaaccataccaaacttatttaatttggatgattaataaaaatgttatagcctttggccccaaagtggtcggttcccgctaattgcccttccttttgtgtctttttgtgtgacacttttttgatgtgattgactttgattttgtgtttttttttggttggcctacagtgaaaagatgagacagccgtaatgaca

SEQ ID NO: 14062 - DNA, 2851 bp, Heterodera glycines
  misc_feature (2834)..(2834): n is a, c, g, or t
ctattttgacggcttttgctccgcccctggccgccagcagatactgactgacacctgcgatggccgaaggaaggaaaaatcatttaataaaattaaatattgtgatcaaatcatttctgttcatttttaataaataaataaagtgatttttcagaaaaatacatcgtttgcctaaatgcctcccaaaataaaccctaaccaaaaacaaatcacatcatttttcaatgtttctggtaccagttcccaatgtgttgatgagaccgggtccgatttggacgatgaaattcctggggatgaagctgtcccccaggaaagggacattgaaattccacctcaaattgtaccggagagagattttggccacgttttggtcaaacaacaacggcgaattaaattgtccgaagaagaggtttattcgtggctgaccgactttttcgtgccacctgcagttttcgactggccttacaaacttcgtgccggcaaaaaaagatatctttccccccacattttgcaacgccatccgcaaatgtgctactcccaacttttgaatgggcttttgtgtcggtcagagacagaatttgagaaattgaaaatttaaattaattaaaccagatgttgcgtgcttttttgcttcaaattcaattggacaaagtgggcaaagcaaagaaaatgtcatgtttgttactgttgcgtacagagattggtcgagattggaaagtcccgcgacgctcgtgaaagatcagaagggtatgaatatgatttaaggcaataataaacgaaaaaataggtataacaaagcacgaagcaacacaatatcattcacaatctgttcaaatggccgcacattttttcgcaagtttttgagagaaagcgtaaaggaattgacgccattgtcaataatttgcaacatgaacaaattgaacgaaatcggtacggcattaaaattaaattaatgatttgaaataatatattttcattaattttaataattattttatagtgaaatattgcggccaatgatcgaaactgttatttatttggcaaaaaccggtcaaccttttcgaggcaataaagattacggtgttttgtcagtgccaaaaacagttggagagattaatgcagaacagggttggaaatataaattaatgtaaaaaaactaaaaaattaaaggcctttttcgtgctagtctgcaataccgatgtttgagtggagatgaaaaattaaaattacatttggagacaggtggtcaaataaaatcttaaaaataaaaattgtgaatttaataaaggccataaaaatgcattgtatgtttcgcccttggtacagaaccaaatgattcgttctgttggaaatgtcatcacaagcaaaatttcccgggagattttgcaatcagatgtgttcagtctgattgcagatgaatctatggacatttccggttatgagcaactttcagtcagttctcgtttcgtcaacaaaacaaatgaaattgaggaagttttcttgggttttgtggaacttgaagaccaaacggcaaaaacaatatccagtgaaattatttctcttgttcggggtaaatacggtaaaaatgggtgacagtaaaattaatttttaagaccgatatgggcttaatttgaaaagaattgttggacaggcctatgacggggctagcgtaatgtccggaggacataatggcgtccaaacaataattaaacgtgaagcagggtacttaagaaaaatgcaattaatttttattaattcccaataaaggccggccgcattatacgttcactgcagtgcacatgttttaaatttaaatatatgtgcatcattaaccgccgaacattaccacaatgtcttcgagatccttggccgcttaagcaacttttaccactgttccgccaaaaggactaaaatccttgagcgatccatcgaggccatctgtttttcaaaaaaacacaggattccaacattgtcagacactcgatggaccgctcgtcacacagtgcttgagtccgtaaaagagttgctcccggcaattatcacttcattatgccaaatacgaaatgacgagccatcaatgagaacagaagctgttcttttattggatcgctttagccaaagcgaattccaatttagcttagtcatggtcgacaaaattatgtcatctttaaagccattaactcttctgtttcaatccaaaaccgttgacattgaaaaggtaaaaatggattttagaaggaactaatttgatactcttccaaaaatatagggccagcgtgctgttcagctttttattgattctttaaatgattggttaagtggctgtggatttgcatcttttgagaattgcaaaaaagatgctttaacagtgcactcaatagtttgtgaatcaaattatgagcgctgaaggagtggacgttttcaaatcaatgaatgtgacttcgatgagtttttggagccctatgaaaattttttggtttcgcttaggtcctcaaaacaaaaaacccctaaaaattttccaatttacagaaatgcctttgaggagatgttttctgacccggctttggaagttttgaaaattcttcaaaacatactcccatggaaaatagggaaagctaattttgcttccgtattgccagctttcaaattttaccatgattcaagaattatggactgttccgaaaatcaaatacagggaaataccaaatttaaaaacataactttttgaaaacttttagtctgagtttgaacagtggaagaatttttgtttttactttaatggagacgacctgaaaaatgttctcgtattattgcgatccttcatactttccaanatatcaaaaaattattg

SEQ ID NO: 14063 - DNA, 1881 bp, Heterodera glycines
  misc_feature (543)..(543): n is a, c, g, or t
  misc_feature (546)..(546): n is a, c, g, or t
ataaaagccccagcaatttgtcagctatgtctcatttgttctgctacaatggtccttgtcatcgaattttgtgcccaaattctcggctgttccccgaaatcactccgcgacaagctcaatcatcccgaggaccgagtgaaggcactgaaggagctggtcggaaaaaaggttcggacgacatacaaggaccggaatggaatgcagaaaacattttttgtcgacggaatatcggacaaaggagcggctttgaccccggcgtatggcagactcagacaaccgtacaacatcaacattgctgcccatttctacgctctccaccgtatcaagctgcatctcccgtacgtgccgtgtgttgtggagaaatattctggatgtggcgaagacagatactatccaatggaactactcgaaattgtggatgacgactacaaccaacaaaagaggcgaggcttggcaaattgtttaccgaaatcgaggacgacttcatttcctgtcaaacgctttggtcgagttgaggaagtagaagaaattgacgacaacgangantggggtggtcgctacgaatgcagtcaaccgtcttacgtttattggtaaacacatgtatgttatcttaattatgcacttttctacataaaaacgacaagttcgtgcacataataaaaattgtatcttccactccttaattatttacaaattgtaacttctttctcttaattctgcatttttctacctaaaaatgacgttcccaaatgcttaataatttacaaattgtatcttccattgcttaattctgcatgcatgttcactccttaattatgcacttttctacctaaaaacgacaagttcgtgcacataataaaattgtatcttccactccttaataatttacaaattgtaacttctttcgcttaattctgcacttttctacctaaaaatgacgttcccaaatgcttaataatttacaaattgtatcttccattacttaattctgcatgtattttaactccttaattatgtacttttctacctaaaaacgacgagttcgtgcacataataaaattgtatcttccactccttaataatttacaaattgtaacttctttcgcttaattctgcacttttctacctaaaaatgacgttcccaaatgcttaataatttacaaattgtgtcttccattgcttaattatgcatgaatttttattaaaaacgcaaataaaatgacaaaattacacaatttgaggtataaaacataaaaaacaaaggtggtacatgcgtgtgtacgtgtgtatggggtgtgtgtgtgtatgtgtgtgtgagagatacaatgaatgataaacgataaatttacaaagtgtgtccaaaattgagaacatcataattaggacccactatccctttgcctacatatgggcgataacatttttggagggggcctgaagtgacgtgtccgccatccctaatgtcgggtctcaaaaagttggggtacatcacatttattggctcatactctccggtttgggcataccgcaacacttcttctttgaatgtgtcgtagcatagggattggttctgcatcacgtcgtagttcagtgtgatgcccctaagcttcagcacaaattcgtcctgcccattacgccggagtttgagtccatactgaaatgataaagtataaattatgaattattaaaaggtgaaaacctgcttcgctccgccactacaatactccacaatttcatgcttggggtattcatcggtgaattgtcccaagtgtggtcctgtctccaaacggttcatgccgatcgggtggacgaaaatcagcgagtcggtgtccgtgtagaggaggccgcatccaagcgttcttatcaccttctgcatcgctt

SEQ ID NO: 14064 - DNA, 3254 bp, Heterodera glycines
aaaataaggtcagattcatgcttagcgcctaggattctccccccgggtcattataaattgcaaaacaaaagggtcccccctctttgttttttgatagaattcaaaaggttactctttgcaaatagcgcccaaatttggctaacaattttttgctctattatataaattttatttggtatttttatcacatttttaaaaaaagatacaaaaataaaagtgattttgggattcgggaccaaaggggagagggagcacatgatttttgagttgagaaatttttttcacaaaaatcttccaaaaacatgtctttaggggttatttgggccgctgatcacgaatacgtgatcagattttacttttgacatcgttaagacctcagaatccctgtgtgattggggattctgaggcatcattttgaggtgggggggcaggttcggatccggacggtgtacattatttttctgcattttttcacttttttcaatgtttattaattttaagatttgttgtaaattattttaaaaaatttttaaattaaaatgcattcgatttttaacctttaataaaaacttttccttatgtttgatttataaattaataaaaaaataattttaaagtaaaggattattttttaatttttaaaacttttttatgtatccaatttttactcttatatttaataaaacaattctcttatttattcatttaaacgatggttgtacctcttttaatcacagttgtacctcttttaattacttttatacctcttttaatcaccgttgtaccttttttaatcacttttgtacgtcttttaatcactgttgtacctcttttaatcacttttgtacctcttttaatcacttttgtacctcttttaaaaaattaatttcattttaaataaaataaatattattaattttcaacgttgtttattattaataatttaaaattaaaatgcattcgattagattttgttcgtttttatcaagtgtctctattttaaattaacaccccatttttgaaaaaaaatcgtaaaacttttttccgtcatcatttcggtttctcactttcagaatcttaatattttcagaattgctacgtacagttaaaaattcagctcgatcggttcatgggaagtggtcaaactcccaaaaaacagggtgtctttattttaaattaacacagtgtattaccgatccgattaataattgagtaaaattttgtgaggcgggaaacgtgaattcggaaaatgcgggaccggaatcccgtgcaggaatcctccgtttttcctattcccgcaagaatcctacaaaaattttgagggaatcccgcgccgggaaacgggaaaattttttctaagaaaatggagtttcaaaaataaaatatttcaatttaaatttttgaaatattatttttcagccaaaataagaaaatttaaaatgaaattatagtaggtacctaatcttggggggcggaagtttgggcaccaggaagtttgggcaccagaaatttgggcaccgggaagtttgggcaccaacttaaagagttaaaaaataaaaatatttttaattgtctatgaattgcaaccatctaatttaaaagcatagaaaatttaatcaagttaggaaatagaaagttctttaacgaatattcattcgattaagcatgcttattttgctaaactcattacaattaattcaatatcaatgccatacatatgtattatttataacttataacattacaaggctcagtatgttcaagacttaaagtttatgagtttaaacaaaattagacgggttcttgttatttcgggcccaactaagccggtattcaggtataagtccaaacagaaactagcacacgtttaattatacgtttaaacaaccgtaagaattgattaaataataagattgccaggttcccatacataaattttttgattttcaagaacatataaattttaagaaaaaagggttgctaaaatttactaaattttaatgatttatataacattttatttatttattttgttttatttttttgaaatcccccctctggtgcccaaacttcccggtgcccaaacttcccagtgcccaaacttcatgtcgccaaaagtgttgcatcaaattttttttttaattgtatttgtcaaaaatgactgcttaaaaaatttcttttgttatacaaaaaactcatttttgtaacagaattaagtgaaagaaactagggtcacgacttttactgacgaaaaatctcaaaatagttaactaaaatagtgacgaaaaagtgctaaaaaagtgacaaaatagtgaaaaaagtccgaaatagtgacaaaaagtgacataattttcagccaaaaataagcaaaaattttttttattccctgattgttgttgcaactaaagtaaatttactttctaataattcttgacaaatattgacatttttaaaccaaaaattttgtcaagaaaaaaaattggttgatgaatttttgagaaaatttttctaaaaatttttaggtcgattcttaggggtgtatttttgaaaaaaaattttaggtcgaatcttagtggtgcatttccgtctttattgcatttttcttgaggatattttccaaaaatgtcgaaatagtgaaaaaatagtgacaaaatgccaaaatagtgaattttcactattttagttacgaagcgacaaaatagtgatttctagtagagtgccacgggaccgggaccgggccgggaattcccggtcatccgaggtcccggttcccgggttttgaaaagctcaggtcccggtcccggtcccggtagggcaaccgggaaccgggaaaaacaagcactggtaagaatggggtctgagtgaaaaattagtgaagaaaattggagtcaaagggaaaaataaaaaataataattaatatattctttaaaagtaacactgcccaagtgtgcaaatggcctaatggctagtctccttgactttcacttcttctttcccctggttcaatccctctacagaaattagattattttcaatttttttttgtatactcgtgggtttcctataaagaaaatatgattcctcatagtttttttaaattgatacatattttatcattttttaaatgaaaatcctaccaattgagcttaataatcgcaaaaaccaaccttttttgttgaaaatctgttaacaaattgcacccaaatttttaaaatttcccccggcggcgcctatcggcaccgccggacccctt

SEQ ID NO: 14065 - DNA, 4279 bp, Heterodera glycines
  misc_feature (3392)..(3392): n is a, c, g, or t
ttatacaaaaaaaaaaaagatttctttactcgggtcactgttttgccgtgaattttttgagaaaaaatcagcagagcatctgcgcattcaatatttaaatttttttatattcttattgcgtttttatttctttttgcaagtatttcaccaaaatttttaaaatttgccaaatttttagttgaataaaacattaataataaaatattatggaatcttttcttatgacagattttacttgcacattgacgtcacatttctgtaataaatggatcgtgagcgaccaaattttcgttgttaacggacgtcgtaaattaaaaaatttcgaataaaagttcgggaggaatgaagctagtcattctaagctaaaaagagaaaattgtagaattatttaatttccaatttttatgatttggttttttataacttaggagtagtatattttggcactttccatcgcgtgggttcaaatggtcccaaataattatgcgttcatagtttaagattgttggaaaatttaaattttcataaaaacaatgttattcagtttttcacattgaataatttcatggaaagtggttaagcaaaataaaacttaattaataatttatcccatttgaaaaataatataatgatcactttttaaattagaaaagaaaaactaactaaaatgaaaaggaataaatggatcactaatgagtaattgccccggttaagttcatataacgccgaattggcatcaaacttttaatcccccttttgtacttacgtatgtacatatttggtcaattttccaccattaacaattggcacaaatttgccccaatttataaaaacatttccgtgccatttgatgaggtaatcagtgacaactacggacggctgagactgcggcatgacaaatggccgtcagtcggcaaatgcgacacaagcgcaaaaatgacggcgaaacagtggtgacgggggaagccaataaaaattaatcagttttaattattatttaaaaaattgtttaaaaagccgagaaaaatgtatttgatcaagaaaacgatgtgccagttggatgcgtaattagggaaaactaaattggccacttttactaactttcatcatgtaaaacaatttaatcatggtacggcctattgacttttataaaaaacaataagcgataatttgtttctaaagtggttttttaatttctaaataagaaaagtttaaaatagttaaaaaactataaatttattaaatatattacaatccaccaaaagttaccattttccaactgagaatgggatcaattcattcactcgctttagctttacattctcgtccaggaatcgttctcgacaaaattgctgtcgggttctcgaatatctgaattgattataaagaatcatttttaattatttggcacttttttatccatttgaaccgcagaaatttattggcacaccatcgtccccgccttgagcaggtgcccgtcaatggtcacaagccggcgcattactgttccaatttaaaaacatttactcaaatgcgtaattatgtcaaaccaaacgtcctggtttgccattactattacatcaaatcatccctgttttatacacattacttacacaaatcactgcgttggtgtaatgtaatttgagtcggttcgctaccgtaaccgttcgatttgttgccccattggtatgttggtgttcatcttcatcatcatcgtccaccatccactgaagctcatcgctcattttggcttgaatttggacatgatggttcagataggcaatgccccaagaaagcgtattggtaatcgtgtcctgaatgacccaatacgaaataaaaaataaattattgctaattattccattttacttgtccagctgaccataaatcgttgcaaatgccctttagctgctcaatgcttaaacaatttggaagatgagatgaagcagaactgattgtaaaagtatttgcgaaaagatggacaaaaattttggaagactgtttcaaatgcatcattttatgggaacagattttgcagccgctcacctgaactggtgcatcggatcgccgtcgtttccgtccgtcccgcttcgtcttttcctttagaaaagcctcaacaaaatcagttggctctgtgttgtcattatcccattgctgtagctgattaattttcagtctgtgctcgtcgatttggcgctcaaagaatgcgtccaaattacggtacaccgttttggttcggttgaatttgccgtggaggaaaggcaaatgccgaaaaaggcggggactcagacggaagagcgcggtcagcgggtgcacactgatggcgaaatgtccgcagagcaactgcttaagctcattgaactgctcaagattgtcctattgcggatgaaaagatagcaatgcattaggattagtcattgtttcatatccgaaggtttgagcccgagattcgattctgatacccaaaagtggcacggtatttttctcacctaacagggatggcaaggaattacaatatacgactaccaatttccgacgttttgggctcagaattccgatttctttaaggatttttagggagcaaaacacgtaaaacctaatcaaaaaattcatttttggtcattaaatgattattaaaatattttatagctttttttaataaggaaaattttaaacctagaatttttatcaagaaaaaatattcttttggagatgaatttttgacaaatttttcatttcttaggagtgtatttttgaaaaaaaaatttgcaattcatagtggtgtattttcataaaaaatttttgattcatttcataggggtgtattttcccgattttattcaatttttaatggtttttttcggaaaacgccaaaaaaggcaccaaaatggcaaaatgccaaaaaaggcatttaaggcacgaaaatcccggaaaaggcaaaaaaagacataataaaagtcaacgtagaagcctcaaaccaagtggaaaaggtgttatttatgcttaatatgtcgaaactagtgcgcagaaaaaaggcatatgcctcaaaagttagaaaaaaggcttagtaaaaggaataaatttaaggaacaaatttaaaatagttttaaaagataaagaaaatcaaaaataaagtagattttttttgtgaattcatttcaactttttgccataagctatgtttttggactaaatgatcaaggtttaaatttatgcaattcatgaccaataaattctcggaaaatctgtattcgtaattacggtaagcttaaaaaaatccgtaacgcatttttttggcatgataaaaagccgtattcccatactttataaatattaaaaattttgaaaagatgaacaaaatttaatgaatcctagttactgttccaatttanaaacatttactcaaatgcgtaattatgtcaaaccaaacgtcctggtttgccattactattacatcaaatcatccctgttttatgcacattacttacacaaatcactgcgttggtgtacggtaatttgagtcggttcgctaccgtaaccgttcgatttattgtcccattggtatgttggtgttcatcttcatcatcatcgtccaccatccactgaagctcatcgctcattttggctgttaaaaaattatggaagggtgtttcaaaatgcctcattttccgagactcaattttgcagccgctcaccgaaattgtgcaacgagtcgtcgccatttccgtcccacttcgcctcggtctcgactagagtgccacgggaccgggaaaatccagaaattataaaggttaaaaatgatttaaaaattaatataaatgtaaaatttgtgttaaattctttttaataaaattaaaacttttaaaatttttttgaagagttgcaacttctgttaaaacatttatcgtaaaaattaaaattataaaattaaagatttttaagaacaaaaaacttaaataattaatttaaaaaaatttaatttttttaaaaagttaaaaaataaaaaaatagttatcacttccgggagcccggaaaaatgttctgtaaagtccggggggatatgaactatacaattttcaccccagctaaaaatccggaagatccggaaaagttcccgaacccggattccgacttttcaaatccggaattccggaattctgagcccggatttggattccccgagtccaaattagccggggaaaattgttattgtttgccgattttctgggccaccgtaaccggtccaaaaagtacgaaaagtgatttggcattttccgga

SEQ ID NO: 14066 - DNA, 3068 bp, Heterodera glycines
aaggaatgatttcacgttatttaaatgtttttatttattcttttaaatccgataaaataaacctaaatataaatgtataatttcaattccattttattcttttttcctggtttatttttgtttttatttacatttcattcattatactgttcgtaaaaataacaatttaattatgagaagtttaattataagttgttgtttctactattattttttaacgaatatttataggatggttcccttgcttaaaatgaagccattagacatattttttaacaaaaaacgcaatttttaatcacatagtcagtttaataattttaattgtttttatttataaggaaatattatataattttttttatattttggattttttacgaatttaatttttatgaaatcttttttattttccactcggcttttcattaaatactttttgttcaatttaaattctttgaggttataattgttagggcttcgttttttaggcatttgcctattttgaactttttgtgtttaatgcctaaatgctatttttgtgccaattacgccaatttgccacctattttcaggattttcgaataaatctttaaccaaaatgcaataaaaacgaaaaatacacccctaagaaatgtccgaaaaaatttcaaaaatacacccctaagaattgaaaaaaatgttcacaaaaattgacccctaatttaatttttttttgataaaattttttgggtttaaaaattttccttattcgaaaaaactttaaaacaattaaaatataactaaaattaagtgtttggatgaagttttatgttttttgcttatgttgtcaaaaagggaagcttctacaatagatattttttcgttttccaattttttaaattttattttgtgggttttttttaattttcattagcttaaaaattttcggctctttaaaaatataaataaattttgttatctattaatttctttaaaaatatttgaaagtaattaaattaaaatttttattaaataagtctatattaatcgatggctatcggtctgtaatagaagaatccgaaaaaaattttcgcggcaaccaatccctgaagagttacagacccgggactgaaatggcctgagaaggagaaatttttgcaaaaaaattaaataattaaagcatttgttcatatgtttgtgtggtttagtgactataccttctgcctttcattattggtcgctagtgttcaattccccaccgggatagaatgttttttatattttctttacattatttcaaatgaaatttaattaataaaaaatcaacttataaatttatttttcttttttaaacagcctaaaaccgcaaatttaactttttattgatttttcattcgataaaaaaattcttatcgatttttgaacatataataaaatttgtcaattgacccgaaacccgaatcctgaaacccgatatttttctcgtcccgatcccaaaaccctactcgatcacgaatcccaactcgatattttttggacccgcagctaccctggttcagatatattataatagaaaaaataataattttcaaaattgaaaacatataattaatattattttatattcagaatacgtattctgttataagtaaaattaatagtttagtaattttaaattaaaaaacaaaaaagaaaattatataaacaaattaaaaaatatgcaaatatgcggcaaattctaaaacaaggatttctaaaatgaacaaaactcaacctaaaaatcagcataaataaagaaagtatgaatgacgaaaaaataaataaaagaaaaaaatttaaaaatttaaaacttaattatttaaaaagaagcaattaaaatttttatattaatttataaaatatcggaagaatctaattaaataattatattctatattaaaataggggacggaattcagatttacgatttacgaaaatttttggtgcttcggaatgccatccttgatgtacaaaattctaaaaaagtcggcataaattttctagaagcattcaaattgtttcaaaaagataagctcactcttacttgtacgaaatactaaaacctcaaaaagttacatttttaaaaaccaataatttctttgcctattttcacaaagaaaaactatcatatatatatatttatattaaaattcttatcttaaaattgaaaattcaatataactaactttatttatacattagtattaagctaatactaatgggtacagtcaattaaaacaattgaggagaaaaagttgcttcaaagtcaaggaaaaaatataaaatttgaaaacataaaacattgactataataagcgatgtcaattgacaaaaatattataattgttctataaaatgaaataaaagatcaggaagcacaattttttgtcaaaatttttacacattaataaaaaacttttaagaaaaataaatgtatttacatttttttcacaagaaattaaatgttccttgcaaattatgaaattaaaccataaagagaggattttagtattattctgtgtatagaatattataaatgcatctgcatattaaatataaataaaataattatcgaatttaaaatgttaaaaataggtaaataaaatttgtaacataaaggaacaatgacaaataaaaatgcgaaccggcctggacaagagaataaaatttaaacatttgtttttaattaatataaacaaagaggctaatattaaatataaaaataataataaaataataaagtcaaagaaaatatatgcatacatagaaatatttacaaaatcaaaagaattaaatgaaaaagcacagaaataaatcaccataaaatgaaaatagttaaaataattaaaaactttaaatcaaattaaatgttatgaaataaaaaatgttaatccaaagaataaaaaattctaaaaaaaaccagagtattcgccagttaagtaataaattcaatggtgaaaatcttaaaaaaaattttactcactctatattggccgaaaattaacataataaagtcgacaaaatgtagcagagaattttcaatgggcgag

SEQ ID NO: 14067 - DNA, 2408 bp, Heterodera glycines
ttttcaaaaatgcaaaaattccagtaccaggatgaattgtggggggaataaacgaaaacctttttctccaggaaaattttaaaaggtttttcagtttgttaacttcttgttaggtatatatttatttctctgttttatcacctaaaaatcctagactttctaaggaattagagcaccaaaaaatatttgcgatagcaaatttttattatggtaaaatgtttttaataaaatccgaaaaattcattcggactttcaaaaaaaaattaatttacccatttagcacctcttatgaaaatcaataaatatttcaatcatataatttgtattaaataattttattaattatgtgactgatcgcttttttcaataggcgaggttcaatagcagcaaaattgttacgatattttcatgcaggtcgcgtgtagagctatccatctgtcaggtccatctcaacggagtattatctcacaaagagagaagatatgttactgctctcagagaatgagaacccccccccccccccccctgtcccacaaaattttttgcaaaagcgcggcgcaaaaaaatgcgtttttaaagcagaaaaaagtcgtcgcaaatgaggaaaatgatcagccgaaacaaaaaaaggttggaaaaatccattccgatgacaaatacaagccattaaataaatattaactatttttcattgtatataataaaaaattttaaatgtccttgggtttcatgaatttttcccattatgtccttgcaaatcggcaacccgtccttgaaaacggagcatggacgatggcagccctgaattaaaataaagtaagaaacgccaaaccggctattcactttaataatttaaaataaaagaaaaaaaaatttattctgtaataaccaatcaatattcatttaaatatttctgtaaaaaataatcaaaaatatccgttttattattgctaaataaaagtttgttgtactaaaaatatttcattaaaaataattccaaaatggaattatattaaaaaaattagtatagaaaattaataattggatggaaacagttgggtggaaagtaacgagcgataagaagggattcagtcaacatgaaaaaaaactaaatttatccaaaataaataagggcaaattcataataaagaaggaaattaataaaattttcaaatacttactgcgcatataataaaataaaaacctttattaattcaaaattaagaaaaaaaaacacttttgataagtcatataattacttttaaaataaaaaaaagtattccaaagaaatttttataatttttatgattaatatgtaaatttaaaataaaaaattaacaattttatttatttaagtaatcttttgaccttttttctcttactttttaatattataaaataatttttaaccattttttccttttaatccagccttattgtgtaaacaatttttgttggtattaagtttttattttaaaaattcctctagaaaaataaaattcttttatgagttttaaagaactaacaaattgtgtacgtatttatgttacaaattttattaacctatttttaatattttaaattcgataattattttatttatatttaatatgcagatgcatttataatattctatacacagaataatgctaaaatcctctctttatggtttaatttcataatttgcaaggaacatttaatttcttgtgaaaaaaatgtaaatacattttatttttattaaaagttttttattaatgtgtaaaaatatttgacaaaaaattgtgctcctgatcttttatttcttcaattgacatcgcctattatggtcaatgttttatgttttcaaattttatattttttccttgactttgaagcaactttttctcctcaattgttttaattgactgtacccattagtattagcttaatactaatgtataaataaagttagattatattgaattttcaattttaagataagaattttaatatatatatgatagtttttctttgtgaaaataggcaaagaaattattggtttttaaaaatgtaactttttgaggttttagtatttcgtacaagtaagagtgagcttatctttttgaaacaatttgaatgcttctagaaaatttatgccgacttttttagaatttgtacatcaaggaatggcattccgaagcaccaaaaattttcgaaaatcgtaaatcctgaattccgtcccctattttaatatagaatatattttattttaattagattcttcccgatattttataaattaatataaaaattttaattgcttccttttaaataattaaattttaaatttttttcttttaatttattttttcgtccttcatactttctttatttatgctgatttttagggtgagtttttgttcctttta

SEQ ID NO: 14068 - DNA, 1537 bp, Heterodera glycines
  misc_feature (1383)..(1383): n is a, c, g, or t
  misc_feature (1451)..(1451): n is a, c, g, or t
ccagatgtccacatagaccaagaaattgaatttattaagaaacatgttacgaaaaattggaaatttgccggaaaaatacttaaacgatcaaataatcttgaaatttttgcaaatatgctttttaaacgggtgaaaattttctacatagaggcatttagtgcccctgaaagcgaaaatttatactattcatttttagaagttctcgataaaattcaaaaattacctaaacttattatgcatgagtatggaaaccaagcattagctatgcaaaaattagaaattggactcaaagaaataaatatatttaaatgtcaagaagcagagattatatccgataccaatttatcgaagataaataaattccaaaaacaagtgcaaaattatcgatttgacatgaaaatgttatacaataaaatacgattgacagctattaaacatgtatttaaacccgaaaaaaaattttttttagtccttttcaaatagaaaaaaatagagaaattttttattcattatttcggcatatctaataaaatcgcaactttttttttgcaaaaacgaaacgttttcgttactaaagaatcggatgattttttgtgtaatatttcatggttacttgcgcaaaagaccaaaaagttttgcaagtttgaaggtcgttcactaatttcatttgccgaatttgaactaaattttacaatcgaaatagtttgagtatttaaagagaccaaaattttttattatcctatcaaattttttgacttcaatcattaggttacgctattttattttgatttaacatttcttttccacttttagaaatgtccgagcaaaatcatgaatcggatgatgttttgcccacttgggccatggtcgattttcatgaaatgagccgtcgagaaagactgcgaattcagcagcaagaagaattgaagcggcaaaaccaaaaaaagcaaacattggagcagtttcggcaacaacgggtggaacaaaaacttcaatgggagaaggaggaaactgaaaaaaagaccccaaaacatggaagaagaggaccgatgagatgaagaaaatctgtgaggagagatggacgaaagcaaaatatgctggcagtagcaacgacaacaagaaccacaataaacaatcaaacgatgcccaatacacttgggattgagcccaattggaaaatcaagaaaaaacatatttggcaggcggtgggttgtggtaaaaaaagccccccccctcctcaccctcccactctgacgtaatcattgaatttgttgttgtgtttgtttttaataaatatgatagaaaaatgtattattatagggtcttgatttatagtaagtaaattttaacacgtggtgtaaaacgaaaacttccaattctganttcactatctgccagaaaataaattattttggttattcgtcataaaacaattaaaatttcataatttnggcattttgtcaaaatttttcagtattttgacattttttgaaaattttttaataataacatattaaattaatctgttctattaaaa

SEQ ID NO: 14069 - DNA, 2387 bp, Heterodera glycines
tatactattcttttttagaagttctcgataaaattcaaaaattacctaaacttattatgcatgagtatggaaaccaagcattagctatgcaaaaaatagaaattggactcaaagaaataaatatatttaaatgccaagaagcagagattatatccgataccaatttatcgaagataaataaattccaaaaacaagtgcaaaattatcgatttgacatgaaaatgttatacaataaaatacgattgacagctattaaacatgtatttaaacccgaaaaataaatttttttttagtccttttcaaatagaaaaaaatagagaaattttttattcattatttcggcatatctaataaaatcgcaactttttttttgcaaaaaaaacgaaacattttcgttactaatagaatcgcatgatttttagtgtaatatttgagccttactgcacaaaagaccaattgaatttgttgttgtgtttgtttttaataaatatgatagaaaaatgtattattatagggtcttgatttatagtaagtaaattttaacacgtggtgtaaaacgaaaacttccaattctgatttcactatctgccagaaaaataaattattttggttattcgtaataaaacaattaaagttcaataatttggcatttgtcaaaatttttcagtattttgacattttttggaaattttttaaataaataacatattaatttaatctgttctattaaaaatcaataaattatcttttagaaataaatgttttttcttgtgccgcataccacaaaacttgtcatcaaacattttgcctaagggttttatcgcaaataaaaacgaattttgcgcttgagatagggaatttatagcgcaaatataactagttattgtagcaataaaaggactaatcacatgatttatgtttttcccgccgtaaaatagcaattgttgcgcaaaaaccccatataaatagagtggttaatcgtttagtaataggcgaatacaaacaaagctatgggaaccgtacgtcactgtgaccatccaaatggtaaacccaaattgctaaaaataaatcaacatttttaagacgttactacgtttattggaccgttgaatccatctaacaattatcctattttggcatattatgaggcgaaattccgtggcgacgctgggtattttcaaaaatattttaacgaattattttaaattaagaaccttcggtatcggcctgtgtgatggatcccttgaccgtagcgatttcgtgtgttggagcccgaaatcttatggctatgagtcgtcaggcgaattgctaggattttccgctacaggcggtccaccagttgtgcattcgcaccgtttttttccaaatgatattgtcgggtgtggaattaatctagcaactcgtgaggctatttttacattaaatggccaaaaaatcagtttgtttacttgcaaaacattgtaaaagtttgatttgtatttttagatactactggcctcagaattgagaatccggccgtttcaatgataggcagcggaacgtcagctactgtaaattttgggcccatattgatgttcaaactttccaaagtttttgagccgtaaacagaaacacataaaaggttaaaattttgttggcaaaaatagaaataagtcgtaacagagattttgtccatctccatcgattttgcccgtagtttctgcacttttttcccgccacgtctattctttttcaaccttttttctttgttgagggtgccggcctaaacgtttttgttcatttttattttgttttactatttccaaaaattttcctcatatcgcaaaaggcaaaaaatcctattgcttaaaaaatgattttcaaaatttttcttacaattctgcactacaaatgtggtcttacacaattaaaagaaccaaatttagcttacttctgctcccaaaggaattgtatcttcctcatcaacaattccaacaatttgatcaagtaaacgttcaggatcgtccaatattttttccgtttcattcatctcggaaagcaatttttcgttgtatttgccgagagcccctggtggctgtaagcatttaaaacattattttgagttgagaaataaatatttagctaaattcccaaaatattgctcagtatccagccctgccctactattggaaacagaaaacttaggcccttttgcacctaatctttgccggaaaaagttatgcttatgtgaaattaattcaaatttctttaaaatcaaaatccactccatcaaaaataaaaaattactatattataatcccctagccagctctaaaataaatctctcaagagcctttttagaggcaaagcagtctaaattttcaatgagttcaattataggacaaaaa

SEQ ID NO: 14070 - DNA, 3520 bp, Heterodera glycines
ttgtcataccaaacggacaaaagatccaattttttaaatatatttgtattaccgcgatcatttattttgacaattcccaattcgtcccaaaattgatccctcttttcattattctttctcattcgtgttgttcagtttttatgttttaatcttctgctgcagttctcctctaaattcatcgtccctccatttttattatatttcttccgccgttcccaatttactttaaaataaatatttatcccaactattggcaacattcggacaacacatcttcggttggcccatccccaatcccccacaacattccatatatttcgtattcccgtagaccccgaccccattttgtttctactctttacgcgttcattcaatgcctaccctaagtttcttaggccaaaattttttttattttttagttggtaaatagctatcttctttacaacaaaagaacgcttaaatttataaataaagaaaagagctaacaatgacttcaagaaaaataaattgagataacacgaaattcagcctttttcgagtagtaggaaaaaagcgatgagggaacagttcaatttaaaaagcagaggaatgagggagtgacttgggaaggacacaaattggcttgggtttgtagcaaagtgtaacacattggttgggatgggaaaataaattgtaaagagagaaaagttatacaagataatgaaagataaaaataatagttaaataaattaaataatgactttgtccaaacgggatcccacaatttggttgttggccgttaattcccatcaatttgtccacttgttcatcgatagttttttcgttgttcttgaacacatcatcagcaccaatgttttgtattgccaatttgtaagcatttcgtagaattatgccgacactaaattaattatacacaaaaataatagttaagtctaattgtgataaataaatattaattaattttctaacatttaaaaattttaagctttttcattaagtttcaaataataaaaattttcgatttattaaactaatttttgaaaatttattttacaacaaaaaaataataaataattttattttcaataaattagcctgtttttttcgaaattgtcctttaattcaatttcattgccgaatagatgtaaatggtaaaccaaatattcaagtgagtacctgtaaattaattaattatttaaataatttaaatcgctatacatcgaattcggcttaacatagtgaaaagaaatggcataatcactgcaacagttgggcccctaaatgtacaatttataaagtaataaaaaaacgatttgttctaatttaaaatagctatcccaaaatctaatattaaattaaattagaatttttttcgtcctacttcttccatcggatagtaagtgtatttccagaaccaaaatgatttgtccatatggtctggggacaaatgagtttccggcacaaatgggaaaaagcgatggtggtcttcggcatcacgcgaatcgccagccttgacgccaattttgtccaaacatttgcccatttcaacgtcctcgtgaccccattcatcggactgaaaaattagggagggatgagtgattagtttttagtttctaaaaaactcctaaaatagttgctaaaatggaaaataggtaacaaaaagtttcatattatggatttgtattttcagaaatttttggtccattcttaggggtgtatttttggaaaaaaattatgtcgatttttagagatgtatttttctgaagcgatcggttttaggggtatattttttcgtttttattgcatttttgttaatatgtttgggaaaacgccaaaatacgttaaaatattttttccaaatagttttgagtttttaggttctaaaaatagtaacatagaaaataggttctaaaaacacgaaaagtacttaacaacgaccgaaaaaaacatattttcatgcttttaagcctattggtaactcaggaaaaaatagataaaaagctaaaaatatcatccctagcgataatcaaataaaaaattttttcattccaaatatcaattttttttttaaaagatggaaatatttaaatgtaatttaattatgaatatttaaatataaagcaaaagttaactcaagtaaaaaatatataattcaagtttaaaaaatgttaaatgcttaaaatagataatctgattttttacatattaatgtttcaagaaataaggaaaaatttctaatattcaaattatttgaatttagtaattggtgttttagattttcggaataaaaatacccggcacttctttgcgtcggggagtccttcttcaacaaattttttcaatgccattcggctcaaaacgtagccagctccgccgctcatatagccctaatcgattttaaatttattaattattattaatttcatttaattgcctgttcaacaaagggtttgaatttgcacccataataaatgggttcttctggcgaatgagccatcagaaggaagcgcaaattctcaacaatcacaaaagtgtcgtcgtcagtcttgagaaaccaatcaaagtcattctaaaaataataaccaatttattattttaataaaatataataaaaatggtttttgcaaattaaaataaataaaaaatggtttttaattaataaaatgttaattggtaattaaaatttactaaatactgttcgtatgcgtatttgaaggctgcctttgttttgccccataagtgctcccttgaaaaggtttgaaaattttaataaagaaattgataattttttcaatatttcaattaaaattaaaaattaagaaaaaacgaatgtgctttaattatagagctatataataagtttagaaaaaataaattaaaaaacatttaaaatgtttcggaaaactaatccgattccgacacctatttcggcccatttcgaaccccgaactcgaattcgataacctaaaccattttcaattaaatgcaaatttatgcgacaaaaccgattcattgtttaaatgttgataacttatttgttatattaatatgactgcacagaagggatttgaaatttcactttgaaaaaattgcatgaatggcttataatgacaatgttttggacacatagtcgaaaatatagggcttctgtaaagagatgaatatttttgggacgttttttgaaggttttctgagttgacaaacgactgtcagtaaactttgtggactggtttaattttttttagagatatttgtacaactttttgtccttctgccatcgccattggatgccaaggtccccaacatttttttttttgtttttctaagctttactctaggtcttttcgttgaaatatatgaaatgcttgttggaaaaagaaaatatggagtcgttcgtgtgcttgtaaagcaagaaatttgattgttagctggcttagaacgtgatccgaacgggaacgcgtttttatggttccagtggaaatgcgtggagcgaaccttcttatcccactcattcaacaga

SEQ ID NO: 14071 - DNA, 2923 bp, Heterodera glycines
  misc_feature (989)..(989): n is a, c, g, or t
  misc_feature (2779)..(2779): n is a, c, g, or t
  misc_feature (2871)..(2871): n is a, c, g, or t
  misc_feature (2890)..(2890): n is a, c, g, or t
  misc_feature (2897)..(2897): n is a, c, g, or t
cattttgtaaatttctgtcattggatacgctcacaatcaggtaagcacaaaaaataaacaaagttttttagtttgctaataaaagttaaaatttatttgcctttttatacctgcatgttcgagaaatttagtgtctttttaatgcctattttgcgattattattattattatttttttgccttttacctaagtgcgtgttttgtaattttcgtgcttaaaaatgccatccctaatacaaattggttaattcgataatttatgttttgagttgggtaaactaggaaaaaaattttaagacgaataaaatatatttaaaaattatagaaaaaaattcttggtatcattcaatggcccttcaggttttctatctacataaaatgtttcaaaaaagatatgagcaaatattgtaaaaaaaaaatattcgtccaaaactttttttttaatacatgaccaaattttttggaattttgcaagaaaatagagaagcttaagggctatcgaatgttattaaaatgtttaatttggctgaaaggacaaaagttgatacgattttttgtcgaaatgcgagtcggggcattacaaattggccttgtacgagttgggtttttacccaatttgtaaacctcaaaaagaaaaatagggcctagatatggttatatattatggaaagagtttttcttttacatataacctcaaaaataatggaatattttcagcttccggcgacacatgatgcccaatattttagaagcacaactgccaaatgactattttttctacattttacggctttttgccgttaaacttgacgaagaagcgaaagagaggcatggattgaaaaccagaaatttgcttaataatgaaattttagtctcaagactagtcgccctgggtgcagaattatcacagaggcaggaactactttcctgcgtgcctataatgaaagtgggttttttaaataatgaaataataatttaaataattaatntaaaagaactgggattttttgttgcggtttatatttgttcaatcaaattaaacacttaattagatttcaaagccctttatgtaatttgggtgctttggcttttttttttaatcatatatttagacatataaaatccaagttctgattattagataattgtaattaaaaagataaataataatttaataataataattataaaattaagttaaattacaattaaaattaatacacaataaaaccgttgcataaaaaaagttaccccctttaaaacagttttatttttgaaagttgtataaaaaaacatatagataactctctaagctgaacaaaaaaaagtaactattgctaggtcgtttttcatgtatatataagactatccaaattgtctaaccccagaaaatttaagacggggtagggctttgtatgtccaagtatctctgaaaattggtaccatgccatatgtataatattttcaaaaatacaaaaatggcgtaataattttacaccgatcggttcacgggaatggtcaactaagcaaaaccgggatgttgtacttttttaatgcaacgaaattgtaaatgtatacataataacaaaaaaaatttttttattaagctagcggcattttgaaggaatggccaagcggccaggatgtagagtctattatccaattaagatttaatatttagaaacgttggtttgttttaatgttatattttaggaaaatattgttgaacacatttaattactcattataataattggcccctattcctttaaatcatttattcataatttcattttaataattcatttatgcataattacattttaataactcatttattcataatttcattttaataattcatttatgcataattacattttaataactcatttattcataatttcattttaataactcatttattcataatttcattttaataattcatttatgcataattacattttaataactcatttattcataatttcattttaataactcatttattcataatttcattttaataattcatttatgcataattacattttaataactcatttattcataatttcattttaataactcatttattcataatttcattttaataattcatttatgcataattacattttaataactcatttattcataatttcattttaataactcatttattcataatttcattttaataattcatttatgcataattacattttaataactcatttattcataatttcattttaataactcatttattcataatttcattttaataattcatttatgcataattacattttaataactcatttattcataatttcattttaataactcatttataataattggccactattcctttaaatcatttattcataatttcattttaataattcatttatgcataatttcattttaataactcatttataatataaatttttcaggtttattataaatttaattggcccctattcctttaaaatcatttattcataatttcattaaagtcatttaaaaatttccatttaaatatcttttaatgcatttattttgggtttaattgaataaacttttttaagtcttgaacactgaagagcataaaaaataattattgtttttttgtcgtttaccataatttttctttggttcaattggggataaaaataaataaaaaatgcaaaaaaaaaagaattagtaaaaaggtgcttatcggggggaggcgggtatatttgaatattccatgcaattgaataanagaaaacacgaagaaaggcaaaagagaaacaaaacagggacatttgggacaaaaaatgaataaagaaaaaatgcaaaatattttaaattcantaaaagtgcttattattgnagggtgntatatgatttaataaccattctcctc

SEQ ID NO: 14072 - DNA, 2085 bp, Heterodera glycines
  misc_feature (1982)..(1982): n is a, c, g, or t
cagcttggaccgctgtttttcgcaaattgattgggctatatggacggacaaatgagtggtgtggcggcggtggtggcctttgaaacagtttgaccgcagcacaaaatgtgacggggcgccacattcactgagttttgtttttatcgcgccgccagagaatgtcacggacacttttagttattcacttaactaatttgaaagaagagataagggaatttaaaaaaaatgtcatgaaaagtgtgagggtttatttctacaagaaactccccaaaaatttaagccaaaacatttgataaaacaaggtccccatgccaaggaagtccttggatttgggcttagggtcatggaaaattgaagacatcctttttcccaagaatgcccttggaaatcggccttagaaaaaaatatttaaattttccaataatttataaaaatcccaaaaattttcccgacgcctaatctttttcttaaaaaaattggccaaaaattgcaaatttagtgatttttactgaaagcctgttaacaaaaaatctctttaaaaatcccaaaaatttttccggcgccgccggcccaaaattttttggaaaaaactcgccgtacaagtgttgtgaaaatgtaaaaaaaatagaaaaatgatcagcagaaacaaaaaaaattatgaaaaaaatctacaggcgcaaaatacaaaccatttgaagaaaattaatcatttttcattgcatatgataaaattttaagcgtctttgcatttgacgaaattttcccgttatgccttggaaatcagtatacccgtccttgggaagtgagtttttccaatgggaaactcaggtaaaatgctttaagagctcttccgaggtaaaatgcatatggtttttggcaagaatattttttgtaaacagaaaaggatcgccaaaaataagcacatttttaaagtgccatataattcctaaatttgcatgtttgtatttttagtcccgtaataaaattggcgtgagccgtgcatggaaattcgaaattttccaggacaggatcgggaatcccgtaaaattccgctgtgcaaaaaaatgtgggaccgggactttcacagaattcttgcgggagtcccacttctcccatcaagctctagtaaaatcaaagtttggttgccggatttttaaatttgaaaaaaaaaattaaaaaattccttaaaaacttttttttactcacccaatgcgatggttgtgaatacaaagtaaaatttcgacacaagcatataaatttcgtcctcccactgaactgccgtcgtcccctcaaaattgggcatcgcttcaacacatatttattagcaaattcatattcgcgttttttgtgcaatgtcagcttttcattggtccgtcattcaccaattcaaatgtctcaattggcggtggatttcgtttcaaaacaaatattataattgacagaagaattggtggtggtggcactgagagatgcctaaacaaatgccaaattgagcaaattaaaaagataaaagccgcgggaaatttgaaaaggaaatttattaaaatttaagccaaacactcgaaggtaataccttaaatagttgtctctcgttttttgaggaaaattcaaatttcttaaatggttttatgaccagggaacccgaaggggaggggggaggggcagtgaacacttggccactctgcattaaattctcacattttcttcaaaattcgtttattcgttttctttgccactcgaaaacttcgccgtttatagaaatgcgaggacggaatcgtcgttgtagctgaacaaaaagaatagttcctcgttaataaatgattttgaatttgatttactcaatctgctgaaggtccttaaagcgaattttgttgggcagcggacggtccggcaaaggaaaatccacataattggcaccaataaacacacgtaaacttggcacttctccgaaaacgcctatgcgaattctaattgctctccanattgtcaattcgtttttgccatcgaaatgtttgtccaccaacgcatcgaaacgtggcccatcccaacatcgctgcaaaatcaactgaaatatgaaaattaaat

SEQ ID NO: 14073 - DNA, 1231 bp, Heterodera glycines
aaaatttttgactaaaatttgttatccaaattctgtctcaaataaacccaataaattggtgctgattttcaccaaatgtggcagattaaataagcaatggtcggcggagaaaagtttttttttcgtccggcgatgccatggaaaattaaattcgcttaaaatatatttggtatgaaatttaagctagattttcaaattaatcaaggtaaagatccgccggtgtatcagataagtttcataatccggattcggaagaaatgtgcaattgaatgaatggtggaaagctttataagtattttaaaaaattcattcccctcaaaacctatacacccaaaattttttcgctttgtcatagcagcaataaattgcctaagcctagacctaggcccaggcaagcctaagccaagtcttttgtacgagttgtcatgacaccggtgagggacttggatatcgcgcaggattttgctggatgagccaagtccgcaatcctgcattttttggaaattttgaaatatgtgggtgtggaattaatcccgcgggatactattaaaacatgtgatattactttaccaatgtcgtcgccttccaaaagatgttgccataaatgaacccgacgattgctgctgactttcagcaatttcgacagaagaaatgacggcgaaggattttatttgtcccataaaaaatgaattttcggtctgaaaatatttgagaaaaatttggaaactctaatattttgaggatttatatgtagggagcataactgtttaaatgggggagggggggggatgatggcgatggggtcagttgggttgggtcatgacgcggaacgcaaggggtcagaagggggggggaaaatttgctgacgaagttgagcagcggacagttgggcaatgtaatgcccttaagaatcgccattgttctccaaataatattaattcccttttgccatcgaaatatttgtcaattaaaacattgaaacgtggcgaaaaaagtgccaatgtgaggccgagtttacggccaaaatgaggaaaaatgtccatccaaacgtcgctgcaaaccagggttgttgcgaatcgaaaataaaatgcgaaatatgaaactaaaataaaacacaaaaattttttttcaacatccctgctgcaaacccagctgaaattgtggaaaattgaaacggtctcaaaaatgaaagttataaatttttaaccccaataaattctcacattttcct

SEQ ID NO: 14074 - DNA, 1754 bp, Heterodera glycines
  misc_feature (74)..(74): n is a, c, g, or t
ttcagcaatattttttctacgaaggtgaaaatgattaaaataataataaataatataatttaccaattttgatntattaatttgttcagtttttgccggtgatgctgcttatccaagcggcacttttctatctgccaaaatggacgctagacaaattgctgagtgattttatgaaagggcaaaaaaaaaataattaattcaatgaatttaaatattttaaaattattgtttataaaattcagcttgtttgttggcaattgccgtggcacaatttgccgtggttaacgcattgaccggccgagggcaccgctggtggggcattgaaatgggaaaatcattgcgcagtggtgatgaaatacaggtggaaaattgaatggaatgactaatttaagaatatttaacctattttttttagacaaaccctgacttacaaatttaaatgtttttgtttagcaattatttcaaatatttcggaaaatttatgtttattttcaaagtgcataattttatctaaataaatttttttaattccaaagattaaattgcaaaactttatcaagttgtgagtacatagttttgctttatgtgcatttatttgttcattagttcgaccactttcggcactttggtttaaattttaattagaaagttaaaacaccgaaaaagactctcttaatcactgcacttttgcccttttaaggatttgcccattttcccccgtctgatcacttgtgactctgtccttgctccgaacgtgttcatccaatgccatctgcgcatcacctggttcaatgagaagattttcttcctcatttggtaaattataaattccattttcactttttctaattaaataattaatttgttaataattcccattatcaatttgcttctgttttaataattgccattctttgctcttttgtcaggtggtcacttttctgcgtctcccttttgactctgatcactttcgttttcgccccacaaatgcgccaatgatgaggcaaaatgtgtttaattagtcggacattaataataattgaccaatttttttataatttaattcacccaaaagcgtgcatttattgttttaaattttaaattatttctactactttttagccatcatttatactaccaataaaatcgtttaaactgaattcattaaaagtttcgtttattcatttgacacaaatttcttcattaaccattaagataaaaaaaatataaatgtactgctcaaaaagctcggtttcgaactcgactcgtgaaatgcctagggtttttgggtgttttgttctgatcaccggaccaattttgggcgttgtacttgcaaaaaaagtaaaatttcctgcaaaatcattcgcctgattgcttaaatagttgtagagaataagctaatcaatcgatggtgccgaaaatggatgagtcactttgagaaaatggcagtaagcgaaatgggccacggaacagcactcactctctgctgctgatcagttggagcgatcactcaccgttttactctccccaaaaaacgcatcagtcaacgtaatatccattcattttaattatcattattaccattttcattttattttattttgtcaaaagaatgtccgtccgccgttatttctgcttcgttttgctgttgtttttccagcaaaatgtaaaaaatttaatgcttttttcacccgccggagttcgcactgaaatttttcaaaatgacatttaaaaaaagaaaggataattaaaaa

SEQ ID NO: 14075 - DNA, 2934 bp, Heterodera glycines
ttaattgctcatcaggtcgaaacttgggcaattattttagttcattaaagtttcatcctttgcttatgaggaggtaagttacgtcaaataaaaagggttcgccaaaatataaaacttttctcccagtcaaaagattgatttgtgagactcgtgagcaaacactgcaaaagttattattagcttatccgcaaatggcgactaaccattttcaataattacaatagataattaaatcttttggtgacaaagttcaattttgacccgcaggaaattaaataaattttaaaattcaattaaaaaaatcattgccgtattggcaccaaaaagaaaaactatgataccatattaggtaagtgaagttgatcatctttcattgttcttttttttcattttgcccctaaactcttccaaaatggcattaaatattagtgagaaattttaactttggatttacccattcatcatccattttccattttctatgcttttcagacaaatttcacatcttccaattcggctgcatccagcgtcgggtcacgctgtgacgattttgtgagaaattccgtcggttcccggtacaaagagttcaacagcgacccgtacacatgcgagtgcttttttgggggaaccggtgccaatctgtccaacaaaaatgtccatcttccggtgactcatcctcggcccgaaactgacgacgccggcacaacagcagcaggtcgaatttagggaaatacaaattgtaaaagttgtcgtttggtctccttaacccccgggtttatctcctctaaactcgaagacgagcaacagcaggccccaaatgccgcagcattcaatcacaaattaattttaataattgctattaattattattatttatttctttccatcttccagtgactcatcctcggcccgaaaccgacattagtgaaatgtaaattgaaaaaagaatcatatgtcggcatttcattatcaatataaaaaatgtaattaatcttttttattattttctttttagattcaattaaaatttttgtcgaattaactggcataaatgcgaaaagtgccgctgttcgtcgacaccattttgatttgaatattctgctgttgttgttgttgatcagctgttgtttttttagaatgattgtgaggaggaaggaataatttttgtgatttaatttcaaaggaattgaaaatatattaattaataaatattatttataaaatcagtcaccgaaaaaaaatttgcatcaaaaaagtttaagtaccaaagaagccttttggataaaattgagtcaaatccgatcgaagagccaaagatttagaatttaaaaggtacaaaatcatttttaatgataaaaatgcaaaaattataacaatgagacgtccagtaaaattcagtcctctttcgacaacacaacagtattgaggacaatttggacaaatagcaccgatttttctggaaagaaataataaatgataaaaagcaaataagtattaaagttctaaagattttactcataattgatttggtttagttatcaccctttctacttttaaaaatcattattttcaaaatgaaaataaagttaattattattttgttgcttttccctcattagtcccatcccttttgctaaacgaccgtttatccgctcaaaaatgggcaatgtccgctgcgggaagatgaacgtagtaaagcatcaatccgacgcccaacatggccacagtgtaatcgatgctcaacgggtgggcccatgccgaacagcgaataggacctgagtgatgttacaactgctcgggaatcccggccgaggcaaaagccggaaatttcgggttattaatgcccgtccagattttgtcgtaaattctcgaactatgaacccctaatttttcaggattaagcagatttagagggaatgagtaccataagggaaagtgccggcttatggaagcgtatttcacccatcggatatattatgaaatattaatcattgagatgttaaaaaaccaaattgtttaacaataaattttgcaaaaaacatatgcgtgtgacaggattcgaacctgcgcgggaaaatccctttgtgacctagagcacaacgccttaacaactcggccacacacgcgatgtttgccaaggaaattgtgtcttgaaaaggatgcaacaggacaaatgaccaaaggtcaactcaataattaaccaccggtggaggggccatttctatcgaaacgagccaaccgggcagtaaagactactgggatttcgaaataaacgggaccggggctgacgatggaaaagtggacggaattaacggaaataaaactccgttttccgggactatcgctttttgtaaaatatattagtaaatcacataaatacatataaaaatggcacgataatgttgaatttttcaaatgttcactccaaaattctcaaatattggcattttttggaaaattcaatcagatggtatttaattctaaaactttcccggcggagcctattggcagtagaacctttctttttccaaaaattttagcataaattatcagaattaatgaattttgattgctcttgtattttgaaaatggaggtcttttagagccccaatgagtgtttttaaaatagagatcaaagttcagaccaaatgaacttaacgcgcaaaaaattaataccgtaccttaattaaggaattttaagttttttgaatttgaaaggttttgttaaattgtaaaaactgaggttcaaaaataatttttcatttcaatggtttgggtttgtacgaatcccttacagcagaagtacagtaggagtaaaaaaataagacaaaaaatgcatgtgacaggattcgaacctgcgcgggaaattccctttgcgacgtagatcgcaacgccttaaccactcggccacacatgcgacgaatgccaaaaggc

SEQ ID NO: 14076 - DNA, 2568 bp, Heterodera glycines
  misc_feature (2543)..(2543): n is a, c, g, or t
  misc_feature (2551)..(2551): n is a, c, g, or t
catattgttgattataattgtcagtccaatcatcaaaaaaatgtatagtttccctggttcagaccagatagcagcgaatcacgtgtgaatatgaaaataaataatttaacaaacgatttttttaatgtgcaaatataaatgtattcagtttttgggcataaatcagtgaaatttaaaagtgaattataatttcttgagaataaacaattcttttgcagtacctttacgactgttgcgatttgcagcatactgtaaaatcttaagatattaataataattattaatgtaagaaattatagtaatatttttaaagaattaaaatttggtactttacggttatcgggatccagatttcaaaaaaatttttgataaaaacttgtttttaggaattttcagagtcaaggaaaccgattttggcatcggttttaacccattcgagccccgaaaccagattcgaacaaaaaattcaaaatccattttttaacaaaattcacattttatacacaaaatcgcttcaatttttataaagtgattatgtatggcacgaaaagaataaattatttattagacacattaaagaatcactcgagaggccaatacttcgaacaggctcatatcaattcttcgaatacatctccgtcaccgatcatccttctctacatgaattcggcaaaatagctctccaaatgatgacgcgcggtgcctctttgcttgttatttcgccattttgcacttccccacattctttccactgtttgagtgtgcgtaccattcattggattaacaaagttgaaactgaaatataagtttatcaaaaaatttcaaaaaaaaacacaccgatgattgaatttaaaataaagccagcatcttcaaattcaggcgttttgtatccagaccaggaatcggagaaaatgatgcttccagttgcggtgttttgtacattagcattgagaatggttttggcgttgcggtccggaacctagaaattagaaattaggacaaaaaacccaaacacgtttatttgtataaggaacattcgtttggaattcgacaaattcctccaaaaatccaaactgcggcaacacactcccggtgttatttttccgcttgctgaaaagcgattcgtcaatttgaacaatttgattttcacccccgatcaattggttcgtctaactacttggaccaggaatagatgaaacgtaacattttggtgaatggtgcttcgtgttgcagaaacaattgcaattacgcagaccaattctttgtcgacaccctttattattgcacttccattcttgcctttatcccaaatataatttcattggatgtccatttgtacacttgcgtttggcgtgaagaagcctgcgttcctggaaaaattgatgaagctatcctcagtgcttggccaagccccaaatttgtaacattattttgttgaaaaatctaaaaatcagtgaaaattatatgtataaaaaaatataatgttaattttgttgaaaaatttttgaatttttgttcgaatccgggttctggagttggattttgtccaaatatatgtccgaattggttttccggaccctgaaaacccctaaaaatcatttttgtgcaataaacgtgaattttggtgaaaatgaattttcgacattttttctcgaattttgttcgagttcgggaactgaagtcggattggagcaaaacagatgccaaaatcggcttcccgactctgaaaatgcctaaacccaagttttaatcaaaaatttttttgaaatctggacacagataaccgtaaagtaccaaatctttattagttccatgctcatgaagtgagaaaatattattgaacatgaaaattttttcataattgaaaattctattgttttttaacaattaataggaatagtagttgattgatgaatagtaggatttgttataatgtttagatacttattttaaatccaaaaattgtgaagaaaagttaaaattgtacgaaattgattaatttgaaggaattagaaattatttttaaacaccattttccctgcagcgtactataaaggatatataaatattaatttgctttattttcaatttctttttcgttttaaaataaactccaaagcatataaatgaaaaaattaagctgtcttaattgaacatgataataatttataaaatattaaaatagaataatttttaaagcagcattttttctttgccaacccaagccaaaaatttaatttataattattttgattaaaaaatcttttgcaagttaatatttgtttaatttaaaaaatcattaaaattaatgttttatataaatcgaattttgtattaatatttggattttttcagcaaatgtttttatataaattttaacaatattaaaagagagatgtcaatgattaattttgcaataataataaatttttaatttataatttttgaatttttgtttttgaatattagcattttactgattttcactcttaatgcatgaagtataaaacctcgtagccgctgaaacaaattattttattaangttatagntaaaattaattaatagt

SEQ ID NO: 14077 - DNA, 2378 bp, Heterodera glycines
  misc_feature (2327)..(2327): n is a, c, g, or t
tttccttcactttcccgcgattttccataatcatcttctttcattaggcaatcgcattataccccgcctatctcgctatcggatcccgccgttccctttaaaagccaagggtaacccagctaaagcggaggagagccccattcatcccaagaatcccacttactctcctcccgtccctttccttctccatcccctccttttcagtcagttggctcatcccggacaattcccccacagagcaactccggagaaggaattcttctccgtcccttttctcgttatcccggctcccttttccgctcccggacaaaaattcacctttggtttcccttcccactcccatcccggaccgtccctcaggtttccttatttttggccattttcgctcagatacatttggaactcggatcgttttcatctcttattaatttcacatttaattcatattttcgccttcaccaattccacttttcaattcacaaccattttccattttaagtaaataaatcgatcagaccaattggataatggagaagtcaaagaaaaggatgtggaagtgtaaagagtggagaattaatttaaagggaattggacaattaaaatggaatgggaagattgggggaaaatcacaattatcccggggaacccaaattcgggaaaagccctattttcggcccggcacgagccctttctggtagccccggatggttgcaaattgcaaccttttcatcgtctctctgaggatccgcatttcttccgttttcgccccaatttttttttctccccataattcccatttttctctccctcttctcttccatttctctctctcctcttctccttccgtcttcgtccattttctccctgtttttctctgctaattcaattccccccgatttctccccgccattcccccccccccccccacttttccctccgtcttctgtccacattggcctctgctcttctgtcctacagtgcgctcgaacgaacagccaagctttgtcctttgccccccccccccgattttccccgtttctccttctcttccgttcgctttcccatcagctcgctgcgagttttacagcgtttgtctcttccgccgagctcttctcctccttctcccttccctacggcgctgttggtcctgctcttagctctgctgacacttcccttttgtcctttgcccccccccccctcgatcgttcgcgtccactgtcactcggccatatctctccgcttcatcgccattaaattgttgcgttagcgccagccgaagcgaaagtgactgcccttccccattttccttgctcatctcatttacaattccgttcggatgtgattccccccccccccttaggcaattgaataataatcggaatttggaatttctttgaaattttcaacccctctcttttagccaattttgaaaattcaaattctcttccctctcgcctccaccaagaattctgtgccgtgccgaaaattgccgaagaaacgccaccagcacccccagactccgatcacctcagccaacccgttccaccaaatcggaagcattgtttgccccgatcactttggcctgtccgcccaccagtccttgaatttgcctgcccacgacgagtagctgccgtttctcgtcttgttcttccctggttagatttcaactttggggcgaattttacccaaatttcgcactcaattaaattttcatggtccggtgtccctgccccccccccttttccaactctgattaatctcaccaaaccgaaatttggcccacctttcgaactcattagttttctccctgttcaatttctcttctccttttgtgttagcataaattcgatgatcaaaaattcggtcccaaaatgagactgatcaataatagccaattctgaattagcggtttgatcacataaattcgcttaacacattttcagccaattttttttttctctttctctgaaatcattgccattttctttaatcatattaaatgcaaagtcagatcgccaattgatatcttaatcaaaactgaacaaaacaatttgtgacaaatgcctgagctgatttaggacaatttcaaaacaacgacatttcgatttgatttatccaaaacaacaaaatttgatcccagaaattcactgacacacttttgagcaaaaacattcatattactgacattttgttcgaacacatcgagtcaaattttgttcacataaactcaattatacacattctgtctatcttttacaatcaaactgaacaaaaagaatttatgataatgtcttatttattctaacacattttctttaaatttctcnaattattggcattgtgaaaattcaatcagatcacaaattcgattataccta

SEQ ID NO: 14078 - DNA, 1015 bp, Heterodera glycines
caacccttttaaaattgtttgttagtgcgctgcaactgttacagtttacggcatgtccaagaaaggcaaacagataaatgctctgccgaaaaagcatttaccgtatccccgcttcaaccatttccactacagcccgcccctaccgtaccatcaattctatttgtccgtccgccagtgaagcgccaccctgggaccggtctgtcaaaatgaccatccgcgttttgtcgtcctgtacataaattcggctaaattttggggaaggttttaaaaaaaaaattaattaggtaattaaattttgcctgttcactgggtaataattggctgccaccggttcggtgccctcaaagaatgacgaatcattgcggctgaaattcaaattttactagtacatttcataaaagtgccattccccacaaattttcaaaaatcatgaaaatttttaaaattaaaaaaataaagaatatttaattaatggaatactttaaaacgaaaagactcagatttagattttgaagaaatatatcaagcaaaattcccaaatattaaaaaatttaaaaaaagttcttcgattcaaagtcttaggatttcttttttgtcaaaaatttttccattaaaattctttgaaaaaattaaattttttcgaattaattaatacatttctttaaatattttttatatttaaaaatttataatggcaaatttaagaaacacgtcaaaactaaaatttctctacttcattaaatactcaaataataaatttatttgtttatttaattaattcaaattatttcaagaaacgataaaatcatttaattaatgagctaattgttttctcaccgtcttttcatcatttgccgtccgtttgaatcagtccaaaaaattccttcagagtttagttcgctcattgtgtaacgtgtgatcacttctattgttttaggtcactaaattaagaccaaaataacataaattagcccaattttaatatcaaattcattaattcattaattagtccacc

SEQ ID NO: 14079 - DNA, 1223 bp, Heterodera glycines
taaaatcaaaaaaaaaaaaccgaaaaccaaaaaaaaacggctgggaagaaaaaaacctttccaattttgcgtctaggttataactgctaaaggcaggattgtccacaattggttcattgcctggagaatgaattaattaagcattttctatttttcgacagaattaaaaatctaattaattaattagttgattaacaatgaattatcttttttcgatttttcggtggaattaaaaaatcaaaatgattaattccccatttttattatataaagtatctttgcttaaacggtatatttctaaccacataaggcatcaaaacataatccgtcaggtgccgctaaaaattcaaaaatttttttgctacagtaattagtctttttgtttaccgtaagtcccgcgcaaaaagccgccggtgagaatatttgtttctaaaaatgcgaaaattacagaaatttgtttattttattttttttttgtactgatgtcatcggaaacattccaaatcatttccagcgctttttgttctgcacgtttttcctgaaaaaaagagaaaaaaaaaacaggtgtaaaaggaggagagtggaaaagaggtgagcgcaaccaaaaaatagtacaatgtgatattggagataagcggaagagaaagagagataaatgagagagtgaagcaaaaggaaggaaaacacgtaagaaaaattgaaaaatttcatctgctctttttatgtgtttttttaccaattcaatgtagtgcatacgtgaaaagaacagtgcttcatagccaatctgaacagtccattttaaatttttaaataaaacaaaaaaagttttaaatacaaaattagcactggaaaaatttagagaatcaaaaaattaaaaaaaaaaatttttttttcaattaaaatttacaaccaggaaaaaatttgaggctcttatgcattattgtatataagttaatcaattattttattaaatatttaaactatgtttctcgaccattgcggccaaattggcatgttccctgctgtggccaaatggatcaatttgccaggccactttggcgtgtccgcaatcgccttaataattaattaggcaacaatatattaccaattttataacaaaattttggcatatattcatataattgaatctctctcgagcagttttatcaattaccatagctggcattgagtaagtcgagtccaatggtgtactgatccatgat

SEQ ID NO: 14080 - DNA, 1343 bp, Heterodera glycines
agacaccgaatataaaagcttatttttctatacaccctataaataggaagattttgattatccatgttgccatatttacactatatttttatcacctgtgaatttttaacatttgattgatttatttttattcattttttattacggtattcattttgtattttttatttgaccaactttatttcttgttttctttttggcaccatataagagcactcatgtgcctttggtttgctcgataaattaaattaaaattaaaattaaattaaaacaaaacgaaaaatctaaatctttcataaatgcatgcaaaaaagacaaataaaatttttatagttctccatttttctcttatcacgaattaatcttgctaaaaattatagtgttaaaaattaacaattattcagatgatccgagaacaatgtcaaaaaagagcgagcattaaatgttatctcatttggtggcttttttggggttatacattttccttaaaattccaatcattttttaatgtaatttagattatcaattcttttttttgaacaatgggattattttcattaaatggcaaagtctcgccacttcttacttgatgaactgcctaatttttgtccttttgtatgtgtttttttaatcattgccttaatttgttcgtctttatattttagggttgtacgagaatcatttttattacataattttaactagaataactttttttgttttaaataatttgaataaaagttttcaatattgtttccgtatttttaatagtatttcataaaatgaatgttaaattttaatttatttaatattgaatgattcttttatatcgagataagttttctgttttttcattaacacttctttctaataatttaaacctttctttaataattaataaattcttcaattgctctctattttaaaaatgcttaattatacatttttcatgttcatataacggaaaacaaccattatcttgaactttgcacattggctataaatgaatgccttaattttcgatagaattaatttttattaagttttgttaaaatttattgtaagagcggaaaataaatttgcttcttcttataaagatatgattgaggtctttattcgttagaagtttgaatccatttataattaatataatctacaggtatattttattaataatatttatgtatatttattattattgttcactaattctttattctttaattaattttaatattcaagtattctagtttaaaaagtatattgatattttaacatgtaagatttaacttttgtaaaaagcacatttttttcttgcctttgttattttaaaaattactcat

SEQ ID NO: 14081 - DNA, 1435 bp, Heterodera glycines
tcctggtctggatacaaaacgcctgaatttgaagatgctggctttattttaaattcaatcatcggtgtgtttttttttgataaacttatatttcagtttcaactttgttaatccaatgaatggtacgcacactcaaacagtggaaagaatgtggggaagtgcaaaatggcgaaataacaagcaaagaggcaccgcgcgtcatcatttggagagctattttgccgaattcatgtagagaaggatgatcggtgacggagatgtattcgaagaattgatatgagcctgttcgaagtattggcctctcgagtgattctttaatgtgtctaataaataatttattcttttcgtgccatacataatcactttataaaaattgaagcgattttgtgtataaaatgtgaattttgtaaaaaatggattttgaattttttgttcgaatctggtttcggggctcgaatgggttaaaaccgatgccaaaatcggtttccctgactctgaaaatccctaaaaacaagtttttatcaaaaatttttttgaaatctggatccagataaccgtaaagtaccaaattttaattctttaaaaatattactataatttcttacattaataattattattaatatcttaagattttacagtatgctgcaaatcgcaacagtggtaaaggtactgcaaaagaattgtttattctcaagaaattataattcacttttaaatttcactgatttatgcccaaaatactgaatacatttatatttgcacattaaaaaaatcgtttgttaaattatttattttcatattcacacgtgattcgctgctatctggtctgaaccagggaaactatacatttttttgatgattggactgacaattataatcaacaatatgagttttatgaacgtgagttgatattaggaaataaaagataaaattattttccaatataataccgaaaaagtaaaataaataaaaaataatgtatacaagtatgtattttaataaaataaaaaataaaacatataatttttaatgatcaaaacgataattatttcctaataaattaaaatggttacaagcaggaaataaaattttcgatatttttttcctactaatgggcgctttaaaaatagaatttttgacatttcaaagcatgaaattgataaaaataaaagctaaaacaatgtttaaataaaaaatgaatgtttattgtaatgttttgtaaactattaattatttgataattaatataaattttaaaaataactataaaaaactaaatataactatttcgttagtgaagagcagagtaattgatttgcgatcgaagctgttcgtcgtaaagtaataattaataacaattaaaaaaattatttcgaatgttctatcatgataaataaagaaattcaaaattaaatcttattttttaacttga

SEQ ID NO: 14082 - DNA, 2169 bp, Heterodera glycines
ttcgtataaaacgcgcatcttttatttccaagttttcaattttttgttgctaaatgcttaaataaatttcattttttaaaaaaaagttaccgtttcttgaattttttccaaatcaatattcgatatttgactttgtaataataggactccaactttttcaaaacaagttacatttgaaattttcccagtgccatccgataattgcattttaaataatattttttggtgtgtcgatgcatcacaataacagccattaaaaacactcctaccacattcccagcatcccttaatttttaatccattataattttaaaaaatccacaccttatatgtttgcatttttaaatcagatatatttgcatgcacagtgaaataatcactatctccttcattaaaagttttagcacacaatcctttaattgttgaaatgttggtcatgtttcctttaagcagacttttgtatacgataaatcccgaagtcatttttaaatagcttaaaatgttaaattaaatttattttttaaagtatttaaccgatcgaaaacaaaaattaaaattaaatgagtttaaataataaaatttatttgcttgccaatagggtttttatattttttagaacattttatgaaccgcaaagccatcccaagaaaaaaaaacacaagcaaactaaaaaagatgattaatataattattcctaaaacatgctctttaaatcggtcattccagaattcatagtcataacacattttatctttaaaaaaattaaaattaataaaattaaaatattgtacaacgaaaaacgttatttaagaaaatttaaaaaaggtttcaagttttattcaccaaaatccatagggaataatatcaaaattttcgtcgattattccttttttttgaacgggtttgtattctttcgtcattttttgggataatattttactgtctcgcgatggtccaaatttatcataattgaaatattttctcttttcgtctttataatttaaaatcattcctttaaagtcctcgtggtcgaagttattttttttgttaaaggttatccctaaatcattaattagtacatttttgattgtgataattacctctcattttagttttataccaaatttttccgtcaatttcattttcaaattttattgagtattgcttactaccaccagaaacgaattcgagaattttatttccattgttttcatgagacatttcgcttaaattaaaacaattaatgatttaaaaaactgtataccctaagtattctccaaaagcgatggggtttttacccttttggtgtttgtatattacactatctaaaacaaaaaaatagtattttcctattcattaatagtacctgtatctgagtataataaatgattatctttatccgatttaacagtttggagccatttatacaaaattattctcgcctgacttgtggtcctaggaaaacgtcataattaaatttttaaagaatgttataccatagtgcgattattatatttgacacgctgtgcggcctaacaaattcgttttgttctctgtatataacgcgtattgcgtcattattaagaattactggtttagataagacaattttatggtcaaataaaagttcaaaatactctgaaggttggcttattattttgtttttcgacaacttatttcgcattctaaaaacttttttgattttaactcaatatttaaacaaacccaaatttgccccaaagtgaattaagtaagagttttgcaatgtatctcataccggcgttcggtttaatgttgttctggtctaattttatgttaaaaattcgtttatattcggaaataaaatgttgtttttcttcatcattagtaagattagggggccatcccgatgagtcaacctatattaataaaattagacaaatttttccatattcatactttgagcttaagaaatttccgaacatatcttttaaatagatcagaatcaaattcttcgaaatgatatgccctaaatcgaaatgttaaatttgtttttaatattccttacctatagaatttatcgattttatatcccaattccatagcttgaaaataaaaattattacaattacatacatttactaacctaattttaattcattgctttgaaaaacccccatgaagccctct

SEQ ID NO: 14083 - DNA, 2165 bp, Heterodera glycines
  misc_feature (72)..(72): n is a, c, g, or t
attattaagtgattactgggtttagataagacgatttcattttgagataaaagttcaaaatactctgaaggntggcttattattttgttttcgacaacttatttcgcattctaaaaattttttaattttaactctaaatttaaacaaacccaaatttgccccaaagtgaattaagtaagagttttgcaatgtatctcataccggcgttcggtttaatgttgttctggtctaattttatgttaaaaattcgtttatattcggaaataaaatgttgtttctcttcatcattagtaagattagggggccatcccgatgattctacctatattaataaaattagccaaatttttccgtattcatacttttagcttaagaaatttccgaacatatcctttaaatagatcagaatcaaattcttcgaaatgatatgccctaaatagaactgttaaatttgtttttaatattccttacctatagaatttatcaattttatatcctaattccatagcttgaaaataaaaattattaaaattacatacatttactaacctaattttaattcaatgcttgtaaaaaccccatgaagccctctttcagaatcagaatgattacattttttaacatttttcataaaaacaaagttagatttcgcccgttggcaacatttggaacaattggtgaagaataaaatggaatcataatggtacggtaatagcggtattgccaatttttttggaggaattgccctaacttttaacagtcctataaaatatttatatttttgtatacggttacggttaccatcataagggatgtcttcgggacattgccacagaacgtcttgagattttggtattattatttttggtgtcttaaccgggtacggtgtgaaataattaacctagaattaaaatttttaagagagtttaagctatattaccgatggatataatgagactatgtcggctatatttatttctctgttttcagaaatctttgaatataaacaaaatgcttgcgttcgcccacccgcaaaagcatcccgggggtcgattggtcataaatatttgttaaattgctttttgttttgactaccccacccttatctggaattgaatcgaaatatttcttcatttctatgtcataattttctttatcacgtggatttagctttcgtcggacctcacattcctaaaaaatattaatcgagaaatcattaacttgtactgacccatatttcctccacccgtattccaaaattattacataattttctaagcataaacattcggttttttgtccttacaaaattttcttctgcagttttaccattgagcccaatttgaaaaggtttgaaacattttttacatccttaatatcatatttacaaagattttgatataacaaaccgtgaaaaacacatccctaaaattatcatttttttagttaacatatatttataacctgaaattcgattatggttttgaatttcccgcaaataaaatcaactttgaagtcttaattttaaaattaatgaatgattttcattactaagacctcctattttaatctcgcccccgttagctgcgtgtctccctttaacacaatgtttatgcatataatattcaaaatattttattgctatcatgctttggttattttgtttttcaaagcccccctcagggactatagctaggtgtttttcctttaaaaatttggctctgtaaatttttatcgccgctcctgcgattgtcgtactgtccttaatttggcataaatggtaactcaaaatgtaaattaccttaaaaacatcataaccgttaggggtttccgagtcttttgttatttcaataaaaatttttcgcatactcagtatcgattttaataaaatttctgtatcctgtccacaataaatttgtaattgttcctcctctaaattaaaatttttttaaaaggtcgctcatttttatagtacctaacaaaaagggttttttttttgtttttttggtaccattctttgaatttttcaaattcgtcatctttcatgctttcaggacaataatcatccatagggggaagggtcgggagtaatttacctaaataaattgtatcaaaattataatcacaaaatttaccgtaatttctttctgaatccgtattatgag

SEQ ID NO: 14084 - DNA, 1354 bp, Heterodera glycines
ttcctgtttgagttcatactttttattttcagaacattgtgctcagtccgaccatctccaagcagttgatcttcagcgccggtcggctcgcttttggccaatccatcgacgtcatttgcagcaaaaacaaattctcttacactgtggtcagtcagtctgtcgctgatccttgctctgatcagtctgatcatttgcttaaggtcagctcaaaggttttctgcgaagcttccaatggaccggtcacctgttttgcctttctccagccataaattgttgctaattgggcagttaattagctttgggcaaccaatcaatcgatagttttcccttttcgctgccttatttttaagtgtctttagcagagtcctttccgttctccctcctgtgataaatgtaaaaatggtcgagaattgttaccaaagttttacggtttgaattctcatcaattttatgcctaatcatactttgtcctttttgttttgatcacttttggtcattttttcgtttttttattttatttatttttttgtcattttatttttctttccttttttatattatttataaaataaacaaaaaaatgtcttctctctttcattttctccttctccgtcccgcacaatttttcgtcgtgcaccaaaagaaccatccgtgttgtgtcttcagttgggaagggaattaaaagcattgatcagcttagggagaagcagcgatcgctattttgttatcattcgatcaaggtgcttactgactgatcactgcattggtcctaatttattagcttatcccattatttgccactacatggttggttgatcccttagtagtccattgatccgcctgatcactcattgcaccacttatcacctgcatcggcacgttgcgcatcccctggcggccgcttgagtccacgtacatttggttgtgcggcgacgcatccgcccaattctcacgtcgccacgggttaagaccccattggtagtttgaggggggcacatatgccggttcgggggcggggggattagtggcagcaaattgggcacggataaaagccaacagagagaggaaaagaaggacgaaaagcattctgagagcgaatgaaatcaattgacaatttggaacaaatgaacgaacaaaacgaaattcaaaaattaaaggaacagcgatcatcaaatggatgagaaaagtgatcagaaggagcagtgattgggatgagtggaatggaggaggagatatgcgacatttatgtggcaaatatgcaataaatcagctgctttttcgggcaacaaatgccgatggaacatgttttaatgcaccaagccgaaaaaataatgtcggagtgaagtggacagcc

SEQ ID NO: 14085 - DNA, 1910 bp, Heterodera glycines
  misc_feature (76)..(76): n is a, c, g, or t
  misc_feature (91)..(91): n is a, c, g, or t
ttcagctgcatgtaatcagggtggaagctatgtttcagcgtgaccagctcgtcccatttgcccatcagatggacanaggcactttcggctntctgcgcatttttggtgactccgtcccaaatgccttaaggggaaatgaatgaatggccaatcatttggcaaattgccaatccctttttcttctcccggtcttccgctgtcttctcacctcttcaatagttcgcagtatctttctcgctgcgttctgatcacttcgtgtgcctccaatgggtccgcctgggggcagaaaaggatcatcgcctgcagcgttagcatcaccgtccgatcggtgcgccactgctcgtcgaatgttagcagaaatcagaaagtacaatactgaattagttcgattcgtaaactcattttatgccttttgtgctcctgatagtgccgttccgtggctggcaatacgttcaaattgagcatgaacggtaacggcccgcccgagccgctgccgacgagcattgcgtggcgccacacttcgttgaccgggtcgaaagccatggcaccacgaagtatcagcagttggacgagtccggcacggagcaaagtgatctgatcggactgtggcagagcacggaaggtgcccaactgtttgcacatggccaccatccgtcgcatggccaattcgcagacgcgcaacgcgtctatgagggttctgctgatgggacaaaatttaatacaaaaataatagatttaaagttgattttgagttagtaaagcttctttatcaaataatgccaaggtttttttgcactataaagtgattgtgattgctcacagattgaagggaatcgtttgttggtttggcacgcgaaggggcgcatccaaaacgtcgttggcacggaccaattccttggaaatgatcagaaaaaaaacgtaagagccaaacattgagaagggtttgctgcgcatcttcgacgagaggacaatcggcaaaagtttgggaggaaaagccaaaaacggcggcggaaggacggcactctgagaagggcacaaattaatttgtcaagtcaacatttgtttaggggtgggaaaattaggcaatttggccgttttggtcgtccccactcttcaatcttttcttgtccccttttatggcaccttttgccacttttggcatttccttctccgtctgtgtgcctttctcctccgtttgttttcccttccaacttttacacttgcaacaattccctttcccttctcttccttttttcttcccattgactttctcttcaatgtttctttctcttccattttcaatttccgtcgtcttttttctcattttcttccacacatccaccaactcttggcgcattccgttctgaatgtaaaaaatggcactttaaatccggtgatgctaaggttaaattgtgcccgattgattgcccattgcttttccctttctccttttgtccgcttcgcttttctttggcctttccgcttttccgcttacccttacgcatttggccaagcggcacgcctggcacgccctccgggatgcttttgtgattcgacaatggccattaaaagggcattcgagagactgcgaacggacggagcagcggcggaagaacgccttgcacgactcgcagctgagacagccgaagttaacgccacagccggcggaatcaccgcaaatctaagcgaaaggcaatggagaaaaaggaaaagcggacaaatgagaacagccgatcggaaagtaagcaaaatgatagagggctaaacagattgatcaccgatacatttcaatttgaaaaggcccaataaaaaaattaacaacagagggaagggtagggatggattctgctgaatgatcagcgattgctttggttcgggctttttttcctttggtggcaccttgcagcagt

SEQ ID NO: 14086 - DNA, 1026 bp, Heterodera glycines
  misc_feature (962)..(962): n is a, c, g, or t
  misc_feature (988)..(988): n is a, c, g, or t
tcactaaaatacaccattaagaattagaaaattttataaccacgttcttccccaaaattttttttcttgacaaaattttttttgttttaaaaaatgttaatatttgctaatttgtaagaattttataaaggaatgtacctcattggcaactgcattagtgaaaaaaaattatttttgctcaattttttgctgaaaattatgtgatttaaatgttttgcacaatttcaagaaatttaaaaaaatatatcggaattttttgagagaaaatcacccaaatccatgaaattataagtcattagtttaaataggcaaaaatagagggcaatagtaatctgatttcaagcctcttagatcatttttcagccctgggttgacggagcattaattagttttgcataatttgatataaccatgaacaattaggactctattaaaactctaattgtaagctaaccataccatcataatttaaagtaaaaaatttttgaaactttttttccctttttcttcaagctccctatttccccacggtcccgagctgctcaactcataagtgacgtgaacattgtgatttttgaacttttttgacattttggctacggaaattttaattattttaaaataaaatataaatatatttattaaaacaatcaataacgtaaaatagatggccaattgttataagaaaactataatgaaaaaagatgtgactaaaatattattgtgaatcaatattcataactatttataaaaaaattatagaaaaaaaagaaagaaatattgtataaggagaaggaaaagaaaaagagtatttttatagagagcaatatgcatatgtatgtgtatattcatgcattaacatattcataggcttctacgcatttaaaatgcatatgcataaatttttcattgctaaggcctaattcacgtcagcataatgcccatgccacataatccacgtncattaatgtcaaacaatgaatgatgnactgcataaatagggcctgggccccagcaaaaattatc

SEQ ID NO: 14087 - DNA, 3935 bp, Heterodera glycines
  misc_feature (36)..(36): n is a, c, g, or t
  misc_feature (48)..(49): n is a, c, g, or t
ttaaatgactcaaaaataaaaaaaattctaagaaanagttggatgctnncaataggcagattcattaggcacttattaccaattatgtaggatcattaaaggcattttccttggctgaattatccctttttatccaatttatttatttatgaaaatttccttattttttgagaaaatgatggaacgcttctccgcttcatttttttgctgcttatttctcccactttttctctcaacatttgaacttggcactgctgtgacaagtaaatattaattgaatgaaagaatgaaatgtacatcaaattgaacaaattgataagtgaaactaaactaatatatgagcaaattaaatctgacactaatcctgtggataaaaaaaagaagataggggaaatttgtaaaataacacaagcattttgcaccgatgtaaatgacgataattgcttatattcaccaaacattttaaaaaatgtgaaagaaatcgaaacaagcattatcatgctgaaaagcaataacaccaaagtgtttaaagattgtaaggaccttcaaaaacttattgaagtcattgagaaacaaaatgggtctaaagactaaacaaacggttagtcatcaataattttaaaatttattcaattcttaaaaattgatgaatacccgaatttagaaacaacaacaaaaggacttgaagaacagaaaatctgtgatgtgtggacgtacagttttattgtagaagattgtttctttcatttctgtctctttttctttcctcttttattggctttcatatttttaaatgttatttttcgcttattttttgggagtagaaaaacgtaaattttgttgcattcatttatctaattagtatgactctcatttaaaaatactttggtagccaaacgagttagaattattataataaaattatcattggaattaaattaattatatgtaagaaaaaaagagagagagaaattgcgacacatatgagaaaattaccgtaaaaaaaattaaagtataattttgcattttgttaaaaatatataaattaatttttattttctgagttggattaatcctttctgctaatatttacttagtttaaaatttccgaatccaaaaaatgttttaaacattttaaagaaattgttttattggggtgtaaaacaagtctttgcatagtgcccaaaaaatacatgttaaaattcataacaattcaagtaataaaataaacttaatcaaactttgccagattattcccttatattagccccagctttacgctctttgagtagtgttttcactttgacttcaaaaaattatggtcccgtaaattggccgaggtcttgcaaaaaccactcacatttcaggaggcattgctcagcccctatttttttatttgaataacaaatattttttagaagaataatttagggcgaaaagaaatttcataagtaatttttttcattttttattggacgctgttttctaaattggccccagagagatttttgagaaagggggctttttcagaatttctttcctattgtttcaaaaattttcaaaaattcggtgtatgtaaagcttaagtctgatcataacaataacatgaaattttgggaatcggtctcctattgaaaaagttatgccacccaaacactttttggagcttgctgaatcaacaatttatgatgctcgtggaaattttgaatgggccatgagataaataacaaatagcccttacaaaatatacataattggttttttaatttggctgagtctcggaaagaaaattcattaaaaaatttcgaaaaaattgcattattggaggttgaatttaaaaaatcataaaagttcacaaactcaaaataaaaatcataaataatgcttattaaaaagcccatagttttctccttagaataacatatccaaattaataataatttgtttgaccgatttttaaaaaatccataaacaaatcaattcacagctatgcaaagacttattttacaccccaataactcacggaattgaatctaataatcgtttggttgttttgatgtggtggtgacactttatctgctctaaattttaattttcctcaattgccataaataggcttctgagtctgtcttggtcttgtcaatcgtgctttatccggggtacaaaatcaacacttatttgctcaatcgagaccaaggtttttttatctaacgttgggattggtaattaatttaggtcgggatgattattctaaatcaggacccatcaataatatggctggctacacgacatttggggatttgtaactttggggcctcgacttttggtgatcccgacatttggggacctgacacttagggattcctacattttggccacgacttttggggacccgttgaatgaaaaacaaaaaattttttcaacatttggatattcaggcccaaaacaaggcaaaattacatctgcttttgcccacacaattctaaaaaacgagagatgaaaccaataaatagaaagtcagaaaaaatgacatttactttcctattttcttgtgcatttattgttgatgggtataaattgggtttaaatgttaggcaaattttattttttatttttttttaattagtataattaaagaaaaattttctcaacagttaaaatatatatattattcctgttttgtgattttttgacgcattttgagaatttggttgaattaaaaaatttaaaagaataataaaaataatttttaatttaaagcttctagacccatcgaaatttataatacgaatttttacaatttaaatgttttctacctattaccaagatacaatttttgtacctatttcggcatttttttttatcattttttatgattttcagaacattataagttaataaatattaattatttggtttagagcttccaggtactaatttataaaacctattttaacaattattctggtgcccaaagttcatgtcgccccgggcgaaaacgtaccccacgcaaaatggtcactcgaaaacgagacagaccccgaccatattttttcggttttttgacaatctgtcaaacaaatttttaaatgataaaaaaaagagaaaaaattggacagatcccatgttctccaacaatagcacactaaaaagcatatcacatagcaacaactcttcttctgctgctgcaccttcaaaagttggccaaattaagcattttcaattttgtcctcaatcatttgttgaagatttgccaaatcctcaaccacttggtaattgtgcatttttagctctgtgatgttttgttcaatttgtttgatgccgttctcaatgttatcggttttgatgtcaaattctcccaaaatttctcgaaaaatattgcaaaaattttttgtttttgcaaaaatttcttgcaaaatttgtttttttaatgccaccggattatcatttgttgctggtcgaacatcttttaggtttttgattttgcttttcaattcttcaagattttccaacacattggttaattttggattggtgccaagattagagttttctccaatcacttctttaagctttgcaaaatcttcaaacaatttgggatcattgcttttcagttttggaatgctttcttcgatcactttcagttgatcaaaaatttcgtaaacagaaaatatgtttttgttgtcttttatactgttttgtacgtatgtgcaatattcttgagttttttggcaaatttcgtctaagttagcctttttagcctcagggtttgtttgtgcgtcaatttcaccaaaaagttctttgcttcctttctctaagactttcaatttgaacaaaagttgatccgataatttgatatttttagcagcattgcaaagttcaaatgtgagagaaaaagtgggagaaataagcagcaaaaaaatgaagcggagaag

SEQ ID NO: 14088 - DNA, 1727 bp, Heterodera glycines
tgtgtaaagccacgctttcttgtggagcagggcgaattccaactgagctcagcaatggaagcgactaaagctgtttatcggcatttattcttatggggaaatggaaacagattaaaaacagaggtaaaattattttaaaaatttggtaaaaaaaaatttatttacggttaaatttgataaggacattctcgtgttgcttttgcatttggtcgtcatttttgttgccatttgcagccccaaaataacaatttccttaaaagctatattttatcgcatttttatttgaaattaaaaaaaacccaccataatcatagacaaactcggcatttttagcgcaatgctccagtttacaaaaagcttaaaaacaaaaggattaagaaatattttcacttttttggtttatatggaagaattattcaattaaatatgtttgcctcagatggcaaactaaaagaatcaatgaatttttcattatttttatggggaatcagggctgtatctaaggccgaaaaaagcccatatcccgattacctttgtggcacacaactgaattgacctcctaaatttaaaagtttactaggtaaaattatttatgaaaaatagctataaaaatgccataaaaattattaatttattgtattaatttattttatttttatctttgttttctgctatgacatttggcttaaagatgatatttatctgcttattctgatgacactggtaatcacagaaaaggccattaccacaattattcatttctcatttaacattctctgctgcagtttgggagaaaattcatttacataatttggtgcaaaaatgacataatgcaagagaacattgaaggaattttgaaaaataatattaaaaataaagacaaaaatgtttttaaataataaaaataaggacaattaaaaggtttaaagagtttaagcctcggcagcccatgcgggtgtcaagaatctcggagattgcgaatttcggggatggaatcagattagcggtcgaacccgtcaattttcttagggaaccgaccgagccaaatatgatgtacccacaatttgttagtaaatttattttttaggcagttcatcgaaaattaattttaaaaaattaattcaaattaaatttttcgaataaaaaaaataattttaaattttaaattgatcaaagggcggcttcactaataaagcttcattaactctcattatccatctcaacaaataccttttctcccttttgatcaatgcaatgagcgatcaattaacaaagtcatcacaaaaatgggattccttttaaggagattaattccatcttaatgtgatctagtttttttccattcattcatttctgttttttgttcactcatttatttgtttttgttcacaacacttggtcggagtccttactccccagtgtgttctttcattcatttctgttgatttttcactatttaaatttttttatattcgtttgttcatttctgttaacacttggtcggagtccttactccccagtgctttcatttttctattttttgttcactcatttattttttttgttcacaccacttggtcggagtccttactccccagtggtgtgtttcaataaattttttaataaaatttctcaaatttttacagcacaattatatactgttagttagataggtaggtcttgcacaaaagggccacctcaacgtggtgtgcaagtctagtacccaa

SEQ ID NO: 14089 - DNA, 864 bp, Heterodera glycines
acaacaataacaccaaaacaccaattgttgttgttgttggagaagctaacggcccgtagggaaaaagcattctctgttgttcattatacttaaaaaaataagagaaaaaattttaaattttagcataaagaaaataatgtctaccccctattcccttcctaaaatacctaaaaaaagtctacaaatgaacggatgcatgtatcgcctcttgacaaagtgccaaaaccacaaatgccaccaccagcaccaaaaaaatcaatttggagagttgagcaaaatcctcaacgcccgccttcacctcctccgcaaatgactccaagaagtgatgagcgtcagcaatttttgttgaatgaaggcccaaatattacaacgccgccaaatacatattgtaaaacaaaaaatatgtacagatgcttcaactgcttatttttgtatctaaaggtcatgcgtggcgtagtgtgtcttccgcacatatgcagtcgattgaagggaatgagcatttatcatactggatacaaacgaacccgccgcaatcaacatcatatgattatggaacacacgatgatgtttctactgccgaaatagatttggaacagcaacaaccatgtgaaaaaataagcgtactgcgacatttgcggatattcccgacatttgaggacatacacaatttcaaaaaataaactaaaaccttaatttatattattataaaaaagaaaaggccttttccaagtgccaacgagagtgaaataaatctattcgttaattgaagtatcgttttcacaaccttatgggtagatctgggattttaggtttttataggcaggcagttgcttaatttgaaaagttagataattcaaagattat

SEQ ID NO: 14090 - DNA, 1299 bp, Heterodera glycines
gctcgaggacgctgtgcccttcgagcgacacgccgacctttctcgacagtccagcgtatccaactcgagatcagcctctcacatggacttagccacgagcaacgacggaattggcggtggctgcgtgggaacaagcggaagtgcaagcggaactttggaacgacgccggtcgagaaggtcggccacattggcagacaacgagcgcatccgagtgaccatcaactgcatttaccatatggtggggtgacattttttgctgctgataatgaattttttttcccacgctttgttaaggttgaagcaatccgtcgcgaggatgttttacagatggtcgaggacttttctcagtcggaaatgcctttttcatcaaaacattccccgctgtcgtttcattcattgcatcaacaatttttgactgaacttggtccaaatcgcatttgatttaattcaatcccccttttcagaagaaccaatggaaaacaaagagtctctgttggtccatctctttgaaatgatgccctcttttgtccgcgggaagacgccccatttcccaataaaaaaggtttatctgtttgttttaatttactttttgattgttcagattctgctgctttcatggaaagtgttgcttgcgactctcggcggcaccgattttctccgcaaagaaaaggcgagaaagcgtgccgaggctggcctttcaccagtgacagacaccgttcaagtggccatgaagatgaaacctttgctcagttgcgacggttctgttgggactggcgctttgcttggtctgaactcggcgagtggtggcgatgggaaggccgagacggactcaggaagtaaaatagtaaaaacataaagaagacaatactaaaacaattatattttataactagcaattaccggacaacttgggcgtaaggtccgctccattcaccacccaatccgtccgttcaatcgccaagttgcctgctcctccaattccgaacaaagttcctttcctttaagtcagccttttgatttgttttcaattagctacagcacacgatgaacccaaccgtcgcgaagaaagcaataaaacctttccggttgacaaaaaaggcgaaggaggagaagcattcggaggaatgtcagaagaaaccaaacaaattgcggaggaagtcgacgaggcgatcgttggaggacggaatcaggaaaatgaggtcagaccgtaaagaggagaccttttggcgaggggaggaggggggggggggggttctcaagctcataattttgggattgtaatgttcgactttcactact

SEQ ID NO: 14091 - DNA, 1083 bp, Heterodera glycines
cagacatgaatctttttgcagcccaacggtaaatagacaaattaaaaatatatttgtatgtcttaatttttagcaaaaaacacttccatttccaattgccccccggcgattccaccaccgtttttgctttgcccgagcccattgtcaggggcagtttgcccgcgttgcgtcgcaatctttatgttccgctcaccgagcttcaggttgaattatcgggaattttcttaccctttttgaatgtttcacttccagctcgaatctgaagaccgatataaccgatttccattctcgcaaaaggaattcattgaagattgtccggcagaacgactttacgtccgaatccttcccgaaatgactgaatatgtaattgccctgctcaaagtcattctcgcttcgttgccttcctccaaagttctttttgctaattttttgcattgaattcttagacattctaaaatatactcatttaaggcgaaaatcgatgctgtcacaattctatccgatgtgctgacacccgaaactgacacaaatgagtaaataaagagccatttattcccttttgggacccttactccgattccctaattatttagagtcctttctaattcgatcagtttggaccttgccagtttttcacacacaaatgtattggaagaaactgtccgagtcgcaattgacataaatcgacacaaagaagttgggcttggtttagtaaattttgattattcatgcactctcttcagctgatcatcaaatcggcttcgtcccttctcattcttttgctgaaacacttacgtttgaaccacacactccaatttgaaaacttggcccgttatctcgtcttggccaattgtcttccgctggtgcttaagtttcttgaccagaatatttgtcgatacttccaagcaaagcacgagttggccccgttcaactatcctcagtgtgcactgttttttgtgaggaatggatgtgagtgggtgagaagagggcaggcaccaataaataaataaatgaccaagtgatgtccaacccgaaacacgcccaatcattcggcagtggcagttacgaggggggggggggggg

SEQ ID NO: 14092 - DNA, 1447 bp, Heterodera glycines
ttattagctgcaatttctgttttatcatatttggttagaattccgaaacgggtcagggtaccacagaatggctacatggttttatgaaaaatgttctataacagaataattttcctgactctgacaattgtaatgtcttcagatgaatggcctcaattaactgcggaaaatgtcgacggttgcggtggttccagcgactcgccttcgtattttctgtggcgcaatgtcttttcctccatcaatttgcttcgtgtgattaacaaactcacaaagggaaaacagtcgcgtacccaaatgttggtcgtttacaagtcggcgcccgtgttgaagcgatgtatgcgggcgaagctggtaagaaaagcggtcaatggccatgaactgagacgcatggattaatgacgtgggtggggggactttaccggtgctctttattcgagtaaaatataatgttacttttttacacttcatagggaatcttccaactgtacgtgttgaagctgctgaagatgcaagcccgctatttgggtcgacagtggcgcaagacgaacatggatttgatttcgggcatttacttacgcgtccgtcatcggcttaacgacgactgggccttcgccaatgaagtgatgcgaacgaaatctattgactcgcagcaagaagagaacgaattgggcctggccatcagacggtttaacgcacggcgttatccgtacatttacagagacggaggtgggcagacagagacttacagtggtaaaagtgaagcatactgactgacatccacgaattatattcaattgacatttattactctgtaataaatgaatccgaaaaattttttgtggcaatcactctgaaacgagttattagatagaccctttcgaacgttgtttttcattttcccttccggtagagaaattttttagctaacaaataagggaaaatttcacaatacgcaattttcagaatcccatgttggagtggcaagggaaggcgaagaacaacatcagcagcatgagagagtgttttcttcagtgactgacgcggtcaaattgggttttgtggacgaatgggagcctaaggaatgggagccgactgacaatgtgtggttcagtttagctggctaacatttgtggtcactttcattcatttctctttgagtctcttcaatccgcgttggcctgggaaccgcaattcagcgaacggttcacacaaaactacgagcaatggttggaggaagaagtgtacggtcagcagacggattgggactcactgctgcgcaactccaggggactgttggacatttactgctgattcgatagaacagatgatggttgagtctttttaacaattccacaaaataaattattgttttctgtattatttttagtttttttttaataaaaacacaatgaattcaagaggagcaaattcctgtttttgcgattat

SEQ ID NO: 14093 - DNA, 4866 bp, Heterodera glycines
  misc_feature (749)..(749): n is a, c, g, or t
  misc_feature (4641)..(4641): n is a, c, g, or t
  misc_feature (4713)..(4713): n is a, c, g, or t
  misc_feature (4780)..(4781): n is a, c, g, or t
  misc_feature (4789)..(4789): n is a, c, g, or t
  misc_feature (4791)..(4791): n is a, c, g, or t
  misc_feature (4796)..(4796): n is a, c, g, or t
  misc_feature (4798)..(4798): n is a, c, g, or t
  misc_feature (4806)..(4806): n is a, c, g, or t
tttttccaatatttaattggtgtttcagacggtaaatcaagtggtcatctctgactatgctcaaatggaccgtgcgctgaaggaagaacgaaattacattttggagctgtgcaagcaaatcaaaaaggccgggtgcaatgtgttgctcatccaaaagtccattttacggtaagcggtgacgaactgtttgactcgttttccgacatggtttcctttttaacgtgatcctctttagcgatgccatcaacgaaatggcgctgcactttttcgcaaaaatgaaaattatggtgatcaaagacatcgagcgggatgacatcgaattctatgccaaaatcctcgggtgtcgcccggtggcatccgttgaccattttgtgccggaatcgctcggaacggccgatttggtggaggaaattgagacggctgatgggaaagtcctcaaagtcagtggagttttactctctcctttttggctattttgtaaccattttcaggtgaccggccttaaacagagtgggtgcgctgtgtccattttggttcgcggctccagcaaattggtgttggacgaagccgagcgctctctgcacgacgcattgtgcgtcattcgctgtttggtgaagaaacgcgcccttctttccggtaaaaaaaaaactttgttccagtttcgaccatcacttgtgcttctctcccacaggcggcggtgcccccgaaatggaagtgtccgtccgcgtccgcgcagctgctcagacaanacacggagccgaacagtattgctggaaggcatttgcggacgcactcgaagtggtgccatacactttggcagaaaacgctggactgtcgcccattgaaacagtgacggagatgcgcagtcagcacgcaatgggaaacaaagagcacggagtgaatgtgcgaatggtgagcaagcggaatgggagaaggggcggacaccccacaccttttcagtttatttattaatgaactgtctgttgcccaaattatggttttctcattattatgacatgtttgagtcctttcagggtgcaattacggacattcgcgaagaaaatgtggtgcagcctcttttggtcagttcgttcgccgtcaaacaggcagccgaatgtgtgcgcagcattctcaaaatcgacgacattgtgagtcttacccaggccatgtctcccattcattctctttccaattttaggttctgtcagtgcgttaaatgtgacggagaaaggcaataagaaattgttatgcaaccatttaataatgttatgacgttcattgcgtaaatcgctttttacttttaaatatttgtccaacaaaagtttaaacaaaatgatttgttatatttttttctttaatacaaaagtgcattttaaacgatgatacagcagacactgctcaaaatacaatgaaaactgctcttgagttggcaaaaaaaattgtttgtggtgtatttattgcacacgtttttcgccaaaaagttggccgaattcttacgggagtaggtccgccgaatatttaaaaattattttggtttttgaatttaaggtgattccatgctgccgactatccacgatggcgacattctatgggctcgagtttgggatccgaacgatgctttacgaccgggggacgtcgtgtgtttagttgaccctctcgatgcagaagagtaagggaacaattctataatattccgttcgtgcctcgaaatccatcctttccataggtatgtcataaaacgcatttccgctgtccacaaagactgcatagaagttcgcggcgacaatgcgaaaaagtcgttggactcgcgcaaatatggccccgtgccggctggacttgtccgctaccgcgtgtctttgcgactcctccccttaaatcgttgaacattgcgaaaaccaaagtgatcaaaagctaaccaaaaacactaattgactcggtcgctttgcctaattatttgctgtccccaaaaggccttcggttggctccgttcgctgtgtctgccgccgttccgcccgtcgaccctcccccaaattacgagtccgcccttctgctcagttcacctcacccataatgctcaattttcatctgattattgcatttaattttctctttttgcgctggtgaaataaaagtgaatcaaaatcagacaaatgggacaacatttggtcaatgaattgacaggaatacgaaaaccttcgagtgttcgtccctccgcctcattattttattttttttatgtgctaatagtattttaggttttactcacaaatccttcccccccccctctccttttttccgctgtttcttttatttattgtgtaattaattaattcgttgcttaattattccgcttttgttcgtgttccttcctctctttctctctctgatcaaatcacgtttgctccgttctcatttctcccccttttttatcgccgctttttgcccagccacgcgttcttcagcagtgcgttcagttcgctttcgctgaccacccttttcacgtatttgtcgccgccgcttccctctttaagttccgtcgtgcgcattagccaacgacgctgagggcgcggaattcgccgcttaaacttcgaaatggcaattaaaatggaataataataattaatgccctcttcgtttgtcccaacactcacttcgtcccattctttcgcttctcccattgccatttgtttgtgcgcaaatcgatcctttgcctccgacgacaatcgttcaaaaagcaatcggtgggaagcgtcgagtgaattggcaggcgaacggaccaattgaacagcgggtaaaggcggcaattgtttgtcattgtcagcaaatccattaaggtcctaattgtttaaatgggcaaaaaaaataattaaattgtaaaaaatgtgcgctcagaaatgacaaaggtccacatggattagttcgaatggaaactgcgtacgttcactcgtttatctcatcacagcgcacgacaataaattaacgaaaatattcaacaaagcaaaggaattgaaccgatccaaagggtagaagtgagaaccaaagtgacaacccactgagccaaacaaacacacgcaagcactcgctctttataaaacaaataccttaaaattctgttgttgctgttggacaacaaagccgttgctgaacattgtcttcatgagcagcgcaaggaacagaataagcatcggaagggacgaaagatgcttaaatggaggggacttttgggctgacggagagaaaagaatttcatttgttggacaaattaagagggaaaacagaaagaaactgcggggaaggagggtttaaatttggcactgaatgccaaaaacgagattctcgataatgactgtactgatttgtgagtttgtcatatgtagacgccaaaaagaaacaattggcgcccaaaaaagtgccatttgcctgaggacacgtcaagcccagtcagtcattaattaactcgcgcaattattatgcgacgtggcctagcgtgattttgacccatcaatcgtccgtctgtcttcacttctcgaaccgagggcggcacttttcgttggcacgacccaaaaacccacaaaatccaattggaaactatttttgtaaatgaagcaatggaatgatgttgagggcccgcctactattaaaattgccttcattttaatgataatattgtgggaatggccaaatgaaagtgaggggagtcaaaaggcgcaaaaacatcaatggaaaatccaaaaattcccaattttccaaaaatggaatgaatgattcatttgctgcaaaatcggcaacattttcccaccatttgttttttgttctgtcattttcagaatttggaagggataacaaaaacagtgaaaaaaacgagcacagaatacaactaccgtattttctctaattatcccccatgggagattatttttcaacctcttcagaaagggggggaggggataattggagaaaatacgataataattacatgaaatattctcaaaacccaaatttgtgccaaaaggaaaagggacaaaaaaagcaattaaaaggcaaaggaagtgaaatatgccaaaggcgactcggtctttgtaagattcggtgccaattcctaaataaaagcgactgctctttccatgcttatttccctcacatcaaaggaaaggataggaaaagcaaagaatggacaatcatcggctgctcacccaccgaaggcacttacgcactattagcattgctttttgtccctctttactactaaaattcgccctttccctccaatggacgccttttcccccgcgtaattcacaaccaattagcgggcaagggaacctccgatggccgaccaacggatgcgcaaattgcgcaattcccgccccctcccccgcccaattgagtcccctggggcatcgcccgcacagacgcttaaggagcaaattggccaacagctgattgaggaagaaaccaagccaatgccaaggaatagctgtttttagatggagaaacaatgctttaggggagggaatttaatttaaatggaatcaaaatatttgaggaacaaatttaaaatagaaatggtgaaaagttgatgggaaatttctacataaaaatagaaatgtccaaaaaggctaaaaatgcattttgagttcttanaaatttatttaaggaggcgtgagatttgttcacaaccaatttaacgtttttgtattcagtggaatttactanagaaaaaaaggaaagcccctttaaccaaatggccacttttattcggagttttagatttttggtattnngccagttnancatcngnattggtanaatatggaattgcaaataatttttattttgataaaaatgagaaaaacattggaaaattta

SEQ ID NO: 14094 - DNA, 2302 bp, Heterodera glycines
ttatactcccgaacaatcaagcttattggtagaaatgtgaagatggcccgtgcatggaatgacacgctttattacccggggatcatcggtctgaataacatcaaagcgaacgactacaccaatgttgtgttccacgtcagtttttttttttgaagagttactttccgacaacattttaggctctttcccatgttccgcccttacgcgattatttccttcgtgagcaaaattacatgcacattaagcgaccgcccggtgacaaattgacactgatgccacaacgttttggtgaattgttgcgcaagttgtggaacccaaaggcgttcaaagcgcacgtgtcgccccatgagatgctgcaagcagttgtgttgtgcagcgacaaaaagtttcaaatcatacgacaaggttttgctacatttgcctgtttcaatcctaaaatataattattcaaaaggcgatgcccatgagtttatgatgttctttctaaatacgcttcacattggcttgaatggcaccggaaagacgaattcgtcaatcgtttataagattttccgtggccgaatgcgtcaatgcatgcgaaaagtgctgcctgtggacgccagcgacgagtcacggcggacattggccgaaacggaggaatacaaaggtggacttttaatgaatgagtggtgggtaagttaatttttgcagaacaaaccaaggaaattcctttcctttcccttgcgatggatttaccaccagcgccgctttatttggacgaacggcttcagaatattatcccgcaagtgccgttgtcgacgctgctcatgaaattcaacggacaaacggagaaagtgggcatttgatttataacaaaaccaaatattgcgataattacccaatcggcgagcaactcttttttaattaaacaattaaatagtttaacatttttaactagttaggacaaattcgaagtaatccaaaaatttccattgatttaaggagtacaaaacgtacaaagacaatttcctaaagaagtttgaactgcttcatctccccgaatatctaatcattacttatgatcgtttccacaagaatcagtggttcatcgaaaagaatcccaccatagtaaattttccgatcaggtgaattttgaactgatatttgtacatttcaaaattggtatttttgcatttgggaggcgtaatgaaactgcttttcagtaatgttgatttatacgagtgtttggcaaccgatgtacgggaaaagcaccgatacaccacttacgatttgatctcaaacattgtgcacgacggtaagccaccgactgcggtgagcaaaggcgacatcgcagttgacaccggacgataccgagtgcagctgatccatgaggtggactttcgtcatttttacaatttcacacaaatgcaaactttgttaggggacaggaaaatggttcgaactcgaggatttgcatgtgaaggaaattctgccgcagacaatcactctcacagagtcatacatccaagttaggagcttttcattcattttttgtcagttaatttcatttcgcagatttggcgattgaataggaataaaacacgcgctgaaagagttggcgaagcgcaagaggaaacatttggcacggtgacgacagaagaaaagcttaaagacgagccgaaaagggaaatcgatggaacagagtcatagaaaagaacgaacaaataaattgtgaattttgtttttgtttttttatttgttaagttgcggcgtccactttgcaatatattttttacatattaatctattctaattgcaaatttagagataaagccagaacagatgtcctctagtttgggtgaacttgaaaattaccggctccagcttcaacaggtaatgggcgtggtcattggtgaaaggcatgaaaacagtgtgtgtctaatttttaactgagcgctcgaagttatacttacaaaggaaggtccccgggtgtccgtgggatttccgaatgaaatttggtgggtggatagagcatgtcatactgttaaattttgctttgaagtgccaaaaaatgacatgtcagaaattaaattgtgaaattttcataagagggaatcgaacctgcgagggcaaaaagggaaggccggagcacaagctccgcaccaccaaacagcacaaaacaatgcaaatatttatttaatttattgcgataaaagaagtttggcacgtcatatctcggcactcagactcatttcgcagaaaataaaaacacttttcttaagaacccatgggtgctgtatccaggcacttaatttaatttgga

SEQ ID NO: 14095 - DNA, 942 bp, Heterodera glycines
caatggcatgaaaagtgatcgggcaaagtcaaacaatggcatgaaaagtgatcgggcaaagtcaaacaatggcatgaaaagtgatcgggcaaagccaaacaatggcatgaaaagtgatcggacaaagccaaacaatggcatgaaaagtgatcgggcaaagtcaaacaatggcatgaaaagtgatcgggcaaagccaaacaatggcatgaaaagtgatcgggcaaagtcaaacaatggcatgaaaagtgatcgggcaaagtcaaactatggcgtgaaaagtgatcgggcaaagtcaaacaatggcatgaaaagtgatcgggcaaagccaaacaatggcatgaaaagtgatcgggcaaagtcaaacaatggcatgaaaagtgatcggacaaagccaaacaatggcatgaaaagtgatcgggcaaagtcaaacaatggcatgaaaagtgatcgggcaaagtcaaactatggcatgaaaagtgatcggacaaagccaaacaatggcatgaaaagtgatcaggcaaagccaaacaatggcacgaaaagtgatcggacaaagccaaacaatggcatgaaaagtgatcggacaaagccaaacaatggcatgaaaagtgatcggacaaagccaaacaatggcatgaaaagtgatcgggcaaagtcaaacaatggcatgaaaagtgatcgggcaaagccaaacaatggcataaaaagtgatcggacaaagccaaacaatggcatgaaaagtgatcggacaaagccaaacaatggcatgaaaagtgatcgggcaaagtcaaacaatggcatgaaaagtgatcgggcaaagtcaaactatggcgtgaaaagtgatcgggcaaagtcaaacaatggcacgaaaagtgatcggacaaagccaaacaatggcatgaaaagtgatcgggcaaagtcaaacaatggcacgaaaagtga

SEQ ID NO: 14096 - DNA, 2952 bp, Heterodera glycines
  misc_feature (2864)..(2864): n is a, c, g, or t
  misc_feature (2916)..(2917): n is a, c, g, or t
cgaaatgtcccagcatcataatgtccaagcgtcataatttggaagattcgaccatgcataccccctaaaattgttgatttttttatgtttgttattttatgtgattatgataaattcttatgaacttcatattctgaagccttagaattatgtaattttaggatttttcgaaaatttttattgggggacatttttactgattttagcttgggggacatttcgacgattggacattatgacgcttggacattatgacgcttggacattatgatgcttggacatttcgacgcttggacattatgacgcttggacattatgatgcttggacatttcgacacttggacattatgacgcttgtacattatgacgcttggacatttaaaaaggcaaatcggtgccgaagtgacaaaaacggttttctattgggcgaagtgacaaaaaggcaaatgtgggcgattagacaaaaaggcaaatgagtggtgatcagaagaggcgggtcatttcagtaccgaataatgattttaattaattaataatataactattttaatctattaattatattgctggccataattataatttcgttattatttaatatttcccaatcaaattacaatattatattctgtctagagagagaaataatatccacatgcatagttgatcaattcgatcaattgcacttttatttattcacaattatatattatattctgtctagagcatttttcatttctttaatattccactattaacttgtctttaataatttattaccgaatttttaattgatttagaatgaaaagtctacttttgaaactttttgttggcctctgcttcattgactttacgtcaaatataaagtcaaaatttgaggactttcttgaaaatcaagaagcaatgaagttgatccaaaattaccaagaaaagcgaatcaaaactattaaagaattacatgctgaactaacaaaaaaagggattaaattggcagaacgtagtttgaggctatatctttgtaaaattaagagtgccaattctgatacatcaaaagaaagtccaaacataccagaaataaaatttgaaaaacaagatagagaggaatatttttggcagacttttactcccaatatggatcattccgtaaaagactaacattaatttttataaaataaaaaaaggctctctattatattaagatggtcgctgatcaagaccgtgaaacgccaaccatttttattttaaactcttcaaatcactttgaagtgatacttgaaccaactcgaatttgaatgctaattataaaatcttatatcgatcacacaatcatgtatttgtaagagtaaactatgcttatgaatattatttctctcttaaaaatgtaatttgattgggaaatattaaataataacgaaattataattatggccagcaatataattaatagattaaaatagttatattattaattaattaaaatattattcggtactgaaatgacccgcctcttctgatcaccactcatttgcctttttgtcacttcgcccacatttgcctttttgtcacttcgcccacatttgcctttttgtcacttcgcccacatttgcctttttgtcacttcgactcaccacgaaaatgacctaattcatcagtgatcaaatgcattttatgaagaaaaacctctcaatttccggtaaataaaaaaattgcataaaaatggcaaaaaatgtactaaaacacacaaatttgagatttgcacaaaataatcgacaaaaattgcgggtaagactatggatggtggtgggcccccttttttcgaatcccgaacccgaattcgaacaaaaagttcaaaattaaattttttgtaagtcatgaaaatacattttcaaaggttttcggggacgctgatcagtgatcacgagtccgtcatccatttcggccaaatccgcggattcaaacaaaaatttaaattttaaaaattcacatttgtaaattgttgagcttttaactatgttttcagcgcttaatatacctaaatggctgtattggaagagtttcaaaattttacattgaaaaaattgcatgaaaaactggctttgaatgacaatgattttgtcgaatggcttgagcatttgggactcgtgcattcgcgtcgctcatgtccttgatgtggtggaaatacttcgattgtagcagttggtggaaattggcgttgcactacaaagaattgtcgggcaaaaacaggttcttggttcgtagtgcgacttttcggaccactattctcgatagaactgtctaaataaagaaaaaaataataagaaattttaataaattcattattccaaattgaattagtgaaggtaagctgatgcaaagcgatctgtctcaattggagagaagtcttatttgtagggcagcaacttttagtgaaaaaactttttttttgctcgattgttttgaagaaaggttctcaaaaaacgcatttctgcgttaaaattttttcatttggacgtcacttttcgtcactagaaatcactattttggcgtttcgtcactaaaatagttaaaaatcactattttggcgtttcgtcactatttcgacattttttgggaaaatttctcaacaaaaatgcaataaaaacggaaaatacatccctaagaatcgacctcaaaattggactataacttttttcttagtcaaccaaatctaacattattggtatcattcgaaagccctaagtattctctattagcctgaaaaatttcgaaaaatcatgttaaggttcaaaaaagttatggccagaagaattcaaaaaaccaagattttcaatcttttttgccataaatttgttcaaaacaatggngaggcgaaaaatcattgccaaaaacggaagggacagaaaaattttggcatannatgaccgattggaagaggaagaaaaggggaacgca

SEQ ID NO: 14097 - DNA, 948 bp, Heterodera glycines
  misc_feature (5)..(5): n is a, c, g, or t
gcttngaaaatcagcagagttgggagccctgtacatacccaaaggggatgcatcgagaaagagagagaaaatttatattttaacggaaaacaacaaatcagagagtaaaaacgagcataaaaatggtcagatcactcttattcatcgccataattcaaaatgatcgacatttctcaaatgcattaaatcaccttcacataattggacaccatttgcgacgtggcgacaaaggcctaaaaattcggcacaattttttaaacaaaatcaaatgcttttttgttgctcacccaatgccagcttcgacgtaataatgaaactcgacagtgctaaatccgtccaaattttgggctgcccattgaaccgccgccgtctcccaatattggcaccgtttcattacccagcggtcttcccaaacatttgcgcttgctttgatcagtgtccgcttttccttggtctgttcgttcgctaattcaaatggcacaatttgcgttgacggttgccaaacagtaaattgaatttggtagctgaccgaagaaatggcattggcacggagaaaatgctaaacaatgggaaaacggacggacattaattaaatgcaatcaaaatcagttggctaacgaaaatatggccacacctttttgagagtgttggcccattccatatttggtggctccttcaaaaagaaatgcaattgcttcggcatgccatcttttctcggactgtgcaaccattttgacaacatttggccagcagaaattgttgcatttggcccatcaaaatcatcatcaccaatcgcctcgggcaacaaatcaccggaatagattgaattcaattggtcgagatcggtgagaattgtcggcgaaagtgccgaagtggctcggatactgtttgaattcatcggcggatcaatggtcgtcaatgatggaactgtttaaagccggtgattat

SEQ ID NO: 14098 - DNA, 1294 bp, Heterodera glycines
tttggaatgttacttctttttattatctatggattttttttttcatgtgcattattttggtgctagtaagatattgtcgaataaattaattggttttttctcttcattttaaaacatttcacgtccccatgccctgcccgcttcccgcggaattgatcaagtaaataattgacgctctcccccctccaaaaacacatcggcttttgcgcgtaaattttgttttggcatactttgttaaatgtcggttttattccatgatgagaagattgtttcgcccagagcatatatcaataccaatggcccgaagaactggaatttatttctttttcgatgttcatactccccctacttattttccactttaccaataataccatttaaataaaattataattttttatttcttatctgattaatttcgatcaatattttttgataattaaacaaattgtatttttcccaaaagaattttctcgcagtagcaacttatcggctttttttttactcccttcataaaatgtctcgcttttgccccctcgcccaaatcaaggaatcgggtcggcttaatacaccaaaggggaaatttagtgagttccaaacctatcaaattaaaaaagaattttgataatcgttttaggtcttttttatgctttggaaattgctcgcaattaccaattgattggaaaggggataacggaaaaaacttttcgttatctcatgaaaacggaaaagaaacaaaggcaattggccatggaattgatggaaaaggcagggataagcacggatgacaaaacttttggcgttcaacagcttgaggctgtacaaaaattttgggactcccaatactcgggcaactttcgcatcgtcgcttttgaaatggtaaccaaattcgctgaaaaaaatatcccgttacttatttttagaagacccgacttaagccaattttcaagggagaaggtgttcgaagaaatgagatttgtgtgataagagatggggaccactgggatggattaaaatcggtgtcctggtttttctgcgtcaaaaatttttgtgttagttgtgaaatgacgtacgatcgacctgaaagacaccgaatggagtgtaaggaaagatgcaagaagtgctgtagaatgggattcgtgttcccatgtgcggatgtgtgcgataagattcactgcgaggagtgcaaccgcaacttctataacaacgaatgttttgaagcgcacaagaaggcggcttgtaacgagtataataaatgtgaaaaatgtggagaagcctaccaaacacgttcgaa

SEQ ID NO: 14099 - DNA, 1701 bp, Heterodera glycines
ttacttatttttagaagacccgggcttaggccatttttcaagggggaaggtgttcgaagaaatgaagtgggtgtgataagagaaggagaccattgggatgggatcaaatcggcttcttggttttttggtgttcgatacttctgtgtcagctgtgaagtgacgtacgatcgacctgaaagacacagaatggagtgtaaggaacgctgcaaaaaatgttgtcggatggggttcgggtttccatgtacggatgtctgcgatgagatttactgtggcgaatgcaatctcaagttttacaacccggaatgttttgaagcgcacaagaaggcggcttgtattgagtacaaaattgtgaaaaatgcggagaagtctaccaaacacgttcgaaacacgtctgcagtgaaaagttttgcaaagtttgcaaagttttccacccaggacggcaatgtttcatcaaaaaaattcaagttcgaccgcagaaagcctacagaattgtggcatatgacctagagacgactgtagatgggggagaacaccggcctaatcttgttagtgcggcactttcttgcagcatttgtgcgggagaagagagggaatgcgagatttgtgaagtccccaggaaaatcacatggtctgtagcggatggttttgagccaatgagcgagtttatcgtttggataatgggttttcaacgatttgaaacgattgctttcgcgcattatgctgggaggttcgattcacactttgtcttgtccgagctaacaaagaaggaaattgcgacggagttgatgatggctgatttgaaaatttatcaaataaaggcgggaagagtgtagtttcgggatttttggatgcttagtcagaataggttggctgaccttccaaaaaccttggggttaaaaactgcagctaaattgtattttccacacaaatacaataagaatgagaattttgggaagagattacccaacctgccacctttggaagactactgcccggacaatatgaaggaggaagaagccgtaaaattggaagcatggtacaatgagaattttcaaacggaatttgaactaggtagggaaaatagcattttttctttgaaaataaaatttaaggggaacaactcaagacgtattgcgaaaacgatgttgaaattttgatggaatcaattttgagttccggcggttatttttggggataacaggagatttggatgtaataaaggacagtgtcacaattgcgggagtcgttatgaagatcttcagggcaaaatttttgaaggacaggcatattccaatcatgccagagggagggtatgagagagcagagaaccagagcaaaattgcggtgaaatattttgagtggcttgaccaaagaaaaggagtaaaagtgcggcatgcgtgtaacggaggagaagtggaatttggtgggctgaaagtggactgtgttattggggccgagaaacaaataattgagtttcaggttaagaaaaatggtattttatcaatattttaatgttaatcattaaggggtgtgcctttcacgggtgtccgagatgttttttaccttggactatagcgccaaacggacggacaatggaagagaaccacaagagaaccgaaattcgtatggaaatgggtgagggaaagtacaaaatttttcaatcggagaagtttgggtagaataaacatttagaatatttat

SEQ ID NO: 14100 - DNA, 1184 bp, Heterodera glycines
atgtgggtgtgatcaaacaaaagaagtaaatgacgttaaatgcttatgaatatgagaattgagacatatgatttgataaaaatagacagcattcatttgtatatttatgtcatcatttgaaacgaaaaaaaagaaataaaagatatttttatattttaaaataaatacaaaattattattttcattaaaaatttattttaaaattattcccaacacctgttatgtacgctgaaggcagtaaaaacattcttaataaaataattttaaaatttatttcatttctttttatattcaattatgcatacataatattttcacatgaatttgtttatttaaatttatgccataaatttatattacatcatatgcgcactttaatgctaataacatattatgatataagttcatcgtgtgtatgagtgttgaataatttttttttaaaggaaatagatttattaaattaaattttgatgttggaaagggaaagatgctaattaaaattaaaatattgatttcaaaagaatcaggtgctctatgtcgtttcatgatttccgacatttggcataaggatttttcattttacaagacctgatcccttcaaattagacaaatcctggaaataagacaaatacgaccacagtgttaatgcatgttcaatatttttttgtgcatttggtattttgatgcatatatttttttaaatatacaatatattaagctgttgatttgcagttttttgttttgattttttgcttgccctaataaataacatttaatataatcattaaattaacaaatttaaaaaaatataaaataaattcacacgttaagatgttgtggcgctatgacaaattcgtctgatccgaccaaatgcacaaaatgtggaaaatgttttgctccattcagacgtaaacaaatttgaagaggaaactgcggcagacatacgaagcgcaaatctgactgtgtttatttttaattcaaatgagcttaaatttttagacactttttattcccacttatccaaaaattggtggattgaaatttttgataagaaatttatacacccagatagcattaagagagatgcaacactgtcatcaatttgtttgtgacgagagaaatgcaatagaaagggacaccagggaagagccccatcccggcgaagggaaacactgattggggga

SEQ ID NO: 14101 - DNA, 1885 bp, Heterodera glycines
  misc_feature (1773)..(1773): n is a, c, g, or t
cttatttgtgttgtgtccacaaggaacaacagaattaaatttattgtggaaagacaaatgaaatcaataaataaataaaagatgacgacggagtcagaggaatgacgaaaatggaaggagcaaaacagatttaatttagaaccgaaaaattaagaatgaaataattaatgaatgaggaggaacaacggagggaaaataatgactggaaatgtggcgcggagaaacaaacaggaacatcactgttactgtatggcgctaattcaaattaattaaaatccaacatcaacatccatctccaacatctcccttcttaaaatttgtttcctcacggcgaataacgtattggggggcggcgttgtctctgaggacgaggcgttggttgaattggcaaggttggcaccggagtggtcgcgacattgtgatggcaaggacttttctgttgaggaacctggtcaactaaatcggccgaaaaagttgtctctgtttggtaagggacaaaagaacgtatttggtttacatgtcgagtgacagtaatattcaaaagtggaattttgaccttccaaattagacctttaccatcgactattttgccttcaaaccaattaggcttgccagaccttccgtaattcaacacgagaacagtgtcaccgttttgaaatgacggggacgttcatcaattgtgttgacttttgttggggcgtttgacaaatccaatgtcgtcgcgatgggagattgcgtggccttctcaaacggcacaatccaatcaagtcccatgatgtttggagctccggtgtttgctactgaacatttgagcttaaattcaacacctttaaatttcaccaaacaatcgaattcgcccaacaaatttaatttatgcccggaaaaactaccaacttttttaccttgttttctcaattttggactccccaaacttatccaaagtggctcctgaataattgtcagatgcgagcacgagtcagccacaagtttgacaggatgtccattgatcagtggctgcgtccaaatccaatcgtggcagttttgagtaacacaaaaagttgaggccactgtgacagcgtttgactgcgtgcgttcaggacaaacgggtctgatgtgtccacgttttccacagcggtagcaattcacatcggctgcataaggacagtcgttgacatggaattgaccacatcgcttgcacttttgctgctgatcttcatcggtcctattcgaattgaaaggaaaattatactctttcgaatttggaaccgaaacattgcccttttggttgaccattttacctcggttagacttcttacttccatcgcttactcgttgcggtcggacctgcactgaatgaacttgtccgggaccagacaaagcggcagccgaatttttaagcgattgaatggaacggcactcttccagaagtgcttccaaagtcatggacctcggcggcgttgattttcgagctttttccatttggcggagacactcttgtcaaagttctttgtgcgcgtcgctcaaacctgtgatgaaaataaggcatttcacttcctcctttgacagagtcatgtcggcgcgttcacagcgagcattgaccattgcaacaaactccatgacattttgtgaggggccacacgacagctgaaagcattcgaagcgcctgacaaaaattgatttagtgtcgccaaaaagtgccttaagagtggaaatggtaagctgaaactcaatttcggcgggcttcttaggaagaacttgctgttcatacctcanataatccgttgccgaaagcttacacaaaatcaaacgcactttcatgtcgccggtcaaatccttaccgtccttctcgacaaattgtccaaaacgatcccaccaaagtaagaat

SEQ ID NO: 14102 - DNA, 3184 bp, Heterodera glycines
  misc_feature (139)..(139): n is a, c, g, or t
  misc_feature (175)..(175): n is a, c, g, or t
ttttaaattagttacgctttccgtttctccgattttcccatgggagtgatttggggtaaaaaatttgcacttttccaaatataattaattacatggcaaaattcgttcatagtaggctaaattgaaaaagatcatttcntaattgattttaaaatgtactcaatgttagtcttgnatttgccgtgagttcggctaaaagtctccgctggggcggcgcattggcaataaaaagtgggcaatttgaagcaggcgctaattgccgctgttaattattctcatctttcattttttttacatttagcggagtccaaggaacagagcttaaaaaacagggatacgaactgctaaatttggaagtaattttacaatgtttcgttagcagaatgaactaaaaaatctaatttttattaaaatattaacattatgaataaaatgggacgaaaatgctaaagatgagatttttatgtaaataagtaacatgaaaatttggaaaagctgatattcttattcagtttttttaatcaacatttttgcaatataacttaaaaagcataaaaatttttatgtaaaatttacaaattttagaaatttgcggatttttgtaaattttaagtgtgtaaaatgttctggtttttgcagactttaagctttaattagaaaatatttgtctacaaaattcaagtcattctgacaattacgaactgaataaggaaatcagttttttcgaacttcgtgaaattttatttacataaaatctcaccttcaccaattaggaccgaatttaaatggacaaaaagaaaggatgaagtatggacaaaacgcttgaatatggataaaaatttcaaaatattgaaatagaaaatcttaaaaataagttaattaagaaaatcttttttcagtatttaatgtctcaattaattatttagaaataattttatttcattaataaaaataattgttctaaaaacgaacaaagggacggagctgctcatttgtcagtttgtttaagctaaaatagaaattaaatatgaaaaagcaacggaattattttattcaatatgcttttgtggtgccatttacgtaaatgccaatggttcctaatgagaatttttcgcgtgctttctgttttttattggaatttccagcaaatagcgaaatgtccgcgtgggcaaatttaaaaaaatggcaaaaaagcaaagcgtaacggtgccaaaagcgaaatgattggcacacagagggggaggcacccaactcacatcacattcggaaaattggttgtgccaatttgcgcattttttgtttaccaattaatggccaaacgaaaggcgccccaaaggcacaaaaaataattggtttttattttgagaaaatgtgtgaatttttaggcgattaagcgactgacagtgggagagaaaatgcacattggcaactgagcagctgattcactcataagctcataaggtacctttcgaataaacatgctaatgacggataacgggtgacttcttagcaattaattgccccctaattaacatttgtgcggattaattgcttcagtcgaaaatagtcgcagacaatctgaaaaggtacgaacaaacgtattactggaccataaatacttttcactgtaagtataagttaaaaaagaggtgctattagcagaatgtagggattggcatcccgacaaaacaaaacggcatttcaatcctgccgggacgccttcttttcacttttgctcctatttttaaaaattttcccctattttaaagtcggatttaaattatttattaaaaatacgcatttggacaagtgttgaatttaattaattattaatcacttttaaacattcgaaaattttaagtaaaatgttgaggaagaaattaatttgttatgagtgaatgattttgaaagccctttttttgtcgttcatttttgacgcttttttatccttccgacgattcgcccagttttgtcggcggcggaatttgtgccatcgaagtgagttgggcaaggacaatgttcagggggcttctgaaatgtgccaaatattaaagaatttgtcgaaaggtacggttttttaattgactttataccattattaatttttaaaatgtttcacaaatataaataagctcacttaatcgcctttttggtcggcctttccctttcacaggtcaaaatttgcttgaacgccttgcgaaagtcgcgcgaaaagcgtgaataaatcaacggattgagcatcgaattcaaatggccggcccaagtgaaaatggaaaagaccgtttcgtagtcggcgaaactctgaaatatgtttaattttatcattaggaccggcagagaatttatgaatttaatttcccccccccccccccccaattaggcttgcccacctgttcattgccgcagagagcgattagcggcgtgaacagaaaaaagggcgtccagcaaaggatgaacactcctacaacgatggacagtgtgcgtgccgccctctgttcgttcaactgtttaatcatttggcgcgacttctcgcgcattccgcccgccagccgtttgcgcgagccgggcccattccgcgcgacatcgttggccaattgctgaagcgattggttagatgaaacgggggaagaagaactctgatcattcactgatcagaggaggagaaaatgagatcgcatcaaaaagattgataatttctggtctcttttcctttcataattaggtaattagtgatcattccgttttctcttttggcacctttccattcgccagcagttcggcatttgcccctccgcctccgtctgccactgtcgtgttcccttggggtgacgtcgcattgtccgcgcctccgccggtggaacacgagataatggacgccttcggcgtgttggaagcagtcagtgaacaggcgaacggggacggagcggcggaccttttgtggacgagccaaacggcgcccggcggcgcggaaacggcggacggacactttttggcatcgcgcaaagagaaggaattggtgggcgaacttttcagctgatcacctctgaaaatggaaatttttcaattcaaacctagtgaatacaagaaaaggagatgacggtagaattaatgggacgagagcaaaagtgccgaaaattgaaatgaaaatgcccaaatgccattgaaaagaagtgaaataacaatt

SEQ ID NO: 14103 - DNA, 1981 bp, Heterodera glycines
gtcgtccgtttctgtccgaagtgaatgcgcagtgtttccgagcccgccgaatgatttcgggagcattgattgggcgcgggactgcccgacttggccgattttccgctgtttcggtcgcgatgtttcagcaaaatctgcaaattatgaggtgaattcaatgattttaaaaagtatttaaattcacaacgatcactctcttccatctttttcccccctttttttgcttttgatttgatcagtcggtccgctcaaagcataaacactcacccgcttctcgccgctcttcatcgatcgcgagtgcgttgtggcgatacagtacacgcgacctttgacatttttgttggcattttgtttttgcaatttcaaaatttaccgtaggcaaagagaatgagcaccaaagggatgtaaaaagaaatcattgcggagaacacaacgtaatacgcatcatcagtgaacagacagcgcctctgaacaaaattttccataaattttctttaattttgatgttagctaattaaattgtccaactttgtccttgtacaaatggggtgaagaagcgcgccaccaaaaaattgccgggaaggaaatgcctaaggcaattccaaattaattaatggttaattggctggcaataataattgcacgtacaggcggagaccaaccacacacagcaaatgcagtaaatgatgcggcgtttggacacgcggtcgcgataccctggagatggacaattaattaactaattaaataattagttaatgggtagcagggcaattaatggaaatggaaaaaaggaaaagcccaaaaatatatttttcagcaaataattctttttggtttttggctggctaatagcacctgggaagagcttatgaaagatatcagttacagttgggcagatttttttttgtaataataataataataataaaaactgttatggaccatctctttaatgacccctcttttttggcaaaatgccatcattaataatttaattttggttttattttgctttcgtaccaattgggtcgacgccggccatgtaccgatcctaatcaaaaacaaaattattataaaatataatcattttaaagataaactttaattttttttttaaattttcggctcactgaccaaactgatcacgcacaaattccaaattgaggacgtcgacgccaaaatgtccaatgcgtgccaaatgtcacaggtggtcaacccttgacaaaagacaaattcggaaattcatttttaattatttttaactttttttgcatgactttcacatgaaaagcgcagttgaaattcatgtttttgggagggattgacacgcaaaaaaaggggggagggcatagggcggataaactgccaaaaatggaatttaaacaaagaaaaaacgaatttgcaaaacgccattttaatttatggagaaaaccatttaatattaaattgccaaaaattaaatttcattttccttgtggtaatttaccctttaaattttatttaaatttcctttttgcttttgttgccctttcaaattggagagtcaaaaaccaatagtttggcttttttttttttgcttttgttttcccccctttgtcccccgtccgtccgttttgtttttgttgtccttccttagttcctttatcgttttttgtttgtcccaaattccctccccccccctttttttcttttttcccccccccccccccccaattgtttttatggcttttcctttttggtcttttaaatgtttggcgtttggctcaccaagcagccaaacatggcgactcatctcaaacagcgaatttaacggcatcaccaccaaacctgggcaagaaagaacgagcgaatgaatgaatgaaattgtggcgaagcaagtcatgtcatttgaaaaacatttcaatgacaaaatgccataattaatgttaaattgccaaagggcataccgacgatcagatcagcgaccgcaagcgaaacg

SEQ ID NO: 14104 - DNA, 4000 bp, Heterodera glycines
  misc_feature (1253)..(1253): n is a, c, g, or t
  misc_feature (1354)..(1354): n is a, c, g, or t
  misc_feature (1374)..(1374): n is a, c, g, or t
acagtttatttttgcataaacatttatttgttcgcagaacgattggtaattggcataaaaacactattagcttaaaaatcacgaaataatataaagaaagcaaattaaaatattattttatcttttgagagcctaaataattctccatttatcaggaaaattaaataatccgttatctgtttaattaaattgtagctaggaaagtttttttttttctgtcgcggtttttttaattttattaatttttttggaatttctcattgtaaaatccacacctaaaaaggtgtttccccatggcctttaccgcctgatcagccatttttgatcgttcttttgaccgctaccggcttccttctattttctgccatacttctgattggtgccaatcgggtgtttcgaaagcggttgccatcgcccggtcaaaatgtattcagtcgctgctacagtaccatcaaaacggcactgcacaacaaaagacggtagaattttcgatcattgatttttatagttaaaattaaaataaataaattcataattaattttattcgcctaaattacgccaagaaaatttgttactaatttattcgtgccactatcaggtataaacaacggcgaatggtgttggcaaagacgcgaaaccaacaaagtgcggagccaaataacttgctggaccatttcttggatgaccacaactgtgaacgggacaaagagtgcgattttggacgaaaaaatgtgtgcggacaggtgagtgagagaaacaaaccaattaaatttgctaattagccttaattggctcattaccaaaattttgtatattattctgtttaaatagaaatgtttcaggcaaaattccttgaagagctccgtacagtgctcagtatgatactgctgtttgtgccaatgccattgttttgggcgtaccaatcacatatggtacgttcaaaaaatgttgaggctgatcacagataaacagggagcggcataatgaaaatgcccaaatacctgacaaaaatagtgatgaaataaaaaattttcttttaatgacaaattcgaaaaaaattttaattagcattcactattcgggatttgtactttttcatttagctctcaatttggtccatccaacgggtgaacgtcgacccgaatttgccgatgatcggtgcctttttcagtcgtgatcaaattgggctacatttgaatatttttgtgctcgttctgataccaattttatatgtgagtttgtctgatattgnggataaaaaattgggtttttttgccaaaatcaattttccttttcagtacatcgtttatcatcatcatcatcatcatcattggcacaaattctgcacatgancacgtaagccaattcattantaatggaaaattttcaggatttcaaatgtgatataccgtatacccaaggtatacaaatgttctctcacttgttccaacttctggttttataggtcacacacccactatttgttcgtcaaaagaattttctttttttaattttttgggaaattaagagttttgcctttttttgcagaaagcctatgatgacccaattctgccatcattaaggtatttgaagaggatggcttccggcatatttttgtgcgctttggctagtgccgtttcggcaactgttcagttccggctcaatgttagtgtcaattaaaaaaagactctgctgttcgtctttctattttatttaaagcaaaatccgttagagatttcatgaaaatttcaaaaagtttgtaaaattaccaaataattttcaaaaattattgacgaacccttttaaaatctttttaaatacaaaagtttcacttgtgcctaacggcacaaaaaataaaattaaaaatccgagatttttcctctccttttctcgtatgaggactagagaccggacgggatcgggatcccgcgggatttcttcgggatcccgcgggattaaatttgggatcccgacctcgggatccgtcccgagtgattttttaaattcatcgggattgatcgggatcgggatttcatcgggatcccgaatcgggatccatcccgaccattttaccaatgtcacgataattttcgaaaaatctccattttttaattaagatcttgaatttaatattgtcatttgctaatttttcataaaaatcccaaaaaaattttcacagttctccaaaattccattaaaattttcaaaatttgacgcaaaagttgaccattttgtgacttttttctttcaaaaaaagaattatcaaattttattttttataataggtagtttcatggcacaacgatttctaagaattttgtccaaaaaatcataataaaattgatgtctacgtatttttcttcgatgcctatccgtcaccgccagacataaaaccccattatttcttataaattagttcaaaatcacaaaatatggacagttttaggataaattctgttaacaaattacatttcaaattcaaaattttcccggcggcgcctatcggcaccgccggcctcccccctgttcccctaaagtttttgaaaaaaattcactgcgaaaaaaattcttgatttttgatcccgatgcagtttacgattttctaatttccttaaaattgtttaaaatgataataggaggcgaaaatacagaaattgacattaattgattaaattgtaaaaatatttaaagctatgttgttaaatgttctaatttttgaccctagatattctaattttggaaaaaaaatataaaaacctaataaattaccattcctatttttcacaatcgaattgatcaattataaatattagataagcacttgaacaaaacttagcacaaaactaaaaattaaaaagccaataaaaaattgggttttagcaaatcccgataatcccgcgggatcccgaataaaaatcttcgggattcatcgggatcgggattcggtcgggatcccgactcggaatccgtctcgatcgtttttccaaaatgttcgggattgatcgggatcgggattcggtcggtatcccggactcgggatccctccgaccccagttgtccggtctccactgcaaaagcccgcagcaatggtcataagctcaagccctatgtgttggtcaacacggtgccgcaaattatcaaccaatttgctggaaaattgttttgtttttcagaaataattagtgtcaaacaatgttctcaaattctatttatcccccatgggggataaatggagactgggtgattattttttaaactcctcagaaaggggggggggataattggagactgcggtattaatagagactgggctataattagagcatatacggtattagggctgccaattttatgtaaatacatatttttttcctagcttctccttgctctaaatagcaggaaaaacactttcttttttgtgtttgcgaacaaaaatcgggacttttatttacatatttttacatatttcgtggtttttatacatatttcgggattttcttacatatttgtacatattttggatttttttcatatatattttcattttctttacatattttgagtattttttacggaaatttttggaaatcctcaaaaaaaaattcaaaatttcggcaaatatttttgtacatattttgaaaatttataaagaaaaaataagtttgaaaatgttgcctaaaaataccaaaaaaagtaatttttatgtcattttgtggctatttcatactttacggggattttctttcccaaaaataccattaaaaaaattttatttacatatttggggttttttgtacatatttggaccactttttgtacatatttttggcggtaatagtatggtttacaggtcccaaaaaaaagaggcaaagggggttttatgcaattcttcaaagtcctttagggttctcgagggcgctgatcacgaatataatattcatttcgaccaatttcgaaccccgaacccgaattcgaacaatttttttgttgctttttttt

SEQ ID NO: 14105 - DNA, 2096 bp, Heterodera glycines
ttaattactgctaattaaatctagaaaaatactgaaaatttccgttgacaaattttcgtgtcgttacaatcgtggtaaatgttcactttgggcacaatttttgtcgcctcttttgcggacccatacaaagcgaaagtgccgttctgagcggtccatccgtcggccaacagatcgtccgattcgaaccctaggaaaatctctgaaatttcaattttttctatgaatttcaattttatttaaatttatgtaatcgcattttgctcccaatttctgacacttacagcggtcgacgtcaaataatttcactctgaccccaccagcggggcttccattgcacgttaatgcgccatacacctgtgattcattaataatactaattaaaattaaatggattaattgaatgcccttaattaccccggctgactgcgttttgttcgatcggttattgataataatgggacaacgaatttggccaaaccggcactgaaattggcagcgaatttcctaaactaaaaacacaaaaaaataataataaaattaaaaaattgacttggtattttcaaagaaattcaattaatttacccttttccaaatggaaatgttctctttttgggcggggacggcgaacacaaaacgattgtcgcgcaaaagatgtcaatgcacaaaaacaacagaagcagcaggtggaaattatatggcatttgaaaatgggaatcgatgggtttgatcaaaaaaggaaatgaaagaagtggccaaaacccgggggattattaagcgggaatctttaaccaaacctaatattaattaatacataataacattaaaatataaaattggtgttaaaatttcgacgcagtaaaaactgcgaatttgcagttgctgaagagaccggcgcgagggatgagcaaaaggaggggggacagacggcgaaatgagtaattaattaattgcataatttggtgtaattgattgctaacgacttgatcaatcacaactgctgttatcactgctttgttaagcaaatcattgctttcgccattgtatttaaggaatttaaaaacaaataatttaattcacaaaatttaattttccttcggagtgaacaaaaacagcttaatgactctgctgacgactgaatttagtttctgattgtgaatttgctttagtgtgctcatcggatctcttcttctttgtgatcaaatcggtgcgcattttaacggccggggaaaagggcgaccgacggaccattgaccattgattgattgattgattggccattgattgattgattgaccgatgatcgatgatcactttggtgatgttttgtggccttaaagtgacccaataccaagtgatcagatgcgttttatcttttgttgtccattgtgtcctcagttttggccaacttccgtcggacaatcaatcggaagatttgaattaaacgatcaatatattagaatgaattaatagacatattgtagtttaatacaataatatggggaaattaattctgaatacaaattactgacggattgtccaattgccctttggccgccttttcaaaatgaataggtcaaccaaacttttatgaacgttaatgtttcttagatttgcttattttgtggtaatttctgttgttgtttttctctctgctttgaaattttgtgattttaaataattaaatataaaatttcaaatttctcccattatttggccattttttgattatttggccgccgtttgttcacgcccattggactgcttgcccgcccgacacggctgtcatcgccacccttaaaatcttccaatattttccattgtttggatacaaagttgagaggggggggggaatttgggatggaagatggatgaataaaagagggggggggggggggtgtgaagaaatatttgactttttatatcgagtagccttgtaagcgtgtagagatttatgtacgaaaaatcattgaaatgaaacaagctaagttaaaatttaaaggaaccttttttttgaagatttcattgaaatttcaaaattttgccgaccgcgacttaggccaccatcggaggccaaggcctaaaattttccatttttt

SEQ ID NO: 14106 - DNA, 1902 bp, Heterodera glycines
tcttaatttcctaatttgtcttcccaaatcgcatttcttccctccccccccccccctccctttttatcccttttttcccctttttgcgcccctccggcgttcctccgaccgcctaaacatggcaattggcagttcagcgcgaaggccgcgccctccaatgaatgaatttggcggagattaaatctccgccgcgcggaagggcgggcgctaaaaaggcgaaagaaacactgatgaatcggcagcaaataattaccaattaattattggacagtgtcaaagccaacttatgttttatgattgattttttttaataaattaagaaattttatttgtaaattgaaaatgtcgtcggaaaacaatgcaataggcgcaaatgaagcgaaggtggggaaaaatggcataaaataacctaagaaaatgtaaaataattaactgttaattgggtaattcatttttgcttctgtcagcccgtcccaccgtcagcttcgcctttggttcaacatctgctcaatgccgaccctttccttgctgatttggtctccggtttgcccgtcagtttcgcgggcattccctacgcaaaagtgagcgactgcgaaattgagaaatgtcaatttaaaaatgccattcgccggcacaggagacggaacgccaacagaatttcattcattcggcacaaacggcgaaacgaattcacattgtaaagaacattttatgaataatgcagatcatttagtggctttgtttaatcaaatcgattgaaatttcagtcaaaaatgggaaattattttaattaaaatttacaattttaaaggcaattccgagcaacggactcaacctccacctgaacctcagcgccgaccactttttgccggaacgaaacgaagtgggaaaagggaaaaagaaatgttggcattttaaaaccttaaaataacggcgaaaattaatttgatcattaaaatattaattgtctatttatctctcttttttggctcttctcccattttgccgccttttcagctgcatttcgccagtgagcttctgttcaacggtgcacccgtacgccttcgtgggcacatcagcacgcgcactttgcacggcaaagtgcaggtgattttcgctggggttgtcgggattgggagggagttcgatcggaaatggaatccccgactaatccgcgcattgggcaggttgagttggcaccgcagtcactcattgggcaacggcaacagagtgaacgaattggggaacgaatcgctcagctgaggacagccgcgttgagactttgaacaaagtgaaaaccgacaaaattgtcaatttaatattatgcataaatattttcaattttttgcatcttttttaaatggattttgaaatttttccatttggaaaaaacggggccgtgaagcacggaaaattcgacttaataattcattaaaatattttttctcatttatttattaataagcaacagctaaatatggtaattaccgtcagaccaactccaattaaacttatttttaattgattgttttttcattatttaccgctatgtccaaatgccattctttctgtaattattttcattaggctctccaattaaaaatttatgtttatttaattttaaaggaaacgtggacaaattgacttttatcgcttggcatatgaatttgtcatgttaaccgatgcttttatgtagcatcttaaaattaattaaattatttaggtaatttcttaaggcataatatttattcttaatcggaattcccaaatcccggggcgcagccgggaaaatttataaatttgagaggaatttatggaaaattgtccaaaaataaacaattaactcattttgagtttattaacagaaataagaacactcttcgggataagaacttttcaaat

SEQ ID NO: 14107 - DNA, 3901 bp, Heterodera glycines
actgtttaccgcgtcggcccagccaccatatcgggttcaatcccgcgcggcgaaactcccgcgcatttaacgccacggcacaaaatctcgcgcaacccccatccaacacccccaaatcccgaccccacaccgtcccgcgcaccagccaccatcccgaacccacatttcccgacgcacccccccccccattctcgcccatcacaccacccaataggcacggaccccccagctgatcctctctcccttcagtggagaaaatcaatcgataattcaagtaatcgtatatagtagtgtaaaggaaaaagggccctgatcactaataagaaccgaaaacgggtatttgatcagttaagtttcatctaaaggtataaatagaacaaataacacaaataattaaaaaaatgtcaactcttaagaaaaatagacaaggcgagtgaggacaggtgaagctgaccaacacgtcggtgtcattcaaaattttgggcacagctttgtcaaaaccttaaaggtgtcaatttcaggtgttgagtcttatgattccggcatttactatgcgtttagggcatatatgatgaatgaattgggattttcagaagatgtcaaaaaggggctctgtgaagcatcttgctattacgtcgatgatgtcgaccaggatgattacacaaatagcggctttaaaaacagatcgtcacgtttggctgatggtgccaaatgtgaaaccatggtgaaacttaattttgatctcgcccgtcagcccaatctattgcttaataactcggatgtcatttttagcatacaccgtaacaccgatgattttctaattatggcaccgccatatgtttcaggaaatgcagtcatagcgaacccgcacacatatcgtattaacatacacgatattagaatttatcgtaaaaacagtagacgttacccaagcattaaataacgtaataagcaatcagctacaaaccaccccggccaaatatcctacgagaaaaatcgagatcagaagtcttttcatcccgcgtggcacttctgatctttcacacaacgtttttacaagcattgttccgagacgtttaatcgtcgggtttgtttcaaccggtgcgtataccggaaatcctaaagagtcacccttcgtctttgaacatgccaaaatacgctctatcggcgtcgaagcaaatggaaacatattccccgggtcaccctattctcttaattttgatagaaacaaatacattcgagcatttgttgacatgtatacgggactcgggatggacgacggtgaaagaacaatggtcgatcaatatacaaaaatttgtaaacgggtggtgtttcttcgtcatcccgatgacctctactctagaggacacccccggttttgaattgattcgaaacggaacgaccagcatcaaggtgcaatttaatgagcctataaaggacggcggatatgagatgatcgttctgggggaatttgattcgattttgtctattaatgctaatcgtgtgctcagtagtgacggaagcatatgatgaattctcatgagattgaaatatttctatccaaacatccaacaacacgaaaatattttatcggtgtttttgcttccgacaagatgcctaaattgaatgacaggcattttccctactgttttgtagcaaataccgacagggcgggcacgataggtgaacactgggttgcctgttttgtaaattcgccgacagaaatagaatattttgattcattgggcgattatcccaacgaagatttaagttcatatcttaacctattcaaacgaattctcattaacgaccgcatcgtccaacatcaattctcagatgcatgtggtcaattttgcatttatttcttgacacaacgatgctatggaatcacttattgtgaggtcattgacggtctatataaggttcgcccgagggccgatttattagttaagcaatttgtcagtaatgtttaatttaattgttctcctaacgatagtaggccatctcactgccgaaagggttcagattctttctgatacacaactttttgacgacaagtatctcactatgacaaagagttcggtcaatgaaagacagttcggattcgatcgctcgagattatgtacgataaataggaatctgatttcagggtggagtgtatcaatccaagaaattaattcaatagaaaagagcggaccaactaatgttagctttaccaggattttcgacaattaaagccccgagcgtgcttttattacacgatcatagttatttaattttccaaaacgaaaatacaaatgaaacttcgataacaagagggagtcaagaaaaggttgttaggaattttcccagtggggaccttagatttgatcacattaatggccgactttttctaatcagtgacgatcgaatagatgaaattgacattagatcaatcgagaatttatggacacatcataatggcaccaaaattattactaaaccgatcggatcaatgccgtcttcatttaccgatttcctaataattgagggacaaatttatctgattaaggaaaagaaaatatataaagatcgatttgactcaaacgagatacttcccaaatatgtggcagacacaaatagtgaattctttaattttgtcgtgttcaaagaatttgagaaaattaaagtttcaagttcaaatatttgggtatattttttgtcaattgtcgatttggtagtggtcatcatctgtatttcagttctcagaattttaaaaataaaaagaaaaggtaaaaattcaccctacagtggtgaagtaagtgtatataaggacttgcaacgaatatgaaaatgcctactggtgctcaaaattaattctctcattgaaattctatgcgattttaacgaatgcgaacctcacgaattatcagaaattctacgacagcggaagaaacaaaatttgaaatttttgagaagacacgccctaataacgagacaccttaggcacaatcagtttatctcaccggatgacatcgcatttagaggttctaataggctttttgcctaccgagggttcctcggggttactgtcgaacagcatctctactcgagacaccgtgtcaagctacaattccctcaactcccatgtataactatgtaccagaataacggtcatagatgctattttccccttgaactgctggattttttataaaaatattacggctaacaggagtgggccttcactttagaccgttccacccccgctagtcctaatatcacattaatttttattcaactttatttaacaaaaaaaaaaacaacaataaaatacaaaattaacaaaatccaaatggcatcacattaagctcctcatcgatgatacccttctgacagaccggcctgtacattttatgcttctccctcgtcaccactttcgaatcccttgtcggcctaaatattgatttattaatgaagcaaataatttttacaaaactcacccaaaatcattcttatagacgaagaatgccgggtccacctcccctttcccataattcaaaaccatctccctgaatgtatcgtagtgcaatgttttcctgttgtccacgtcgaacgtaatccctctaattttcataacatattcaatatcccccgtctgcttgtttctcatcttcagtgcgtactgcttcgcccctccacagcaatattcttcaatctcatagccgccgtattcctcgctcatctctcccaaatattttcccgttgtgatcggctccacgtcccgatcatgcaaaacaaaaatactgtcagtgtccgtatacaaaatttcccctccgttgctttcagcctccctcataaattccaataattttaacctcgccatactcgtcgtcctaaaattaggttatatacaaattta

SEQ ID NO: 14108 - DNA, 2209 bp, Heterodera glycines
ttttcatttctcaggagtgtgttttgaaaattttcgggtcgatttttaggggtgtatttttgaaaaaaattttaagtcgattcttaggggtttatttttcgtttttattgcatttttgttaacaaattttggcaaaacgccaaaatatgtgaacataagttttttcaaaaaattttaggttttttaggtgctaaaaataaaaacctagaaaataggtgctaataactcgaaaagtagcttaacaacagcacaaaaaaacatgtttttcgtgcgttttaggccacggggagctcaggaaaaaaataggtaaaaacctaaaaatggcatccctaataatagaatacaataaactaaaattttaaaggatattttttgaatttttccggggttgggcaataaaatattaatataaatctttaaaaaagacttttataggcttataaaaaaataaatcggcgcagttttcggatttcaatttgctcattgtcagtttgtcccaaacgataattttgtagaacccaggcggtgaaactgtgccagcataagtctgaaaatttgcaggaaaaacattttcactcatcgaagatatcatatcaaaaagagaaatgccacagaaaatggcaaaaagaatataagaatgtagaagcatttatcttaatgaatttttaatataaaaaataaaaattagagctacgataaataaataattaaatcgctaaattgtcacctaaatatgtgtaaaaagtgaaaaaaaaagatggaatgctaaaaatacagctagaacatcaacaaaatttcaaaaatatttctcataatagtaataattaataattattgcgggatatattcagtcatgattcacgacttcagttcacagccatggttcggagtaattcacccatgtttcacggggtaaattcacggccatgtttcactgggtaaattcacggccatgtttcactgggtaattcacggtcatgtttcacggggtaaattcacggccatgtttcactgggtaattcacggtcatgtttcacggggtaaattcacggacatgtttcaatgggtaaattcacggatatgtttcactgggtaaattcacgggccatgtttcacggggtaaattcacggccatgtttcacggggtaaattaacggatatgtttcactgggtaaattcacggacatgtttcacggggtaaattcacggccatgtttcactgggtaattcacggtcatgtttcacggggtaaattcacggacatgtttcaatgggtaaattcacggatatgtttcactgggtaaattcacgggccatgtttcacggggtaaattcacggccatgtttcacagggtaaataaattcacggtcatgtttcacggggtaaattcacggacatgtttcaatgggtaaattcacggatatgtttcactgggtaaattcacgggccatgtttcgcggggtaattcacggtcatggttcacggtttaaattcatggggtaaattcacgctgatgtttcattcacggccctgtacggggtaaattcacggccatgaaatttgtgccaaaccccttatgtgccaaaaggcagagtagagcgggaccgggaattttgggcaaaaccgggaccgggacttgccgggacctgagaagccgggaccgggacctcgatttttgtccgggaaccgggaccaaccgggaaattttaaaaattcaaaaaatttaaaaaaatttaaatttattttaagtaaaaataatacaaaattaattttttattttgctatttatttaataaaatccaaaagttaaagctaagttaaattaattaaaattttcaaatcgaatttacttcaattatttcaaacaattaatcatttttggaccaaatgatcgaatattaatagaaattcagatttgcttttaacagcacttttttttcggcgctttttccaaaaaacttttagggagcagagaagagcggtccggcggtgccgttaggcgccgccggggaaaaatttgaaagtttcagtgaggtttgttaacagattttcaacaaaatatggctggtttttgggattactaggctcaatttgtacggattttctttaaaaaattataaaatatgtataaatctaaaaaaactatgaggaatcatattttgtcgataggatagccatgagtatacaaaaagaaaattcaaaataatt

SEQ ID NO: 14109 - DNA, 958 bp, Heterodera glycines
cgccgccggggaaattttgaaaatttgtgtgtgatttgttaacagattttcaacaaaaaaaggctggtttttgggattactaggctcaatttgtacggattttctttaaaaaatgataaaatacaatttaaaaaattaagaatcatgattatttcttaattttttccctttaactccaattttcatcactaatttttcactcagacccattcttaccagtgcttgtttttcccggttcccagttgccctaccgggaccgggacctgagcttttcaaaatccgggaccgggaaccgggacctcggatgaccgggaattcccggccctgtcacggttccgctctactctagtttttatgagtctctctctaaatcaaaaattgttcggagaaaatgctaattttggacttctctcgtcttaattaagccgcagaaaaaatatatatataaacataaaaaccaagttcttactcaataggtttaaaataattcagagaaacggtttgcatgcttttcgcatcaccaaaacctaagaagcccaaaaaaattatgaaatggcggctgctgctgaaaagtgcatcccaataaagaaagaacgaaggcaattttatggagaggggactaatcacgtgcaatgaataagtcagctgtatgcctgaaatgccaatataatcgacttttttaatttacaatattcctattttattaaaattaaattaaatattctgggaaaacgaattaaagatatacaatactatagttaatgccaaaaaatggacaaatgacgtaaatctcgaaatatgggaatagaactaactcccttcctaaaaacttcaaaccaactgaagcttgtacaaaaacttgtacgaagaaatgggcgttagtcaaaaaaccatcaaatggaaaatttttgacagaaaattattcataactttgctcaaaagcaaccaaatttttttg

SEQ ID NO: 14110 - DNA, 963 bp, Heterodera glycines
tttttatgcgttcttagccgtgacatttttttgattgtgcggtcttagacgggcattttttatgcggttttagccgtgacattttttttgattgtgcggttttagacgggcattttttatgcggtcttagccgtgacatttttttgattgtgcggtcttagacgggcattttttatgcggtcttagccgtgacatttttttgattgtgcggtcttagacgggcattttttatgcggtcttagccgtgacatttttttgattgtgcggtcttagacgggcattttttatgcggtcttagccgtgacatttttttgattgtgcggtcttagacgggcattttttatgcggtcttagccgtgacattttttttgattgtgcggtcttagacgggcattttttatgcggtcttagccgtgacattttttttgattgtgcggtcttagacgggcattttttatgcggtcttagccgtgacatttttttgattgtgcggtcttagacgggcattttttatgcggtcttagccgtgacatttttttgattgtgcggtcttagacgggcattttttatgcggtcttagccgtgacattttttttgattgtgcggtcttagacgggcattttttatgcggtcttagccgtgacatttttttgattgtgcggtcttagacgggcattttttatgcggtcttagccgtgacatttttttgattgtgcggtcttagacgggcattttttatgcggtcttagccgtgacatttttttgattgtgcggtcttagacgggcattttttatgcggtcttagccgtgacatttttttgattgtgcggtcttagacgggcattttttatgcggtcttagccgtgacatttttttgattgtgcggtcttagacgggcattttttatgcggtcttagccgggacattttttttgattgggcgggcttaaacggggtttttttt

SEQ ID NO: 14111 - DNA, 1537 bp, Heterodera glycines
aaaaaaaaaattgaataaggtgataccatatgaacacttatcgatttttgtacaaatttaggttgagattagatataaaggtgcatgaaaaacttacgcaattgtaagatctttaaagtgtattttgtttggcaacggacaatccggcaatggaaatccctcagatttgcttccgacaaaaagttttgccatcatatcaatgtcctttcgaattccgattggtctccaaagcgtcaattcctttttgccatcaaaatgtttgttcaccaacgtatcaaaacggggcgaaagcagtgccaatttgaggccgagttgagcatggtcaaagcatgggagaatgtccatccacacgtcgttgcacacccaactaaaacgagaaaaaaaaagtagcgtgaatacataaatgaaaatttttaatttaatttttaaaatttcttaccgtctgttcatttttgctgcaattagcacacgttggtctttttcaattgattgatgtcacaaaaatgcacagaataattgttttggaaaaaccctttctaagcaaaaagattatttgaaaattaaaaagaataggtggccgggccaaaggcggaaaaatgtgttgatgtgaaaatgattttaagggtaatagtttagatggtagcacacctttttgacagaattttttataaattttaaaatttgtaaaaccatgtctcatggggttttcggggtcgctccagggcagcgcaccgataccctccaagccaaaatcctggatcgttttggcgcccacattcggagccaactcgattttgaagggaaaatacggtaataaaactgtagtcaaataaaataatgttcttttctttttgtgcttacatacctatgtatcagggatggcattccgaggcccaaaaaattttcggaaatcggaattccgaccccaaaaatgtcggaaatcggaattccgtgccatccctgctatgtatcacacacacatattaaagtggctctactgaatgaactatgaatccatcaaaattacgagtccaataaacctaaccaatcttttgaacaataactttttctttttcaaacattcattcatttttgaaagcataattgtctaagtaaaacaatatgccaaattcgcagcatttatgcactttgcaaacaaagtaaacaattgttgattatttccgttttcaatttacaaattcaatgtgttaacaaacttagtttattgataattaaatcggtagggctcatataaagtgcatagaacgtaaagttttctttcgttttctcctaaataaccaaatttgtgttaggtgaactttaccgttgatgaaattcattctcttatagacaagaaaagaacatccgaaagatgttggttattgcccacgttgaccatggcaaatcgacacttaccgactcacaggtgtccaaagttggcattatcgctggtgcaaagtctggtgagacgcgcttcactgacacacgcaaggacgagcaggaacgttgcatcgccatcaaatctacgtttgttttt

SEQ ID NO: 14112 - DNA, 951 bp, Heterodera glycines
agtttcgcgcgatttattgttatcactcgctcaattggttctgaggcacaggaaacgtttcgccaattccaagaagacgaaattagtttggaagacgttctgggaattttcagaactaagatgagtcagttgttttcataaatttattgttaatgaatagtttagcggaagcgcagtcccaaatttctgcgctgaaaactgagcttgctgcttctcgtgagagtgtgtttgaaggtaccaggccggataggcttgacattctggagagcacggttcgtcgctgtcattctttcccgatgaaattaattacttataggacttcctcatcgtgaaggcttcaggcctcagtgcggacgttaggtcgcttttttcgctgtgtgaccggtttgatcgtgcgaggcacgcaaatctccggccatcattttataatatattagcatgcaggtcgatgattgactatgactacaagcatgtggtcgtcaccgaattgcagttgtgtgtgatcaagttgagttcgcagtgcaaatgtatttctggaatgttgtcgtggcatgtgggctctcttaattccggccatagcaaaactatccgtcgcgcgtatagcgttacctgatttttttgtccatttttattgtctccgatcatccctatcatctgtctatgtattgctttaatttgttgtttttttattttttatgaataaaatcagttgaccgacttcgaaacttttcaagataacagtgccgatgtagcaaacctttttcaaaacaattttttttacgatttacaatatgtttgtaatgaaaaagccttaacgataaaagaattataagtacaagattttttttactatcgcatgatccatacggtcaaacggagctaaatttttcaagtgcctcaaatcaaaaatattgaattgttaaattttatctttttgaactatttgttcaa

SEQ ID NO: 14113 - DNA, 1755 bp, Heterodera glycines
atttatataaaaaattttaaggtgtcctttggtgaacgactggaatgaacgcgtcgtggttggagtggcagcaaaaatcaggtgggcattgtttttgaatttcctggattaacccgccttccccttcgtctgcctgttttttttttgatcggcctgctcatttttagcagcaattttcaaaaaaattcccgttgactattttttttaaaattctttaacaaaaatgaacaaacgttctgaggtcggtcggcccggcggtcttcctttccatcagcaggtcacagagctgaattaggagcatcattaattagcattaattttttttttgtatttttttggcacttacccgcaaaacatccggccattcggcgaccaactccttccgggccgttctcatggcccatccctctaaccgccggacctcccgcttgacaaacgccctcttctcctcctccccttcaatctctgcccatcttgtcgacgtcatggcaagcttaaattataagtttatttatttttgtttcacttttttaagtcttgaggctgcaattaaacggcaacaatgtgttttactggtcccagaaattttttttttttttttgtaatttctaaaaacacgtttcgagaattcggcatccctctcgaccaattctaatccgaattcgaacaaaagctctaacaaatttccatttttaatccaaaaatagttgaaattatattttattgaaacagtgatgactttcgctttgtttccatgtatttttaaacaaagttttgagtcagaagatttaacaaaaaatttttttttagaccgaaacgcatggttttgccaatttgaactggtcattttcaattcatttttcagttacctttctggcgacgcggcaccaatccttctcgtcctcttcccagccggacgaatgcccgaccgccttcacctcggcaaccttccccgctaccgccagcaccataaggcgcttcatttccctccgcgtgtaagtctcggggtctggcccgctatgcatcgtccagccttctctcgagctcaaaattttcatcttaatcaaaaagggattttttcaagaaccccaaatattttatatgagaaaataacggaaaatgcatttatgcataaaaagttgaaaatagatcaaaacgggtagaggggggggggaggggattgggatcacttccatttattttgccatgcagtggtttcccttcatctgcagtgaatgtgaaccggggttggtatgctaccatcccggtaactaccgtaaacccatcctctgtttacattccagtattaaatttcgtaaaaaaacaaagattcaatttcttatccagattaactcaaaaaattaagcaaacccaatttttttcttacaggtttcatttttaaaaaattttcagtagttttcccattttttgtgtacataaaagaaaatacaacgctacaaaaaccaaattttatatgaatttcgcgccatttaagccagcagaatcatttatacttttttaattgattgtgaaaattttgggctcggtgattgcgagaggcctcccttattgattgttattttaatttaattttccattttcattgaaaacagaaacgcgcgcaatccgtctgaaaattttttttttggaaatgggaaaatattagataattttttttgtggattttttcccaccacctaccacctacctgcaaaaaaagctcaacaagaaaaccttaaatttttaagtcaaact

SEQ ID NO: 14114 - DNA, 1785 bp, Heterodera glycines
ctgttcacgcccagtccggatggtatgccgaagtcctctagatgctctgttaattcaccggatcaatggttttgctgcaattggaactcaagattgtcacaaaaggcaaattatcgttagcttaaaatagagacaattaggaaaaatgagatcgaaaagaacacaaacaagagcaaaaaacgataagcgatgaaatcaataaaaaacaattttttttacgacattctgtctttttttacacaaaaaatgtctttcggatgaattattgaatcaatgaaacttaaaaaatttgacttatttttagcttaggaatgcttttcaagatggttagcaagcacagtttttaacttaagtgattaattttcaactgaaaaaaacaccccctaagaatcgacactaaaattaaaaagagttttttatttgaggtgtgccgggcaagtccctcctggcgccaccttgtaaaaaaaaaacaaaattaatgctttcttatctacatatctattttcggttaagtgctatttggtgatgacgacgcggcggggggcagtgcggaaggggaagcagaagcggcacacgaagaggaggaagaggaagaaaatggtcagcaaattgactttgttttcaaatttaaaacgcgttattttttttttttgcttgaataaattgtagtttttatcactagggttcgaagttgtatgcttttgcatattttttctgcgcatatgctatgaagaaagcggctcaaaaatagcatttctacgttaaaattttttgatttgatgaaggtttttagtgcatataaaagcatattttgggggttttcgagaataaatgcatattttgccatttttgggcttttagagcatatttcggtcatttttggcaaattttcacaagaaaaatgcgaaaaaagcgaaaaaccctaaggatctactttttgggaattttttaaaaaatacacccttaaaaatcggaaaatttttaattttctgtaagtacttaaggaaaaaaattatttatatgaaaatgtaattttgttttccgtatataagagaaaaatgggcgttttcgaaagcttttgtgaataactctcttcaaagttgtcggagcggcgcgcggttagcgcattctgttgtcacttttcggttgcgcatcgagtagcggaaagcgttttttgaaattttggcctagaaaaaagtttcttcagaaaatttttgaaaattttttatcactatcgaatagtattaattggttttgtaattttggtcaaaaaaaaattaccattgcaattttgatgaaaaaaaaaattgtttttaacgcaacgacagactggaaaatggacaattttttgccatcagcagtacagaccagggattttgatccaaatcgccaattattatttttgtttttttcagatataatcagcttattaaactgaacattgacattcgaattgctccatttttcatcagcatgttttggtattaaaattgctaatttttgacattttttaactaaaaagcatatttgtaaaatgttttaagctgacaattgcattttaaattaactgcttcatctttattgttatgttatgtcctgaaatgctttctgttttctatctatgtatgattcaaattattttaaatattttgagttcataaaaatggtaaaaatgtgattcggaaaaggaaaaaggcaatctctgtcaaatttggaatcagcgaaaaaatggtacaaaaatttgacatataatttttttttttttttgcattattaaaggtaaat

SEQ ID NO: 14115 - DNA, 3378 bp, Heterodera glycines
aggtctagtccagtgaaatctatgggcttttcgtgtttagcttggccctggacctggattttttttttcgtagttgacctggcctggacttgtttcctggacaaaatccatgcaaatccaggtccaggaaaaaccaggttgccgtaaaatggcctgaaccttgatcgtatttaagcaaattttcaagaataataataaaagcaggcagaaacaaaacatcctggcttgtatcaatccgcatcagagggtaagacgcgcatagataattccgcgccgtggggtcgcgcacggcgaactcaaatttccgtcggtcacaaaaagtgcaaagaattaaagggaatcgcggatcgcggtcgcgctccatcactggtgcacataagtctttccgatttaaaatgggtccccgatcgttccgtcactgatttttgacgacaataccaaaacattaattattaaatggtgtaaatacgtaaaacttgcaatgagaataaaatgttttaactttgtaatgaatgcacttttggttactgtgctcgattattaggagcaacagcacaaatattcgcttcgccgaatttggagacggacaaaagcttaaagaaagggtggggggaggcgggggaatatctgtcaaataggctggaacagagtgtgactgactttctgactttgcccatccgtgaagcgaagcccattcacagcccatttagagtcagtcgaagccgtggtcagtcatccctccccccccccccccccgaaggggcgttgaggtcggacggggattagtttctcccgaagggcgtggtgggagtagctccgccctttgggctgtgtttattcgcgacaaaaaatggcaccaaaatgtcgggaaagcgcccccggggggaggcggaagttgtaaatgcggtggcgcaccgcctccgctcaaaatggcggtgcttaacggcgccaataaggttggtagacaaaaggctgaggtttcgcctgttggcgattgacatttcattgtgggcatttaaatttgaaaaaataaaaaaaatgaatacggtagcaaaaagacgacaaattccgaagttggcatcatttcgtttcgactaaatcgttgtgacaaaatctctttgcagcaaaaggtgggagacaaaatgtcactatggataatgtgaaacgaatccatcgaattgaaaatgcgacttcccttttttggaagggtgtgccgccatttgactcattaattagaattaatgacctacaatttgcaattatcccacaaagcccaagagaaagaacaaattcaagcaaattctaataacaaatgatcaaaagaatgcaaatgctttcttctctcttttttgaaatttcctaacaaaattcaaactcatctcttgggacaattttccggtgatgccactccatttgcccttactcccacatttaatggaaatgaacaaaatggcacggcacttcctcgtcccctccggggcttccgcctccccctcccctctcccttcttttgccatcacacgacggtgcgcatttcgatgccaggctaatctccgttaatgccacgaccactctcagatgattagccaagtgatatatggggaagggattggcccgtgaataaacagtggcacacttccatttcctgatttggcggaattacaaaatgatgccaaccatcaaaaaattttaaaaaaactcagaaaaaattatgtctaaaagggaagggctaattttcaattcttttttcctttcggcgtgtaaaaattcaattggcactgtttaaaatgcgcaacttctcattcgcttctgccgcgtgtatcggactgaatgcgcttatttctcagccaccacccacgcgctaattccccgggggggggggggggggggggctctgtccggagcacggattaatgttgatattttccgcatccaaaatgctaaggacgaaagcgatgaatgaatgcctcgggtggaaaagaattttgcgcatttcccaccagcccagcgtgaaaactgaccaaataggaaggaattgacttaaacgtgggcatttaaaagaagcgatgatggaagggagaaggcgaatttaataagcgaaagatgcatttgaatcatccaaaacatttggcattaaagcgaaaaataaacaacaaacatttttatggaatcacagcaaataaaagtaattaattaaaagtttttgtggaagctagtcgttatgttagaccaggattagtggaaaattgtattcgcgcagctaagctcatcatcactcactcccattatccccatactgttcccgctaactgtctttcccccattatccccatactgtaccaactaacttcttcacccattatcgccatactgtacccggtgacggtctttttcccattaccccaatactgtacccactaacgtcctcttccatttcccccttactgtacccgctaactgtcttttatcattgtgaatctttcaaaagtcctttttttctctgccttccctcttgcattgttcttttagtacttcaaaaatgccctctcgttcattcattgtcagcctccgagtgggcttcgaaaaggtaattatgcgcacagagtatgtcgttttcagcagaagggagggaccgattatttatacatttggggggggggggaatgacgagttgcagcagattaacctttgtgaagggcgcttcttcagcggagattagccaaaagatggccggaagaatggcaccacaaaaacaaaaagccaaaagaggagaagcagcgaatgagtgaatgagtcgaccgaaccgaatttggaaaaaacctaaggcaactcgaagcgtcattcatttaccagagatttgtcaaatgtttatttccaatttgctaaagtctcaatgatcccgccggattaaccttccaagtgcctgttaattcggtgtcccccgagtgccgtcgggacttcctcccgctcccctccccccgtcctttcctttctttcttcttcgtgttgctgctgctgatgggctcactggttggggtggctggtggtaattgatagtttgctgtttctttcttctcttatttcttcttcctcccgtcgagtgaccctccaaaatgcataattctcgcgcagaacggagacgaaattaacagacgcacaaagaaaaagacacatggcaaaacagaaggaagagaaagagccaacggacgaaaaacactgatttatttgccaatgatggcaacaatttaaatatgaattaggtattttaacaatgactaattaattgcctgtggctatgctctcttccattaagcatcgttcatttttctctctttctgacgtccctttccattgcgctctctctcgtcttccctctct

SEQ ID NO: 14116 - DNA, 3871 bp, Heterodera glycines
caaagaattaattaggcaaaaaaaaagtgggggggggggagggagagacttaggggggcaaatgtaaaaacgaggtgcgcttcatcccatccatcgacgagtgagagaaaatgccattccaatgcgttttacccattctgccgtagaaaatgaaatgactgccaatggcataaaaaaacgggaattcgactccgtgttttgccaaattgaccctccaggggaggaaagtcggtgatgcctttgtgagtgtcagtcaattagcccacgtaagtaaattgatattttaaaatttccattaaaatgtgatgggaaattcctcttttccttccctggtttttttattggctttcccttgtatcgatgcctttaaacccctcggggaaaagcaatgctgtctttgcgcctcaattagccaccgtttaacccttcccccatatttggcttaatgccatcgatctgccccttctctctcatttagctcccctaattgcccccatgcctttgccaattcaattagcatcgtttatcgcccccatttgctggttatttgggttatttgctctcccttccttgcttactcaaatgccattatcgctttgtgtttgttttaggtattcacctgtgccgtctgtcccagacaattcatttgcacactcatctttgtctcgtgcgatctctgcagattttttgttttgtctgtgtcaccgtaattttggataaatttaatggaaaaatactgtataaaatttaaaataattgatcgatcgattcatagggcacagattcgtttttgtttaatatgcaatggaatggcacggcaaaagtgcaaacaaaaaaaggggggggggcaaagggaaccgcccacttcggcgccggccttttcggcgccgttgctaacaacttttttcctgatcaaccaaattaaaaatttttgttatcattcgatagctcttcagattctctattagtctgtaaaatttcaaaaaatttcgtcagtttacaaaaaagttatggccaaaaaacctcaaaaattaactttttcttggctttttcggcgccgcgtggcataacttttttatttttgaatcattcatttctatttttacatgtaaatatagagcacacatagagctttcaaatgatgccagattggctaaagctaactgacaaataaaaaagttatagcatttcaaaatttgcggcgccgaaatggtacgcgccgaagtgaccccgacccggggcaaaggatagcaaaggcagcggcaaagttttggccgcattggcccattttttgccccttcctttcgccgtggttggaatccgtcaacaaagtcatctgtttggtaatggttgtaaatggccgccctctcaatgcatcgattttcgccggaagagaattgttttttaaaaaaaaaaaagggtggagggataattaaaatggccgaacgaaaaaatgccgtgccgaaaaatccaaatgataaacaaacaaaaaaattaatgaaaaataaatttgagcccggttcgctgaccaaacaaagaacaaattcaattgaactaattgaagagaaagcgctttttggggttttgtgtaaataaaaatgattttgtaacaaattttatttatttttttaatccattaggtttggaagcgtggtgagtcgaagcgacaaaaattgcctatttcatattgttagacaaatttaaggcgaatcaattgacgaagctattagtgatcaattaagatctgctgatgtttacgaaagaacatcaaatccggagatatttgtttaaatttaaatcaaattattttgcgaaaattttttaaaatctctcttaagcttttagcccatttaaaatgcgatatgaattttctgagttctgagattaaaaccgattccccctgcaatgttaatccaagaaaattttcgacttcaattttatgagccgatcagaagagaagtgaggcaatggaaatggccatttaacagcgcaaaatataaaaattcataattcggatttactaaaaaaataccaaattcatttttcaccaattttagcattcgctgattgtcaccaacactgacgtggactcactttgtgcaacaaatattctcactgtaataaacacattttccattccattttttaaacacccggccaactttgtctttttgtgctatttgcgaaaataatttcaattaacattttttgacccaaaacgcgaccatttatgaggatattatgataaattaaaagacaatcccgaggaaaaacttcaaaattaaccctccgcgaatgattttagcacattttctcttgtgacgatgcctcatacactctcagtccggtggactccttcccgacgttggagaaggcaatcaacgaccatgtcagacaggccaagaacattgtgctggttaattgcatcggctcgcggtctgtcagcgaattgagcattgcccgactgacggacgaagtcacaaaaaatatgaaatttttaataaaatgatccatctttaggtgacattttgggtgttggagtcgcggagaccgctcaatttggaggacatttacaacgcgaactctgtgcgcgtgttggccccagcagcggaagttgcggaatggacactgcccgaagcgagtgccatttttgaaacaatggtggagcaggaggacgaagacgacgacgacgaagcgagcgacggggacgaggaaaaccgaccgccgtcggtgggcgacggggaaaaaagtccatttaagaaacaaatagctgagctaaaaaaaaaatagcaaaattcggtgatttttcaaaatcttaccgaggaaaaattggggccttatttgaatagtggtggtgtttatgacttatgaaggcgtaaatttaggacgaccgcgaagaagcggaggacggagaagcggcgatggcgggcgattccgagtgagtttttacaggaattttaaatttataattccacaatggtctccgagtggttttttggttagccatttggttttgcattgaaatatttacaaaagttagcatacataaaaagggggtttggtcggaaaaattttttgcgaaggggggtcgggccgcccgatgacctttttttcaaaaaccgtttttttcggcgcggtttttccaaaaaattttcgggaacagggagcgggccggcggtgccgataggcgccgccggggaaaattttttgaagttttgggtgtgctttgttaacagattttcaccaaaaatggccaatttttgcgattttaagccaattttttaagaaaaatttggatttttggggtccggcggtgccgctaggcgccgccggaaaaattttttttgatttttaatgaatttgttaagaaaatttccaaaatttgcgaccccccattcgctgcgaacccccccccccccaaaaaaaatgtgaacaatggaatagaaaaagttttctcaaatataaaaaaatactaattattattttgcattcgtgggaggaaggcaaaataaaatttgaggaaatgaaatttctaaaacaaaaccttgaaccttcggttaaaaaaaacgaaaaatttagtgcttttataaaatttctaaaattaagtttcggaaaaaatccgcgttttttggacctgccaaacgcagtccaaaaagcagaggaacaccggcgcttcgtacgggcccgtctgagcgccggtggcgaacgccgagtgagcgcagcgcaatgagaacggatggccggccatcagccactcgtgctcaatcagcgattggaagccacggaccttcagaaaaaacaacaaacaattaaacaaatcgacatgacaattattaatattttatcgaaaaaaattaaaaaagaaattaaa

SEQ ID NO: 14117 - DNA, 4505 bp, Heterodera glycines
gcgttcttcatttgcttgatgtgaacctcattcaacttaaaaagaaattaccaaaaaacagaggaatcaaaacctttgtacgcctaacgcttgtacaacgtggagtgttcgcacccgcagcaaaaagcgtcggcgctgacttccgacgccgagtatctgtgactttttgttgaaaaattatgggaaaattgactcaaaatacctgcaacgctttcaacgtcgcttgcatcctctcgttgctgtaccgtgtgctgagttgcattgttttgcgtacccacgtttgaactgtgacgggttcttttatttgaagagcctggcaattgtttaatatatattgttttagttttaattttgcttaaatcaagacctccaataatgcttaaggcctgtaatccagtggtggtcggagtcgaaacaacacaggtgcccagatccattggggacgtacccacagcaggttcaacagcaccccgtggctgactgcattgtgctcggatattggttgaggttgatggcactacaaataggtattaaattctcatgaaataaaaacaaataatggagaccattgccgaggtcctgaataggactggtggctgctgtgctggccaatgaatcctgtgaaggaatcgaagccgcacccgcaacactgtcagcttttcccagacgtgaagatgtttcacgtcggagcattctctctcgtcgtccagttaacgttctctttcgaggcatttagtatttttgaaataattgctaaataatctaaagcaaaaaaagtatatgttacgaaacagaaggggagggtgtattgtttctcagcaaatggagcgaatgaaggggagggaacggtgctagcttcttttatataaaaactaaaaaaaataaaaaggtcgtaaactgtaacaatgaaaaaattggagcgaacatatatttgtttggtcaaagtgaactgacaaacgcactaaatcagagtccttttatactctttacgtgtttctctgcgtaggaaagaacacgctgaaaagtgaagccagtgaaaaatgcaagcacgcagggacctctaggtctcaatatgctgggacctgtgtgcaggcacgcagggatattgttcatagtaatttttcaaattataattaggtatgcaattaatgcttaaatattttgtgtccaattcctttaaagaattttattttttcaatatttatcatttaaatgttaagttttttgaggttagaaaataaaataaattttcattgtactaaataaaaaatttgtttttcagaaatggggaattaagcattgagaactcaaaaatcttaaagtaattattttcagtgaaaatattaaagaaatacaaaaatagttaaattacttaaaaaaattaatgaattttacatatgaattttatatataattttcactgttgaatttttgtatatttatgcaaaataattatgaataaatctccatcatatagaaattttaaaatatgcataaatttatcctaatatatttttatgacttttaaccataatacgaaattgccgaaatgttgaaactgtcaaaagatatgatgctacgacattagaaagaagatgcaataatgtacactacaaaaaaaaatgcaataatggtcaattcaaaaaagggacaatattggtcaatacaaaaaaagaaaagaaaataattaaaaatacagtagtctttcgcatatcagagattatgttatataaacgaaaatttcatttcgcataattcagattaaacacgaataactttttttaaagacaatataaaaatctggaaaaattcatgccagtataacttttgatgctgatcaaaaaataataataattgtaaccacggtaattagatcactcttacagggtgatcgggagtgatctaaattttaacaccccagcaggtaacttgagttttctctagcaattttctaaaattttaaaactgcaccaaatcaacatgataattatgtaaaaatatcccacagtcattttttaaaattttgtttatataattagatagcccaaagatttctctacaaatagttaaattcccaaaaattttcttcaatttaaaaaagttagggttaaaattattgagtctaagtttttcgagctattaagttacaacttcttgtaaatttttgctaaacttttaaaaattacttaagttgtagaggatatgtagagctacattataatatcaagacatttatcacttcgtcttagcacctaattacacaaaagcaaccaaaatttagattatttttctcaaaaactattcattatttttttattaaattaaatgatttattaattaataaaattctttatttttttcggcctgtattatgatatccttttattggtttttttgtttaaatttattttgtctttttcaagcgtgtttttaatgttttcttttatttaattttgatatttttaaaatcttagaattttcgacattttttttgctcatttacttttaggtaatataagaaatgttttttagtcgaattcacattttatgaatgattcgaaaagctaattagttgcgcaagcacaaaatgataaaacaaattattgtactcattttatttatttagttttttaacattcttcatttgtgacattatttagacaaaaaataaaggatttgaaataattcagtttggcatgaatttaatttattttaatatatcacaaataaaccttgagatctgaaatcgctttttgttcgtctcttcttgactaatcaactatttatcaattatttaattaattaattgtcactatttttatatgattaaaatgtttctatttggtaaatatcggtcatatggccggagactaaaatggtcaaaatatatagctctcggtctgtaatgaaagaatccaaaagaattttttgcggcaacaatccctgaagagttacagacccggggctgaaatggccaaatacctttgggactgaaccgtccaactagtaaaaacacatgaaattgcgacaaaatatatgccaatcgcttcctttcggcatgtaacccccgaatccgaaagaatttttggatgaaaaataaatttaccaaagttttaggtcctcaaaaacctccgaaatttactttgatataaaaaccaatttaagtgagccaaaaaaacgctcaagaacacttgcatctttcgaacttcgcaaaagggagcatgcgaagcagggctgcatgcaatcacggattacggattacggaaattacggggttttgggagttatggattacgggttacggatttttgggatttttccgtaattttgatccgtaatttgacttttggattattttttcgagacgatttcttgtacgattatttttataaaaaacaaatttttctattttttgtttaaagggctacccgtatttcgatttatttaagaattaaatagatttataattttttatttgttgttgttaaggctatttgggtagttcgcctagaaaatagaggcatcacttttttgtcacacctatttttcacgcattttatgaaaattcataaaaccttagccaggtgaggggaggaattcccccccttcccccgcccgaaatgaaaaattaaaaatttttacaggaaaaattgggacttttaaattttttttgtcgatttttcttaataaaatcattaaaatttaaaaaaaaatttgcccggcggcacctatcggcaccgccggaccacgatttactcgattttaccttatttttttaaattttgactacaaaatggcaaaaattagtctttttaaaaatggttacaattcctgtttttgctgtccagcgctgaacttttttaaataacactaaataaattttaccaaaaaaaattcttcggattcccccccccccctccgtaatttttttctggctattaaaatgttgaaataattatatacatatacataaatccgattataatgatcagactttcaaaaaattttcaaaaatcaacccataaattcaaaaagaatgatttaatcagacacaaaattataaattatttgtaaaatttaaataaaaaatgaagaaactccatcaagaaaatcagttttttgatttttattaatcactatttaaaaatttttttctaaaattctgacaaaaattgatttttaaaaattacggattacggattgcggattacgggaaattacggggtttttggacccccgtaattacggattacggatttccgtaactgagaaaatcgccgtaattacggattacggatttccgtaattgcaaatccagttgcgtgcagccctggagggggggggagagcgagagagagacaaaacaaagggaaatgggataaaaaacaaggagataaaacgggagaaggtacataaaagagagaggcaaaaaaaagagcggaaacggaaagaactgaattttctaaagacatgaattttaaaaaaataaaaaaagagagagagag

SEQ ID NO: 14118 - DNA, 4025 bp, Heterodera glycines
aaaacaaggaaacttcaattgacatccatccatttgctggaagggacaccccaatcactctgtcaaattccaacgctcacaaactcccaattccgatcactaattgcgtaattatgggcggacatcgccccttccgcgactaattaacgccctccctttattaactcctcggagcgctttgctcacatgtcggactgtggcagcagacaaatgggagagagtaacaaaaacaacactaacaactgacgcctgtcgcatcgcaggccttttttgtcgtttgcaccgcatttagccctcgtgttaaaaagtcaattttataaaccgaacattcatacacaaaaacaggagtaaatatagagtcatcagcaaaaaccattgaaaaagattttcaaaatatcatttgcgtccatttggatgtttgtggccctaaagagggccgtttgggataattttggtttcatttcatcgcagtcacatcatcactttgacgaggtgtacttcgtcaccgccttggtcccctccgacacggcgtgcttggccaactcgccgaggcagaatcagacggacggccgtttggatttcgcgcgaagagatggtcgatcgcttgttgtagtgggccagacgagaggcttccgcggcaatgcgctcgaaaacgtcgttgacgaacctgacaagcaaaattcgtgagtgatcgttaacttttgaaaatgtcttacgagttcatgatggacatcgccttggaggagatgccggtgtccgggtgaacctgcttcagcacgcggtagatgtacaccttggaaggggacaagaataccgtaagtactttttttgggtcggggtcacttcggatatgattatatattattctttcatattgacatgtttttaatttaatttagttttattttatttatcgagcaagccacatgtgcattagcgatcttatatggagcctaaaataaacaaacaaataaaaatgatcaaataaaaaatacgaaaaattgactgaggcctcatacagtggaaggtttccagtttccaacaacatttgaccaaatttttcattttgtgtgaattttgcccataaaattgggcgtatgacattttctcgaaccctattccatacatactgatcaaaaattttgggattttcttcaaaggacttatattggtccatctctttgtcagtaatctttttaaattcacttggttcagtaattccatctttgaatttaatttttttttgccaaattaaaatagccaaaaaacgaggccttctcaaagcagtatttttgttccacattgtcccatttaaagccatccatcataaaagaagacggatgaaaatttgaaaaaacaaaatttttcccgaaaaagaaagctccttttttgcctgaaggtgaacttaaaacaattggtttccaatgtggctgataaatttccttattttcatttttgaaaaatgttttgacccccaacggttccgtgtttgtagtttcacatttcgaatttacccaaaatttggttcgttttgtgcacaaagggccttcaaaaatgtctccttcttcataatttgattctggagattgagactttcgttttactcccaataccacaaagggatcaaatttttctgattggatttttccaaaattttcaccttttttggcatttccggagttgggaagaacattttagttgttgttgttggcaaatatgatgaaaaatgtggcgccacaaacgaattgtatgaatggcttcccgcggcctgcactctgtgaccgtctcccaattggttccaattcactctaggtgcgtttgttgaagctgtctcgtgccatctttgttcgccccttttctcaattggcattccaatttgttccaattttgtcaataaattgtcaatattttcttcttctggcactcgaacaatggccggaaaccttttcttcataacgtgaattggcactcctttggggacaacccaaatacaaagcagttcataacatatttcttcaacttttgttagaactgccaacagttcagcgtccatcgtttctctccaaatcactatgcattgtgtaatcgtgccaatttcgatttctgtgccaattgtatttttgtcccactttctcggtcgaaaaaccatcgccttcatttccttcttcctcattatttgcctcagttcgatttccacttgattatccacaataaaaaccaaaattgaccgtgccaccacttttggaatgttttctggcacataattccgagtttttggtttttgagaatcccccaacaaatcctcaggaattttgaattttttacttttttcctccaacggattttttccaaaatgttgttcatcctccaacggatttttcagcaaattttgctgatcctccaacgaatcttttccaaaattttgttgatcctccaacggatctttttggcaatttggactgttatctaataaattttcgaaatttggtggatcctccaacggatctttttggcaatttgaatgttttttggcttccgaaattttgtcattatttttgctgctttgaaccgagactttcatctcgaaattctcatccgccgaatacatcagttcatcatcactgctttggctgtcgctcattctgtcagaataatgatatgaataatgagtaaaaatattattatttaaaattaaagtatcaatatattttttttaatattttaaataaataaataaatttgattttattaatagattatataatatttaattaaattatctaaaattatagctattcttcgccttcatcctctatttctaagggatataataattttgtgggtctttccgccattcggtttcctatttttaatttaacagttctatcagaaagaatttcgaaaatttttcctaatttccacattgatcttggataattatcctggtctctcacgattactacttgtccgatttttgggtatttatttccatctttatttttgttaatgtgcttttctcttaacgataataagtatttttcactccattccttccaaaatatttcacttttaaaaattgcctttttgtaaatttcaaataattcttctcttttagttttcttttcaaaatattcatttatgtcttcccgatcaaatgtcggatctaatttcaatgagaaaggttctccatccgtcggatttaatatatcgattggccttaatggttcaatcacttcatcttgggttatatagcttaaagggcgttcgtttacaatcctctcgacttcgattaaatatgtcattaattcttcaaaactcaataaccgttttcctaaactccgaattaaatgtgtcttaacaagtcctatcattctctcgtaagctcccccgcgccaactcgcatatggcgaattaaattgccaatcaattcccaaatttgatgaaaaattttgtatcgtaggatcacgataaatttctgaccatattctattttgtttattttcttcaagtgctatttgttttaatgctttacttgctaatacaaaatttgtaccattatcggaaataattaattttggcactcttcttcttttaatgaatcgccgaaatgctaaaagaaatttttcggcacttacatcggaaactaactccaaatgaattgctcttacaattaaacatgtaaatattgctccccaacattttttattgccatccaaagtttttacggagaggggtccaaaataatcaattccaacatgttcaaatgcacttttcccttttactctaaacactggtagaggagggtttttaggatatgtatatttattatttgtaaattttgcacaaatcccgcatttttctttgttttttctttttaatatttcataaattttccttctgcttttaggaatccaaaaattttctctcaatttgctattcaccaattcgcgaccgccatgcattgtcttcaaatgtgcatctctaatgaataaagtcgcaatatatgaattatttggaatgaaaat

SEQ ID NO: 14119 - DNA, 2885 bp, Heterodera glycines
ccgtatttataatttaataatgcaatagattctccccgatgtgaagaagatgatcagttccgcctgaatgaagggcacacgacacaatgatctttgtttagatttttagacaaatttgcttgttttgaaatatatttttatcacatcttgctggcattttcatttttctgaaataaaaattggacactgaaactgaaaactatgtttttaaagtcattttatcaaaatatcttcgtgggaattcactgttttcgtaaaccttaactttagtaaaatgtgtgaaccaattggggtgagtgttttttgtttatgatttagttttgtcatggtttagaataataatgatgtttccgcatcacaacatttccctggtgccagtggttccggcggtttgacgtcagttagccccctcgaacctttggatccgacaaagtttcgtaacataatggtcgagaagcatgaggtcccttcagcattcggcaatttttgtgacaatagcgaaatgagtaatgcgtgaaatggaagatgtcctcattttgtcttttaaacagcttccgatttggtttctctgggccagcagcagcagtcgtccactgggccttttctgcatccgtgtttccctccagcagctgtgtccgctttacatcagtcaaatccacaacccttcaaagtccaacagtcgccatcgattggccaacagcagcagcaacaactgtactttgttcagcaaagtatcatcaaaaacatgttgtgtgagactaactgactctatgcctttgtttcgcagatgcccaaggcaacttcggtccaatgcattcgtcttcatccacctccccgctgtttggtgtgagacagatgagttactttggccccggtggtgcttccgttcaaccaaactggaaccagcagcgtcaagtgatcataaaaatggctcctaatatgactctggcaaacaaaaaatctttaaggcccaatatattaataaccctcaacttggtcagcaaaacaacataatgtcacctcctaagcaacaacaacaatttgtcgttgcaaattgtaagccttcgcagccgtgccaaatcagctcttttcccgctgacgttgtccaacaacaacaacaaacgatcggttttcctccgccaccttctcaatcgcttcagaactctccccctgttgccactaaacaagaactaaaccaacaccaataccaccagcaaatgcttgttcagcaacaacaacaacaaaggtacgctacttcatatacccaacaacagtttctgtcacaaccgaaccctactgcatttccgatggggtcaaattacggcgttgtggaccatcgacaatttatgagccagccatgttcaattccttcaggtaccagctgacaatgagtaattttttgccatttatcgagttttgttaccattcaagaaaatgtgcaaaatgacccgtcggcgcaacaacaggtggccgtccaccagttaaagaagactcaatccatgctttttaccgctccttctgatatgactcatcaacaacagttcggctgtggcaacccatcaagtaattgcttttgggtcgtctcaatattttcgaatcataaaaagttttgaagaaaaatttaaacttttcattaaattagtccaattttttgattaattatttattttttgataactaaaaagggcttagaaagacggagaccgcttaatttgatgattgattagtgagaaaatattgtcatagaataagtgctgtgccaaggtaatttgcacatacctttatgtctaaaatctcctcaaaattctaaacttagataagccgaatcaaacaaatttgattttcactgaaagaaactgttcgaattttagaataacaaaacttattgttagcaataaaaaatttctaatgataataattattgggtgacctaacatttttgcccacgctttaggcgtcacttttccttctccttctgcgtctttcgtccatccgtcgccctcccaagatttttctgtggttcgaactcaccataaacaccaacaaccgatggttcgtcttccgccttctcaacaaactccgcatgctcatctcatgcatcaaatatcctcccaatctcttcaatttttcgggcacgatccgcttttagctgccactctcaatcctgatatctgtttggccggctgtgtctttcttttaatcgacgactgtgacccgcatttggttgacttgtacgtcattggttgctcctccgtaaaatcttccatttcagcactttactgccgagtattattcgcttttacgggggttggtggttctttttagactgtttcaattatcatggttaatatatttttaggcgacgtcgaatcgaacaatccccgtggcattcctgaggtagattgcctgctttataaatgatcagttttgcttgttttagcgtgttacgcacatcatttgttcaaattgggtagaaaatgaggcgctgattttacaggcgctgacgactgtttgttattttttgtcgaatagttttgaaaattatgtaagttcagaatttcgccgaacggatgccacgcaaaatgaaaaggatcgtttccctcaattggcttaacgacgcaattgcaaagagacaagtgactgcgccaagtaaagcttgccatttgccgaggtaatcaattttttgtttatacaatttgccgttttttttttgttaatagcatttggagttcaacacgatacaatccaaaaacatttgcaaaagtaagtggatttcactagcatataactataagcaaaacaattggtgtggagaagtttccgaaacgtcgtcggctgaaacgtcatcgtgacaaaacgtcgttgtgccgaaaaattcccaaaaa

SEQ ID NO: 14120 - DNA, 3576 bp, Heterodera glycines
  misc_feature (3549)..(3549): n is a, c, g, or t
aatttaaatcttcaaacaagcaaattacatttcttctgctttgtaagatgcacactttaattttgtttatgagaaaaaccgaatattattagttgttcttaaaaccaaattgctatcaaaaagaataataaactgaaaatataagcaataaaacaattttcttttgacttgtccatttcaggtgccggcagcaacatcagcaactctgtaagaccttttttctgttgaaaatgtgttcgattatactttttaccttctgctgctgttcagctgagtatctgcacaaatgttgtgtggatcctgagaaacagtacaaaatggtgaagcggaatacggtaattgtaaaggggcggagtcgttatttaaaaaaccatgattatgaaattcttgtcgaaaaattatttataattttgctccaaagcaatcaaatttttaattcttgatatgattgatagctctaagtgtttctcatgaatgataacaatgattaaaaatttagtgcttttgagcaaattaataagcaaaaaaattcattttgatggtttttaaaataacgcacataatgatggtttttaaatatgacataacaccattgtaaagattcaatctaaatttatttaaatcataatttctaggaagatttggtaaatgaactcaggaagaaggatgagtgtgccggcaaaaacagaaaatgtttttgctgggcacatacgaagatttactcggaatctgctggcggctggtgttaaatttttgtgctgtgacaagtcattatgttcttgttgtgaaacggttggcatggataatggctttaatttgattaattaatgagaatttatttttcatttacttaaattggtcataaatttttctttaaactggaatgaaaaaaatttaaccgaagatttgggacaacattttttaagtaaatgtttagtgtccaccaatgcagaacaacactgataggaaaaaataaaagaccagaagctaaaaacttatattttttgaaattttcttcaaaaaatctaaaaatattgaaaattcaaatttggattttttttggaatttttgctttaacagcaagcacgtgaaaaccttttaaaaagctttattaaacattagaatttatatagagaaatttctttaatattatatagattttcagtcactaattgcgccaaaatttgatgtcatttaggacataaaactagccaaattggaccaataacgaaaaaattctgtagaaatttaggttgagaattggccttatgaatttctgcatcagttgttgagaacgagtttttaagaaaataaaaaatttattaataaaattttgaagccaaactcagagaatgcccacgacattttctatttgtatggatgccgaatcggcggctgttcttcggcccttcctgaacttgaattcgttggccaattgtcaatgcggatgggccaaatgcgtgaatgggtggcgagtggctgctgtccggtcggtacagcttcaacaatgttgtgtcacgggtaaataaaattctattgaataaaagaaatatttaatttttaaaaatttttaaatgcaaaaaattatttaatgtttctttttttgaaaaggctattccaaattcatttatcgttttaatgaaaaaatatataaaaataatttgacgggcaaactgctatagagtgattgattaatttattcagcgaaagccgatttctgttttcaattgaatgccgtcgagccctttaacaaatcggaagtgccaaataaaatatattgattttaattattatttttttaatatccatattgattttaatttctttatcaacattctcacatacaaatgccaaattttcttatttttggatttgctaattaggagtatttaattattgttattcatttatttctcttcatctctacttcatttttatttttattttattgaattaattttagaagaataaatgctggtgcagaaataattattggttttgagagagtggtgttgctggctgatcaaaggcgtagccagaccttggattcagggggggcggggctaagtaaaaaattcgatttttagggatgtatttttgttttttgaaaccaaaattgggtgcaatttatgaaaattgcttaaaattacaaaaaatttactgcaaattttattcctttaattttgtacccgtctaagaataatttatgcattaaaaagaatttttctaaaccgagactttgcccgagattataaagaaaattaaagcagcgtttatagggttttgcgaaaataatagagaaatttcaaaatatcatttctgattctttggcgcacttcctgtgaaacaaatgaatatcttcctcaagtcaaccatattcaacacattattgctatcatttggtaacaataatttatgatttatgtataatttccaacagcaaaatttatcaaaaaaatttctctaagtatgcataataccgaaaatgcttgaataattaaaaaaatattaaataaaaatgtagtttttttcaaaatatttaattttttttaaagattattgctatatttaatattttggtaatcaaattatactaagcatttgaaatttggttgcttatgtgatgttataactaattatgaaagtctttacaaaaatacaaaataactgtttttatttttttctccatttttattttggtcattagctcaattagtagttattgttaaaaatcaagaattttttaaaaatgaaaatgagaataacaaacacttttgactccaaagacctaaaatttatgaaatgaaaagcaatttcctttaggtcattaaaaatatttttttccattcattttgtcagaaaatatggacgtgaaaaaatggatttattttatttttttttttggtattttatagacaatgaatatccttttttaagtaaataagggtaaattttgaacgacttatgtactatgaaaaaaaggcaaatccgtaccctttttttgcggctatcttacctttgcttattcgttctttgtctcatttgccgccttttttattagagcaaaggctagaaaaattcaattaaataaagacttggtaattttaacataaattcgttgacttatatttgaatgtttcatttttgatggtgtacagcagggatggcaattggaggttccaaaaatttttggaaatagaaattctcaccccaaaaatatcaaaaaccgtaattccgtgtaatttttatattttaaacatttggatgaatgactaaaataactatttttaattataaaaacatgtaatctaaaggattcattgaagaaaaattcactttgtttcatttaaataatgcacttttctttgtattttcatttcattattaaaacctttttacgcattggcaaataaatttatttaataaattattttaaaagccaatttattcgatatttttatttaaaattctttataaaatggaaaattttttgttcatctgtttattattctgtgcaaacttcggttattttttattttataattccanacggtcattttgaagtgattcttgagc

SEQ ID NO: 14121 - DNA, 3310 bp, Heterodera glycines
attgttgtgccgttcacattgatcggtgcttcccaccgatttgatgaatggacggaattgatgtaagccgcgcttagcatcaccgtatttgtgttgaaatttctgcccttattttggtgaaatgctcgaattttgtcgcattgccgatcgatgtggcctctgcgattgcatttgctgcatatattttccttctttgggcaatcctgtgcccaatgcaattctccgcaacgatagcagttgctcggcggtattttggcctttgatttgcccgtgaatttttgatttgggcgaccgtttccgcgattttggtgcttatttggcgatgatttgccatgctgaattgcgtttattttgggctttggctgctccaaaatttttgcttccgcctccgtttttagctgtgtatttaagtcctcgacgactttgtcgaataatttggacgtttttgtcgtctttgtgccctctgctgtgagacgcgcgaggatatgttggcgtaattttgcgtcgcttggtgacttaagcgacgtaagaagaaccaggcatttgaattcctcttcgtttaattccgaaaaacggaatttgcggagggctgccttaagtcggttcacaaaaatttcgaatttttcgccgttctcgcggcacactcgcaggcattcatagcgattaatcgctaaagatggcggatgtgagaacaatttaataagacgagatttggtgtccgtgaagttgaatttggtgatttcctccggcagacagtagcgcttgtattcgccgaaggcggccggattgagctttgtcatcaacaatttgactttcgcttcatccgccatattggccgctgcgcaatccaatgcgaattggaatcgctccaaccactcctcgaattcctccacattttctgttgaaaacggatgaatatccggcaatgtgatgttttgtgccggtggagttgtggtggatgtcggcgcgctctgctgtttgatcgcttgcgttaatttttccaaaatttccgcgagcgttttgtccattgttgatttggaggatggactttagacgaagaaactgcacatagcagaaccgcacacaagattagtgattggttttttgaagatttctgcgaaatccaaaaatcaacacgagatttttgaatttccacaattcgaacaatttcaacacgagaaaatgttcgaagtgaagtcctgaagaacgggcgtcgccaatgttgagccggttaattgctcaaacaattatttgtgaatgtcgaacaccaaaatatttatttaacacaaatggaaaaataatacaaaaaatatttgtcggagggacgaagcaaattggggagcaccaaataagaaggaaatataacagaatgaatgtgtgctggacgaagggaagggcaggaataaatggggaaaatcaatatggggtcaaagagcccaagagagggaattgcaaatatttgaattatttgcctctctaacacctccccttttaagtccaactgatcagtgccatgatcagtcacacataggacgatcggctggggtcgatttgaaggcggttaacaggccggcgatttcgaatcggataacggcggactggcggtgattgattggatggcgggacttctgccaaattttggtcccttaatggaattgggaggccaaaagtgccattgatcacatcgagcgggtcttcgatgtcctcatccggaatttgacgtgcgcggatttggttggcatgaaatcggccgcgagaattgtttggcaattcgacggtgtaaattacaccctttttgtcgatgattttgccgtgtcgccattccgctgaattgtgccgacgtgtgaaaaccaattgtccgatttaaaatgatcggaattttgcgccgtgtttgcgattgaattggtcctccattttatcgtccttgacaattggaattgacagcggaggccggaggaggtcgaggcctattcgaggctttcggccaagaaataattcggccgggcattttccatccagtgtgtctgatggcgttgtgcgatatgtgagaagaaaagtgtcgagcacattgccgtcgactccctccccttttattttcgcaaatgccctcttaaatgtgtcgaccatccgctcggcttgtccgtttgattgtggcatgtacggcaccgtaaaaatgtgatcaattccattcgatttgacgaaaccttcgaattggtgactttggaattgagtgccgttgtcggaaacaattgtttccgggatgccgtagtgcgcgatcaatgagcgcattttggatgcatttgtagaattcatttcaaatatctccggatattttgaaaatgagtcgacgacaatcaaatacatttttccatgaaatggtccggcgtaatcgatgtgaatgcgtttccatgggccatcagattttggccatgactgcagtgtcgtcttgattggatttttggcgactgctgcgcatgaagtgcatttttggacgaacgtttcgatttctgcgtccatcattggccagtagacatgcattcgggccaaagatttcattcgcttgactcccggatgtccttgatgagcagcttgagaatttgcttctgcagtgatttggggatgactgtccggtcgccgaacatcaggcagtccttgacgattgaaatttcgtcgcggcgccgaaaaaattgaatgaatttggcttcgtccagcccttcaattggctgaaaatttttaggtgctggccaaatatttttgacaaattgacgaatttgttgaagtgcctgatcatttgccgtttcttgggccaaatttttgaaggtgatcggcaattggttgacattgttgatcaaatttctgtccaatgccgattccacttcgaatgaggcaataatgacttcgtcgtcgtcggattttgacttttggacggaaattaggcgagataatgcatctgcctgtccaaacttgtccgttttgacgtattgaatttcgaaatcgtaggccgtcaaaataagtgaccagcggacgagacgattgtgcgaatgcttcgggacaccgtctttattgccgaaaattttcttcagcggctggtgatccgtcagcaatgtgaattttctgccgaaaatcatcttatggaagcgtttgactgcttccacgagtgctagggcttctttttcgatttgcccgtaattttgctcagccggtgtaagtgaacgcgaaaagtgcgacatggcttttattgagccattggcaaatttgtgtgatatgacgccgccgatgccatgttgtgaagcgtcggctgcgacgatga

SEQ ID NO: 14122 - DNA, 3615 bp, Heterodera glycines
ttttgttttcttaaaagactgtccaatgcgtgccaaacaaacatttccttgatcattcacgaaagtttgcggttatgaaaacgcattggtagaaaatgggacaaaaatgccacattttctttgtttggaatttcaatttatgccatgttttacaacgaaattctttgttaaattttggccaaagaccatcgaattccgcaaaggttaatggcaaaaagcagttttaaaaaatggcattttttggagactgttccaagttttattggcttaccatggccaaatgtgggcggcatgttgcgccccaacggtccgtccaccatttgcggctcccacatcattccggcacccatcagctgttgctgctgcatttgctgacggcgaatttgtcgctgggcctccagacggtccaactcctcctggcgatgcagcaattctggaaaaaaacaataaacaaattgatcggacgggacactaccattaaataattgcagcaggcattaaattccaattttctcgcaattttccaaattttaggggcaaattaaatcttttgagcatggaaaaataatttaaaaaacttttcattattttcctccatcattttttggtatgaattgttcattttggtactcattgtcagatgggtgagtgagtgagtacacatgcggcaacctaactcattaagtgcattcgagtgattcaaatttgtccagatttgaccgttttatggccaattttctttattttcgagtttaaagcaggtttaatcgcttcggatcaaccaacttctttcgcccctatgtggatttggctcatcaagagctttcgattgataacacatttatcctggtcccacccaccctataaactcacattagcccctagttttttcacgaattattttatcccacccgcccccttcaccttcgcgcaacatttgcgccttgtaatcctcgtattccgcctccatgtccgcgtccaagcggcggcgttgctcgcgcagttccgcctccacttccgcgcgccgcttgcgctcaaactcgtacaagtccttccatcggcgcccgtagatgtactcgaagctgttcatttgcgcaaaacgggggcccaactcacgttcccttaatcacacaaatgtgaaacataattaataaattatattgggataggacaaaaacttaatttaatttaaatataaaaattgggcattttaaatggggcaaaataatagaatttggtataaaatttagtttttttttttttagtttttttcgaatttatccccacaaatttgctcacttgtacaggtatggcgttcgctgaattgtcttctcacataatccatcttcgtcgtccttttggtccaaaaaatcggcttgcaatggacgcgaattactgcaaaacaaagcagagacatcaaaatatgtaattctaattaaggtctcaaaaatattaatttttttggaggggggggggggggggtcgatcgggcgaaagcagagaatttcctaatgaagaatatttacggtgttgcaaaaaaaaaaaagttttttttttaaaattttaattcatctttgtcaatataatttccaattacataaatggtagaattgcatggacagcgccaacacagcccccgtttacccgccaaaatttttttttaagttgtaatattttaatttctatttaaatttctgagtttttttctagtaaaaaaaatatgtgaattgtaaaggttcttcaagtttttcatcattttatataattttcaatgaaaaattttagcgttttcgaaaaatttttttttgttgatatttttactcaagattcggaggagacaagaatataatgcatccaaaatgcacaattttccccccgtaaataaaaacgaacgtcgtcatgaggaagacgcgctcgcggatctgcgcgatggcctcctgggcggacactttgcgctcaaactcgacaatgccttcgccggtggaccgccccttctcgtccacaatgtgaatggcacgctcgacatcgccgaaggcggagaaggagagcataagcatttcgttggacactgccggggacagttccttgagctgcaaaaaaaaaagaaatttttttttgcgttttttgagagagggggggggggggtaaattttaacaaaccccggcccgacccgtttctcaaggtgtacatcgggagtaacccaaacgcagccgaactcaacccaaaaaaaaacaacgaattttgaaaaattttgattttgaaagcaattctaaatcgcaatttacgagatggtatgcatcttttctatacaaaaacaaacaaagggttgaaaattttatgaggatttttaaaatttgaattactgtttcaccaataattttataaaaatctctaaattaaaaagaaattcctgggactctcttataaaaaaaaattttctgaggacgtaatgatacagattgagatgtccgtatactcattccccttccccatccgttataatttgttgaaaaataattaaaaaaaattacgtttaataaaactattccccctttccacaccttaattgtcgcgccatggaccgagtaacggacacgcagctgacgcccatggattgtcttcccgtccagcgcctccttggcactctccgcatgcgcacgcgtgtcctgcgcagaaaagggcacattttaaatgcccatttaacccaaattgaaacgaggaagaaatttccccaaaaggtgtaaattaattaatgatattggcaatataataataataataataataaattaaaaattaaaaagagagcagcaaaaaattaaaaacaaaatatgattacaggtggtaataaaacaaacagacattggtcccatgaaaaattattcaataagtaattggttgctcgagagtgtcgggacaaacaacaataggaaaattgttccaaagattggaaaagggaaataaaaaaatttatatatatttcatttaaataaaaaatgtataaattatttaatgctcaaaaatgtccatttttgctgctcattaaattcatcgacataatttgtatacaaataaaatggaattgtaaaatgatacaaatttgcggtacaaaaaaaaataaattaaataaagcgattcgattaggcgtggcacgcgcgcgcgcgaaaaggcacatttgcgaattgcgcattgaataggcagtaaatttgaaattcatttaattcatagtttggaaaaaatggtgcatttttgattcattggcgggggttgcatcagcagctgactgacgtccgtggaaaaatggtagagccaaaataaaaaatagcacaaaaggttggcatttcaaaaaaatagtggcaaaaaaaaacccgcatgtcaaccaaacgagagtaaatgtgggcccatattttcccagaccacgccaatttgggaagacatcattaatatttttaaataataaattaattaaaaataaagtattttttgcaataattttttaaaggtaaaagaggataagctataaacttctgctccggtgttgtggatgtgcaattccaattttattcaaaaatgtcgcataaataaggcgttagcgctattcggttcgccccatt

SEQ ID NO: 14123 - DNA, 4776 bp, Heterodera glycines
agagagtgagcaaaagctttgagcatgagtttattttgaaagtgatcagtcggttagggataacgaagctactcccgtcttttcgggattttcaaaaaaagtcctcttcattcgattcccttttataattttagctttggccaaagtattatcccctcgaaataggggactctgttctaggcaaatcggcaaaatgcctatttccgatcggtcgaatgactaaataacagaatgccaattattattctacttttaaattcaaaatgttctgtcgtcttttcctccgcaacatctgactgtctctcccatcttccgttcattattcgctcatttgattatacttccctattaaatcatttatttttaagctattgtttatggttccgccaactccgatctctttgcttgaaaaatgtaattccatcgctgagagaagggcgcgtcgtcgacttaagaaaaggacgacagaaacagtcgaaattggtcttttttaattttcaattttttgtttttatttttttgcttagatgcaacgattctctcttgcccttctaaggaaatgactgagaaatttgctcattttctgatcactctcatcgattccaaaagttcatctgaatgttttcacatcgttttgaattcgctgatcgctgtccatgccaagaaatacccgtgccattccccgtccgatcaccgggttttttccctatataataaaacaaattaaaatatcactttcttttaggtgtcggtaaataattttcttaaaaaagtgctcaaatgtttcactgaaacttctgcgattaattcggagcaattgactctaagcgaattgttcgtcctattggaagttcatttgttgcgctccttccccgtccatttaagccaaactcaggtattattttctctaaaaaggggtttttccggtgcaatttttcttttaatttgcattttaatttccttttcgccacttgaattaattggtgtcattaattctaaagcatactagtataatgcgtcagttttattttaaattctgtaccgaatgataccaaatacataattgttttgttttaaatcaaattctaaatgttgttttgataggacaatattgatgacacgacccaataagttttatttttgtgatttcatttcactttttccacagattgtcgagcggctgaggaccatttattttgcaagtgaaccggtgaaatttaggcattttttggacgacattctctgtgatgagtaatttcttttggcgtttgtcctttgacaatgaatgttttttttaggtttttggacgatttgcctttttatttggccggaatctatgaacaattgctgttggaaatgccattggatttgcagcgatttcaatcgcaggaatatcgtcaagacatttcaattggccaaatgcaattcaaaaacaaattagcggaaaaattggaaaattttctgagagaattggacgaggagaacaaagaagagacgagcgaccaattggaggaggagaaaaacgaaaatgcgaatgaaaaggaaggggaggaagacgaaacgaggacgagggcaccgaaaaagaacagaaaaagtgagaatttccggacaaaacgccgaatttgcgagacgatgacttggaccatttagtaattcggccgtcattaaagacaacattcgttggcgcggcgacgtattcaagtgattcccgaaactcccgaaaaggaccctaagggcgaaacatcgatgggcaaacattttgacgagaacgaagtgataaaacaaactccgatcggcaaaatcaatgggagtcagtaaaataaattttcattttttacaaggcatcattttctttgaggtggtggtcccaaggcttctcactttgccaatttgttgcgagatgaggaggagaagttttctcgactgcatttaaatccgtcgggaatgggaaaggcgaagagagtgctcaatctcagtcatcagaacattgaaaacaacaaaaattcgatactgacgagggacgacaaagacgaaacaacgaattcggtgtctaagcggggaaaacgaccagcgactccgtcgaactcatcctcgacaatagcaatgctaaataaaagaccaaaaaggcgcatgacttactccactaaatcatcaacttcatctgtgttgtcttttccttttccccgcaaatcataaatgacttttgtttatgacttttgtcattgtatagattgaacttgaacaaaaagttttgttcaaaattaaaacaaaaaataaaataaataaaattctgcttaactatatttttattagtgggtattttatcattcattttatttatgatttttcatcaagtacttgatttttttgaagatttttattttctaaaattttgttttcggtaatttcggtattctgaatggtgtggaatgcataaatagctttagaatgagccattaaacgtataggaaagccaaaattttagaaaacaaaaaatttcaaaaaaaaatcaattacatgatgaaaaatcattgacaaaatcaatgattttgcaaaatccgagctaggattcgtgatcagtgaattttttaccctagcaaaagtatttttgtaagaaaaaaaaatttttttttcggtcgggacaccaattccgaaggattacccggacagggggtaaaattctgaaaattttgtgaaaacggtaaagaatttcggtctctaattgatctaaaataatgcttcaattgttatttggctaaaaatgcgtaatttgcgccaaatgttattgaacgcatcaactgtttttccaatagagctgcctccgtgaattcgtcaaaatagggtaccgtcccgctcattgccttactgccatattgtcaatactccgatttgtgatcagccctcgataacccccgccgaaggaactcagaactgttcaaaaccaccttttttacccttttatgggcgcagtaaaggcaatgattaccccccccccccccattcttaccagtgtttttcccgggttttaaaaaaaatagcggaacgggattatggaatattaggtccagagccaaaaataatcaaaaccacttttatagttttcttaggtaggcgctgaaaacgatagaaaatcaaaaaaagtctgcgacaaaaattttaaattttgtgcatattttggaatttgttccaaatttaaatgggaactatgaacctcaaaatgattcataaatttaattttcaatttaattgatttaacattttttttcaaaaattatcggtaccaataataaacttttaccaaatgatggaaacagatgtgtccaaattacaattaacggtaatgatttcaccaaatatttgcacttgtaattccataaatattttagttcaaaaaaatcatagaatgcagcgacgaaattaaaaattgttgcactgaatcccctggctgttcttccacaaaccagcaaaattctggagccgaaaagagcacagaacatcgttcacggatagctgagttgctcaatcgccaacttcagctttctttggaggcattgtcctgtgtcactgtgcggaaaccgttttccgaaacggttcgaatgaaattccatgaggaaaaaagcggagagacaatgggatcgaggggactgagcgaaattctgatgctgatcgacgattatgtgaattcggatttgtttcgaccccctgggaaggatttttaggccgaaacacttccattgcacgtcgaaccttacaactataaaaaggcagaactggcgcaaaaacgtccgatttcggctttgtgcacgccgctggtcggctccattcctctcccggacacggaggaagttccaattggcagtttagtggcggtgtggaagaaggaggaggaccagcgggaatcgaaatggattttggccgaagtcattgttcgtcgttcagctcctttgacaatggctgttaaccacgcttcgctgtttaaggaccaaagcgcgggagtgcgcggacgaggccgttacacactgttggaccatgtcgcggaatacgaatattaccgcaactatttcatactcagtcggacgcctcccgtcacgccaaatgtcaaatattcgctagtgcgccaaaagctcccctttctgctgaagaaagttccccgccaaggcggggtcaaccaaaatttttgcagaggtctgctgctgtgagggagtgggtcgacccccccccctaagctggagcagcaggtcgctcacccccccccctctaaaaaaatttttttttaaattttcaaacatagaaattttcagaaaaactccgcaagaaaaaatttgaacaacttttcagaaattttttcaaaattttatgatggactacaaagttttttcaaaaaaaaatgtttcttgaaattttcttacgctaaaattcctaagaatttttttttttgaaaaattatgtttgagaattttttcggcgagggaacaaaatgatggtaacgtgccggttgacatcgaattacgagccatccccgtggttttggttagatccatcacacggtcgactcgctcgctcacaaactgttccaacgcctcattagccttaattgttttttgttttattggaaattcgtttatgggagtttaaaaagtcagcattaattgggtttttttttgaaaatctagcaataaaaatgaaatttatagggtttaaaatatcagccttaaaagaaatttatgggatttaaaaatgtcagacttaattgtttttggaaattcaagcaattag

SEQ ID NO: 14124 - DNA, 2090 bp, Heterodera glycines
tcatttttaactgaaggattatgttaaggtcggcttgagctaatcccttctttcatgaattggtgtgtggaaatgggaattcggcattcgggcttggatattttgtgttcaccccacggactttgccttagtgctacagaacctcttgaagagggagcaattgttgccgaagtccctttatcggccattttttcgacggacgtagctgagaatattgtttccctcaagtgatttgcaatttaaatcaacaatatattaaattctaaggcacattttacaagataaattgcttcaaagcatggagaatgttgctttggcaatttgtgtggctcatgaagttctgcgtgggtcggaaagtcaatgggcagcttatttcactacgttaccatcgaccttcccaactccacttttctacagcgaagagcaattaactgttattttccgtttaaataaaaagtactttcaaaaaaattaaggcattgaaaccgtcgccggtatttgaggagtctctgcggatgcatcgtgccattgcccggcaatttgtctatttttacttacaaattcttggagataatgggaacaaagtttctatcttttgtagtttattggcataatggtcactccacagacaaagacagaaggtccactgtcgaatttatgaaatcaaatgccaagagttaaagcgttatactttgtcctctagcattttttcatagcttgatttgagtaaattttttagttaatatgctttttattttagtttttttaaatttaaattattttttgtgggtactttgtctgttggtcctttacccgtggatcctatgtccctgagacctccggtaatactgcagaattacggtcccgatgaaaaataaatttataaaattttattcttatctttcctggggtaaaaaagagtgctcttacgaatctgagcttagatttggcagaaccattgattttgtctatgacttttcatcaagtacttgattttttccaaaaattttattatttaaaaagttttctttagaattagttctgggttaaaaaatgcgctgatcacgaatctgagctaaaatttacaaaatcagtgtttttgtccatgttttttcataaagtatcttaaaaaaataatccgcagccaagcggatttgaaccccagacccccgtctcatataacccctagggccagcaattaaatttcaaaaaatcctaaaaaaacgaaaaacttaacttcacctaacattcaatagctcattcgaaatctctttgtgagctctgcacatattcatatgtatgagtattttacgcgcgattaattttgttaaaatttttggaaaaacccactttagagcaataaatgtcctccctcaaaaatgtttgcaaagtctccatttaccactcaaaattttaccttcgacttttatcgttggtgcgtttccattgtctccacaagaataaacatggtgccgagtcagcacaaaaagggcgaagatggccagccgagaatggtgtgacggcactttacgttttgtgcctcttttccacctgcagttcagattcccgccttattgccatttattgacatggccaaccacgcaaattccgcggctaaccctggttcagtgtactttgagtgcgaaacgaattcagtaaaaattcaggtcaaatttattgcaaatcagaaggggtcaccccttttttaaaaattatttttccgacccctaatctacagaagatataaaaaattaagcttaataaaccaattgtgaatggagaagagttgttcattcattacggtccgagaacaaatgcgaaatttcttttacacaatgggttcgttcctcaacagcctaacccggacgaccttttcgaacttaaaatcggcaagcttttcaagttgttcttgtaatgacgctaactgattttcaaggactacatcggacttctccgaatttcgatgcaaaaatgcagcatttagcagcggcatcgatagtcccaagaaataaccagcccagtaacaatgtcgtcttctctttccaactccaaatgtgacccagtgctgaaagcgtaaagcaatcttcact

SEQ ID NO: 14125 - DNA, 932 bp, Heterodera glycines
gactccgatgtttcaaatggaagtgactctcaaagactgaaggatgcagaagaagcaatcctcaaatcgcatttaaaaatgtctgaaagaagtcatttgatttctctgaccaaaaatatgatatactcaaataggattctgctctatctgaacaatgcctttcattaaattttatacagaaataaaaatgtgattacaaataattctgataaatcagaaccaagtgcctcccgcgtttcccacttgtgaagtactgaaagctgcgtaatcgttccggggaaaatagggagccggacgattggtcgtccactccattgcagattgtgatttctttaaagcactgttccttgatttatgattgtatgattttggtttcaaagtagctttgtacttgagtgcttccggttggaaatttgatgcggaattagctggaatgttacgaggataacgatataagccaaacggttgagaagtgccatagcaaaacggagatcgcatctataggcgaaatgccaatttaatacaaaacaatggcttaccctcgcttgagtcattggccggtgaaactggttagcatatggatggtaacccactgacctcccatacatcaagtgcggtcttggccgtgaaggatcatgatgaaatggccaatgcgggaatcgaataggacgagagggagggtaaaagggttgacgaggtggcggaaaaggctgatgcattgcatttccaacctaaaaataagtaaagttagttgggaagaaaacaattaacgggactacactttttgttcttcttgccattcttttagttttttcagcagtttagtcgaattttctctctctgcttcgattggagccaatctgatgacatcgactggcggtcctctgggaggaagggacaaaacggtgaccaactctttggactttttctcg

SEQ ID NO: 14126 - DNA, 1602 bp, Heterodera glycines
  misc_feature (16)..(16): n is a, c, g, or t
  misc_feature (57)..(57): n is a, c, g, or t
tcgcatatcattcacncaatggttgtaatttcctgggaaattccatcggatatcttncaataaggcaattgacatattctatcatcacgaaaatgacgaaatttcaggacgattgtcaacggcctttggagcaacatgtaaggtttggttgcccaagaaacaccgattatttggtccatgaagatgaacgactcacctccctttttatcccaaagacaaaaaaaagcatcattaacatttatattccaatacgattattaaaccttctgaacattgggatttggaggagcacgtatctgtgtgtaaaatccagtcacagtgcgatcaaataattctcttccgtagtctatgagtttgatcatctcttatatggttatcaccaactttgtcaaactcgctcttgatatattacatggcttctccgggacagtcgttttatctgttgagtccatgagtgactgactctccccctcctcaagtgaagaaactgcttttctgatcgacttcaagattagtaattggaggtccatatagggcaatggttcgttcttaaaatgcgatatcaaagaaaatttaattattcggttctagcgcatttagagcagagaccggattttgcagcatttgttaataaacatgaaaaacgaattctaacttgtttgagacttatattttcgagtttttcatgctgattttttgtttagattagtattttcgtgcttattgctgagtttcagagctatttttaggcaattgcagccaaaagaaattcaaggttaattggactcatataaaatgcactataactaaaaatttacccattttttcatgtcatttatccacagattgaatccacgctgatcaattgcattttctggttcctttattttgtgaatgcttctgtagctgttgtcacgacaatgcttgaagcgaataccatctctattgacgtggataattttgtcaataaagaaattgcattcagagtcctggaacacaaattattagaccactttagttacctttgaaatttgtgtcccgaaggaaaataaataaatttttctttgactattttttagagctttaatatttaaattatagagcagtaaaacccatatacctattctgaagggaaacgttttttgaattttaccatatatttattaataaaagctcaaagctaattctacattatgcagaataagtcaacgccaacaaatttctttactaaaaaatggataaccttcagaatttctcggattgcatggtaacgcatgtagcaaccaaccatcaatggccttagttccggcaatggcaattttgaagcgagcaacctttttgcagtttcaacatccaacaagcacttagagagctgttcggcatttttcggtgcagaaaaagaatttgactgatcgtgagcggaagaatcctcctttttcactaaacttaaacccagagaggaagcattaaagacactgttggatgttaaatcaatttcagaaacactcgccgcactttgtgaacgaagcatcactgaataacgaacgacacgaattaactattcaaataagtacagtgaaagaataataaaccgttcagaaa

SEQ ID NO: 14127 - DNA, 3144 bp, Heterodera glycines
aattaaaaattcaataaaagttttcttaaatattctatctatgttttcaattaaaaaacaagcacaaaaatattccatggtttttttctttcgtcaaaaagtagtaaaatttgaatgaatcacaaaaatgtttgcgacgatttattagttaaataaagttttaaaatgattttatttattttttctaaatggcaaaaaaaaggaatttttttgttattttttgttatgaataaggcaaaaggcatcccatcagcccaaaggtgccaatcaattcttgcacaaagcgccattagtcatcgccacgaacagcgacgacccccgaggggcagggtaaatgatcaatttaatcgtcattaaaaatgaaataaaaaagacacaaaatcaaagaattaaaattaaaatttgtgataatctcttgagttaagatgtttcttaaaattccgcaagattgagaaaagttctaaatgttgcatagcctattcaatagcataagtattctctcgccaccagaatattaattcaacaaaccttaattaaatttttaaaatttttttatgaaagaataaaaaatatgcattaaatcttaaaaagcctcaaatgtccatattaatgcaaaattgaataaaacatttataaaaaaaaaattaaaatttgaataaaaaaaaattaaaaatgaaacaaatcactattcttctgcgtttcttcgaactcttactcttctaatattataaatttttcattttttctattttttgttcctccgttattttactgcgaatgccaaattgtttcttccatttcttaatcattccataattaactctaattttcttacaaatttcgacataatttttcttccattcttttggcgaatattttcttttttgcttatattcctttttcatttcaatgaatttttgtacaaattctaatttttcttcatcagtttttgatttatagcttttttgtatttgtttttgaagaccaaattctttaatccatttataaatatataaacgatttgtccccaatttttttgcaattttcaaattaattttattccattcttttgttgagtattttcgtcctttttgcttgattttctcttttattttataaaattttgcaattatttctcgttttttgagttcatttcgtttttcttcttctttttcttcccatttttctccaaatattccatcacatgacttttgttccaactttttcttttctgtttcggtttggtcaattaaattgattaaaaataaaattaataatacacatatttgcatttttaattggcaataaatattgcctaattatcaatgtaaaattgggaatttttagctttataaaattatttattaaatgaagaaaatgcgaatttattgcttttaaatcgattataaaaaaacagtacaaacacaaaaaaatcaggacaattatccaatgaatgtttcatcaaaaattagaaatattttacataatttacaataacaaaaaataataatattaaattcatatccctagggcaagcggaaaaataaggacatacatatttaaaaaattcaaatcgttgctgtttgcacattacaccaaaataggtttgcacgtttttcccactccataaattttgtaaaaacaaaaaatgcgcgggtttttgtccaatactatgcttttttatccattcaaatcatatcgtccaattttaattcaattcttctcccttttgctttgccactcggggcggaatagtcgacgattgagaaagccgacaagatgacaagcgaacggactgtagaccaattaattaaaattgacgaataaataaatgcacacaaaatatttagagagaacagtgtccttagtaaaatgtaccatgaaaaaagaaatcctcctggagacatgcggggaaatctagcaaaggaaatatctattgaaaataacaacataattagcgaaaacaacaaaaagaaaggaaaacataattataggtaggtcagaggtcggagagaaaaataacacaatttatagaaataaattaagcagagagaggtcaaaatattcaatttaacacatcacaacccctaaaaaaaggcgtccctgccgttaattcggcatccgttaggtggtgacccgagtttttccactcggattggtcgaatccagacgattggaggagtttctttgccacggcacatttctcgcaccacaaaatccagactctttccacgtcttcatggtttggaaagatgccggcacggacattgtctttacggactccttcgtagacgaccaattccattccgggttcggtgccgagaatcagttgcaccaaatttttagccgccgaagatgaaactgttgcacccgaacaaaggatgaatagactcaaaagggcttggagaggagtgctaatttccacattgcccgtctcagttttcgcgtccagcactgggcccaactcgccgcacaacatttttccgcaaaattcgtgggttttctcttcacacttcatagtctacgaaagtccgtcgttttctttctgctgtcgctgcttcatcttccgttctcctaaattgtcagttgtccctaactgattaacgacgatttttttcgatgactttaaagaattttccccaaattgcgtctgtaagagcggttcgaactgtccaaaaattccttttgtgtctaattttgaaagttttaagctggccaatagaattgtagccaaaatattccggtaggggttttttccatgaggaagggtagaaatgtcgggtacaccgattggaacgcgcacaaggcgttctattggaacagtaattggttctgccgattttttatcaaccgggacaacactagcagacgaatcgagtgttttgacaatttcgtatggtccgaagtgattccaatgtaattttttgtgctgtgtttttgatttagagccagggtaaatgaccatgcagcgatccccgactgcaaatttgttcatggacacatttggacgtaaatcatatctgtttttggtttccgcccgtgaaatttcggcatttttacgggctgagtcaagaattaataacaaattttctttgaagaattgcaaatatgtctcttcatcgattgtgtaaagagggtttccaa

SEQ ID NO: 14128 - DNA, 1026 bp, Heterodera glycines
ttatcgttcttcgggtgaaataatttgataaggccctttttgcatggccaacagccaacggaacaatatgtaaattaaaaatattttgaaaagaaacttaaatttacttttatgaacatcaaaatttgggtcaaatactaaaatttaacactgattgtgcctgaatttaaaaaaggcttgctaactctaattattatttacacttaaattaatgaaaattttcgcgactcctttgcaaaaaggtctattcataccaagtgcccacttcttttaaaaacaatgtttaagttccattatcttcgtttttacgaacactttaatttaattaatttctgttatttccttttactaaaatttaaattagtaattactcaaattttacgattattaaaaaagtgacgtcataatttttcttgcgctgaaaaatgtcggacgaaccaaaagaagcggaaaagaaaatggaaaagcaaatgtaattgaaaaaagtcactcaaaatatttgtgccaatctcagttggatgtgcggtgacaattggctcaaagtgttcgaattggtcccaattggccaacttggccttggaattgcattggtcagccgcgcatttgacttttttgtggacgagcacttcaaaacgcgcaaatggacgttggactcaattttgatcagatgcaaatttgcagaagatggccaaaaagaaatgcaaactttcaattcgcgcgatgaattagtgccaattcagaaagtgccgttgccaaacaaagtcgtcggcttcaaatgcattcgttgcaggcaattgaacatggcgcatcatctttcggatgttgatgctactaattactacattcagatacatcgaccaaaatgtcgtggattttctcagccaatttcgccatcttttcgccgcttttggggcaaatttgttaattataaacaccgacgaaccaattttggaatgggttatgcgcatttggcctatgctcagggttacatttgtcaattccgcgcccacatcatggcgattacac

SEQ ID NO: 14129 - DNA, 2377 bp, Heterodera glycines
  misc_feature (1298)..(1298): n is a, c, g, or t
tgtccatcactccatcttgtcagttctggtaatgtttttccaatatttccggcggatgacagtgcaaatgcatcggtgggccaagtgttggccaaatggcttttttcaccgcgttcggacggtgtgccgaaggagctttggtgttccttaaagcagtttgagagattatcggcgattaatgacttgaaaacggtgattcatattcataattgttcaatttctttgctgattcacccctttcaggcttttctcaatgcttcttcccgtgcctatttcatcattttcattagaaattgtggttattacagtggtggtggtgcccccgttgtgtcgccatttgaattgatcaacaatttgacaggggaacgactgacctttaaaatgttaaacaggaaacatgctatgctgaaacgttatcccattgcgcaagatgagcaaaaatgggcgaattgggaaaatgatatgatggtaatgggagcgaaaaatgtcatttggattgaagacgaattcgacaaaagtcgaaagaaagcgaattgaaaagagataattggatgactaaatcgcattgcttttcgagcttttttatttgttatttgcaatattttgactaaatgttgataattaattttggaaaatgcgccccctttcaaagccctaagggtacattcatataacgactttaattaaatgatttccaaaatggaagttccacttctatgaagagtaggtacaaaaaagggttgaaaaacagggcttccggaggctcgaattcagtaaatacggcaaattagcaaaaatgcattttttaaattttatttgtaaaaaaagggaatgattttttactagaatatagcgggaccgtgacctggtactgaaagaatgggacaactgagtaccttttgactgaaaaaagaaaaaataacagccgtaaaacaaaattaattaaaaatattccataaaaaataatattctggaataattgaattcttttgttagaatttttaatgcatttttggatattaatttgtttaattacaaaattactttctttttgaacgccttccggaatttgcggacaattttagggaaaaaaatttaaaaaatctttaaaaatttctgaaaacatggaatgaaagacttggccccgttagtccgtttcttctattaaaagaaacaattttaaattttttgagatatacttagttgctaacaaaatttatttacaatttcaaaattaaaaggatattatataaatgctggacactagctgcactaaattccgatttccgatattttgngcatcagatttcccgtacctttaatcataatttatttaaatcatgtgaaaattatttattcgctaaaaactgattatcaattgtgtatgttatacaaatatgaagatctatgaaaaatatttctaatttacaatcttttcgcagatttttgatatagctcaaaaaatttgctgacgaatgtccactgacggatatacactgacggattgtccgtaccccattttaatcacataagagaccaacatttcattctgtccgcaaatgtcccactgcgttttaaactcaaaattgaatgaaaataaacgaaaaaatattttgtttaaatttataaatgtgactttttgtaattattttgccacttttttggcattttttatcattatttagttaattattttggcattttttgccactgaaaatcctcaacaaaaaatttaaaaaaagacaatgtcaattaattgtttcagagattggccaaatcgaacatgaaatttggcccgaaattggtgctgattttgtccccataatctgccaacgaaacgaatggaaacagagaatcggcgggcacagaagaggaaaggagcgagtgaattggtgccatctgaaaaggatttaagtgatgccgatgccaatgcgcaaaaaaacataaaatgcttttactaatggagaaaaaaaaaacaaaattttttgttttaccaacccaattgatgtccattctttgtgaaaatcagcttctgattggccagattaacaccacgatccgaccgtgtcaccatcggcaaacttttcaccgccatttttgtttattttgtccacccaaaaagtgccgattcctatcgaatgcgtaagtaccggtgcggttttgaattgttccgtccgagcgatgtctgatttttgacggcgaatccgacgatggcacgagataaaagtggaaaagaagtaaattgaattcttgtaaaaattggcggatgttgagccgaattaacggtcgacgatcgaatgccgaccgttttatccggcatttttatttcggcgttgatgcgagctatcgaatttggaatgttacaagaattttaaat

SEQ ID NO: 14130 - DNA, 2991 bp, Heterodera glycines
  misc_feature (2957)..(2957): n is a, c, g, or t
gaaaagtatttaaggagttagagttgataaagtaaaaattgtcattttcggagtaagtatttttgatggttgattaaaagaaaattaaaatagatatagagaaaaataaaagtgagtaaatagagtaaagttagaactataaaaaattataagacaaaactttacaactaataagtgagctattggaaggccgagtctgaaagtggtttccaaaaacggcattttccaagaccaaaaataacaaaattttttaatttagttatattaatatttctttatagtatttaattggtagtatttaattataaaaataaatggtatggtataatttcatgaaaaattaaattgaaataagttactatgaaaattaattacttaattaatttttgttatcaatcctaattaatggcagctcaggaacacacaagtcagctgtatcaagaagagtaaaataaatacttaataacaacaattatatttaaataataaataattcaaaaaagtgaattgaaaagtatatttctgcaaaggaaatttctaaatcaatattttaataaataaattcaaagcaaaaaaaatattataatgagtaaagaataaaatacgatataaaatttttcatactttttcattaatcatgagacaagagatttatttttgaaaaaaaacaattaatgagcttatgctgaattacgctaaaataaatcgttagtaaaattatgaatacatttgataccaaaacaaaagattaaaattttaaaatttataacttgcaaaattttatttatagaaaaagcatctaacactttaataattaatattatttattcattaaaaggtaagttaaatcagggctcccatccgtcattgaatggcaaggacgtccttgaaattgggcccttccgcttgaaaatttgaaagtatccttgaattcaagaagtccttgaaaaaatagcattttgaatagttttaaaaaaattcaaagaatttgataaatttttgaatttaatttggattaaatggcgttatgtcataaatgtaaatttttctcatgcttgcgaatgaattttttacgcaattaaaaaaatgcccatcgccattatctcgaaattacaaaatccgtatttttggttaaaatctgttaacaaattacactcttattttcaaaaattttccccggcggcgcctgtcggcaccgccggaccccccccccccccctgttccccggaaattttttgaaaaaagagcgccgcaatttttgatagagaatctgttaaatatatagcctaagtctcaaaaataaatttgaccggcggcgcctatcggagctgccgaaccccactgtcccccaaaaagttattttaaaaacaacgccgcaaaaaaacgttatttagaaacaaaaaaagtcgtcgacttgctaaaaaatcggcaattttttctcatggttgagaatttttgaaattttatggtataaagccactactttcttaaaaatttagcctaaaatcgcaaattttagccatttttggacaaaaatcgggtaacaaatcgcattaaaaatacaaaattttcccggctgcgcctatcggcgctaccggacccctcccccctgtaccacaaaaattttgtaagaagcgcgccccaaaaaaagcttttaaagcaaaaaaaagtcgtcgcaaatgaggaaaatgatcagcggaaacaatttcctattcatggaaacttggggaaaaagatttctaatacagaatatttacccaattctaatttatttaactttacatatatttttatacaattttaccattcgtcattagattaatttattgcaaatagtccattattattactagttggatgaggtgatattgtatgagttggtgttttctcctattttcaagaaattacaaatatattcattttatggttattttttatagaattaaaagaaatattattttgatttttaatatttaaattgatctgatagatttcaattttttataaacccaaaaattttttatttatttctttaatcattttacaaaacaaattttttcctgtaatttttgtggtttgtcttataataaaaaatgaataaaataatagttaatttaaaaaaaaaatttctttaaaaaatttttttggacgatttaaattatataaatgtcgttgttttattatttttgcatttctttttctagtttttactgctaaaaaaattaataaaaattaatttaaaatttaacaaaagcaataattatgaagaataataacgtaaaattattttatatatacaaaaaataaattacaaataaatatttaaatgcacagctcaccaacctggaacggaacggaacgtaaactgagtacgaatgcatgagataaatataagatgtaatgcagaaaaaattaactcaaaaataatttttaaaaactaataaatcattgagaaaagcatcatcaacttacttcagtgaaggaaacaattaaaaaataataattaattaatacctattattattataaattaatagagattttgaacaattttttaatcacatcacaaattgtatattgaaaagaaaaaagcgctgaataaaaaattgaaaacaaatattttttacatttgattaatttgaacactcaaaagtttattggtgatttcttgccaaaaattaccttgaagaaatttattaatttattaaatacatttgattaacagaaaatattaattaataagtaaaaatccagatttgatatggttaatgaaaaaatattctaattcattaatcatttcctaatcaataattaaaaatactaaatatctccaatttgaattttattaattcaaaatgaatttttttctgatattaacataaaaaataaaaatcagacttattcaataaaaaaaatgacgattaaggaaaatttattttttgatcccatatgaaaanaagttatttgaaaaattcaccatattaaaaaata

SEQ ID NO: 14131 - DNA, 958 bp, Heterodera glycines
ctggaattttgacaaaaaccagggaccgggacttaacgtgaccagaaaagcccgtgaccaagtttttttgccgggaccggacccaaccgggagtttttcgaagagaaaaatgttttgaaaaattgaaaaattccaaaaattaatctaaattcatagattatatgaaaaatttcaaaacttatcgaaggctttcgaatattaccaagaaagttggtattagattgaccaacgctggcgcgtaaacgacaccgaccccaaattctcacccagaccccattcttaccagtctaatttagtcccgccgtgaccgggactgtcaaaaccgggaccgggatttcttttttttaaaatgggttcgggacttgaaaaaccaggaattcccgacccattctcggtcccggtcccgctcagctctaccacaaacccatcatttgcttgctttttggaaattatgtgactatttagcggtttttatggccaaaatcgtagctttaattattacaaaaaataaactaattaaaaagttacagtaaatttgtaaatcaagaaaaaaatatatttaatttccgttttaatatttaccgattattaaatttaagtaattttgtaaaaacattttttagctttgttcaattgcaatttatatttttattaatatttacatttctccaattaataaatgaatttattttttataaagttttaaaatactgtgcaaatttttcgcaattcccaatgtgagtttttaataatattttttttacaatcttaaatcattattttaatgtttttacttgattgctttaattacttcgttaatttaataaaaccttcaatcttactaaaaactaacctgttcgttaaaaagatattttgtttatttttattgtcttgaatttttcactaaataataatataaaatgtttctcctatatttaaatttcatcgaaatcaataa

SEQ ID NO: 14132 - DNA, 2120 bp, Heterodera glycines
tttaaggcgtgcggcggagaatggcgccgcccaccgaattttcgtaacttctcacttcgtccttgcccaatcccatgtcctcaaccgcactcataaagtaactctcttccggctttcccacagaaatatgttcgcactttcggccgtctccatcgattgcaaattttagtgctgccgcataagcgcccgtgtcaaggcatgggccttggtctgctctttggtaaaaccttctaattgattaatcattttgcaatgcactgatgtgtttgatgaaattccacaacaaacccattgccgagtgaaattagcaatggtttttcactattgagcaatattttgaacacgctgttcatattgttgaagcttagctcgtgttctgcgtcgcctaacaccacacaatttgggttttcgacgttgagaaattcttcaaaatcgggaagtacatctgaagttcgaggagtcttaaattaagtgtccttcatggttttagtcggttcagttggttcgccaaataattatatcaactcaaagtccaacttttaaacctttgtgcactatcaattttggtcgtagtccatgctgtcgaaggtatttgacagcaaccggtgccggtgtgaaaatgtgctcaggctgaggcccaacgaatccgagacggtgtaatttttgacaaattgctcctcgtgtcccactactttcattgcttacaaaacgaacacaacttagctcgtaaagtctaagagcaaaatatgaagcatttggaacaaaatgtataggtatgatgccttttaactgcttcaatcgacccaggaatggccttgcctccgtccaaagaagtgtcaaagagtacgccatttatgtcaacaagaaagccgcgaatgcgctgcgaacgaattttatcagataaaacgaacttcatcaaattgggatataaaaataaacaattatttctaaaaatgaagccctgacaaagcctgtgaataaaaataaggaaatggggtcgcttacaaaaagaaatgcttttacttttacacactatccactgaaagacacaaatgattacatttatctttttttttttttgctttttctcaaattttctctccaccaaatgaaactgagttatgaactaatggtcgtccagagcagcacatttattctttcgctcgctctctccgctgctgtgtctttccctttttattctgccgtgccatacaataaattaaaatgcttcagttgttatgtattagcatatgtcatcgttaatggttgcctagctcgcgccgtttacgttttcatccgagattcaaagcacgagcattaagctgttaatccgtccactgtcagtttatccctccatttgtcaatccattttcatccttcctcctcaatttttgcacttaccctaacaaacatttcccatatgctaacattagttgaatcattaaaaacaattggtctatgccctaaaaaccaaaataaaatcataaaatgtccgttttcctgagaaatttgtccaaatcgcccaagtataaaaggcggacttgcactgcttttattgggagaacacccgctgaaatgacaacatccattggcggtgccgcgtttcccactgtgtctccgacagcgtcctcaagtcgcaaatctttttttgacacatccgccgcctttggaacgacaatctccggacatgcgctggttgccgtgttcccagtgaccaaaaaaagtggccgcgtaaggcaatgcttcgtcacagttcaacaaacgctgttcgaggtacacaaaaatcagaaggacgcgaaaaacaaaaaaccggccaaatatctcgtcgatttcggcgacgttttcaatgtttctatgcatgttcgttttgattttatttatttatttgaaactattgttctccaaattcagaatgaaccaattcaaatcaaagatgactgcatttgtataatggacccaaatacttccttttttgttcgtcccatcgattctgactatgacctcactgcttggtttgattggatcttggaaaggtcgcgcgagtgtcgaagcaccaaacttctccgtccggtgttccgtgaggaattttttgaggtttaaaatgcctaaacccaagattt

SEQ ID NO: 14133 - DNA, 2407 bp, Heterodera glycines
  misc_feature (69)..(69): n is a, c, g, or t
  misc_feature (2391)..(2391): n is a, c, g, or t
gtaatttttattaaaaaacgatttgtttctttataaggctgcttgggatgtacaaatgtgaaaaaaacncaaactccgatgtgactactccaaacaacagcccgatgctcaaaatgacgatttaacagaaaaacgcactaatctgttgggcttccgtcgcctttgcttttgtgccaattcctttctgctcttttctattgggtgccgaccaattgcaaatgtcgatgcgcccgaacctttcgagcgcagtgctttcgtggaattgccggtaaattttttagatgaatttatttttctaaattaattttgccaaagatatttccaattcaaggaaggggggatttaaaattttcaaaaaattggtccggtttccctaaaaattccattggaagcagctcccttccctttttttccattttcgtctacaattagaccaacttacgatcccttttcatccgattttttattataaattatttaatgttttttgttgcataattttccaagaatttcctttgtttttggaatgtgttcattatttcagctgaacgttgtttccaactatggaacacaagagcgtttctttttcgtccgcattggtcgctgttctgagatcggtggtggggagctgtggatggcgacggagcatggcgcatcggcccggtcaatgcacgaacggatcagtcagctcaatttgcgggaatccgaacgacggagggcacagggcatcaaaatgaatttgtaagaaaaatgggaaactagcaacaatttaattatttgttaggccaaccatcagttcaagtgtgcttaaaagccgggctcatcgggagcgttctcaaacgcaaaaccaattgcagaaagccaattcgcaattcaggtttaaatgacaaaatgaaaatgatttaaaaattggattttgatagtaaagggaagtatattttaaggttgcgtggagctgtgcccgactcggcgaggtcggcctgttcttatcagtccgaatcagctgagaattgttcttcgcgaaaggcatcgtcaaactccacaaatcgtgtcaaaaaaaaccaccatctgcacgcatcgaacggaagtttaagcggcgtaaatagcaacccaacgcaacaattggagccaattcgtgctgcgtcgcacgcatgtcggaccgactcggtcagcagcggattgcattcaatcccggaacagcgcgtgttgaacgacgacgaaaggaataatgtggacgaccaccaggagcaacaagggaaaagcgggccgagcgaggtgaattttggcacacaaagcgcgaattcagaagattcattcttccccttcgccccactcaattagcaaagacaacattctgaagctgttcagacgaagaagacttccattgccggacttttcgtctctcgatttggtgccaaaatgtctgaccaaataactgctccttcttcgccagcaacacgaactgttgggatgacatttgaattcactggaaaaggtatgccaaagtctccaattaaaaaaccgtgctgctttcggtcgttgtgccacgacttcgttggccaacctcgctttgtcttcaaatcaatcggctcggaactcgttagtcggctcagtcctcggtttccgtcttaccagaaacaacagcaacgcaaatacaaccttggcaaatcggcaaacggtggcacaaagaacgacgtctgcctcagcgaatgcagccattttcagtgccaatccgacttacgattgtgccgaagattacatgacattgtacgacacggacaatactacgacacagctgcaacagcagcagtacggttactcattgaatgctccgtcaggaagtgtgggcagtcgaatgtccgccgtttcaaaagacgagtccagaaagagcagttcgtctgctgctccatacagacgtaccatttcacgtccttctacaatttcataattcctttcagaattttcaaccggcagtaccggctattcatcggacacacaacaacaaggaaaagggatggggacaatttcggcggattatgtcgaaatgggtgcataccaaagtcatgcggatggtaaaactttgggaggaaaagcttatctgcttcttgttttattattatcagagtcgaatttttcgttgtcagaagttcattcgtatgtgccgaacaattccgagccgtattggacctcgccgggcacgagcaacaacaatggattttgttgttcagatttgggttctcagccaacaggggccgaggcgcccagagcctattctttgggctctaagcctcaccaaactcaatcactttcctgttgctcgatgcggccgtccagctcggagatgagtcggtctccgcaactgcttcatccttgctcaaacaactcccctcncaactacctcaaaaaa

SEQ ID NO: 14134 - DNA, 3585 bp, Heterodera glycines
ccaagtaaagagaaattgtcgcctcgagactcaccggtccgaggtggggacatttgtcaaggctcaaaattgagcgaatttttgatgatgaccaaaaatttgggttagaggcaattgggagaaagaggagctaattgattgctttctaaaattgatttgtaattaaaatattatttctaatgtgaaaaaaagtattttgaaacgattaaatttttgcaaattggttgttcttaaactatttataaataaaaaaattatttttttaatgttaaaaaagataattgataagttatgaatgatataaattttagaaattcattatttaattaattaactaattatgataatatttattattgtttttatttatatttactaatttcgttttttttaatttatatattcaaagaaatttaccgaataaaattgagaaattttccgcagcagatgccaatccgttggttaacgaacgatcaatgtgtggtaaaaatgtggccaaaactgcaataaaaagggaaattaaaatttcgtaataattttttgataatttataaaaaaaatggtaattaattaatttgcgttgaaaaaaaattattgagaataattttaatttttttttacctaaaaaacttagataagcaatgcaaaaaccaattgggcagaaaagcgcactaaatgttataaaattttatttttaaatttcataaatttaaattattttaaattttaccagcagctaaattaattggagattcacaatgaaaatgacacggcacacaaaatgaaaaaactgtgagaaatttctgctaaaagaaaagcgtagattaaaaaataattccaagatctcagcaaatccacacaaaaattcaaaaaactgtatggagaacacacagcaaaaaattgatggtacaataagcaaaaaaaaaaaaatgtacagcaaaaaatggagtaaaataatggaaatttatttaattatttcatattaattttaatttgtttttcactaataataataattaaaaaattgtataaaattggcactccttctctcattatggtccttttcgaagaattttttgctctactaaaactgaaattctgtttataattttttgttttcctaaacattttaaaattaggccgttttttgattataatatataaaaatttggacataattttttagaaaatttttgtcggaatgccatacaaattcaaaaaataataatttttctttttaaatattttagcggatctaaagcttttgctctccgtttggccttctgttagtgatggaaaaaacgggggatcgattagggaggagaggacgaagattggctatctgttcctccgcatccgccacaaatccgtcgcggacggatctcatttcttcgggaggataaatggcttttacgagttccgaggccaacagccgcagcaaaaagtttaacaaaatcaatcaatttttcttggccaaatttcttttgaaaaaaggtaaatgaaaacaatatttatggcacaaaaaaaatttgaaaaaaaaagaaataaatcgttgatttaaatttgggtaatttaaaataaataaagctgaacctcaaaaaaaaagtaattggaatgattgaatcgaaaataataaattgctttttaaataactaatagaaaactttttaatagttttttgtttttgaatttttaaattttctaaaattttaagagagtagaaatttcaaacatgattttagcaagaactcaaaatgttaaatgtgtaaaacaataattatgtaaattaaaatattatttaaaaatatctaatttttataaaggtcaacaatttttatcctaagaaaaaatgtataaaaaataattatgcaaaaaaatttatttgaaattaccaatttagaaaaatttcaacaatttttatcacaagaaaaaacactgaaagtgaatagggttaatgaatttatggcaacagaaacaaagaaaaaaaagtgccagcattgagtgccaaattgtttctgtggctgaggggcaaagacgcatttttggacccccaaaaatttcactgccctccgccggggggggggaggaaaatgagtcggacaaaccgaagagatttctcacacaaaggaaatccgtcccatttgaagacgcaaaatgtaactccaacaaaattggcaaatttaaaataaaggaagaaaggacggaggaggaaaatttggaaaatttatttgagagttaaacacggaatttttttactgtggaaattttaaaaaattaaaaattgttacagctcgacattttgaaaaaagccagggaaccaaggctggaacaggattttttagaaatttgggttgttgaaaatcctgaatcttggatggtttcaatgttggacctggacctgaatttcctggctaaaaatcctggaaaattataggtccaggaaaaatcaaggcttgccatggcctggacccaggcaatgggccaagattttataaaatagagtttctgaaaaaagcgtgggccttgacttgcattccatattggacatgacctgaatttcctggacataaatcaaggtccacagattttttttggaatttaggcctagattcgatgtccaagtcgagctctaaaaattttccattttttaattattaagaaaatttcatgtaaagcaacactaattaaattagtgcacaaatgcatttccgaaatttgctaatcgaattaggcgccgcgaatttttggcgatttaatgggaaagtaaatttttttatgacagaaaaaaatattagagaaaattttcttattttcaaaactaaaataattttagaattaaaaagcctttttaagaaagcctctgatattattaaaatttacacgaaaagcgaaaagttaggtaatactttttaaagaaattatgacaattgcgggccggcaaattagtcatcaattattttaaacttttcgaaatttccaattgagttattaattttcggtaattaaaaatttaatttgttttctctaataaaaaataaaaagcttagaacttaaataaaatctcggaaaatgacattaaacaattaattttagataattaaaatctaatttctctaataaataaattaaattttcaattaagcaattaattttagataattaaaaaagttcaattacggctcatctaataaataaatacaaagcatttaattgaataaaatttaaaaatttacccctttttcatttcaaatttcgcatattttattctgtccacaattgtcattttctccgtttataaataaaataaaaataattaaatgttagtaaaaaataataaaaatttaattaaaaaaatattcaaataccaaattcaaaattaacaaattcaaaattttctacagcaaaaattcagtagcagaaacatttagatgaatttgcaaaaattcactgcaattggactggacagtgtatgtcttttttttctcttatactatatacctccggattacgggtatttgcatccgtttacatgtattttccctctaacgagatgaggcatattttttttataaaagaccaccaaaa

SEQ ID NO: 14135 - DNA, 1778 bp, Heterodera glycines
tccgtcggttgccataatcccggcggtgtttccctgcagcaaatgccacccggagagaaagcacacggtggcactcataaggacgagcggcgttagcaggaggaagcacaataaatcggtgagaagagtgccgcgaattgtcaacggaagaccgaacacaggacgaggatggccggaacggacataggcaaagaaagagggcgcagtgctgagggggaggggggggggaatgcatttatgccggggcaaacggaccgacgcaccgttttaattggaatttgaattggcaaatttcgcaatgagtccttaaggggagaaaaaattaagagacaaaaaggattgattggtgaattgatattcgaatttgaaaacccaaaacttttaaggtcggaatttcttacctctgagagacaaccagccatttgttcagacaagtccgatggtaaagccccatagtccccctgaaaatgcaaagatagagtataagaaattgcaaaatacaactccttttttgtcccttttccaccctttctttttctcacttgcaatggcatggcgaaatcagcggctcgccatcgttgggacccgattcctcgccactgtagcaaatgcgacacaccgccggtgaattgttcattgtcaggtcgattttagcgatgacgacacaatttggatgccctgccaaaattggagacattgcattggccacagtgttattgatgttttggaaatgaacggaggcatccgacgaagacaaagaagaagagaagacgaaagccgtacgatgactttgtggggaacgaagagagtgatccattgagaagacaaaaaggaaatatatgtccttttatccttaaacaaaaagttaatggttctagtcggttttacgcgtcccatgacattttacgcgtcccatcacactttacgcgtcccatgacattttacgcgtcccatcacactttacgcgtcccaacaacactttacgcgtcccatgacattttacgcgtcccatcacactttacgcgtcccaacaacactttacgcgtcccatgacattttacgcgtcccatcacactttacgcgtcccaacaacactttacgcgtcccatgacattttacgcgtcccatgacactttacgcgtcccaacaacactttacgcgtcccatcataatttacgcgtcccatcacactttacgcgtcccaacaacactttacgcgtcccatcataatttacgcgtcccatcacactttacgcgtcccaacaacactttacgcgtcccatcataatttacgcgtcaaaaaatgtttttcgaaccgtcaatcggaaactttataccttccgaatagtctaattgttcttgtttgtatactttgatcatcgaaatgtgcaaaagcaattctaagcacacttaatgatgtcaacagaaattcaactaatataagaaaaaaatttacaaaagcctaagcttaggcctagtctaacaataagccattgttcgagttgcctgtgtataagttgtcatgataaccttaggtttaacaacgaaatttatagttaaaaactttactaaatacctgacaaaaaaaatagttttctcttagttattaggacaactataataccatgagaccagggatggcacggaattccgaaaatttttggggcctcggaatgccatccctgccatggacacaaaatgtcatgggacgcgtaaagtgttgttggactcgtaaaatgtgatgggacgcgtaaagtgttgttgggacgcgtaaaatg

SEQ ID NO: 14136 - DNA, 1299 bp, Heterodera glycines
ttttttattatttactttaagagagaatctttccaaatgaactaaatataatggaacttgcaggaaaggaaaagagcagaacataaacaaacaaaaacaacaaaagtgatgcgactattcattatcagcgaatttggcacaatcgacgaagaacgtccggcacttcctggttagcctcctccaaaaccttgacgagttcgcgcgctttcggtccgtcttgaggagtgaagaaagtgtaagcagttccctgagaaattaaatttaataggaaatatggaacttcgtatcaccgttttgtcctgtcgtccagtcctaccaattcggtgcacatagccctccgcattgttcggatagtcaaagttaatcacatattttatgtcgcgcacatctgagaacaaatacagattctcatcaaattctccctgaaaaagctaacccaatcctcgcgcagcaacttcagttgcgataagaataggcattttgcccccacgaaattctaaaatttatgattgaatgagattttgcatccgtaattcatttgttcaccgctaagcacccattcgcgttctttttgacttttgtctccgtggatgcaaagggcgggaattcccttgtagcgcatctctctggtgagttcgtccacttttcgcttagtttccgcaaatatcagcgttttgtattctgtctaaatgaatattttttgttgaaattctgattcccattttattgcttgatttacctgtttcaaaatgtcattgagtaaaacaaataatcggtctttctttgcaaagtcttcgatgacttcaacattttgtttgatgttgtggttagccgacagatcgagggagccgacattcagtccgactggtgaagaaaggaaatcggctgcaagagaacgcacttcaactggccaagtggcagagaacatcaaagtctggcgatccggctataaaaaaggtaaataataaagacgacaaaagaaatgaatgacccggatttgtccaacgattgatcgaatctgcggttcgaatcccatgtccagcattcggtcggcctcgtcaagaacaagataagtacagttgtgcaagttcgtaacacggtcattgataaagtccattatacgaccaggggtggccacacaaatgtcaacgcctaccaaaagacaagcagaatttgagggttgtattgtttaagaattacccgctcttagggcgttttcttgaggcattttaccggctccaccatagcagcaagtcactttgagtcccatcatgcggcaataatcacgcgacacctcct

SEQ ID NO: 14137 - DNA, 1190 bp, Heterodera glycines
  misc_feature (1031)..(1031): n is a, c, g, or t
acgtcaaatgattgtccccgcgcctccgctgctcaccccctcattctttctctttctcccgcgatgaccaaattcttccgttggcttttgcgctttgaccgccaaatttcgtccttttcaatttgaccaaattttgcgctctccccaaaatggaaaaagtcccaaaataaaccaatttttgttgctatttttgtgggtttttcaatttttaagtcaattaaagggataattccatgccaattagcaccgtatttgtgcaccataaccaaaaaaacaaaacattttctgccgtttttttgctctacgtcggccattaccgtaacgcattttgtccattccgcggatggattcgcttcgaaacgctctttcacactccgcggcgactgttctgaaccaaacgcacgactcacacaacggagggccaacggcgagctttgtgaccagaatactccaggtcagtttacataattaaatacattcattggaattattgtccggtaagactggatcaactcagcaaattcataactgatcagagtgatcttctgatcattctgatcagccttttcctccaaccattcatgtttagttgggcttttgtttaggttgcacttggtctgttcgtgacaacctccgaactgccgcaactttccgacctccgttccgataattccgccgtcggcttcgactgcgacttttccctcccgtgccgttggcacagtgtcggcggcacggccgaccgatggaaaatggcccggggcgagcccgactcgattctgtggttggccgccaccggcacaatgcttcaaccaagtgatcatttgtccatcaaatgccaataagcaaatgccattccgtcacagccgaaccgttcgctcttttggaggtgcgcgagggtcggctggcggacattctctgctccgaactaatcggctgtcaggaagttccttcgctgctcagcttcacttattggagtgtcagtgcttccgacttggagatttgtctgctcggctcggactttcggcggctanactgcacgggaatgctccaagcgacggcccaaccgggcaaagtggcactgaaagtgccgccgatcagacggagttttcacgtgagaaaccggggaaatcattaaaattaattttaatttaatttaatggcaaactttcaaaaacagatcgcaatcattc

SEQ ID NO: 14138 - DNA, 2228 bp, Heterodera glycines
  misc_feature (2185)..(2185): n is a, c, g, or t
gccacttactccgcctccgttcacttcgtttcccaccgcttcgcccactcgcattgcgccctttgtggtgccaacaacggactttggcacgggcactgtgcgacctccgccacacgtcactccgccgccggatttggcatcgctgttcacttccacagtcatttcgccacgaactcggcccaacccgtacacgcgtcacagcgcaactgttccatgggagaccggcattccgaagtgaggcttgccatcaaattatttaattgattaattattggataattaattagtccttccaatttagcattttggtccattcttcctccaccacaacagtgcagccgttgccctcttttgagcttctgatcgtcggcagcaaaacgcgtcccttcttcgatcgccgccttggccgaatcactgaacaaacggacgatttgctgtgcgatttcacccacactttcccgtgcctttggggggccgagtcgggccgatgggcaattgtgcacaaaggtggccaaactttcttgttctcgactcactatctctcattttcctttctcactctctctatctcgccctatctctcatttcaattatctttccttccttttttttctctcactgtggctctctttctttactcttttccttttccccactctctcacctctcgggatgttttttttatcccgaaaaaattgcttttgcttcaggtgcaattccgtcgcttgaccaggagttggactcgtccgaggaggagtcgccccagtacccgtccattgttgtcatccaaggcacggcgatgctcagcagcgacccgttgcgctgtcagtcgggctcgggaaaagtaattaatgcctttaatgagctaattaatgatatttgtacaaacttttcgtccgtttttgtgggtgatttaacattttgtcactctttcagcttctttttcgctattggaccaatgggcgcgtgttggtccaagtctgtgccatcggatgggcggtggacagtccgaagatccaatgcgtggaggaggtggcccagcacaatcggatggaccccaactctttggcggtgttcgaactgtccgatgcgatccgcgaaccgttcaccgttcgtccgaaatgcaattaattaaattaattggtaaaatttctttgattccactgatcagctgaatgtggtgccaatttgggagaagaattcacacaacaattatctgatgatcgacgaaattgcgtacatcggcgagtgcaatttgacggcactgaacgaaattgaggaggaagagaaggaagagcacaacggcagaaagggcgagccgaaagaggtgggatggaatgtcagaacaaatatcaattaattaattaattggttaattagtgaattaattagcgggagtctcagaaagtgggctcccatatcaatttggtaatagtaaagctcaactctttttaatctttcttctgtgatttccctcaggtcgacttccccgggggtgttttgtcctctgtctccgctggcttttccaccacggttttctcgacacaaccaccgaaaaatgaaaccaaaaaaagcactgccacacatcggccgacccttccgacgacaaagccccaggcaataaaaattttttttcattttttttccttttttatttgcattttagagttcgtcttatgccacacctatcgcgactacggtagaccaaaccgtacctcccaccagcgtcagcagcagcggtgggcgaacctttcctacccctccgccttctcctcctacgccgccaccgtttattttgtcgtccattaccgtaccatttacactaccgtattcatccaccggttggacagcttttgcctctacagtagtcgcaatccctacgatttgtttcccttatgcagattcacttttttcgtcctcggccacgcctacccgcgagacgccctttccgccgaagagcagcaagaagccgggaacacgtgcatttttctgaccaatcaaatcccgttggcctctctctgttcactctctgcttctccccttaggctatcctttttttccgaacaatccaaagccaactcagccccgtcatccgaggcccagcacagttgggccaacggcacagagcacaattgacccggtggatttgataatgaccagcacaaagccagaggagcaaaagaanaaaggtgggaaggaaaagtcatgccgaaagagatgaagaaatg

SEQ ID NO: 14139 - DNA, 3316 bp, Heterodera glycines
ctcactttacagcccaatcggagcattgcttttgcatttcgctccgtgcgggcagttcaaaggacgggcaaatgccattcactcgctcaatggctgtcttaagcaattttctggcactcatcggctggttgtccacaaagctttcgacaatgtcttaaacatttgaaatcaggattacatgcccaaaaagtctaaaatcggcatgccggcactcgtacgactcccccccccccgaaattgttttggcactggcattccaattctatttttgggccttaccggggctccaccctttggtggtaacgcattgaatggcggagatcagtgcgccttgggcaaaaatttgttccgcactttgcacagtgtctttcatctgtttgatcaggcccagcaaagttgagtcgggttgtcgaagattttccatcaaaaaatccttaaaaatgcaattatttggacagttttagtcattgcattgcaaatacgcactgaccatcctcgacttgaggaaaagctgtaacagttcatccgcggtggtccgtggcctcaacaaaaggtaagcgaccaaagcactgacagccaaatgccactgggcaccggcagaacccattttggaggtggaaatgtcaagcaattccattcgaaaatggatgaattggtcggaaaacatcggcaccaccggaggatgggagaagggaagtgcaaaggaatcggaggaggaaagcgtccgatggaaaaagtcggcgacacacagacaaaaggcacggaccaaagggtcgtcggagacaaaagactaaaagcgagtgaaaaattcaaattaattggaaaattcaagcggaagaacgaatcgggtgcaccaaaaatgtcgcaaggattttccataaaattttctaataaaaaattctacgatttttttcttgaaaaatttcagtttaatttttttttttccaatttcggcggcgaaattatgtcgtcctgttcccgaacgaaccatggaaagcaaattttgaaggagcaaaaaacaacgactggcattgggtcgtaataactttggtgccactaatttggtgccatcttcgccggcaaaggagggcgtttcgctgggtttgtctttctgctgtccatgcacaacattttgcccaatgttcgccagcagcgaggccaattcatttgcaatttcggacagtcttttcactgtgttcgacgcctccaacacgtctctgtaccttctgccgaccatgcggcgcaactcctcacgctttttgtccatctcgcctctgcaacgattgtatttttttaaattattatttttaatttcccaatcaaaaaatataccaatacataggtttttgggttcgttggtcacgaatccggcacccattcgacctatttttgaaccctaacccgaacaaaaagtcgagaattaactttttaatgatttaataaacgaaattggtcggaatagtgccggattcgtgatcagcgaccacggaaatatatattggtggtttttgcatgtaaagtgaaaaatttgtgggggctaaacttcataagagcctgggaagtgccatatcggcaaacaaacaaaaccccactttagtgacgattggatttggacgagctgttcaacattaagctccctcatcattcggtccacgttatttaagtcaccactactcattattatgacctttcccaatatttgattagcaaaaaaaaaacaaaacaaaaaaagtaaaacgacgaatattgcaaaatatcaaacggaaaaagcaccaataaatacatatattttatacgctttaccaaaaaatgaattacagaaccatattgcgtaacaaaaaaagaccatttcactgctctgattcacccgccttgccagccacctgtcaaattcaaatgtcaattttaagatttagttattctaaaatttttttccaattttccagctagaaacaaattttttttgttgtcataagttcttgatcagtgaccctgaaaacctatgcaaacaattttcacgaattataatgccaaaaaaacaatccaaaaggatctccccactagtttttttaaaaagaaaattcaattattttcgaaggaaagcaactgaaagcatcggtgcttttacagctagaaaagtgcgctgctgtaaaaatacccgtgtgaaatcctgcatgttcgtagtcttcgcaattggcatgccgtaaattcgaaactcatcgacaacggttttgtcgccccctccaacattgtccttcacgaaaaactgcagattgaacacattctaaaccgcgtagagagaaagggagggggagaaagaaagagagacaaaaagaaaaaagagagagagaaccaaaagaggggaaggggtgagagagacaataagaggggagagagcgaaagacaacagagagagggagaggagagagggggatagagggaggaggcgttagatgtgaaattgaaagaataaacgagaatgcgagagaaaacgaagaaaagacaaaaaggagaattagtgagagagaaagagacgacatagtagagagaagggggaaaggaaaagaaagaagagagagatagagaagagaggagagaaagagacaacaaggagagagagagagatgggagggaggagacgctagatgcgcaattgaaagaatgaaattggactgatttttagaaaaaggccgggggcgcttaaataggaaaaatttttacgagggggcgggcacaaataagcacctgatcaaatgggacagacatttgaaaaaaaacaattcgaagggagcgaagtgaaagaattgggcaaaggaagaagcgcattctcacaatcaggcgaaagatcccacgaagtgaagtcggtcaatctgccgataatttaaaaaataaaaagaaatttgacgcgggacgacagataggggggggggggggcgttgggaattatatatggatacaaaatcacgaaataggtcatacatttttacaattgagggtataatttcgcaaatacttattcgctcatttgtaaatgtaaaataaaacttccaaaatggccaaatatggcgttaaaaatcattttagaaggaaaaacatgttaaagcttggctgatgaaggcctttctaataaggtttttggaaaaaaccaaaaaaggacactcccacaatccacaaaaaatggatttccatataattccgaacatttgtcattcattgcccacctgtccacaaatgcgagcacatggtcggcaagagcttcgtgtagctgttcagcctcgtgttcctggctgatcagaatgtatttgtctaatgtttt

SEQ ID NO: 14140 - DNA, 764 bp, Heterodera glycines
tatattaataaaagaaaatttttgtaagaaaatttttctgcaagtttttttgcacaaaattggccggagttgagccggccgaagaaaggaatttaaatttttgtgaagagatgggacaaatggcagaaatgggatttttaacaaaaggggactgcaggacgggggctgtttacaatttgaattgctcctctgggaaaaagagaattacggggggaggggggggggggctcaaagaacggatcagaaatcacgcagatgtgcaaaaattagggaattgccaccactgtcccctccacccgccccctcgttcacgcgcgctgagcccccccccccactctcccgctgccccctttttttgtttttccggtcttccctgctgagcttcctgcgccgtccgttcccttgttgatctcctcggcgaagactcggcttctagaagtcaatccgtagtccgcaacagtgcgtccatcatgcataggcatccctaaatagagatagaaatagaccttaccatcaagaaggagacgcacgttgttcgttgcagtacccatcaatccggctgccattcccctaactttcacaatgttatccgatgcctggaccggtatgtaatgccggtcgtcaaccaaacgaatagttagtacgaattccattttaatttagaaaactgcaaaaagggtgaagattttcgagggtggaggaaaaggagcgagagggaaaggagagagggaaaaaggggaaatggaagggaaaagggggaaaaa

SEQ ID NO: 14141 - DNA, 1946 bp, Heterodera glycines
cgcttccattctttccttttatgtacatatatgcgcgttctttactttagccacgctttggcgacccgcgtcattttttagcgtgcttctggaatcttctagagaaaagcaggttacttctttatgtgttttcccgttttattatttctttttatactttctcatttctccttcccactctctcttttcacccttatctctcccctccgaatctctctttctctcactgatcgcgctttcctttttcatgatatctcgctcttcttcctcttcctcgctctgtttctcacccccccgcgctccttctctttctctctctccctccttatcacaatgatcactcagtcacctccatttctttcccttttacctccgccctccctctctcgctacgctccttttatactctcttcgtctcacttcctcctattttttgtttctttttactctttctttttccctttcttttctacctttcctgcactctctcccttcctttttttctttcccccacactcttttcacacctccacccaaatgggttccattcttcttttcctttccttctacatcaaatattattgctgctttgtccatcattgccccagggaaaatgtcgccgatcgccccgggggaggggagggcggcggcagcgaaaatgggaaagagaagcagcgggtaattaatgggtaattagtgatgacgacagcgcccgcgtactttggagtttagtgatcaccatgtgatacgcattaattacaacaagaattacattttcaaggacgattagatggttttcaaggattttgcaggaaaatgtatgaattcaaggaaagtattgctcccattgagccgttttcgcaatatatgtcaggttttattttaggtcatcatcataatgaaattatgtaaaaacataaaaaatacaggccttaaccaattaaataaattaaatgcgaaaatataggcaaaaatgattaatttaagagctatttttacatcgatgggcaaattgctctaattttaaaggacattcttgaaaaacttcgaatttccacgaatcgaggaccacatatttcaaacatatacaacacataaattgaaataatcttttgaatatgattacgcttttcggcatcattaacactactaaacccaatttaattattagcatatgggcaaattgctaattttaaaggacattctaggaaaatgggctttcacttttttaaaacaattgagtttatccaaaacacaaatcacaaatcacaataatccttttgtatatgattgcgcttttcggcatcattaattaccacttaattatgatgccctaattggggtcatcaaagggcatcattagacacatttctcacccttttaactcaaattgccgcctcgggcccatgtaaaacccaaacaaatatttttgttattgttttaggtatgatgatggattaatgtacatattgctgcttattattatttgccaaagaacaagcccagtggttgtttggtcatgccaattaacaaaatgagagtgtgccgtcctccgccggcgccgccgttgtttgtgggcagtgctgtgacgaatgagtaatcctcttaaaaacaggacgaatattgcaatttttctgctgatctttagggctgcaaaaaatatggaaatccatatttttttcctggactgtgggaggcctgaaacgcacgaaaaacatgtttgaagcttggtttgaagcttctaggatggatttctatatccatattttccgtatttttccatagttcgcgaactatgtccatattaccatatttgaccatattctgagattgttccaaaaaaacatcaataaaacgacccccaacagataaataggcttctagaccacgaaaaatcggaaattctttcgaaaaatcacgctttagcccaaattgttttgaaatat

SEQ ID NO: 14142 - DNA, 1577 bp, Heterodera glycines
tttaccaagttaatatactatgaaaaaaaatattatatttaaaaaatgtattcggtctttgggaatttggggtgtgcaagagttttcttggtctttagtcttgagttaattccggtgtgtttttttgtatcagtttagagttcaatctgacttttatgtgccaacaaatgaattaaatcagaagtcagcccaaatgccaaaatttaacgctgtagcaatttcgcttactgtcacagtacgcttgctgataggcgcctttctttgggtaaatcatttttacgataccaattttttttaacttaatcagtggtaattaactcattaaacattatttcattcttaagtttaagcattcatcgccatccgacactgaatataattgacgggaaaaagagacaattttttgtgatgattagtagggagtgtaattatatggatataaaatcgcgaaatatggacataaaatggcaaaaatatggacataaatttttcaaattgagggtatgatttcccaaaatttctttaaatttgttaaatataaagtaaaaccttcaaaaatggctaaatatggtattaaaaatcattttagaagaaaatacacgataaagctaaaatttactcatttttagcgaaaaatcaaccagaaaagtgaaattttatcttttttgcttatttttgacataaacttattaatttttaagaaaatttaaatttattcaatattcccgagaaaatttggcgaaaaaattattttttggaaaattttccggtttttgggctcaaaaaggccaatttagctgctgggggccgttctaatagaggttttttggaaaaatcccaaaatatggacaaaatgccaaaatatggacataaatcgcgaaaatatggaaaaaatggatatggaaacccatcctaaaagcttcaaaccaagctaaaaacatgtttttcgtgcgtttcaggcctcccacagtccaggaaaaaaatatggatttccatgtaattctattctattccctaatgattagggatgattcgtagtagcaaaaaatctcaacgaagtaatggaaaaaatatggcgaaaaaaatgaatttatcttagaaacatggataaatggcatttctattttaaagcgatttttccttttgtttttgtcatttttcaaaagattataattgaaatctattctggattcattcttctctgtcataaaaaaacacattaattaaaagaattccattttggcatcgaaataaaaaaacgcaaaaaatttggaacgcttcacgaatttgcgtgtcatccttgcgcaggggccatgctaatcttctctgtattgttccaattttagtatatgtccatttggaatgaacgaaagcggtgggagggacatttcttatatatgatggaagagaatgttgagtaaaatttttgatgggttctaaatgaggaaaggcacaacggccctctgctgcgctcttttcgtttactatttttcttttccatacactctctctttgaatctcctctcctatttctttgccttcttcactctccttgtctcttccctcttttcacagaa

SEQ ID NO: 14143 - DNA, 1610 bp, Heterodera glycines
caaatttacttaagagaaatttttttatattaaggacgttgcggttatgagaagataaagtaccggcgaattcgggggatagcccacgacgaaccagaacttcattcgtttgcttataccctggtatgttaaaaaattggtctatatttatgagtcatcctttcaaattagtgtgctatcagaacatacaaatacttaggtggtaaaccaacgacggcgccaaccaacaatcagtttaattccatacaatgagacccatgttagaagtattttttgagttatatttaaatttagtttctcttgacctttcctccacctcatccctgattcccggaaaatttttgagaatctattggataaatgaccattgagccaatttgtttatttatactaaaaaatgttcaaattttcaaggaatgtaatgttaaattcttcaaaatttcttatgaggatattgcaaaaattgctttaaaaattttctaaatttatgtacatattaaagaaaaaagtattattatttaaaaaaaaatttgagctttgattacttatgataaaatggcatttttctacaaaaatctttaaaaatatacaaaagagattgctatgagaataaattgtatcccaataaagaaggaatagaatcaaagagaataaataaccactaggccataggagtgattttacccaaatattaaattagtgttttaaatctttcttttcctcaatttggtcagaaattggacccagaccctcagtcttgctaaagtattttggtacccggttggtccctaatctactgggtcgtgtaccggatattggattttcaaaaaaccaggctccgagtccgggtctggatattgaaaaagacgggtatctgggttgccgcaaaaaatttgctttggtaacccggtttttgcccaaatacccggccccgtgcatcctagtctaaagtatatgcttcgcatttctttttctttgaaatccgttctcatccataaatttattattttttgtctttcccatcaaataatttttttaagctataaaataaaatttttttattcaaaataatgtttgacatatgttatggtttttctaatggggtgtgatacaaaagctttataatttgattcttaaaagtcccagcctttcacttaacttttcttcttgtgaaatattttctcttcaagataactattgccgacaaaaaagaagtcagacgtttaattgaaaaaacctttaaaaaggttaagtgcggcctgcgctctgtgtggaataaaacagaaagtgtaagcgacaaaatgattattcttaattaaaatttttagctggtgcgcaaattggtccgagtgggatcaatgaacgaagaacaagtgtatcggcggtgatttttgttaaaaaactattgccgacaaaaaaaaagtcagaagtttaattgaaaaaacctttaaaaaggttaagtgcggcctgcgctctgtgtggaataaaacagaaagtgtaaacgacaaaatgattattcttaattaaaatttttagctggtgcgcaaattggtccgagtgggatcaatgaacgcagaacaagtgtatcggtcggtgatttttgttaaaaa

SEQ ID NO: 14144 - DNA, 1645 bp, Heterodera glycines
aaagctttataatttgattcttaaaagtcccagcctttcacttaacttttcttcttgtgaaatattttctcttcaagataactattgccgacaaaaaagaagtcagacgtttaattgaaaaaacctttaaaaaggttaagtgcggcctgcgctctgtgtggaataaaacagaaagtgtaagcgacaaaatgattattcttaattaaaatttttagctggtgcgcaaattggtccgagtgggatcaatgaacgcagaacaagtgtatcggtcggtgatttttgttaaaaatttttcaaatttttttttcaaattttgtaatattttaaaaaataatttttttttattattattattaaattttctcaattaaataagctaaacattttaataatagcaatttcaaccttttcgaaaatagaatttaaaacatccagaaatttaagcgagattgggaatttgcgtcttccccggccgtaaacgaacaagaataatctgcccaggtgaaaattaaaatatgaataacaagaactgtataggcaagtttatgggtgcatgaaatacagataatttggttgctaaaattctgtcattatttgaaatattttaccagttttagaatgtaagctcgcgacaaattccacaataactttttttaatttttcggacatgggtcaaacgagtccgggtctggatattgaaaaagacgggtatctgggttgccgcaaaaaaatttgctttggtaacccggtttttgcccaaatacccggccccgtgcatcctagtctaaagtatatgcttcgcatttctttttctttgaaatccgttctcatccataaatttattattttttgtctttcccatcaaataatttttttaagctataaaataaaatttttttattcaaaataatgtttgacatatgttatggtttttctaatggggtgtgatacaaaagctttataatttgattcttaaaagtcccagcctttcacttaacttttcttcttgtgaaatattttctcttcaagataactattgccgacaaaaaagaagtcagaagtttaattgaaaaaacctttaaaaaggttaagtgcggcctgcgctctgtgtggaataaaacagaaagtgtaagcgacaaaatgattattcttaattaaaatttttagctggtgcgcaaattggtccgagtgggatcaatgaacgcagaacaagtgtatcggtcggtgatttttgttaaaaaactattgccgacaaaaaagaagtcagaagtttaattgaaaaaacctttaaaaaggttaagtgcggcctgcgctctgtgtggaataaaacagaaagtgtaagcgacaaaatgattattcttaattaaaatttttagctggtgcgcaaattggtccgagtgggatcaatgaacgcagaacaagtgtatcggtcgatgatttttgttaaaaatttttcaaatttttttttcaaatttgtaatattttaaaaaataattttttttattattattattaaattttctcaatgaaatataatttggttgcttaaattctgtcattatttgaaatattttaccagttttataatgtaagctcgcaacaaattccacaataactttttttaatttttcggacatgggtcaaa

SEQ ID NO: 14145 - DNA, 828 bp, Heterodera glycines
gtcgcttcacttattaccaatccactactgctgtaaggatcttcatcatactacgtgcacacatagtttagcgtataggcaacggaacgtgacacgcacggtaccgttagattcgccacatcatgctgagtctacggacaccgatcgcgtcccgttccgttgcatattcgcggcacagcgactgctttcgtcggttcactttttaccaatcgactactgttgtaaggattttcaccaaacttcgtgcacacattgtttagcgtataggcaacggaacgtgacacgcacggtaccgttagattcgccacatcatgctgagtctacggacaccgatcgcgtcccgttccgttgcctattcgcggcacagcgactgctttcgtcggttcactttttaccaatccactactgttgtaaggattttcaccaaacttcgtgcacacattgtttagcgtatgggcaacggaacgtgacacgcacggtaccgttagattcgccacatcatgctgagtctacggacaccgatcgcgtcccgttccgttgcctattcgcggcacagcgactgctttcgtcggttcactttttaccaatccactactgttgtaaggattttcaccaaacttcgtgcacacattgtttagcgtatgggcaacggaacgtgacgcgcacggtaccgttagattcgccacatcatgctgagtctacggacaccgatcgcgtcccgttccgttgcctattcgcggcacagcgactgctttcgtcggttcactttttaccaatcgactactgttgtaaggatttcaccaaagttcgtgcacacattgtttagcg

SEQ ID NO: 14146 - DNA, 1297 bp, Heterodera glycines
tcggttcactttttacccaatccactactgtgtaaggatttcaccaaacttcgtgcacacattgtttagcgtatagcaacgggaacgtgacacgcacggtaccgttagattcgccacatcatgctgagtctacggacaccgatcgcgtcccgttccgttgcctattcgcggcacagcgactgctttcgtcggttcactttttaccaatcgactagtgctgtaagggttttcaccaaacttcgtgcacacattgtttagcgtataggcaacggaacgtgacacgcacggtaccgttagattcgccacatcatgctgagtctacggacaccgatcgcgtcccgttccgttgcctattcgcggcacagcgactgctttcgtcggttcactttttaccaatcgactagtgctgtaagggttttcaccaaacttcgtgcacacattgtttagcgtataggcaacggaacgtgacacgcacggtaccgttagattcgccacatcatgctgagtctacggacaccgatcgcgtcccgttccgttgcctattcgcggcacagcgactgctttcgtcggttcactttttaccaatcgactagtgctgtaagggttttcaccaaactccgtgcacttattccaatcgactagtgctttaaggttttgtctttgactttgctttttttccatttattccaatcgactagtgctttaagcttttgtctttgattttgctttattttcattttttccaatcgcctagtgctttaagcttttttctttgactttgctttatttttcattttttccaatcgactagtgctttaaggttttgactttgactttgctttatttttcatttattccaatcgactttgctttattttccaatttgggatttttttgtaatttcgctcttttggtcatgaccgtcagggtaagtgctggctagcgctttgttccttgcggtatgctacggctgctgctggggtgccacgttagtcgtggtctcagtttctccagcgttcggcagtcggtccccgcctcgggactctaaagatgcaggtggccagccgtgccggtccccgcctcgggactcaaaagatgcaggtggccagccgtgccggtccccgcctcgggactcaaaagatgcaggtggctagcaagagccggtccccgcctcaggactcaaaactctgagcacattgaacggtgatggctgctgctggggtgccgcttttggtggccttagtttctccagcgttcggcagccgtcgaaaaacgaaacaagcagctttgctgttgt

SEQ ID NO: 14147 - DNA, 2030 bp, Heterodera glycines
accaatcggatgggtatttagctgccggtgccatttatgtaccgaatggcttgaacagagaagacagcgacattgacgaatacgaagatgagcaatttaccttggaacagttgttgatgtttcattcaatgccagacttgccaaatcaaagtccacccgatgcctatgatgccatccctcgcggttttgatgggtcttcttcgactgacggttcggcacctggcactccaaagcagattgcttggggcgaaaatccattcgacactgagcattttccatcatcatccagcagaacttgaattttgtctaatgataagataagaagattgttcgctgacatgaagaggactatgaatttttgttctaaatatacatttttaaactttatgaaacattatacatatattttgtaaaggtttccttttcactaaaatgttgattatcgtttttctataaatgcattttgatgtaatcggcaactctaggttatctcgtttggtaaacagttttgaatgatttatctttattaaatagttagatataaaattaagttttgtgtgtgctgttttgatacataaaaataataagaaaaatttatttccatatttttgtgcctgttttaagttattaaagttatttctgcctatttatgcccattttgcaatccttattagctattggaaatcccgatgttcaaatttaccaacgttcttagctccttaaatgaataaatgaggcactaacacaattttcaaaaggcttaaatatatgaatttaaaaagaagtagatttttatttccggcttttccattgtaggcttttaaaatatgtatatgttttttacatatttccggtattgataaacatttttattgagtgaaagacttattaatttcctgcgcacatattttcatgtgattttataagaaaacaaatatttccaaaacaacaaaaacaacaaggaaatacatatattagtctgtatttaagtgttttcttttcaagaaattattgtgtctgaatatttttaaacagttacttcacatatttcatcatatttaaaaaaattaaaagtttttccctcaaaatatttaaatgcctaaaaataatttttgtattttaatattattttttgtattacccgtttatctgaactagagcccggaaatttcaaatttgcggatcctgttgcaggattagaattcaaaaatttttgcaggaccggacccggccggattaatcctgcaaatcctgcatttaaaatctgcaggatcctgcgcaggattgcggatttttggaaattttgaaaaattttaattaaatttcaaaaaatttccaaataagaaaaaatacctgatattttgaaaaagaaatttttaggggctggcgggatgcattaaaaggggcgtctaagatttttcgaatgggtcagagggtaaaaagagatcgggaatcaaatctgttaatggtccataaatttgactattttttgcttttcaaaaatgctttttttcggcgaaattttttcataaactaggaacaaaggggtccgtttgtgccgataggcgccgccgcaaattatttttggaaaattttgacaatttcttatacaggattaataagtaaaagccgatccggtggtgccgataggcgccgccgggaaatttttttttgcaaactctaggtgaaatttgagatgaaattggatttaatttgattgaatttattataaatttattcaaaattttggcattctgttcttatcaaaaaatcaatgaaatcctgccggatcccgcacaaaaaccaaatttgcggatcctgttgcaggattggaattcaaaaatttttgcaggaccggatccggccggattaatcctgcaaatcctgcaatcctgcaaatcctgcattttcctaaaaatgcaggattgcgaactgggatcctgcaaaatcctgcgcaggatccggtcctgcgccgggctctaatctgactcatggggttttaaaattgggaaactccggaattattgcca

SEQ ID NO: 14148 - DNA, 1244 bp, Heterodera glycines
  misc_feature (50)..(50): n is a, c, g, or t
  misc_feature (120)..(120): n is a, c, g, or t
tgaccacgattcttgatcagaggacaattagtgctgtgaagcatcgccancacacgcggaaaaaaataaatgaaaaagatgataaacaattagctgagttacagtacgaccccgaaaggntttctgtaggggttgagactgacccccgagctccccactccccgtcccggttcttagacttttttaaaatctgctccccaaccccgatccccgaactgtcctcccccgatcccggacatgcgttcctccctgacgggcagcgggggaggggattatgcacagatatgggtgttgaggaaaaaattttcatgaattggaaattttatgaaaaaataaaaaaataatttttatctttttaaaaatagtttgattggctattgttaagctttgtagcatttataacgaaaaattttttttaattctcactctcaaaaaatatacaattatttatttttaaattagcctaaagtttaaaatatttcacaccttttcggctttgcctgagcatccgtaaattatacgagaatcacctaattatagtttaaaacaaaaagaaatttcagccttatcaaagacaaacacggagaagcatctggcagcaataaaagtggcaacaatagacggcacaattatcaccaccataagagcaaaagtagtgaccttcacagaagaagcacggaattacacagcatttcacgacggcatagtgccgactcaataaatgagtcacgtggccaaaggagacgctcaaaaggtagagagaggaccacccaaaatataaagggtgttcacatcggggaaattatttaattagggagcaggtttttaggaagcagatttattgttttttaactaagcccaaacttatcagaatgaactggatttggcaacaaaatactttggctaagtggataacttcaagtaaaaatccaaaacttttattcacgtacaaatttaaaaaagccatcaaattttaaaaactgaactcatttctatgtttttaataacaggaagattattttagaaaatgtttgaatttatattgaattttgtatgtaattagaaccaatacaaaaattttcctgaaaagtttcaagtcactcgaagacaatgaatatgttacaaaaaggcattttcatgaccgttatttttaaaagattccagctcattatcatttgaatactcttggagtcaagccttttaaacttaatgcttaaatggctcataattacttatcataaaaa

SEQ ID NO: 14149 - DNA, 1189 bp, Heterodera glycines
tattttatttaaaatacaaaaattacctccacaaaaaacgcctaagaatgcgaggaggacgatgaaaattgcaagacggcggaagagggacattttgagggggttttgtttttaaatttaaattatctgtagaaaattattattattattattattaactttattttttaataaagcataataataaatgaattccgaccagaattagcttaacatcgaatgctttttgatgatgatcaatgaaaataagaggagaatgaaagtgaatgaatgaagtgaatgaattggttgtcgagcgacggacgaccgaaccgattctgatgatttgatgattcattgtgaaagtgctgttttatgcataataatcaaataatgtaaatgaataaactaataaattaatcaaaaaataaagttattttatttttatttagttattattggaataaataattatagaaaatttaaaaaaacctgaaaaagtgaattaataaagtgaaaagttgaagaaaattaaaaagctaaaaagcttgaaaattataattcaaaaataaataaatctaagcgataaatacaaactttaattaatttttattaaaataaacattttaatataattatttcatgaaataattcacttgtccagaagttgggcattcaaaacagatgaaagaaacattaagagaaattcgcgacttaaagaaattctgcttttccaaaggcattgttggtttaaatgaaaaatttccttgccaagagaaaattttttctaatttgaattttaaaactgttttcaagctaagcatttagaattttcatagcacgatgaaagattttctaatgttgtgtaatttccaaccaattgcattcaatttcccaaaaatgttaccggctgtgaaatcccgaccgaccttgccgacccagacatataatgaaaaaatgaaaacccaccggtcgatttggacaaccccgacaaaccataccccgcttttcacaatctcgacaaatctcgaccccgacatttttcaaccccgagaactgacatttcccgaccccgacatttttcaaccccgagaactgacatttcccgaccccgacatttttcaacccagaggaatgacatttcccgaccccgacattttgcaagcctcgaaagggggcatttcccgaccccggcaaaccccgatcccga

SEQ ID NO: 14150 - DNA, 2146 bp, Heterodera glycines
aaaaattatcggtgtttctcttcgtatttgagcaccatttatagagagaagtcaaatcatcttcagaaatgtttatttgtaaaaacataattcttatcatttgtacgatgtattaatagtgctcatatttttaagcactaaaaataccaaaataggcaggatggaaacctagaaaattggcacttaaaaacttgaaagtacttaaacataaaatttttcatatatttcagaccaagggaatctcagaaaaaaaattgaaaaaagcaaaaaaatatgagcccaaccaacctatcaatagcaaaattgcacaacgaagtgaaaatatattcaaaaaaatttttgcattgaaatgaaatgcccaaaaatttaaaaaaatatttttttccttttctccgctggtttccaaaaaaaacaatcttttgtttaccaacttagtttattgttatgtatgtattgctggtgccagatagtttttccttatttccgccactttggataatttatcgacaaaaattcttataactttgctaataataaccatataattgcattcttacttttattcaatagcttaaagtttatttatattttcaaaaaatttcatttcataatattttaaaaaattttataaagaaaaaaaaatttttttgaacattttttgtcaaatcattttgaaaaatgactgttaaactacaccaagttattttaaattatttatttctgtaaaaaaggaacacttaaattaagtttcgttccttaggtctttcgtaaaaacttattttattcgataatttattttaaataataatctatttatttttttaaaaaatcaataccatgccttccaacaaaaacgaatttccttcgagcgaaaacaactttaaatatgtaatttaaatattttatttaaatttaataaatgtgatttttcaaatctattattaatttcaatttgattcaaagctttagttgcgtccgtacgaatggctttgtgttccaaaaaatgccacactcgcgctgatcaaaaaaaactacaaaacacttgccattgccacacacccggacaaaaacaatcaatgcagcggcaaattgtttacggtttgggttactgtacaatttaatttaatattttagcaagatatataaagaaaattatattcagctcattagcaatgccaaagatgatcttcttggccgctccagaagctgcagcagaatggaggaggtccgtttttgaattcttaaaatttggaacgatttatattaattattaattaaaatcactaatatattaaaatattaatttttcactaaattttactgttaatatgtacaggaggacaaccaccagcagcaaacgaacaaatccaacaaggtcttcgagaaacgagtgtttgaatcatttccgaaaaatgctgctgacaatgatgagaagagcagtgatagtgaaagtgaaaagggtaaaaattgggaacaattacatattaagcaaatctaattaaaaaaaaacattgcttaatattggatttattaattcagcaccaattttaaaatactatgctccagggttaattgatatcctaattttggtcggtaagcacataaattcaatgttatttagaataagcaaaaaattaaaaaatttgatttggtatgagcattatgtgttttcgaacctaaaaagacatgaaaacactaaaacctagtcctattattaatgcgaaccgtaattttatcaattaattatttttatttaatattttatttttgaaaataaaagtttactttacctaatattaaattcaatttataaacaaattaattaattaattatataaattgtagatgatgagttcaaaattgctgatgagaacttgtggtcggtctataaaatggtatgatttttttaaacattcttaccttttttttttgtaaattgcctaatcctcctaccgtactttttctataacatttgggaaaagatcgttagaaaagaattttttcaatcttcagttgcgtccgtacgaatggctttgtgttccgaaaaatgccacacgcgcgctgatcaacaaaaactacgaaaagctttccattgccactcatccggacaaaaacaatcaatgcagcggcaaattgtttacggtaa

SEQ ID NO: 14151 - DNA, 4672 bp, Heterodera glycines
attatgctatttaaaaatacttcaattaggaattttgattttctgatttctcgagtctccggagcttaatgttaactatttaatctgttgatttacaacatgggttggcacaaataataaatttacgcgtctaagcaaatgtaattggaagaagggttccaattcaaacgctaaaaaaagattcaattaggagaaaattcgttcattggcaaaacaataaagacgatgaaacaatggcggcaaatgcaatcgcaaaaggcgggggataaagcaaagaaaaagccacggaatgaatgcggagaaaaattgctaaggccaccatcggtcggctccattcaaatgccaatccaattattctgccccaatttgctcatttgtcttctcgggaaaaaccacaaggttttgttgtggcggagggtaaaaagtggcgggtttgtgccatcggagaagaaaaatgaaaaaaaacagagaaaatgctgaaaatgacgaatccttcccaatttgggaaaaatgggcgcgaaaggcgcaaagaaatgccaatttatcatagcaattaattaatgggttggctgtgccattgtttaaatcaaatgcaaaacgaagcgtaactgtaaacttaagataatttctattgatattcctactgtgcccaatttaccgtatgccatggggtattattttttgttttctgcctaaatttagcgtatgtccatttcgctttggccaccctctcttgcaatcaaatgcatcagtgccccgctgatcactgattgattgcttgcttatgaccagtgatcaccacctttgctgctgctgttggatgtgtccctccgagtgggcccgttgccgtagcgccgaaatgtccaacgccacggcggcgcacaagcctccggcgccgtccagcggcagacagcgtcggaagcgtcgtcgccggtgccgtttgccgacattagccgcttcctcctccgcttcttcgccaatgttggcactttcctggtgccgttgttgtgccgtatgctcctcttctcccatgttttgctgctcgtcttcttccttttcatccttccgctgctttttgccattgtccgtctccccactgcgcttttccttttccctttgcttttcctttttcagcgtcggttcaatgactacaacggcggacggcgatggcattggcaccgtcgccgtctccgctgccgccccttcgtcagcatactttggcaccatccttcgcataatttgcgctttcttttccactcgaatcagatcagtaatcccttcctttttcgattgctgcaacagaacgaaaggattggaaatgggaggactacggtatgcgcaaaacgtttctgaacactatgccaagcattgtttacaaagaaaaaataacttcgtaaaatttcgaggggactttcataaatacggcatccttttacggtaggggtcaactccgtctggccaactccgtctcagcaatgttcaaaaagctataagttttttctttgttggccaaacttcacaatcatggtatcattcgaaagccctagatgtttagaagatatttataagctatttctcagtgattaatcagctctcaaaaaagttgtcagttgaaaaccgcaaaaaaggcagaattttcgaagttttttatttctatctttttttatagttcgaaattttctgtaatttttagtaggctaatagagcctgtaaagagctttcgaatgatatcaagattgtttgattcggtcaataacttcaagagttatattgactcaaagttggctcagacggagttggcccgttccgatccttttagacttttttttgaatttgcctgtttggcgttttgtctttgaaccaaaagcacaagggaatcgttttgaactttgaactaattttttccaacaaaaagcgacaacattccctgaaggcttttcatcagacagaagagtgatttgaaagaaacaacattttgtgctttccctcctaaacaaaaacagccaaaaaaataaaaataatggaaatgtgttctcctcctccgacccaatttgccataggtcaaaaattggccaaatttttgccgcccccccccctcgcgcctaattttgcttttgtttgccatatggatttgaaaaggcagggaaataaagcgaaattcggaggggagggacagcaaaacccatcacacccacgtcgaaagcgttaccaaaattagacggtttgtgtaatcaaatgtatttatataaacataaagtaatgaaaatatttaatttaataaataaatttagtcatccgaaaaaatgattggaaaagccaaaaaaaggagagatcaatcaatgggagagaattataataagtgacatcgagaaaccattgtgagatgggagaaggcaaagaaagagagcagaggcagagagaaagtggcagagaatggggaaagggaacacacagaaacaaatgccaaacggaaagacggcgaaacattggccccccggggaaagagtgagtgagtgattgatgatcagagccatcccaacatccatcgctctttcatcccttcccttttcctcactcatccgctgccgatcacagtgcctctggcgcctctccgctgatcagtgatcggtcccttcgtcctcatcctccccctccccgtcttccgccgtcgctcggacgaattgccggggacggccgcccggcagccgctgttgtccgtgctcgggctgccgctgctggtggtgcccattggtggccccagccagaaaattctccggatcccaatgctaattgtaaggggggaaagtaatgtaaaaactaattagtaattaattaattgacaaaaaagaccgcccaattgtcccgtgagaaaaaatgacggagaaaaatgggaacaaaagggcaaagtaatggaattttaaccaattttatgagagcgttcggttttgaaagggaattcccgaacttgatgttttttagaatttttttcctccctaccatctcaaaaactcacatcgccgtgttcaatttcgggtccgttgtgcacaatgtggacagtgacgcgctcgttgaactcgagtccgttcagcaatttgggagtcagtctaagggaaagaatttttacatgaaaatcaagtttgctaaattgaacaaaaaagatcattatcgaaaaattttaatttttgactcttactcgatttcggggtttagaaatggtcaaaataggtgtgagattcgtaagcagggactcaaaacgcgtgaacaaattttcatgactgggcattatttataaaaaattttgcaacccaaaaggctatccctcccttttgtttttaataaaattcaaaaccaacctaattttaattagcgcctaaaattcaaacaatttgttttttgaaaatttggcaacctaaatttttacgattgtgtaaatttcaacttataatccaaatttaacacaaaataaggcatcgaaaacgaacaaaaagtattgcgttttggcaatgttttcgccgcctcccctcgccgtgccgctgttgcccagcagacggaccatcatgttgaagacggcccgctcgttgtccgggtccatgccctggttgatttcgtccatgcaacggaacggcaccggacagagattttgtagtgccaacagataaagcattgtggccacactgcgctcgccgcccgactgcgtgtgcgggtccaacacgcggaggccaacgccgttgcggaatttgacgaggatggacagaccgtactccgcgacattgtactgtaacaaaagaaataacacactgtaaataaatggaacattaaattttaagaatagaaatgtcgaaatcaacaatagcaccgccgagtgaatttttaaaaattcggcatcaagtacggaaaaataactcgaatttttcagaaaatccacaaaattactaattttagatgaatgatttttttcgaaaacgcgccacaaaaatacggtttgaaaagcaaaaaaaggtcgtttgggggaccacccaagccgaaatcctccgtccctggcaggcataaaatcctaggggaaattgtcgccgaacattttcccaaaattccatcgccccttccaaaacaagggcatggccatggttattttggccaaaaccaggtggggttggctcactttgttctccggcggcgtgtcgagccggacttcgccggcacagccgagttgggcgaaaaagttggtgaagttgttgctgatgttggccaccaactcgcccagcgggtccaaccactcgctgagtctgtcgtccatttcgcgcttccaccgttcgttccgttcgcctactcgccgcacttccgcgcccaatttgtcgtgctcctccaacagtcgctgatactcgtggacatcctgtaaaaaatgcaatattaatttaatgatgtattatttagtgggagcagctcgtccccccccccccccctccctcccgccggccccgagaaattttttaaaaaaaaatttgctaacttagaaatttttcaagaaaaaattcttagaaagttttttcataggaaaattctaagaaaaaatttttttgagaaatttttatggtgaattactaagatttttcaaaaaaaattccaaaaatcgctgaaaatttctcaaatttttttttcttagaattttcctatg

SEQ ID NO: 14152 - DNA, 2000 bp, Heterodera glycines
ccacgcgaaaatggcaacgcgaaaatggccacgcgatcttcctcagcgcgaaaatagccacgcgaaaacggccacgcgaaaacggccacgcgaaaatggccacgcgaaaatggcaacgcgaaaatggccacgcgaaaacggccacgcgaaaacggccacgcgaaaatggccacgcgaaaacggccacgcgaaaatggccacgcgaaaacggccacgcgaaaacggccacgcgaaaatggcaacgcgaaaatggccacgcgaaaatggcaacgcgaaaatagccatgcgaaaacggccacgcgaaaacggccacgcgaaaatggccacgcgaaaatggcaacgcgaaaatggccacgcgaaaacggccacgcgaaaacggccacgcgaaaatggccacgcgaaaacggccacgcgaaaacggccacgcgaaaatggcaacgcgaaaatggccacgcgaaaatggcaacgcgaaaatggccacgcgaaaacggccacgcgaaaacggccacgcgaaaacggccacgcgaaaatggcaacgcgaaaatggccacgcgaaaatggccacgcgaaaacgtcctggcccgaaataaaagtaccatttttttttctccttcttttgtggcttatcgtataaatgattaaattcttggcaagtcgctttgcctttgacggttgagtgagattgctgttagtttgttgtccaaaatctgactacgaatttcttgactattcgacatagttatttcgcattttctcactttctatgcgtgatttcgacagcaattgaacccgacaattagagactgggtttttaagaattattgacaaaaatgcaataaaaaaacgaaaaataacatataagattttcccaaaaaattgagaacaatatagccctaagaatcgaccctaacatttacaaaaaggacatccataagaaatgaaaaggttcttaaaaattcaatctcgaaatttttttttactcctttggcatcttgtgacgtggaaatcttttttcatttacaaacaaataaatacaatataaatcaaatctgagatgcgaagtgaattgtagactcaggacgaactacgtacatttttttagtttcttctcgctttccaataaacaactctacagccggctctaaattcctataaaatctcaaaaaatttaatcattcacttcaaattcaacaattaagaaacaattgatccgtattgaaagcaataaaaatgtttattaattttcttatcaaattgtattattatatttaaatacaaacttagaatttttaattaaataaaaaatgatatgaacatggaaaagatatctgttgagaaaattattagcgacctttttgtggtttatgctcgaggaaatcagcatttacatgaaaaaacacattaaaatatctcgaaaattttttttactcctttggcatcttgtgacgtggaaatcttttttcatttacaaacaaataaatacaatataaatcaaatctgagatgcgaagtgaattgtaggctcaggacgaactacgtacatttttttagtttcttctcgctttccaataaacaactctacagccggctctaaattcctataaaatctcaaaaaatttaatcattcacttcaaattcaacaattaagaattgaatttcagcgaagaaaatgccaaaaagaaaacactgtttgactttgacctagggttaagccccgagccatttaaaaactttgtcctggatttgaaaataaaacacatttgctaactctttacacctagcaggggtagtgcgtgaactgaataatccccgtgttgatcgagcaaaaaaaaatgccgtggattgcgcatcgctgatcgcgcattcaaaaattcaaaattttccgatttcgtaaaccaattttttaagccatggataatcatttacatactataaagatttaaattaaatatatagaacacattaagagggggcgcttaatttgattgtgcacagtctaag

SEQ ID NO: 14153 - DNA, 1783 bp, Heterodera glycines
  misc_feature (1692)..(1692): n is a, c, g, or t
  misc_feature (1698)..(1698): n is a, c, g, or t
  misc_feature (1711)..(1711): n is a, c, g, or t
  misc_feature (1725)..(1725): n is a, c, g, or t
ttaagaaagatttattattcatttttgacatttaattcaaaaaaaaaagcattctaaaatattgaaaaaattcaaatatgaatttaagaaccaaatttgtttaaatttactttttttaaatacttaacaataatcaacaagatccactttttaaagattaaaccaagtttgtcattcatttcataaattttagataatataacaataacaataaaaaaattaataaatttctcgacaattacttaacatattcatcattattaacgcaagtgcattgattatagagatcaaaaaaaataataattggcaaataagcacatagtttttagctcgttacataaaattatacaaattataaatttatgataattaaataaaattaattttcttgttaattaataaatatggtacaacaataacgcaaaaaatttattatcttttattttaaaaaataaatttaaaaaataagtaaaataaaagcattttaatataattatacaagaaacaaaaactttaatagattaaaaaccgtaaaattattttaaattttttaataaagattaacataggactacaaggaaattaccgaattttcaacttttattgcaaaatatgttaccaaaaaacttttaataaatcaatttaagtccaattaaacatttaaattactagctaattaatccgtttttttactcaaatattaatcataggtaattttttaattgttaaattaccagcagtcaaataattaattcacaaaacataacataggatcataataacataataaattttccaaaggctttacaaaacaaaatattataaaagaattattttaaaatgtttaataaaagattaacataggactacaaggaattaccgaattttcaacttttattgcaaaatatgttaccaaaagactttaactaaattaatttaagtccaattaaacatttaaattactaactaaataatccgttttttactcaaatattaatcataggtaattttttaattgttaaattaccagcactatttatatcaattaattaattaatgcaccaaaatatgacatagcatcataataacataataaatcaaatggacaattatatgatttaaaaaaataatagaataaatagtttaaagatttaattgataattcaaaataataaagacgtacatcaaatttaattgaaattaaaaataacaaaaaaataattcaaaaatagggaaagaacataaaattttaaagattatgaaggcgacatcctaaatcttaattgaaattaaataaataaagtaattcaaaaaataaataaagatcataaattttgaaaggcacacaaagtaatccattttatgaagagtgaaacataattgaaaagaaaaattaatcgagagcgattttacataatgggcaagaaccagatattttgagccattttttaatacaattgagatgataaagatgggtgcattgtagagcagagacaatactatccataacaaaaagttccccacaaattgagcactcaataccctcgttaatatgcgattggttaatttggcaagtgggtaaacgcttaattttactaagcgggtaagggccgggaggaggcgggggttccactatagatgacaaagtaggttcaactgaaggacgaaccgattggcgggactgccgctcangacgangtaacccagtacnccctgacgtgctgngtctctcgtcaagaacaggctcctgcgccctggcaggtcttcggtagggatgctaaaa

SEQ ID NO: 14154 - DNA, 2209 bp, Heterodera glycines
tcaaacaaaaatgtgaaaattctgaaatatttgcctcaagattctggctattttgttgttgttgtggttggaaattggtgaaaaaatgagtcccgacattttgatggatgccaggcaaatgatttgacaaattcgtgggctgaaagaaacaaaaaaaatgttttaataaaaacaaagtgtatttgataatttaaatttgaaaaaagaatacactacctgaagattctggcaattttgttgttgttgtgattggaaattgtttgaaagatggggcccgacattttgttgggtaccaggcaaatgatttgaccaattcgtgggctaaaagaaacaaaaaaaaatgttttaataaaaacaatttgttttttgaattatttgcctgcaaattctgcgaattatcggcattttgtgggccaaccatggcatgtgtgatcatttgattgttgttggcacgcaatgccggcgccaactgaaaatttctttaatttttttttgatttgccgtagattctgtaattacaaaaaaaatcccgaaaattccataaaaacattaataagtaaatttgactaaaaatgacttaaacttctaaagaattttaaaattatacaattttttttatttgttcaaagatcaacaactttagcaagatatttttttatcgcttctttaaaaatttctcaattaatatagcaccaaataaagtatttttcgcatcccaatatcattttttaaatgcagaaaaactttattttttttaaaaaattttaaaactcaaaaataatccatgttataatagatttgataatatcattaaaatctgatttttaaacctgtgcaaatgattggttattgtgttgagcgtgtggtaaattattcgagacttgagctgacggaataaaaagctaaatagactaataaaaattggttagatttatattatttgattgcctgagcgaaagaggcattttggaaatttcccggcatttggttagttgctggggacacaaactattaacacaaacaaaagataataaatttaaataaaaattattcaaatgcctgatgttgttgatgcacaagagaagcgttttgataagggggaggcatttgactcggaggtacaacaatttgctaaataatttaaaaattatgtatttaaagaaaaaaagacttgaataatttattgcctgtgaagcagacgatgagttttggtaacccccgggcatttgataggcgccattcaattgacccatcccaaaaggatgagaaacaaaatgctaaatacccatttgaataattaaatctgactttttaaagaatttttttttaattaatgaatttgaattgcctgtggcactgttgaaaaagttggctgaaatgtgcccgctgaaggagtgccatggatcactgaagacatggggtgaatcccaagtgcggtcgggatcattggctaaataaaattaaagaaatttaaatacacaaatttttggttttacttaagtaaaataaaacaaaataaattgcctgaaactgctgaccaccgttttgacaatttggattagtgtattggaatggggtgccaacattttgctgccctgggatcattttttctataaaaaataaaaacttaaattgaataagaaatgaaatttattgggttaacacctgcaattttaaaagtgaaatgtgcgaatgctttagcagcagaagaaaattgtttggacagggagacactccgcctccatcgaacaaaaaacatttttttagttgcgaataaaattatttaaaaataaaaatttatttgctgaaaataaagaatgttacaaaaataatggccgcttttccatcctttttttctatgaaagacatactatttcctttcattcaattctcaccgtttatcgggtaacaaacataaacaaatttaacttcctttttccccagtgctacatggccgagtggttaaggcttcggccgaaccaaaggttcgattccaccgtttttgaatttttcttttaatttaataaaatttaaatttaaaaaataaataaaaataatcaaaatatttaaatatttaaaaaatatttcaaaaataaataaaaattaattgcggttagagactacatataggcaagagaaaaaaaaagctagagaaaaaaagctgcgaagccaatcaatcgataattgaagtagtctccctatgtagtga

SEQ ID NO: 14155 - DNA, 2788 bp, Heterodera glycines
cggcttgtcattgctctgcgggtgataaggcggacctaactttgcttaattcccctggtcctgcaaaaatgggaaaattcatttgagtgaaaaggtgggccattatcggtgacgaaccatatcgcgaaaatagccattccaattggacaatgacattgtcggcggttgtgctctggactgagaatatttctggccatttgctaaaagcatccacgacaattagatagagacgtccatcggaacatggtccggcaaaatccatgtgtagacgctcatacactttgtttgtagaaggccatgaacgaagcggcgcttttggcggtgcttttgctgcaagtgcacattcgtcacagttttggacgcacctgtcaatgtcgaggtccatgcgtggccagtacacgtgtcgctgtgcaagtgccttcattcgtacaatgccaggatgagtgaaatgtagcgcggacaggatgcgttggcgcaattctgccgggatgatgacgcgctctccaaacagaagacatccattgacttccgagagtttgtaccgatgtgtgaaataagatgccaaattttggggtgttttctttggccagccatttcgacaaaattcggaaacttccctgagagtttcgtcgagttgcgtttgttcggcaacttctttggtggtgaccggaagttgatcaattgttgccatgaacacaaattcgacagcggactcgtcgggctcatcgcgtgaggtcgggtgatcgtgatctgaaattgacaagggaagttcctcaatgttggcgatcactcggtcttcagattgtacagtttcgcgttgttgagcgaccagacgtgaaagaaagtccacctgaccaaatgaatttgttgaaatatatttgatttggaaatcataatttgaaagaattaaagcccatctttggagtcttgaagcggtgtaaattggtattccgttctttgatccaaaaatcgcaaccagcggcttgtggtcggtgagcagtgtaaagcggcgtccgtagatcattctgtggaacttttggacggcgaaaataagtgcaagggcctccttttctatttgtgaatagttctgctctgcggaggagagggaacgtgaggcatgctcaaccactttttcggagccatctggaaatgaatgactgattgtggctccgattccgtttttgctggcatccgctgcgacgatgatcggcttggatgggtcgtagtgggtgaggagaaggtcggactgcatcaactcctttgctttgacgaatgcttgttgttgttcgtgtccccattgccaaggaacatcctttttgagcaactcgtcaagcggtgtgcggagctcacgcattggtttgatgaagcgtccgtagtagttaagcgcgcccaaaaatgaccgaagtgtttgaaggtcatgtggtggtggcatgaaatcaattgcagctgaacgagccgggtccggacgaattccttcagctgaaacaatgtggccgaggaacttaatttgggaacacagaaatttgcatttgttcaaatgaacacgtaggccccagtcttggagccgggaaaagaatttcttgagaagcgaatggtgttcctccagtgttggtgtggccacaatgaagtcgtccaagtagccaaaaactccgttaagtccggcggtgagctcatccataagcttttgaaaaatgctgggagcgcttttgacaccaaatggcaggcgttggtactgaaataagccccggtgtgtgtttattcctactaattctttcgattcctcgtccaacgcaatttgcaaataggcgtctcggaagtcgatttggctgaatactgttgagccttccaacgctgcgaaaatgtcatcgatgcgcggaagtgggtggcgatttaactccaaacaatcgttgaggcctgttgcaaaatcaatgcacacacgcacatcgccgttcttctttcgaactgcaacgatcggcgctgcccacttgctgtaatcgacttgtttgatggcaccgcaagcgacgagccgatcaagttcggcgtcaactgctgatttggccgcatgtgggactggtcgaggacggcagaagacgggttgtactccggacttgaggtggagatgtgcgcacattttgttgcaaaggcctaagcttggggagaaaactttgggaaatttttgctttaaaattgtcgccaatttgtccgggtcctccgagattgagattgaatttgaatcggtgtcgaatttgaattgatctgtggtgagagtagtgacaatgggacgttgaagtgccgcttcgaacgccctgatccatggaagaccaaacaaattcattgctccttccggtgcgacatgacattctaattgaagtgtgactccttgataagtgactgagcaaatgaaatacccggagatttcgaaaaagtgccccgaatatgatttggcttttgaaatgccctttttgagtttggggctgcctaactgttcccataatgcttgctgaataacggccaaacgtgatccagaatcggccatcagtgatgctttgttgccattgagttgacaatcgaccatgatccaatccgaaatgtcgtctccgatgttgaagatggacattgttgcatggttgcggtgtgaattggacttggatgatggcgctggcaggcggcattttgattgatggtggccacggcgattgcagtttgagcagatcggtgcctttggacagtcgctgatccagtgcatttggtgcagtaacgcatggcgacggaggctgctgcggtttgc

SEQ ID NO: 14156 - DNA, 2058 bp, Heterodera glycines
gacttgtttgatggcaccgcaagcgacgagccgatcaagttcggcgtcaactgctgatttggccgcatgtgggactggtcgaggacggcagaagacgggttgtactccggacttgaggtggagatgtgcacacattttgttgcaaaggcctaagcttggggagaaaactttgggaaatttttgctttaaaattgtcgccaatttgtccgggtcctccgagattgagattgaatttgaatcggtgtcgaatttgaattgatctgtggtgagagtagtgacaatgggacgttgaagtgccgcttcgaacgccctgatccatggaagaccaaacaaattcattgctccttccggtgcgacatgacattctaattgaagtgtaactccttggaatgtgactgaacaaatgaaatacccggagatttcgaaaaagtgccccgaatatgatttggcttttgaaatgccctttttgagtttggggctgcctaactgttcccataatgcttgctgaatgacggccaaacgcgatccagagtcggccatcagtgatgctttgttgccattgagttgacaatcgaccatgatccaatccgaaatgtcgtctccaatgttgaagacagacattgtggcatggttgcggtgtgacttgtacttggatgatggcgatggcaggcggcattttgattgatggtggccacgacgattgcagtttgagcagatcggtgcctttggacagtcgctgatccagtgcatttggttgcagtaacggcatggcgacggaggctgctgcggtttgcgctgaaattgggatgatcgttgattgttgctggtggtggtcgtcgtcttggacgagctttgcgacacctccgcttttgttgttgatgatcccttaatttttggggttttagagtgattgaattggccacatgagttgaatgggctaatgcgttggaagtgttgcgaagagagagaaacgcgcggcattcttctgtgagcttctcgaatgagattgcttccggcggtgtcttctttttcgcttcttccaaaagtcgcaaacaacgctcacggagttctcgatcagtgtccgaaagtcccgtgaggaagatcagtgctttgatttcgtctttggtcagatccatttgtgatcgctcgcacattgcgttgacctggcttgcgaaatctaatggggattgtgaaattgattttgtgagctgaaaacattcaaatcgacgggtgaaaatggattttgtttcaccaaacatagccttgagcttgtcgatcgtctgcgccagtgtgaaatcagtgggcttgcttggaagcacactttctgcatagcggttgtactcctccgatccgagcttgccgagcaaaagtcgaacttgcatctgatcagggaggtctttcccatcaatttggatgaaaggcccataacggtcgagccaattttgaaatgttgaatccatttctggattgaatgaaaattcaccaagttgggaattaatggtggaataaattgttgaatgattggaaacattgggatttggttgggcattttgaagcaaattttgaaatgcttgggtctgttggtcgactaattgctttaggatttgagcaaagtcaacggccattttagtcagaaattgaattcaattggagcagagtgagtgatgaatttgaatggtgataagagagagaaatggttttgcttggtttcggccggcaatgctgcagtggtggtcaggcacagagaaatgaatggatggaaaatcaataaacgacctttggtgatgggatgatgcacaaatgcgctgagtgtagcggtcgcaatgacttacactttcacaaatgtgtctttccttatagcagtgcactcagaggctttttacggcgtaagtgttgcaataaggcttctcggctcgcttggcgttcagcgggctatgattttgccttgacgtttcaagccgatgtgttacggggtgggcaaaggtcgaaattgatggaaaatgagtgaaataggtgaagtgccgactgatgcgagctgctgacaccaacctcgcaaaa

SEQ ID NO: 14157 - DNA, 1084 bp, Heterodera glycines
aaattcagggggaattggtccgacgatgttttccgctggcattgatcgactgattggaattgctttttcggaattgtataaaaattcatttattttgttaattacagtatgcttcagtcacgatagccttaaaaagcgactgtatttggcactgtgaactgtaatttctgtattgtttggtttctgcttctctgttctattttcaataattgtctatgaaaatgttaaaagtaaccctccgaatgtgttcagttcatccagcaaaattgcaacatctttaactggttaataacgaaatgttcttttacatacaattctttttacattaaaaaataatgagtccaatttctcgagttttggctaatgaaaaaaataattgggtttcactaattggtctcattagcgggacgaccttttctatgtgatgctttaacaaataaaataacgaaaataacggctcttttttgcataacattttttcatacttaaatttctcatgagagtgagtcatgctgcttaaatttttcatatattttgaattttttttgtggcagaataaaaacactttcttttttgtgtttgcgaacaaaaatcgggacttttatttacatattttgggatttttctacatattacatatgtacatatttttatatatattttggacttttcgccattttttcgtacatattttgcaatttttgaggattttttaaggaaatttttattaaatgcccaaaaaatccaaaatttagcaatttttcgtacatattttcattttttttcatattttgagaatttatagaaatttcttgtgaaatttagattttttttgagaaatatacctctaaaaaatcaatttatttcaaaaacagataccaaaaattaatttttaaagtactaaaatgtgattctaggcctatttgggtcatttttattcagggttcgcagatgaaaattttcaaaagcctcatttggcagacaaaaaagcctcattttgattcaaaaagcctcatttttacaaaatttattcaaaacacgcttaaaatgttcaaatgttatatttctgattgtcccatgatca

SEQ ID NO: 14158 - DNA, 3593 bp, Heterodera glycines
gggatttccttggcctgatcaccagggcttataattatttggaaaaattgcaaaaatcaatcacttacttgaaactcaggcctagcctaagcttatgtacgaaaattcaatattttatgggccaaaaagcactgaaaattgccctaagttatctttttatgtatattaaaaaaagtctggcactaacttcatctgcgtgatttggacaccccaatatacacttttttgcaattttagccggtcgaccaaccacgcaaatcccatattttttccctcgactgtgggagggctgaaacgcccgaatacatgtttttagcttggtttgaagtagggttcgagccccgccgccgcccccgcccccgtgattcagacccccgcatcccccgcccccgcgaccagggatggacgaaatttcgtttcgttttcgtttcgtcctacattttcggcactttttgagtttcgttttcgtgtttcgttttcgtctaccaaagttttttcgtttcgttttcggtttcggttttcaaaattttgtttttcgtttcgtgtttcgttttcgtcagagcaaaattggacgaaaaaagtacgaaaaagcactggtaagaataggccccgttggtagatttttcattggcattccgttttttcaaaaagggggggggacaaaccacagaattaccatttttcttagtccgttttttccgtgttataagttccgttttactacacatcaaagtcttttttaggcctattaatgtcttccaaaagcaaattccagtattttaattgttgcgacacaattccaagcggcaatttatggttttgccgttctgaaaattgcagctacaaatttgaatcaaagaaattgtctgggtatccaatggcttcacttcgttctcacttaaaaaatcaccatcaactaaaattgaaagaattggaagaaaaagataaggctgcagaaagcctcaaaaataaggaaacgaacccgagacaaccgacgttaaaacgaatttttgcgacttcaagtccagtcattaaaaaaatagcgagggctgaatctgctaactcgtcgcaattaaccatcgaaaaaaccttttgtaggaatttaattttaaatgaatttacataatattttcagctcaatggacacccgacggagaaatgactaagaaaattgacaaggcaattaacgatttggtatgtactgctggattgccgttctcttttgtggaagaacttgggctaaaaaatttattaagaatattggttcctcactataaaactaggtattaatttgataaataaaactttcgatgatcaacttttttcaggggcagaaaatatttcacaaatgatgttttagagtacagctattccttgatgttgcaaaatgttaaaaggcgaattgaaagcactgattacattacaattgccgttgattcgtggtcctctgacacaacccactcaatttttggtataattggccattttttggatccgaattttgaacctaaattcgttgtgctcgcggcgatcccagtgaaaggtcgtcatataggccaaaatttttccaacatggtttcaaaagttagtttttgggtaaagcttaaaatgtaagtctgtgtttttaagactttgaacgcttatcaaattactgataaaaaattgcacttgattctacgtgatgacgaaagtgcgatgaaattggcgaccaatttgctcggttatgattccatgcaatgtcacaaaattcaattggtaaataaaataattttgtgtatatttggctattttaaggctgttggagatggctgaaagctccttggtgggtttttcgatgtaaaggaacgaatgaaaaaagcaatccgtcgcataagaaaatcgcgcataattgctgacgatttcaaagcattgcaaattgaaaatgatcttccactaaaaactttacaaaaagttttagtacatatttcatacatattttagcattttttatacatattttatttacatatttcgcgatttttcttacataaaaaaagatccctgattatgatatataaaactcatttttgttggaattataaaaatattttttttaaattaaagttttctcgaaattaaattataacttatggactaatcgacacatttggcatcattttcaattcttatgtcattgctgtaacatatttaacaaagtaatttatattaaacattgcgatttaaattatataattaatatttgtaattgatacctaattaatagaggtgtgccgtgactgaaaaaacccgtgaatcgtgaccgtgaattggtcccgtgaatcgtgaccgtgtattgaccccatgaatcgtgaccgtgaccgtgaatcgtgaccgtgaattgacgccgtgaatcgtgaccgtgaccatgaattgaccccgtgaatcgtgaccgtgaccgtgaattgaccccgtgaatcgtgaccgtgaattggtcccgtgaatcgtgaccgtgaccgtgtattgaccccatgaatcgtgaccgtgaccgtgaatcgtgaccgtgaatcgtgaccgtgaccgtgaccgtgaattgaccccgtgaatcgtgaccatgaattgaccccgtgaatcgtgaccgtgtattgaccccatgaatcgtgaccgtgaccgtgaattgaccccgtgaatcgtgaccgtgaattggtcccgtgaatcgtgaccgtgatccaaaaaacccgtgaaattcacggtaaccgtgaccgtgaattttttgagtttattttttttccgtcagctaatttttttgcttttcacaccgtcatttttctggtatgattttacaaaaaaaattgggaaaatggggtcaatggggtgccgatagacgcttgccagaaaatttttttttgaaaatttgagtcttatttatgcacacattttgtccaaaaatgaccaaattttgcgaaaatgagcaaattttatgaaacaataagtttttggggcccggcgttgtcgataggcgccgccggaggtaaaattgaaaatttgagtgcaatttattaaccttgctaacagattttatccctaaaatcagcaaattttgcaattttaatcggtctaaaaagtcaaaaaggtacaaattataggtgcgcttgcatttttcatgttaaaaaaatcgggtactgaagtgtccattagcaagcgcgctcataatttgcatttttcgcataattgtggacgttctaaattgaatccgatcatttttaaatggttttgagttttgtaaatatgagaaatacttacccaatttttaagaaaaattgtgttttaggtggaaaatttttgaaaatttgttgggatttgttaactgatcttgcccaaatagctttattttgagcgagtttttttaaagagatttaattattttttatttatatggggtcatccttgaaacttgactttttatttttttcgcacaatattgatagttggctttgttcaaaaaaagtttcaagaatagtgaggggccggcggtgccgataggcgccgccgggtaaatttttgaaatttttctctgtttcttatcaaattttgcccaaaaatgaccaaattctcta

SEQ ID NO: 14159 - DNA, 4115 bp, Heterodera glycines
cgaattctttgtaacatccaattgcttcgctggcgtatttttgtcggattttagggagccaaagattgatgcgccatcctaacgtcggtttggcaaatggaattgcttttgtaaactgaaggaattaagcatgcgtttttcaattatgtgaaaatggaaacctcgcaatgtcatcggccgatttgcttggcgaaatggcggggcttttcaacaacggactgtccccgtaggggagggaagagagttgggcactgataatggcctgttggatggcagaaatgttgacatttgagccaagcaaaattggaggtgacccggcggaagccgcaccaaaagcggaaggttgggaaaagcctgaaaatgaatgaagagagaggttgggacacatttaaattttaaaaagaatacatacccgtgccgaacatgcctgatcctgtctgaggcgatgttgtgccaaacagagaaggctgtgctggcttttgtaataagtttgttcccgtctgttgtccgaataaaccaccaacggggggctgttgttgctgttggggagaaccaaaaatgctaccagtgccaattttggacaagggggcgccgaacagagaagtcgactgggtggcaggagtgcctaatataaattattaaatgtattttattataataaaataccgaatgccccgaattgttgcgccggcttcgccccaaaaaggcccgtggtggcggccgtttgctgcggttgctggccaaaggaaaaggcactctgttgaggttgtccaccgaaaagactcgtagtcgtagtcttaaattactatcattatagaaaccaacagttaaccattcttcccaccgtcgcagcgccaaaaccaccgacggaagacggcgcagtgccaccgaaaatactgccagtggtttgctgctgtcccccaaaaatgctcggctgtgacacctgaccaaaagcctaaacagacaaattaaacccatttcccgaaagaaaagcagcacaccgatggcttattctgtccgaacagtccggttccaggtgttgtggtcgccccaaaggcactcgccgtctgttgctgcccgaaaagccctccgctaggctgggaggtggccccgaacatggacgttcccgctggttttgctgcgccaaagaggccacccgtttgagtctgtccgccaaacaatgacgacgtcgttgttgcagtcggaaatgttgcgcccgaagttgtagctggaattttttttatgggaattacaatttattgggagagaaggctaacgattgaccgattacgaaagagaaacactaaaattttctgacattttttgatactcaagatttcatagaatgggttcgattgcatatgatcaaagactggcctttctgcgattatctcataatattcaagggcgtagccaggagggatatagcccccctccacggaaaccaaaatttttttaatgataaatatgtgaaataggttaaaaatgaatattataaatttttatgtttcccttcttggcaggcagacaccggccctcgccgcgaagttcacaataaaggcttggactattggtaaaaaaagctgggtcaggaattgattttcgattaccatttcacccaaggcctgttttttgagaggaactctgagggttcctggctaaaaacgttttgatacgactttgtgtcctgttggattttgcaaaaacatacaagacccaaacgcggatcttggcaaattaacaaatatccaccgggtgagaagagtccgcccgctggcttcccaaaaagtccgccctgctgctgctgttgcggttgtcccataacattttgatgaccaaataaagaagtggacgcggcggaagcggcgccggtgtttttcgctctgccggcgatataatcctccacccgaagttccttaattatcattaaactgataaaagcgaaggattcgtcccgcgcacttccaaacttttgtgctcatactccttcatcgatgttatgcacatttgtttcgtgttcactttgtgaggtgttcctttcagttgcatttggtcctctccaattggtggcgcaaatttagccgctaaatcagttgatagataagaaattgtacaaggaaaagtaactaattttcaagtcatagcaatgaagttctgaaaatgttaggtaatttcaaaaattaaaaataaattatagcggtaagcaaggtatttataggcctataaaattacccagctttaaaataattcacgaccaagaacaacatataaaacaatttaatttcaaatctttaaagtaatatttaaaaaacaaccaaaacttgaagtgggttgagtggcaccgaatgccccgaattgttgcgccggcttcgccccaaaaaggcccgtggtggcggccgtttgctgcggttgctggccaaaggaaaaggcactctgttgaggttgtccaccgaaaagactcgtagtcgtagtcttaaattactatcgtaatagaaaccaacagttaaccattcttcccaccgtcgcagcgccaaaaccaccgacggaagacggcgcagtgccaccgaaaatactgccagtggtttgctgctgtcccccaaaaatgctcggctgtgacacctgaccaaaagcctaaacagacaaattaaacccatttcccgaaagaaaagcagcacaccgatggcttattctgtccgaacagtccggttccaggtgttgtggtcgccccaaaggcactcgccgtctgttgctgcccgaaaagccctccgctaggctgggaggtggccccgaacatggacgttcccgctggttttgctgcgccaaagaggccacccgtttgagtctgtccgccaaacaatgacgacgtcgttgttgcagtcggaaatgttgcgcccgaagtcgtggctgaaaaacaacaatgaattaatttttgaaaacccagtgaacttgaaaaaaatccgccagctggtttcgaaaaaaggcttccttgttgttgtcccaacgtgttttgctgtccgaatagggatcccgcaccgctcttcatttttagaaatatttaactaaaatcaaaatttctgtttccttgacaaattagataatcattcatattcatctcatctgattcgatttaggtaactaattaatgataaaattaaggaatatggcttattttgatttatattgattcatattttttcgccttgtactagaattttgggaagaaataaccaaatatccccgtacctgaattcgatcaaaaagatttttcgaatttagttggttcaaaaacggcgtaaatcatatctcattgaaggattaaattgcttttggtttgttttcatgtgtttaaagtagggtaggtcgggaccgggaccaaaacacggacaactgagtaccgaagtcccggttttgatcgggcccggggaattcccgggttttttctcggtgtctttttcccggttttcccagccaaaagtcccggttttacaacccgaaaagtcccagtcctggttttgcccaaaattcccggtcccgatctgccctaataaaaaccatcaaaaagggcgttatataaaaaaccatcaaataaaaatttccaacaaaaaactgcccaaatttttgtcaaaatcaatcgtattaaatattcttgatatcattcgataggcctaagagttctctattagctcacctaattttcaaaaattggtcaaatttgaacaaagttgtggcaaaaagtactcaagcaaccaggttttcagacattttcggtcataacttttttgaaagttaaacgaattttgaaattttgcattctagtagaaaatattaaggctatcgaagatattaagaaaataaaaatatcttaacaatttataacgaaaattttttgattaaacataaaatttttgatcatcaaaaactctgaccaaaacattattagaaccaacaaaattaagaaatcttgatatcattcggtagccctaaggttttctactaatctgcaaaatttcaaaaaatttggctaagtttcaaaaaagttatgtccaacattgcctgaaaagctggttgtttgagtacttttggccataactttgtttaaacctgacgaatttttt

SEQ ID NO: 14160 - DNA, 3245 bp, Heterodera glycines
  misc_feature (1106)..(1106): n is a, c, g, or t
attcaggctaaggtcatttatgggcatgatcgtgggcttaactggctctttaatcaccacggaaggggaggatggtgtcctgcaggggccgaacggggcaaaactttattcgatgtccgttctttgtaaacttgtttgatttgaatttgataatccgcttttattgttcaaatatatttggaaattaaattattgtgccagcgattactacactttatattactatcagaatccgatctgatgtcataaaaaaacaacttgaaaatttctattcctttgacataacttttggacaatttaaacgtttttatttatattgtttactaaaaaggtggtgaaatttaatcaaaaaacataaaatgcactttctgataggtgtttaaattttctcatttcctagtgggagcaggacaaccagggttcctaagtgccctttttctaagattttcctttattttggcattccctccttattttaggcttattcttggatttgaaataaaaatctaacttattatggcaaaagcatacattgttcgtatcattcgataaccacgaggcttttcatagcaaatgaatgcagggcagatcatttataagcgcattcaaagaccaaatgatcacttatttatttacctatgcaaaatattgtgtgccttccctaattactaattaatgtctccttccatcaaacattattttgttgtgcaattattacattccgaaaatgagcagttttatcgccaaaaaactgtcataaataaacaaaaactcgggtcggtgtacgcgatgacaatgcgattcataaattaatgagagtcaagagaaaggttcacaaaattcgacagtttcgctaattgttgcgtcctcatatttttttaacgatcaatatactacagattcagaacacaatttttcgagcgactcccgaaaactaaacggagtgaatgctgttccacaaccttcataaaatttgctctgaaattcgaccctgaaatgatgaaatttgtttgaatgtgaaaatgtaaccaatgaatgcgttaccaatgcaatcgaagtgtgtgaagaaaggcactcagtccctccatgacgacaagctaaacacncaataaaagcaggtaaattgagaacaaaatgcttacaatcacaacagtaagcgtaaaaaatgcgaaaaaagacgagtaaatataaagtggggcaaaagtgccagtgacttttagggcgggaacgaaaaccatgtggaagagcacttcggacaattcttaattaagaaataagtcaaattaatgtacaaaaaaagagatagtttctgtgctttttacgtgcgtgtgccaaagagagggcccaaagtctgaggtaagaagccgtgtgggaaacgcagccgagcacaaattcaattgtgtgaatcgcctggtggacagtgaggtcggaaagcgtctgaatcggagaagtacagaatgacaaaaaagggactcgcggagagaaaagcgtaccaattcgtcctccgctcggtaggcccttccgccctctccgctcggctgtccgtttcttgtccccttgtccaagtcgttgttgctagtcgtggtggcgatcaattcagcaacttcggagtccattttaacacggaccaactgaaataattcattgtataatgaattatttttaataataacgtacaatattttttgacttttgcaattttctggtcgagtcctttctgttggccgccaccattccatccgtcgtacgatggtgatgccgaatcttgcgaaccaacggtttcccgcaaagcattatcggcacgcagaacaaagcaacgccaacgagtacggactccaccaaagcctgaaattgagaaataaaagtaattactaaaaatcggttaaagaattcatgtgtaatcgaaccaaaaggaaatcagataaattccgcaattcccccccccctccctcaacgactctcacttcacctgctgtgggtaccacaaggacaagtgacagtttgggtattccgtagaattgttgtttgaatcgacaaagccataaggtcgctgtttttgcatgaacatgttaatcagtccgatgagcagtgaaggtgcgcaatgactacctaaaattgagcaaaatatgaaagtaatatcgtaattaaaaagatattaataccggggtaataataaccgaaaatcacatccggttttaccgagaagaaaatccatttgacgaaaattaacacgcaaaggtaaacaaaaatagaagacaagaaaaagaaggacggaattgccactgtccacaaattgacggaagaatggaaaaatctaaaagaaatgcaaataaaacagaggagaaagtgcgttcacctggcattgaaaagtgacaaaacgacaccaaaagtcatttgagaaataccaaaaatgacagacattttcatctgaagataatttgttaacggaacaaatcaacaaatgattagtcacttttaaagaattgatgaaattcagccgattttccgccaaattccaaatggggtccaaccccatccaataagagccctcctgacgaagaaaagcaacatccgggtccaagcctaaaaccatttgacgaggcgaattggcgtcggaggacaacgcaattaactgagttaaactgagggggaaaatatcaaaatcgaattcaaaaaggtattcattacacgttattacttgtaaggacttgtccattttgaactgaaaatactgaacgatttggaaaaggcgtcgttgtacatcagtccagcgtaaattgagaacagtcccatcagagcgataatgaaacgaccaccaaaaaatgttaggaaaatctgcgagaaatgtctaacttatcaatggcaatgccaatcagaaaacgatcacaacactcacttcatctttgatgcgcgactgctcaattcgcctctcccacaaaatgagtgaaaggccggcaaggaaaagaacgagtccgtggccaatgtcgccgaacataacgccaaacagaaaagggaaggtgaccaaagtgaatggtgctgaagaaggaaaagtatgaaaatgggggagaaatgccaagggattgattaccggggttgatttccctgtagctggcaatgccgtaagagtcgacaatgtcttggaagacttgtacaaatttgttcgtccgattgtgcgtcggatgcatttcgcccgtatcaagtacctaaaagggaagatgcaaatgagaaagggcaattgtaagatg

SEQ ID NO: 14161 - DNA, 981 bp, Heterodera glycines
caaaaacgaaattatcaatttaaaatggagaaattcatgagaataacacacccaccactctgaagaaagcttccaccttttcatagacacttttgaactgcttcaaatcgttgaaattgcgcttcagctgggcctcgttggcaagaaactgccggatgtccctctcgatgtcgtataagtgtgactgaattgaaaaacagtaaattaattttctaattttccatgtccattacctccaaatcgtacatttcacgcaacagagtgatgtccgttcgagtggtgtccaatggcggaatgtggtcgctgacgcccccctccacgacttcagtctccaaatagcgaaggcaccgctcaatttctgcacaacggcgaacttcgcgtacatacgtccgttggaaggtggtcaaatgatggttgagctgaagagaaaaggtttaataacaaccccaattatccgaaaatcacatctttgaactgaacaagcgaatattggcccagctcaaccacacaggagtaggcagcatctctagacaatgaaacttaattaacggaattttgatgaattttgggggcaatacagtagtggagtcaataagccatttgaatttaaaaaacataaattgtgatttaatatggaattaaggaacaatcagattttaaaaatagtaaattaattgtaccgttggacgataagttggcacaattttagtggttcacttcgcaggctcatgtgtaccgagtaaggaaatttaattaaatcagcagagaaaatgacccatcatcgaccgcatggcgtcaattaattaaccaaaggcaggaggtggattgccttatacaggttgaggagcagtgggaggatcgatcatcaccaacactaaccaccaatcatttaacgtatggtttattacacagtgaagaaagttagaaagaggagaggagagaggagaaggacgaggaaggaatgtaatgacattgtaatgg

SEQ ID NO: 14162 - DNA, 3451 bp, Heterodera glycines
  misc_feature (1254)..(1254): n is a, c, g, or t
tttttatttattttttctttaaaatttaatttaaaacttcttgttgattttccaaaattatatttaatgattacatatttaagcaaataaaaatagtttctaaaattgataaatataattaaaaaattcgtttattttttaaatatttattttatcttagacaatcttttatggcttacgaatggatattaaagagagaaagtaattttttgaattaattttttttaattttttaattatttttttggttttagtgcccataatttaataaaaagtgatcagaatagaatcaaaatttacaaggatatgtctccatagacagaggactaactgtcctttaattattccaacgcttactgattttaattttttttttcttttttcaagtttttttaatatttaaaaatatatttttaaaatattcttactacttaacaattttactttttcacatgtatgtcaaaatcacattactttttttgtcactttttttaataaaaataaaaaatcaattttattattaatttattttgaaaaatgtgctggcaaaatcaattgaatttgccatttttcacataaattaaatttataaatataaaaattattccattacttttttggctgtgaaaaaaatgaattatgccaaaatttgtttcattttcctgcaactttttccaattttattccattcatcggaaggtaaattttttaaataattataaattgcattttaaatccgataaatttagttttaaaagtaaattaataaaaaattgaattacaaattttttttttggaaatttctaaaattttatttattatggaaaaatgattttcttcaatttaatgggagtcactgaaacaatttttcggcaaattcgaacctatcgtgaacaaaaattttaaataaatccgcaattaaaaatttaaataaattttcatataaagaaattctggcccagtattaaaaattatttgatttacaggccgtgtcgaactttggcaagtcagccaagggtatgtttcggtgggcagggtttttttcatttatgaatgactaaattcgaacccgtccgaaaattaatgctccgtttttcgggtaaaaaccccgggggggggggaggcttttcaaacaaatttttgtccaaaatagacaattttatgggggtttttggccgaaaaaatcattgttttttcacccagtaatcccgattactacacacggggcgctattctgaatgaggatgctgtgcncaatgaaaattacaacggcggaggccaacattatgccacattctgagcaaaaattatgattgattgaatgatcgccagtccaattttgcatactgtacaaaaatcattactgttgctttaggttttcacttttgtatataaattttaaaaacataaaaataacaacaaaatgaagcaaaaaaaagtgaaaatgtcacaaattgtgggaaaacaaacataaaaaaacaacagcagcagcggaggtaaatgaaaaagacaaaatgataagtgttgttgatggataaacacaaacacttcgggagggcgggatcaacttgaaaatttccaacttaaaaaaacaccgagagtttcattagacgacaataagattttttcgcgcatttttcagttatttattctgttttccctgacttttgggtattagaaatcatttaattgctcctattaaactttggtcgggtgtaaggattaattagatgaattggcagggtgtcgaaaaataactcgcccccaaaaaaaatccatggcattttaaaatgtccgccaccagcacacatcattggcacatcaccatggtggaaatgacatcatcgatcgatcggatcggcttcgttccgttctctgtccccccccccccccccgacccctccattgtccgatcggtcagtcatcgctcatcaaatgtccccgtccgtcgtcatcgtcgccgtctcctcctcctctccgatgccgctgctgcactgtgccaccgtccgctgggccacccggtcgccaatgttcgcgctgctcagctgcttgaccgggaatgccaacgacgcgttgtaggcacaaatgatggtggtgtcgaacagggacaccgagttgcgggccaacctttttgaagaagagggacatggagaatactttaatttgcaaaacaaccccaactgtcagaccaaattttgtgagtgttacgaaataggacaaaaaaacaaaatttttcgtgtatttttgtattataatttattggttcgtttttcaaatttgattttttcaaaatttaaaaaaccctgaaaaattgagttaaaaggtaaaggcattaaagattgtataattttaattatttatcggtttttcccattttttgtgaaacccccaattttagttaggcctttttccggctaataatctaaaatcgttaaaaatattaaataaacttgtcctctacaatttgatacaacacgccgtccgtgcgatggcctcccgcgtctcccggggcaccaattgcgtgtccgccaagtaaccgccggtgctcgcctcgtcgtcgctcagatggcgtgacacccaaatgtagctgaacaaaaacttattatcattgaaaaaacccaacaaaagtttcagcgaggcctaattacacatattaattgcctcgcacatcttacttaaaaagaggtgggtgggggttagaattttcggctttgtttaggtcccgcccaagttttggcccaaattttttcaccaaaaatcccatggaccggaagtcccaattaaatggaaaatcaatacaaaaacagcaaatcggaccgacccatttcggccaagaatgacggaggccccgcatggcaaattgtggaaatgggacttgcgatgtcggaccagatggggcagtacctgaagcacatataaaaagggatttgaaaaaacaaatttattagtcaacggatcaaggaacgaaaacataaaaaatgggtagatttttgaaaatttttaccctcctgaaaatattacctcaaaaatttttcgaccaataaaatatgaacttattctgtgcaaattttgaaaaatttccggccaataataaaagtgttctctttgctaatgctgcggctccccttaataagtacgccttggccaagctttccgtacttgagacttcgcgtgtgcaatgaaatggaaccgtcttggaaaagttgttgaacctaaagaagcgaaaaattcgtaaaatctgcccccctaattctggcaaaaaaaatttgaagccttggctgggtgctctttcccccaacccccgctgccccccccccccccgaaaatttttgaaaaaattaaacaatttaccataaaattttgaaaaaatgctagataaatttttcagaatttttttctcggatatttcttaatgaaaaaccattttctgggggaaagtgctgcttcctcc

SEQ ID NO: 14163 - DNA, 890 bp, Heterodera glycines
agctttgaatgaatgaacaaaaaccgactgggaactcttgggtccgtcgccgccgccaccgtcggcgttccgttgccccaattccatggataacaactaaaaatgtttgagttatgaaaaatatgtgatggatggcatcatcgtttgtcattttccttccaactgacgttgatgcgaattccatcgttcctccgaccaatcccacgggcatttggcctcctgtcgcggccaaataattcgcctgcattggccatccggcggcgattccgttcagtgccgcagctgcggatgccgccgccggaccaatcggagcgatattaacggaagagacgggaggagacttgagaagagaggaggcggaggcattgggcgaagtcggccgattggagtgggcggaagaaggcgcggacgaattcattccgttgggggaggagaccaaaaggcaacgttgggcttgggctgaacggaaaaaggggcgtaacaaatgactttattgagtcaaaaaaggattaaatgccatcctggtggatgaaatatcgaaaagctatttcaagggttctgatcaatgcttcccatttgccctggtcaatgttccctggctgtacacatcgattccccctcagcccattacccaaccggttgatctctcttccgctcccttccccttcatttccctcccttccctttcctttcccttcctctcccttttgtgtcccatagttttcgcccagaattggctgcaagttaactgccaattggcccaattcacactttcacgaactcactaaatttgggttgcataatgcaataaagtccgtttttcatggctaatcgttggttttccctcaagggagggagggatcatcccctcccccccccactcgataaat

SEQ ID NO: 14164 - DNA, 1293 bp, Heterodera glycines
acgatgaatagaggagagaacggaaaggggagagaagaatggaggggggagagagcgtgtccattaaggtgggcggggcttcgtgtgatgagagacccaattagagatgaggacggatggcagtaggaaaagagggcattgtgtgatcagcgaccggagcggacggagaaaagccccgccgcacgcaaaggaaacggcggagagagtgatcaaacatatttggacattacaaccgtatttttgaatattatatcttgctaatttctttctttccttccctttccttttcctttactttccttattttattttattcccttctcttttaaatgttttaaatcctttttttatttatacactattttagcatttttattccctttttctttactttttgtttgattctgctgggtgtgtgtacaaactgtaagatacccgtaattttctttctatgcctttattttctttctccccaatccccttatcgtaaccgccataccgtaacttttctctcaaatataccattaccgtaatctttttagtttctctatgttcttttgttttcacgcccatccatcccaactgcccatcttttcttgccaattcactctcagtcagtgccaaatgccgtgcttaattgcaaagcgcttttcgcttttcccctcccccgctccatcgtccgcttctctctctcgagaggcgtgccggtgcccatcccccgcttctcccccccccccttcttacgagtgccatcctcaaattcattccctaagcccatctgtcctcctcctcccccctcccctcccgcgctcttttccgttctcccaaaaccgaaatcatttttgctctccacttgaggagacagcggaggggggggggggggacttgataaaatctattgatttggctcccgtgaacgcatctaccatcgcgatgacgagatataaatgtgtccaaagagacatacccatttatctgacaaataattctgtacttcaatatctcttaggataatggatcaaattatgtagatgatatccggaacggattaacatcagaataacgagatatatgattgtcctaaaaatagataaccatttttctgacaattaattctcaattgccgcagctcttacgggaatggaaaacctattgaagaggctatccggaacggattagcatctgggttacgagatagaaaattgtcctacaaaaagataaccatttttctgagaattaattcacaatttccgcagctcttacggtaatggaataaattttgaataggctatc

SEQ ID NO: 14165 - DNA, 1137 bp, Heterodera glycines
ttttttaaaatttttagaaaaattataatcatttgccatttatttatccattcgtttgactttttctgccttttgttaactttggtccgtttctttgctcgttaaaatgtttttctgaattctctgtttggatttttcaaaactttcgttgttttgttttttttcagatttttagtgcaaaaaatggaccaaatcagaaaacaatttttgttggatcgcaaaattgacctaccgaaggcgatgaccagcagttcggctgctctctcatcggcaaattgtggcatcgttcgctttcttcggcattccctttggctcctttcttctttctgcttttcggcctctctctttgcttcagtttttccttccttctccttcccgtcattttctccttctccctcttctactttcttctgtccgtccttttcccctgtttctctttctctccgttcctttccttctttttctttgtcctcttctttctccatttcttctctctcttcctcttctcctttcttctcccagtcattttcccctttttcactttctttccttctctttccctctctaattttctcttctcttttcttccctccggcgtctcctcctctttctcgctctctctccgtttttttccttctctttccttctcctccttcctcctcctcttctttcacgactccttctctctcttcctttcctcctttctctcctcccttttctttttctcccctttcttttttctcctccctttctctgtcttccatttcctctttctcttctttcttctctctttccctcatctttttttgttcttcttcctcttttcctcttctttttccgttttctccaattaaatcacaaactaaaaactttgagcatgatgccgacggtagacagtgcttttccatagttaaagtgtgaataaataaatttattagtcctttaaacaaaatcatttaaaattcagaaaaaattcaatcataaaaacttaacgagatttattattttgtaattataaaaagtaattgcaaaagttaatttggacatgaagcatcaataacattggttagtcggggccgagacgggaattaaggtttcccccccccccacccatttcccggtcccggcagggcaact

SEQ ID NO: 14166 - DNA, 3296 bp, Heterodera glycines
aaaatgttctaagacaatttttcgctaaaatcaaccccctgacgagttatgggcccgggactcaaatgtcccgctcaggccaaaatttttttctatttccgggaaaaaaccgaaatttttccaaaaaaattaccagtcgatagagctcgaaaaactgttgcttgaaagtggtctccgtttttctgggaaaattcgttaaaaaataataaaattcaaaaacccgaaaaccgttttttaggcctagctcgaaaaattttgaaaattttcgaaattttaaaatttggaaaaatcaagctcattatgttctacaataagtccgctggagccccctcgctcagatcaaacgctgacgcggtattcacctgggacgcaagaaaaagtgagaaatcggtccccgggactcagacatttgaccaaaagtacgagttattgaccctggactcaatgtcccgctcttaaaacatttgttcataaaaataaccatattttccatgggagtccatttatgtacactttttcgctgtatcgcccgatctcatccgcctctcgtcaaacaccgacattttttcaacttcgtttgttgttaaaatgcccggatgaactgtaaatatggaaaggctggtgaatataataattttataaaatagtccgaaaaagattcggacttatttaaaaataaatttgtaacatttttaaattaaaaaaaatttactgcattccacattgaaatttcttcacggatttgcaattcgtcgcgttccaaaatttcgcacaacattttttggtcaatttgcaaaaatccatccgatttgatcaaagtgtcggcattttcgtcaatgtaaaataaacaatggcaggcaaaattctaaatttgaatgaaaataaagtattaaaaaaaattggctcttgattgagaataaaaataagtgaaaaaaggaacattatggaaaaaaatcgatgcgataatttccgcttttaaacacaatttagaaatatcaagttaaattgagagaagtttttctctcaaatttccttactatttttctcttctctgcccgccgctaaaaatggtagcagcgacgagtcagagaagagaaaatagtaaggaaattgaagagaaaattttatttttttattcaaaacaatttagtgattaaaggaggtacaaaagtgattaaaagaggtacaacagtgattaaatttgaacaaaagttgaggccgagttgggatgggcaaaatgggaaaatgtccattcaaaatttcattacatacaatgatgaaatgttaaaaaaaaattactaaaaaagccaaaaaatgattatggatatttttaaataaaaacatttttttgcaaaagaaaaaaacaaaggcattgatgaatttaatagatacttgtctcagcaaaaaaaaatttgcggcttcagaattataaacagaaataggaaaaatggttgatttatgaaaaagatttaatatgaattcaagcactttaatttaaaattgttgaaaaattatttttaatttatgtttgtttaaaaacaccagtgattataaaatgtacaacaatgattataaaaggtacaaaagtgattggaaaagttataagagtaattagaagaggtacaaaagtgattagaaaaagtacaaaaattgtgaaatggtacaaccatggttaacagggtaaaatcatgatttcaaaattaaataaataaggaaatggtttatgaaaaaatataattaaaaaaaatgtattaataatttttaaaaaattattaaaaaatgctttcttttattaattaaaaataaactttgaatttacaatgattgagtattattgtattgaaaataaatttttgacaaattataattaaaaaaacaaataaattctttaatttaaaaataaaaaataattaattttaaatgaatacatttatttaccaaaattatttacttcaaattaaacatttttatttattattaataaaagaaatctattttttattaataaaaacattgaaaataacgtaaaaatgcacagaaaaataatgtacaccgtccggatccgaacctgccccctcccccctcaaaatgatgcctcagaatccccaatcacacagggattctgagggcttaacgatgtaataactgaaatctgatgtcagattagtgatcagcggcctaaattggccctaaagacatatttttggaagatttttgtgaaaaaaattttccactcaaaaatcctggtcacccccctttggtcccgaagccgcccccccccaaaaattgggaatttaaaaaaaatatcagcgatttttaggccgcttccagtgattagaagaggtacaaaagtgattataagaggtacaacagtgattagaagaggtacaatggtgattagaagaggtacaaaagtgattataagaggtacaacagtgattagaagaggtgcaactgtgattagaagtggtacaacagtgattagaagaggtaaacagtgatcagaagaggtagaacagtgatgagaagaggtacaactgtgattagaagtggtacaacattgttaggagaggtacaatattgtttaaaattaaataaataaggaaacgtttttattaaaagttaaaaatcgagtgcattttaatttaaaaattttttaataataaaatactcttttattaattaaaaacaaccttggaaattattaattgaatatttatttaatttgaaattaaatgaatttttttttacaaattcaaaaataaataatgaaattctttaatttaaaaaaaataaatttaaataatttaaaagaaatcttcaaaaattaattaaaaacattgtaaaataagccaaaaatacaaagaaaaataatgttacaccgtccggattcgaacctgctgcccccccccctcagaacatgtcccagaatccccaatcacacagggattctgagggcttaacgatgtcaaacgtaaaatctgatcacgtattcgtgatcagcggcccaaataacccctaaagacatgtttttggaagatttttgtcgaaaaaattttttcactcaaaaaccatgtgcacccccctttggtcccgaatctcaaaatcacttttatttttataaaaattcttaaaaaagtgataaaaatgccagataaaatttaaataatagagcaaaaaactgcggatttttgtagtattttatttttccagaatatcttttcagaaccgagttatgaatttttttctggaaattcgaatttttccagaaattctggaataacttttttcctttt

SEQ ID NO: 14167 - DNA, 1750 bp, Heterodera glycines
atttgcacattttcaatagtttatttacactttaagaccgtccttgctgcggaagagcgcgaaactgaacttcgaagacaaattcgggttctccgggaaaagtcgacaacggagggcacttccatggtcaattcgctggaacagtaccaggtaaggaaatggaaaaaagaacggagtttttgtttaccagcagaatttgtgagagaatcgtacaaaataaaacgggaggacaatcaaaatttggtgaccgtttttttcccggaagaggaaaattacgaagggatttaaccaaaatgtaacaacattaaaaagtcaatttagctcaaagtcagtgaattgaaagaaaaagttgaacacttcggaattgagaaaattcaaatggaggcgaaattaacggaaaaggacaaaatgttggctgagatgaacaaaacacttgcagatttacagagtgtgctcagagtacagttttacttgtgcaaaaatgcaataaaataagaagtaaatttaaggaattggcggaagaccaaaaaatggaaaggcaaaaatcggacacggaactttcgggtgtcagggaagatctgaaagtgtgtgagaaattaataaaaatgaaaaaattataaaaacgaaatttcagcagaaacggcacacactcaaagaaattgaagaagcgaaaacgaatttggaggacgcacttgcgaaaatcactcgcgaattgaatttgtcaaatgagcaattggtgaggaaggaaaatttggtggaggaattggagaaccaattggaagagatgcgaattgtagggacgggaaaggtaaaaattggaaaggtattcgggggaggggacaaatggacaaaatgatcacttttattggagcaatttaaacatttaattatttagcaccaatacatcatctctactgaccaaactgtcgttggtggcatcaacggaagtggcgctgtttcttcacacaaaattgacgacgcgacacttcgccaattgttcctttcctattttactgcggaaaagtctaaacaacccgaaattgcaattgtgatgtcaagaatattgggatattctgcagaagtgagtgtcttgttatttctttgggaatgatttcggttggcgcttaccaaaattttttccgaaacagtttttttgagtacgtttgggtcgaatgggcgaacgccccttcaccgattattttttcttttatctccaaaaaattggtaaagaaatgttactttacttaggcattgcatttaaagaagaataaatgaaataaaaattaacaatttacaacgaaaagaaaatgaaaaataatgcttgacaatatgaactgggaattatgatgttcaaatgagctggtgttcatttgacagcctccatttgaaccaatccgttgtgagagaaatttatggatttgccccttggatcagagacccctcccctaatatgtcacttccttttttctaggaactatctcaaatcatatcagatattatatagtacacctcctctgctcctttatatcctacttactttgccacatcttaggcccgatcacatcgcccttctcataaaatatctcttatatgtcttatacgatttgaatgattttctaaaaaatgagaataaagttgaaaataaactacatgtcacaatacaacttgcatgaggaaaaattgatgacagcatcacgatgaaatcagtcactaatgctttcaaatcgatgtcgggacaattgacacctct

SEQ ID NO: 14168 - DNA, 1505 bp, Heterodera glycines
agcagggaacagaagtggcggagggacaggcggcggaagaggcggcccggaaacaacgtgaattggagcagaagttggccaagttgaagggactgtaccagcagttgagggaggaccacatcaaagttggaccagggggagggattaaaacgaactcaaagggatcccattgaaggcactgacagaaatccgagacttacggacaaaaatcgacacggacggggaggaaaagcgcaaaaacgacaacgaattggagaacaccaaacaacagctgaagcagacggaacaggagagagcattcttcgaatcacaggtcgacaattcaattgggaaagggacaatttggcagtatttcaggcaaaattagtgcaagaaaacatccgaaccagtgctcaaactgttcacgaagcgcagtccaaaattggacagttggagggacaaattgaggaggtaaacgacacattggccagtgaaaaggcaaagaccgacgaattggaaaggaaaagcaaagcgacgaacgaacgaatcttacagacttttagaggtcagttttttgtggataacagatcacttcttgaaatcatagttccgttttcgttccttttctgattgatcatttttcttcttcagaatgcctttgttcggctgcctttgcgattttggaacagtctttggaggatttgcaaaatgcttcttccatttcttacccattacgtaatcatactttgtggattgttcttaacttgatgctgatttgccacatttccttcagaattggccatgccctctcttcggacggtcattgaccaattggactccgtcgcactttccccgtccttcgccactctctccgccgatcagaagtcctcctccctgttgcccctctccgatcagttcaaatcgcttttcgttctttcccatcgcctttccgatgttctcatcggttgtgcgtccgccgcttacaccgtttccattcaacactttgaaggtgtttttaattcccttaaagctaattaagggattaaattgttcagaagtgaatgagcagtgccgtcgtgtccatacggaggcggcgtacttttacaaagatttgctgaaagaacagaacgaagggaagggaaagctgcggacggagttgggccgattggaggcattggtgggggcattgccaagcgaaacgggcgcaggaggaggggacatcgacgtggaaatggtgggcagacaattggacgaggaaatgcaacggatgggcacggcaatcgccacggccgtggaacacatcggcgaattgcaaaagcgaaggtgaaatcggggcaaaaagcaagcaaaacggaagagttcgacacattttgaatttgatggtttttttagtcgggagacgaacagcggaatgcgtttggaagtgaacgacaagattttggactcgtgcaatgggctgatgaacgcggtccgcgaattggtcatccgaagcaaagaagtgcaggaggaaattgtggcacagggca

SEQ ID NO: 14169 - DNA, 3361 bp, Heterodera glycines
  misc_feature (11)..(12): n is a, c, g, or t
catgcctgcannggtccttttatctggtctacttaagaataagaacataagaaatctccccttatcatattaaagccattttcaagcagaatcagaattaatatttgaatccaatttatcgtttttgacatggaattagctcgactaaaaatcgaaaaaagctagaaggcttaaaattctgcttaatttgtggagtaaatgccgttgtttttgcccgctgatcatttcaaattttgcccgatgggtctgaaaatattgtcggttcgtctctttttctgctgatctgtcagtcgtccgtcaagtaaaggatcagcgtgtattccatgtccggctccacctgcaaatgcgtgtccgcctgcagcggcttcgtttcgccagaggaaggccccaaaaacacagcctcacacgtcaaattgacacactcaaaacaaaacccaaatgcaaaaattatttaaatattgcttaaatgtattatggaactaaactcgtcttctgctttgaaaaagtgaattaatgtgcttaaaaatttgtcaaaattcggaattctggggctaaaacgctgaaaatagttccattcctgacactttcgtttatggatttacatcgtttttaaaaaaaattatgaattaaaattatctctcgattcctattttttactgcgtcagtaattttttgttgtataattaataaaaagaattttgaatttaatcattttaatagtgactaagcgaaacattttttgttagtgccatggaatgatgtcaaaaatgttcaatttgttctgacaaatgagaaatgttatgccaattttttgtcaaaatgacagttttacaaaatgtttctctttttttgttcatttatttcaattttcttcaaatttatttaaattcaaaatggcactcactttgtattccttggcgaactgtccgatcgctttcttcttcaaactcttcactttgtcttgcttccgtgtgcgcaaaatgcccattcgttctgccaacggttcgcccgtccattggatttcgttgcctttccaaagaaaatctttttttgctcgaaaaatgcgcagaaaaacggtgacatttgtccactaaattaaaattagaaaattacaatataattatttaaaatcaatttataaaaatggcaaaatattttattgtaattaccgataatttctttttcgggcgttcgttggcctttttcagtgaagccattaattatgtgaaataaattgagtctttttttggtcagttcaaatcttcatcattttgttaaggaaaaataaattaattgttttatttttaattgagccaaaataaaatttgttaagtgcagaaaatattagaggaagggactgtccaaggattttgccttggagaaggttttttttcggcgcacttttgcgattttgagccaatttttgtggatttttggaaaaaatagcgaaattttttgtgaaatttaggcctgcggtacggaaaaattttggtgtcagactttcccaaaacgaacgatagcaatttaaattgattttccagttttttggaaattcttaaaaggaaataagcaaaaatcttagaaaaaaagtacaaacgacgaaaactcatgcacaacaattgcccatttaaagcgaaaaattatttgggaaaatattgaaattctattttaattgttgtaaatcaatgaatgggaacaaaagtcgacggaaaataatttattttttaagtttagaaaaaagtatttttgaatttatttgcattttatttggaaatattttgattttctcaaatgtgagaatagagaatcatttgttaaaatgcaataaaagatcgtccacatattccgcagcaaaagatcttttgctgatatttttgtgaaattttatggattggaaaaagcaaaaaaaaaaatgcaaaaaaaagggaaaggccgtcaatggtcagagagatggaaaaaagcaactttaaaatgtagaaaatcttcacattttatcttaatgggttttttaataaattaatagggatgcgatttttaggtaagaaaaatcccagaataggtacttaaatcgcatccctataaattaatattttaacagaaaacgggaaaatagccataaaaatcacaaataaaaatgtattatttaaagaaaaattttcattttcttctttctttaataaaatcaaaagttttttttatcaccgttccccggtttacgaatccccgtccgggggttcccggtttagtcatccccgctgtccccgttctcctgtttgaccggggatctcccgccccccccccgcggtaacgaccctagtctgttctgtattggtgacatttcttcatgtaattttctaaatattacatgcattaacaatttttcttttcattaaatttaattcattttttattattaaattcacaaattgtgaaaaattatagtaaagcaatgatttgttacttattacctttattattatattttttttgttgttaaaatagattcttttcatcttttctataaattgccactttcatatttaaaattattgatgtgttgattttaattatttatgaaaatgagttggctaatatttattacttttcaatttaaaaggtgagcagatggaaaagcaaatgaacaatttcgtaatgttttattttaaagaaatgttaaaaaagaagcattacaaaacacatacctttccatttatttcttgtgaaattcaaaaaattattgaataattcacaaatatttaaataatatttatcaaattctgttatgcatacacacattaattaatttattgaagactcttaataaaaaaattgttaaatttataaagcccatcctaaaagaatcatttaataaaaattttcatttgaaatataaaatttacttttatatacaatatttttagaaaatgcacaaaatcattactttgtttgtcgttttgtttttgtattcttctaaattcaatggacacccaaagggtaaaaattaaattaaataaaaataaaaataattaatttaatcacaaggagaaataactgaagaggaagccgaagtctcggcagaagaaacagaagcagcgccagaagtgaaaaatggccattgcaaatttgaaggaatgcttcttttgggacaaaatgccgacaaaaatgtcgatcttttgtccattttggaaagtgccgaaaacaatgaaaaagccaaagatacggaaaggactgacaaagtgaaaataattaggccaagcgaaatccatcgattcattgaatcgctggaggggcaaacggtggccaaaaatggcatacaattcaacgtaatgtctggggtgaaagaggaggacaaactgacgat

SEQ ID NO: 14170 - DNA, 2384 bp, Heterodera glycines
  misc_feature (2279)..(2279): n is a, c, g, or t
agtgatttatctttgctcagctgcgcatttcgcacgtgactttttggaagaaacgcgcacagtgatgcggcacaaattcctcaacgaatggggcgacgaaagggacatgtacgagacgagcaattgggaaattgtcaaaaaaagacgacaaccgaaaaataattaaatacaaaaaaacgaacaattaaaacaccttgaaggcttatggtgaattactaagattttccaaaaaatgttggaaaattttcggatttttttgtacaccgtaaaaatgagttgaatgtcatcaaattctaaagctattctttctttactcttgagattgaagtgtttatttttaggatttgtctttttcaggctcatttatccgccggcaaatggccattactccgcgtacagcagcgatcaaatcatcaaacattttgcacacattgttaaagcggtaaaaaagaagatgacaatgagagtgaaatcctgggtgatagaaagtgaggaagagataggagaaaggaagagagagactgcgaagagagagagagagggacagacaaatgttatggatagagagagaggaaaaggcttgatttttgtcattttttcagtattattccatccaaaacgactcgttcgccgcgttcagctacgatacatcggtggcacaaatgccctaccaggacgtgtgggacgacgagcttggcaaggcgcacattgtcgacgagcaccaatcactgaggctgcacaccgtttttgccaacattccgccactgcgcttgtgcattgaccgaattgcggacgtgaaaattcagaacaaaatttacatttttgacaccagcgtagagaatggtaacggattttcacaaaaaggaccaatttttatgattttgagcaaaatttttaaggaaaattaaaatttttggagtccggcggtggtgccgccaggagtttttgaaaatttaaacggatatgagctattctcattgtcacagagtgctttgtgttggatttcacgcagacggaggtggacgacgtgttccgcgacccgttcaccgtgcgtcgactgttggtccaacggaacataaccttccgggcggaggacgcgctgattgtgtccaaggcattcatcaacttcaatgtgcgcaccattcactacagcacgttgcaaaatgatcggaagccggagtgctacctgatcagactgaccatccgttttgacaactcacggcacacgggccaggtcaaggtggacctgattgccacgatcaggcacgtgttttttttgaattttcctataaaaaaattctaagatttttttcatggaaaatactgttgagaaatttttatttttcggggggggggggaacgacctgctccgcgtctaatgcttttaaatgattttgagaaattttcaaaaaaatatttcttccatttttcttgaaaatatacaattccaagcattcgtcataaagtcgtttccctttacagttacatcaatttgtgtaacggacgcattcagcaaggtgaaaaaagcttatcacagggattgaaggcgcctttgaaattttgataatttttccccataaaacgaaagcaaaattaaaaccattattttatttccattgaatgccaaaagttcctttttcattatcaaagcagacaattcggtgccattcaaaaaaaaaatccaaattggaatattctgtttttcttcttacagtaaaccgcttcgggttgggtacggtaatgatcgctctgctcgatctgttcgtgctgtccatgtgccttggctcgctgtttctctgcgtgcgctcgttggtcaaaggacatttgttgaaaaatgtttgaaaaataaaatataatttaaattattattgttattatttccaaaagactacacgtgaatacttcgatcgggcatttggcattcggttgagcatccaagacaagtgggagttcttcaacatgtggtacggcattgttgtcgtggtaaggcgtgccgtaacaaaacatacaatgatgaagcccaacatttaaaatgggatcccacacataaataaaccccgcacggcgggaatcgagaatttgactcgagattgggtctaaaacaagggatttataacgtacctaatagtggttctgaaaccaaaaattctcttaaccacgactctcgagcatcgcttattcgtaggccgtcggtctctatggcgtttttagccttttgctctatgacacccgaagtttttcaccgcactaatttcagggaaacagtcattggaaaacgngggaggtacgggcgcgacggtgctgcgacaagcgcccgcccaaattcttttttgcaaatttatttagtaacgaaccgccagtataaaattttttactaacttttt

SEQ ID NO: 14171 - DNA, 1641 bp, Heterodera glycines
  misc_feature (68)..(68): n is a, c, g, or t
atttggagggcaaatctgacgaaaaatgactttgatcagagacaaacacatgccgacgaaggcaaggnggaagcacgcagcggaacagagcataaccaaaccaacgaagaagtgagtactgaaatggaaaggaatcaaaagggaggataaaatgggaaaaataaaaaattaaattgaaatggctgaccgaataatggaaagcgtgtcactccaaccgctgatttaaaaagtattggaatgttcttgagcagttagtgattgcttattaccaggcatattccgacagtccaagtgcttggatgaaacaaaaaatggtgtggaggaagaggaccaagaagaagaccaggaaattgaaggacgaatcatcactgacaaagaacagagaatgaaaagaaaagttaaggcattgcccaccgaaatgctttgtaaacggggcgaaaccaaaggagaaaagcgcacggagtgaacagagccaattgaatgacagccaaaaaggggagaccgatgggaccaccggcgaacagaacgaacagcaaagaggcgaccaagttgaaggccaaggccaacacgtacagcagatagacatggtaagcccaacggacggtttcctgaaatgggaaagaaaggggagaaaagataaaaggagacaaaaacacactgaaacaatgacgacacctgaaactgttggggaatctccacatcgatgtcctggtaaaagcacggcttcagcggcacaatgctcggaagcggaggccaattgtggtcccgattctgtgccccaaagccaaggccgtttgcctgcggctgcgtttgctgacgacggttttgctcctaattgaggcaacggatgtattgtagaagaaatcagggtttttggaccaaagggaattcaatttttacccaacaaatgatattaaatattctaattccatttcaattttgagtcaatcgctcgtccgtccccgttcgcaaacgtcgtcggaagactttttgaaccataactttgttcactgtcaatcaaattaagaattgttggtgttgttcgatagctctatgtgtttattattaatttgcaaaatctcaaaaattttcgttaagtttcaaaaaagttatggccagaaggaactcaaaaacccagtaattcgaactttttttgctctgattttttttgtgcataaataaaatttttgaaaatttgcaggctaatagcatttttcgaatgctttcgaataataccaagaatggttaatttggttgagaaagaaaaaagttatggtcgaaaaattcgttcgacgacgtttcggctgacgacgttttgtcctactccgccccgttcgacctgttcccttttgctcaattcctcctgtcgacgaaacaattcatcttgtcccatgctaactgccggtggagtcgagttggtagccttaaatagggaattcaaaacaaacaatctttgcaactggttgtgagttggatggaccattaaattgcgaaaattaattggcgtcttcttgccaaatctaataaaattaattcatttctccatgaaagtcttttgccgaattttgcttttttatttgtgacgacgtaaaagaaacttaaaagggtcaattttatgaaggttattcccagggcgagaga

SEQ ID NO: 14172 - DNA, 1034 bp, Heterodera glycines
ccccctccctcttttacagcccccccttacgacgaacgatgggggggggggggtgtttcgagacaccccttgtatatgtatgattttatgtatgaaagaacatagaaataaaaaaatttggatcaaaaattttagctatatattacaatttgtttatgagatttatcatcattgatttgatttacgagtcaatgacggtttttatttttgaaatgatgatttctaagcgcaaaatggacctaaaatcgattttaaaaatcctccaggcggtggctatggcacagccggaccccgcttcccaaaaagttttcttggaaaaacgcaccgcaaaaaacttttttgttgattttttgatttggatcaaaatgatgatttttggcctcaaatgcttttttcatttggcaaaattatgaatcatatatttatgattttcaaatttttatctgatagcccaattgccgaaatgttgctgtaaacaaataagaatgcttttcaagaaaagccacatcaaatgtcgaattggatgccatcattaagacaattgggagagggaaaattccaacgaaagtcgaaaattggattttatcaccagaattataattgtatttcttttatatatttgaacgcaattttattttttattatttagatttccatttttgtgttttgggataaaaaaaaaatcagcttggaattatgtctttcctccattcattttgttctgtgggcaatgatttttctcttccaaaaactaaaaccgatattatgagaagggataatgaattgaatagcgaaatcatcagcggcggcgggaagcaaagggatgaaagtccggctgaacaacagaggcgggggggggggggattcataaagagaatggagagggggaggaatccctccccggggtgagagctcagattcatacaggcagagacggagagatcgcccaaggcgatttcgcctcggagtgacccacttcaatgcaactgctgctgatggctggctggctggctgttctgcctcaggagaaatcc

SEQ ID NO: 14173 - DNA, 888 bp, Heterodera glycines
  misc_feature (74)..(74): n is a, c, g, or t
attaaaaaatgtcagaatgaatgaatcataagctgaagctggattctctgttattgaagcaaacaaaaaggagnaagaatgctaaaatcattttttgtgacattttccactggaacatttaaaaaaaaaagattttaattatgcgttaatttttattccgttttcagtgtctgctaattttcgaatttgccgctccaattcgcttctgtttacccttttctgctggtcaatgactaaattttcatggggtttcctgcgccgtggcgacaatgttcgagtaattattgaatatttttaccattttcaattcattttattacatattaagcatttctccaccaatccgttctctgtcctgattttgttcgtccttttcgccgtcttttccaactttgtcaattgctctgatcctccagtcggtctttccgcaaaaatggtcctttgtccgctcagtttaaaccgacaactcgggtgcacttgcaccgtcctttccgaaagtcattcggtccaaattctgtgcaacggtacccaacccgacaaagtatgggcagttttgggcggtttcgcccccaacattgacaaattggcaatccgtcgctgcacaacgaacaaaaagagcagcatattgaagaatatgctcccgttgaaggttaattggtggctggtcacaagaaaccatgacgaacgattgactgagtttaggttcgaagccttgagatttccaactgcgcaattgcacaaatccaaccgaacgcctttgactcgttggccgattcgttggaagagctgtccctcgaaagcaatgcgctcacttcgcttccgaatctccacaaattaaagcgtgtaaaatccctcaacttcaacaacaattcggtgagcagcggacaa

SEQ ID NO: 14174 - DNA, 1781 bp, Heterodera glycines
  misc_feature (1641)..(1641): n is a, c, g, or t
gatgaaggaattgattacgctttatgagatgaataaaaacgaaatgatgagacgaacagcgggcgccatttcaatgccattcaatttcgaatagccgattattggataaaagattggtagctataaatgtacagctcgtatggccttgaccaagccaatgattttaatttctataaaatttgaactattggaaataataaaatatttgggccgattaaaatagtaaaattaaatttaggtatgatcaggacacaaaacataaatttaaaatgattgaggcgcaaatattcttaaggggagcaaatgtccgaaaattgcccttaaggaatgggacattaatatccgggctcaaatgtcggggcggaaatgttcgatttttagtgggggcacaatacccgaggcgctgcttttattttcgagttgattatttcattgtaattttgtgtatttttgaatttattattgtgcgaccccatctgtgagcgacacgcggctgccacgatgagcatattggcaacgatgtcgacgggaataatatccgcaacggatttcatatcaccacacatatctgtcagcagtcctaaagtgattaaaaatataaataaataaatagtcacgtaattatttaaaatactttcccattaacgcggagaaaaccgatctctcgtccagtctttaactgtctgttcccgtattggttctctcattttccccactctctctcaccgtctcactctctttttctctcttttactcccccgtaaatttttaatacaatatcaaattttgattgcaaaaacaacagacaaatgctgactgacccttcccaacactggcaaatatgcccgtggccccattcaaattgtcaatccatcccggcaatggttcttgccaaattgcaccaatgctgaaagataattgtgtattaagatcaatcagctgattgtgagtaagaaaagtaaaaagcgcaccgcaaaaaatgggtgtgatttccctagaatctgggtgtaaaattattaaaaatatggcaaaaatttccaattttcccccagcggcgccatcgaccccattggactcctcctgttccccaaaagtttattgaaaaaaagcttgtcctgaaaacgctgtaattaataaaatgatcaattataattttagaaaaacgaaattcattaaaatattttcctggcctttccgtcaaactcaggccatttgcgcagccctctattaaaacaaaattgcgaatcgttctcacattgatggacgcgcaatgattactggcagatccttcgcgcttttgctcaactgattctcggccattgccttcgcaaaagtgtaagtgttcggtcggtccttcaaaaataaaacaaaattccatgaaaattttgaaaattaaacttgaaacatcaaatttaaataatatagattattaatccgttgcctccaacaatttgtcctcaattgcctccaccatttcgtcgctcatccattccatcgttcccaccaatttgctcacttccactttttgctcgtaaatgcgctcttccgttttggccaaattgcaatttgcataagcgctggaagcgtggacaaaggcctaacacaaaaaaaggagttcactttgattgaaaattcccatanattattgaccttcagctgtggcatttgttggcacagctcaacaagtcgttgagtgccaattacattcctaaatcatctcattttaattgagcaatatttgacaaaacttaaacgaaatttgttgttttttacttatatta

SEQ ID NO: 14175 - DNA, 2953 bp, Heterodera glycines
gcaaaaacaacagacaaatgctgactgaccccttcccaaccctggcaaatatgcccgtggcccgcattcaaattgtcaatccatcccggcaatggttcttgccaaattgcaccaatgctgaaaaataattgtgtattaagatcaatcagctgattgtgagtaagaaaagtaaaaagcgcaccgcaaaaaatgggtgtgatttccctagaatctgggtgtaaaattattaaaaatatggcaaaaatttccaattttcccccagcggcgccatcgaccccattggactcctcctgttccccaaaagtttattgaaaaaaagcttgtcttgaaaacgctgtaattaataaaatgatcaattataattttagaaaaacgaaattcattaaaatatttttggaaattgttttccgggcctttctgtcaaactcaggccatttgcgcagccctctattaaaacaaaattgcgaatcgttctcacattgatggacgcgcaatgattactggcagatccttcgcgcttttgctcaactgattctcggccattgccttcgcaaaagtgtaagtgttcggtcggtccttcaaaaataaaacaaaattccatgaaaattttgaaaattaaacttgaaacatcaaatttaaataatatagattattaatccgttgcctccaacaatttgtcctcaattgccaccaccatttcgtcgctcatccattccatcgttcccaccaatttgctcacttccactttttgctcgtaaatgcgctcttccgttttggccaaattgcaatttgcataagcgctggaagcgtggacaaaggcctaacacaaaaaaaggagttcactttgattgaaaattcccataaattattgaccttcagctgtggcatttgttggcacagctcaacaagtcgttgagtgccaattacattcctaaatcatctcattttaattgagcaataattgacaaaacttaaacgaaatttgttgttttttactttatattatcaatgtcatgtcccccccccatcttaatttgcttttacatttgaatggcaactttaagggcctcgtcaaatttgacggtagcggcgcaatggaacacaaacttaaattaatgagaaaaaaattagtgctaatttaacttttaagtttataaaaattaaataattaaaaaacttaatgggttagcgtattaccgtaacttggttgatcagcgcagtacggtcctgctcattaatgccaatcccttccattttcaggtcaccactgattgggaccaatttatttaagcgtgtttcatcgacacaccgaattcggttgaataatgggctcttaatttttttattttaaaaaacacctttaaattattaaaatgcctcaagcaaattatcgagccgctctttaattgtttgattgtttaacggacggatgagcagaaaaattttatcaatttttggctgcgtgaataacaaattttcaagcagcactttacccaaaaagccagtggcacctgtgatcagcaaactgaagggatgaataattaaagtaattaggggattcattaccaactgccttcatacagaggcgacacttttaattgatcaatgttagataaattcatatttgacaatatgtagtaataattgagcttaaataatggtaaaaattaaaaaatgcataaagcagcagagattcacatttcacaaaagtcattaattgaaaaggcgagctttttcttttgttgaaatgaatggcgtgtttctttctttacgctgtcgacagttatagcaaaatattaattaattaattaatcacttttcacaaaaaagaggaatcaaaaagaaagcaattcaaaaagaaattgtctgttgaagataattaaaataaacatttttttatttcccgacaaatgaggggtggtaaatttttgggaaaggaaaattggtgataaaggtcaatcaataaatgataaatcaatgtgcaaaataaaagcgaattcattaagaaactttgggctaattaggcttattttaaactgaacaaaggggaatcctaattgaataaaaaatatatcgttaataaaagagcataaatacataaaagaatagggaaatcattcattccgtcgcttcccccggggggggggggagattggtgcagcgggcggctcctttatcaatggggcagcaaaaggaggaagggacagagacagaccatcgccggcgggggatgggagcatggcgcggaaaagtggtcccatatcgaccgcgaaatgtttgtattgataaaaatgataattgatattagtgatattaatgataattgacaatgataatgataatggacagcaaatgcggacggaggacaagtgcaggtggtggtgaaatattgtgtacaaagtccggggtttataagtaatttggcgattgaaaggtgaaaaacaaaaaacggaggggccgaaagaaagcgaaatatttacaaaaacagaaaaagcgaaacacaacgaaaagttaattaaggttgcctaattatcaattttaaatgtattgcaatgcattattaattatgattgggatggtgacactttaatagaaacacaacaacggtaattatgtctgattaatttgccatggtaaaaattgcaatgtcaccagagccatttcaaactacaaaaaatggaatgaatacaaatgtgaacttaaaaacgattaaatcttcttaatttcaatttttgagaatttttctatggatttttgcttttttctaatttcgattcttcaatttttacatattttcatcagaccaaccgttaaaaaaaatttttttttttgcttgttacttacttcataaattgaattttattttacttatttttctaaaaatggaagattgagagatacgccgccaggaaaaaaaatggaaatttttgccagttttattaacggatgaaaa

SEQ ID NO: 14176 - DNA, 1497 bp, Heterodera glycines
  misc_feature (1427)..(1427): n is a, c, g, or t
  misc_feature (1455)..(1455): n is a, c, g, or t
  misc_feature (1466)..(1466): n is a, c, g, or t
aaaaagtttttgggaaaagcgcgcttcaagaaagctttttatttttttttaaattttggataaaattttacagaaaaatgatttttactttatgattttgactattaaaaagttgtagaaaaaatttcgcgtttcgcaatttcgcattttttggaatttcgcgtttcgcattttattttccgatttggcccatccctggccgatatgtaccatcgggaaaaattttgaaaactttgtaagaaattgacccccccccctcccccttcccttgtccacctatggaaaacattggccatttttaaaacaaatttaattgttggaaaaagaaaaatgaaatttttcaatgctaatgaggaaaaaatttgacaaatttaaagaattaaaaatttatttatttttttcaacccccaggcatcaaaattctgcacattggcaatttgatatgcaaattgttgacggatgtgctcccaccaacatcattaaagaataataatggaccacgacgacggcgacggcaagcgggcaaagcggacagcacattacgcagatgcacccgcagggagtaccgtatgctcagcgatgaccaacggacccgctttgtactgtagaacctaattatttatctcaagtaataggcgaaagaaccgatttataagcggaagaacaaaaacaaatgaaaaattttgtaattaggaagggaaaaaagtaattaaattaccatatttaatagagcccacgggcgcttgtttttcaaccaccctcaaaagggggggggcttattttaggaaatacggtatattaaaatggagaaaaaagccaaaatatgggcatatatttcataaaaattgggaatagtaaatttatttaatcaaagcgaaaaatggctttatttgaggcttaaagcaaaaaaaaatttaggcaaagaaaaaaaaatcattgaaaaaaataataggtagtttattcttaaataaaattgcaaatttttatttattatttttctttatttaattatttttcaatttttttttatcattattttataaattgtcttaggcgctgagttatctccaattgacgggtctttgacgcgaacattttcatttaataaattaccaaaattaaattacagtaaattattttagcataatgcactgttgcaactgaagcgtggctatggctcatatgaatacgaccgaatcacggcactccattccaatatcaatatgatgccatccgcgcacagtgggccaacatttccattatggcacagagaatacaataaacggtgaaaaaactgtttttgtatattataaaaatgtaaacggtatttttgtatattacgccgtaattacggattacggatttcagtaattgaaaaaacagttaacttcatttataatttcaaggaaaataagccttttctgtgntttaattttttcattgttatcctattanatattttctanaaaagctaagtttttttttattttattattt

SEQ ID NO: 14177 - DNA, 1025 bp, Heterodera glycines
atttatgaatttgtaaattaaagacattcgataaaattattcataaaactgcgctcaaaatcaacaaaattattttaaaatgttgatataaatcggcggcactatgtgttctctattagccttcaaaataatttaaaaattctttaaattttaaaattgtcatgacccgaggaactcaaaaaactgtttttttttttttttgaaattttccaagctaatagaaaacacttaagggtatcgaaaatttataataaaaaaaaatccatttgatgatttttgactaacatcataacacacaccatcccgaaatcatacaaatatttaatattgtgaagtatttaaatcaaaaatccaccattttaggcgaatcttcccacatcgccacaggacccaattttctttctacaccattcattcactgattatgtaggcaatataatttttttaatttttaatatgcacattcaaaaacattttgcctttattatattggattatttaatttccaaatgccaaactttgggtcgactatatgtaacggcagttcgtacaaaggcttagactaattctaagctttaggcttaagctaaggctcaggcctaagattaggcttggtttggatgttgcttaggcctaagcttaggcttttgtgaaaattattgcacaaactgtctattgtacgaactgctgctattggactcctcttctcggtttagctgtgggagcaatggcggttacggtaccaggaccgtacccagcgcgagacgcaatttccaccggacgatcaaattgtgccggtaaaaatggtgaaaatcaaaaaaaaaaagtaatttttttttaaatagtgttccggctcggaaaattatcatctcaatgcaacaatgttgccatttacaaacccaaatgtgaccaaccgaagtaattaataacaaattttgataggaattattgggatgattttatgggttaataaaagggctggaatgcgtccaaacccttttttccaagtacgggtataatgtttt

SEQ ID NO: 14178 - DNA, 902 bp, Heterodera glycines
tccaccaacgcattgaaacgtggcgaaagaagtgccaatttgaggccgagttgggcatggtcaaaactgggcaaaatgtccatccaaacgtcgttgcaaatccaactgaaatgggaaaagagtttagttaaataaatgacgaatttgtgcttaccgtcggttcattttttggcaattagcaaaatttgctgttgaatttcgaatgatgtcacacaaatagcagaaaaataattgcgttggataaagcctggatttttagggttttcctattttttacggataatactgatgagaaaaacacgagaatcgcattttattaaaacaattttgaaccagttcagcttcaactgttgccaatgggctcgaggggttggacaagtgccaataggaggcgaaaaatcattgccaaaaacggaaggcgcggaaacattttgacataaaatgacgacggatcggaagaaaaagggaacgcacataagaggaccaccaaataggagaatattttgcaaatgatgagatttcggggagtttccccaaataaataatcaattcgactgataattttttatccaacttcatttgtaaaggttaaattcgcatttttcaaattttgaaaattgaccaaaatggaaaaacataactcgtactgtctttcgacaaaaaaatgccatagttttgccctaatggacttatttaaatattcttggtataactcgatagccctaaagattctctgtatacaggcaaaatttcaaaaaaattgatgaagaatgaaaaaagtcatgtacgaattttttttttttttacgatttttggtcataactttttttgaaagcaataaaattttcttgacttttttgcctgcagatatagaaactttaagggctatcgaatgcgaaaaa

SEQ ID NO: 14179 - DNA, 974 bp, Heterodera glycines
gtttacaaaatctatgcagagttctttaaagtttttcatatagtacgcattaatttaatcccaaattcccagctttttcgtattgatttaccctgcaattcagcagttggttccaaagttagggactgctgaatggtcaatcacaacgctcattgtgtacaactgggcaaaccccctaggcgctgtcttaaaaattttgtgtcttttttacttaattgttcccaagttaagcttacatcaaaagtgccatcacaaatgtttggctattgcatatcaccaattttttgttaaggaaatgattggactttccgctcaaactgcttaacgaaagtatatcaaactttaaaaactgttgtgaatttttgtccccagttatataatgagaaaattatatgtacaaatatttgcagtttatttatatttcgtttttgaccaatcttcaaattttggcatgaatttttttcaaaaaactctttagtgtcgaaattactcagtgtcgaaaatactcagtgtcgaaaatgaagtaaaacagtgaaagctttgaaaatagttcagtgtcgaaattacccagtgtcgggattacatggcacccttttagaggtcgctgatacgaaaccgctcgaacttttacaggcttatgacgacgcgacttccgatgcgcagacaacgggcgagagtatttgcgcggagtccgtcacgatcatgggactgttgcaggacaacatctcgtttttggctataacttttttctttgccaaccaaatccaacattgttggtgtcattcgatagccctatgtatcctctattagcctgcaaaatttcgaaaaatttcgttcaggttcaaaaaagttatggccagaagaattcaaaaaaccaaattttccaacttttttagctcgaactttttttgaacttgacgaaatttttcggaggaggcaggctaatagagcatctaaagagctttcgaatgata

SEQ ID NO: 14180 - DNA, 4122 bp, Heterodera glycines
  misc_feature (14)..(14): n is a, c, g, or t
  misc_feature (109)..(109): n is a, c, g, or t
gacgacgactcgcnagtgttatggatgagttgcgtatgataaagttggatatggatgagttgggcatgactcattaaaatgataagcacatgctctttcttatacatgnaagaggggcttgcgatttttgaattctgctaaagagcctgagatttgcatcttggcactaaacccgacattagttagcagattttataatacggttcgatcttagataagaaattgttgtattcttgaatacagtccagcaagagaaatttgcatgcaaaaagtgaaagcgatcaattttttgacaaaaataatcatgcaagtcttatttattacttacttcattacatataaattttgtatatgcaaatgtatattaatattaattcatatgtacaataaattatgtatatgtagcagatcaattaaaaagtactgttggaatcaactactgtcgaaaacaatcactgtcgaaaacatctggtacgatacagactcctattttgtcgcaattccatgcgttttaagtgagtggacggttcagtcccaaaggtatttggccttcagaccgggtctggaacagggatgttgctctctcgtgtctcgtattctcgtgtttttagaccgtctcgtattcgtatctcgtaatttggcacgaaacacgagatattttatgcactggtaagaatgggggggggagggttgagaaaatatttttgggaaaattaagagaaaaagaaaaatttaaaaaaataataatttagttaaaatagaaacatttattctacctggccaaacccccagtccttacttggtttctgcaatggttcgattcccacacagaataaaatatttcttattcattttaattgtaaagatatttttaaaatttaattaggaaattttccaactaccaaaaataaaaacaattaaaatatttctttcatttttttaaacatagccaaaaaatacaattgttagtgccaaatctttaataaatggtgacaagatttccaaaaaccgccggacccaaattccctaatttttaaaatttaattcaaaaaccagcagaaaagtgatcattttatagacaaaacctcttaacaaaatacacctaaattttccccggcggcgcctatcggcaccgccagacccctctactcaacaattgttgtaaaaaaatgcgctagaaatagatctcatcaaaagtaaggaattttaaataaaatttaaataaattgatttctcatttttgatttaaaaaatgtgaaaataaattgatttttaacacaccgagtcaaaaaacgagacatgtgccaataaatagagagtgcagagaaaaatacatttctctcattttggcgtactatttctttacagagaaagaaaaaaatttaaaaaatgacgatattcaagggcacccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattacgccttgcctaaccttaggcccatccgaataataaaaaaactcaatttcgagacttggacattttgtgggtcagcgctcctgccctgtcctgaactgtaactgtgagaccgattatttaattccaagggctgtcaagtcaagtgtccttatttctctagcatttgtccttattttgttaatattcagtaaatgaaaatatctcaaatttttttaattggttttttaaagattaaattagccatttttttctgcaaaatgaaagtggttgcgctggtgtcgggcggcaaggacagctgcttcaacatgatgcgatgtgcggaggaagggcacgaggtggtctgtgtggccaatttgcatccaccgaacgaggtagaaaagcaaaatttcaaaattccatattttacaaaatgcaaaatttccggtaatggtcccgttttgtcgcccattttaaatttaaatttattttcaaaagtcgtgtaaatatttttcaaggcttttcggggccgcttatcacaaatccggcacccgtttgactaactcagaacctcggattttttgtcagattctgaccctgggtttggaactggtcgaaatggatggatgctcttatgcagtttatttagccccacaaaattttttcacttttcaagcaaaaaacacagcaatatataggtttacggggtcacttgccacgaatctggaaccatttcgactaatttcgaaccccgaacccgaattcggataaaaagtcgaaaattcacttaccaaaattcatatttgcccaaaatctatttaaatttacgaaatggatgctggattcggatcatccatcaaccacaaaaatctctaaaaaaatattttcacaaccaaaattagcaaattttcagattgccgagttggacagttacatgtaccaaagtgtgggcagtgagggaatcaaggttagtgagactaaatatgtatgctttaaaataaagaaattgaatgcaatttaaatttttttaatgcatttgcaatccaaaaattaaaaaaaaggtgccataattttttttaattttcggcttcaaatttttaattttccttaaatttcattttttgcatttccgagggctcctttgtttggaaaaaaactcctaggcctgttttcctgcaattttcagttttacgcggatgcccttggcctgccgctgttccaacgcaaaatttcggggcgtccaaaatgtgtagagagcaacacttatgtgcaggacgaggaggacgaagtggaggatttgtaccaccttttgaagacggtcaaagaatgggacccggaaattcggggtgattttttaatttaactgtgcattttttacatcttttggcaaacaaaaaaatttttgctcaattttcttaaataaaatttcagaattaaatttacaaaaaaagaactaaaggaaaatggcattttttgacgaacgatagcaaaatgaaaatttaaaaaaacctacaatttcatcaaatatttattggaaatgaattattttttggattttaaatttaattttttgtttttaggcgtttccgcgggcgcgataaacagcacttatcaaaaattgcgtgttgaacatgtgtgcgaacggcttggactcgtcccgctgtgcttcctgtgggaattggaccaactccaactgttggacgccatggtcagtgaatggtgctgcacaaaatgacaaaagaaaattttgagtttttccggttttactgttctttgggatttatgaaaaattacacaaaaacattttgcaaactcgagaatgttgatccaaaaagcattgaaaaatgctgctctttttgatgcgatgtgaaaaaatgccacagaaaattttttagtttaaaatttttcgtgttttcctttttctaattgttttttcttacagttttctgtgagattaagaaaaaatccatgttttcaaaaaaaaaaaacaaaaattagtagccctttttactttccctgtttgaataccaaaatccgcaaatgttcgtccattcttcgtagcttctctttttcttattgtttgagaagaattcaatggcaattgaagagggggaacagtttgccctctcccacctgaaaaatttgaattcttacatgttttactagtaatagtttactcaaaaattaaaaaaaaaaaattttttttcttaaatttcaaattgctaaaaaattttgtgccgtcctcgcagatttccgctggtgtgaaggccgtgctgatcaaagttgccgcacttgggctgaccccaaaacacttgggccattcgcttggacaggtgagaaaatgctaatgacaatgacaatgacagcagcggccggttgaatacgacgatttttctttgaagattcgcgaaatttttaaccgtttttttacaaattttacatttacttagtgtgaatttgttatttctgagggcttcaaaaattggaactttgactgtgtaatgaggaaacttgatgttttggaggtccctaaattcaaatccaaaaagaaaattaattaatgcttaataaaactaaataatcttgg

SEQ ID NO: 14181 - DNA, 1215 bp, Heterodera glycines
atgggccaaattgaaaaataaaaagcgaactgcgaaaattgcgaaactgaaaaatgcgaaatgaaaaaaaagcgaaatgcgaaaagccaaaatatgcgaaaagcgaaacgcgaaatttttttcaaaaattttaccaatagtaaaatcatagattttgtggttgtgatgcaaaaaaaaaaacaaaaatctctgcattttccggttcaatctttttctcacatcacaaaaaatgacaaattctacccattttgtggttaaaatttcaaaaatcatggtaaaatgagggtccggcggtgccgtcaggcgcccccggaaaatttttttttggaaattgtaataaaatatgatatgtaggaaaagttgcaaaaatttcaaaaaatttactatttatttcaaaaaaatactgaaaaaggcatgaaaaaggcacaaaggtcaaaaaaggcaccaaaatcgcaaaaaggcaaaaaaatgcacctaaaagttcaaactagaagcttaaaaccaagttaaaaacgcgtttttcgtgcgtattagaccataacaagttagcaaaaaaggtaattattaatcctctgcagcccaaaataataataaactgaagcattcgttttaaaaattaaattttcaaatatattcattcttaggagtggaaatttcgcatttcgcgccaaagagcgaaatgtaaaaagcgaaatgcgaaacaccaaaaaatgcgaaaggcaaaatgcgaaacgtcggcccatccctgatccgtactattaccaaattgagcaaaatttttggaaaattggtgagattggtctttgagggggtaccaacaaggaaaatcgaaaattttcagcaaactttttttccttaaaaatttcaggtgtggtgggacctttggaggggaagggagtaaggacctcgcccccttttgggactgtccctgacctgtacatgggtccaggtacaggtcgatctctaaaagaagcaaaaccgaaacacacatatgtgaaccttttattgaatcaaacataaaattatttattgcaaaacgatattaatagcaatctttgctcattgcctcttctccgtttgaaatgctcactgtgcagctgttattcacaattggtataagtgtttccacctaaaaattggaatttgaagaccaaaaaatggcttcgactcactaacgattgcactcaaatcctccctctgttgttccttccgtcg

SEQ ID NO: 14182 - DNA, 1811 bp, Heterodera glycines
ttcgtcgaaggaatgcatttggacagttcagtacacagaatagctcctttctgtaggcattgttcagattcctcctcctccaacatttgctctattatgtcaagcaattcatttgcacttgcgattattgccaattggtcagacgcagaattttggtcggccaatgggtccacggacaatgtgacaacgaattggtggataaatgacaacaagtcggatctgggaaatatttcactgaataaaaagttgaatctgagttagaccgagctaacaatgaaattgttcaagaaacgaactccatacatttaatgtaagagaaatacgactcacttcacttcggcactgtcaaaattctgcgtataaatgcgttgccaatgttgcactgtttgacaaggaaaatgtttgcacaaaatggtaagggcagggccacacagaaacgaatttgactcattcagggcacaacggatgaggaaatcacacaaaacagactgatctgaataaatgatcaattaaaaaaaatattttttatcgagtttattgcaaatgcactcgaaatgtgtggcataatccattggcatgcaattataagttcaagcgcactgtgctcactctcccattggaattggtcatggatggaagaaggacggacagatctgtcaccaaccagtgccatggaaaccaaattggccaattgcacacccaaattttgatgttgggcaaacagttgttgaagaatggaggaagagttcgagtcgtttttctgcacctttttgcagaaggtacagaagaaatttcgtgccgaaagacgggaatccttaacgggaaagtaaattaacagatgcaatgattggaccatttataaccaaaaggtgtggaatgaactggtcaaacgcccgggaaatggtctccgagaatgagtcagtgccgaacaatgcttcgacaaaggaggaaatggccgagtcggcacacggctgatgatcacgtcgaatgagcgatggaaagagcgaacggagaagctccgagaagccctttttgaagaaatgaaaatgccagaaaaggaagaagtgcaacattaccgctttgtcataaaaaaacgaatatttgggaagcaatggaccaattaagcccaaattccattccgaactgctgcccaacaactcaaaaattgttttccgactcaaattgcaactttctccagtgtcctcagcgagcagctcagccaatttagccaacattagagagaagccatggcggtctttgaaggaaaagccatcgtcggaggggtcaattgaaccagaaaaactaaagagcacaaagttatatacctatacagatatggtcggcaaatcattttcttttatgaatggtataaatgctggacgaaggtctgtttgaattatctgaaacattttatgaaaatacactgcttctccttagtactgttttattcccctttattgcgggtctcctcgcgttacggtcagaccacggaaaccaaccccacccaagatgtctgctgaagttctaccttaaataagacgttatgaaaaatgaatactctactttatcttcgagcaccagcacaacggcttgttccgggtctatgctaaacatatcagtgccgattaaactgtaacgaatgcgttcgttctctcccgcgtccgcatccgttgccacgaggcgaatgtaattaacgtaattagtgccggcgctaatttgtgtattcccatatccgttggatgtaaaccctcatccttcaaatgggcattgaattctcattgaattcctaaatgccaagtgtccattgaaat

SEQ ID NO: 14183 - DNA, 1297 bp, Heterodera glycines
gacaatgaaaaactcggcatgggtcaaagcatccaccaacgaagaaaaaagagagccattcaccgacgccgaacaactaattgctttggtgtcgtgcattcccattaaagtcattgcaatgcgttcgatggagggacggcgagcaattcgggtggactcattggccaaaagggcggaaatgtgctgcttagcaatttctgaaacgcaaaaaattcttgcggtgcctttctttagtgaattttcacgactcatcgcaaagcacaggtggacaagggggggggggggggaggggtggtgatcaatttcataaaattttcgatgaaaatcgaaaaagcactggcaaagatggaaaaattaggcttctgattgtgaggggtgagggtgagtgggtttcacactagaagtcgaccctgctctatccaatggtatatcgtttatatgcaatttcctagtcacagctcggaatgttcccttgttagatgagttggatatggatcagggatgggccgacgtttcacttttcgcatttcgcctttcgcattttttggcgtttcgcatttcgcttttcgcatttcgctctttggcgcgaaatgcgaaatttccaccccctaagaatgaatatatttgaaaatttaatttttaaaacgaatgcttcagtttattattttctgttaacatattacactcaaaattgcataatggaaaaattcttctaatttctccccacaaacgagaattaaaaaattttatgggtacatttttgaatataggcaatttttcgtaacaaagtgcactcaaattttcaaatttttttttcaaaaaatttcacttgggaaaattcccggttggtcccagtcccggacgaaaatcgaggtcccggtcccgacttttctggtcccggtaagtcccggtccaggttttttaacttggtttgaagcttttatcttgaactttttggagcatttttttgccttttttgcgatttatttttttgaaataaatagtaaattttttgaaaatttaacaacttttcctaccatattttattacaatttccaaaaaattttccggcggcgattatcggcaccgccggaccttcattttaccttaatttttgaaattttaaccacaaaatgggtagaatttgtcattttttatctgagaaaaagatcgaaccggaaaatgcagatttttttttgcatcacaacctcaaaagctattggtaaaatttaaaaaaaaaattcgcttttcgcatttacggcgtttcgcatttcgcttttttttcatttcgtatttt

SEQ ID NO: 14184 - DNA, 4199 bp, Heterodera glycines
  misc_feature (4058)..(4058): n is a, c, g, or t
  misc_feature (4131)..(4131): n is a, c, g, or t
  misc_feature (4178)..(4178): n is a, c, g, or t
gttttggagaaaattttacgcttttcatttaaattttaaacttaattactttttactgtcgaaaagtcacctcctgaaatttataatatttctgtcgaaatgtcctttgctgtcgaaaagtccggcgcccaaaagtccggcgcccatgggggcaggtgtagaataagaaatcaagtgggctgaaaaaatttttcgcggaaaacgaatgggtgaagaagttcttaggattttaaaattttaaaaaatttataatttaatttttcattttattgctccgtttaactaatgctttagcacagaattgagtcaaaaacgagatttcttaattaggattttttgaattttgctttcttcttcctgtatatctatttttaggtcacaattacaatttagctgaaataaattgatgtattcaaattttaattttttgggtcatatttttgccgttcatttattttcgtttgacctcataaatatatcaataaaacccactgaagaatgatgctctcttctgtctttttgaaccgatgccatttttttcaacgaattatttcttataactgaaaatatttttattttaaactcaaaaatgtcaatttctaccagttcaacaaatgctgatttcacaccatcaataggtgaaggagttaatgaaatgggaaaaggttgaaaataaatggatttttttggggaagggagtaaataaatattataattaaatcagggaattaaatttataaattttcagaagttaatgacgattcaattagtttggatgaagattggcaatttgatagaaaaaatgaaactgttgctgatcggcaacaattgctgatggtgggcaatgaaagaagcttcaatgaggcatttacatatatttttcgacaaaattatttatttttaaaggaatttcatgaaagttatgctaagaataagatgaaaatggaattcaaaattaccaaacttgtacttgagaaggtaagttttacaaagaaaagtttaaaaatccccatttaacgagcagaagaaaaaccattgattttaagcgggacaaaatacttcgcaaagtcaaacgcacactgtcgaattcaaatccttctgagttaaggcagtttccaacaatatgcgaaaattcgttccgcagatcaccattgtcttaaaaaaacttttgaggtaagggaagttcggctgtgctgatattgcacaaaaaagtcccagcgcctcgtgctatcgacacccccccccccctccacccccgtgatcggcgacttgaatgatgactctctcctgtatttacggaatttagatccatggcatatggatattttgtcgttgggccgccataacatttgccaaacaattttacaaaaatacaggtggagaaaaacagaagggcgggaaacgaaggcattggttgtgtgaaaatatactaataaattaaagaggctgaaataatttaaaatttaactcaattaaaaaaaaattaaatttaaggaaaaaatttatattttgaaagtacatcaattggggaagtgagaaggaatgtgatgaatcagtggccaaatcagcgagggacacataattatttatttttgtgcgaaatatatttatgttaatgagcttatttgtggtagaagcattttgtaattgaacaaatatttaaataattaggacggattgagtacaaacagttatcagaacagggatttgccggggccagaagcctggggaccgggaactgggaggaccaactgggaaaaacaacttaattaaattaataatttttttaagttaaaaattaaacttttctagccgacatttgcggaccgacatttgtgactaaattatcaaaaaaaagaaaaaaaaaatttaaaatgaattttcaaataaattttcgtaattacccaattgaaataatgactgaaggtgataattaaatagtgcttcttgctctaagctatgtcaatttcgacatactttttttctttaatcggaaaatttacccacaactaaacgaatttatcacatatagtttattaggcaaattgattaaaaaaatgctttatacaaaaatcatatcacaaaatatattgcacgcaaaatttttcgtgtttcacctactagccttagtctaaagagcttagattttgatcaggcatacctaacaattaatatcaagaacaaataaaaaatataaaaatatattttatatctttaaaaagcaaaattaaaatgaattactcacattatctatgacaacataattcttgtaaatcaggaatttataaactaatgcattgcacaagttgatcagatcactacttaaggatgatatgaagtgatcaaaatttttagcaccaagaggaattgaaaaaagaactttttggaaaaactttctaaatttttcatattttcattcgcattaacttgcttaactccgaaaaatcacatataaaattcaatattgagatgatcatccaatttaagaaaaaaatttttttttgaaaattaaatccagaaaatatgacccgcaaaagtcggtccgcaaatgtcgcactacgtttcgagttcgtcgccttttgtgtaggagaaaagagaagcatttttgggaggagggaaaagcgcagcagaaaatgccaacgacggaataattaagagaacaaatggaagaagaagaagaagaaacgcagacatagaaaatgggagaaaatgcgggggatatgatggagttgaagaatgacaaaatttcattaattcacaaaatccataattaatggacaaagtgcggcagcagcctttcattcccctccctttcatttttcacaattcataatggctactaattggcatggcaattaactaattagtacttgttaataaaattacgacaaaaaacaaaatggacagacaaaaagaagagattttgaaagaaaaattaagtggaaatgggaataaaaatcttcgccaactgtctggctaaaagtggacaaaaattttatattttcttttttaaaatcgcatcgaaatgttttgctaaaaagccaaaagcatcataatctgctgataaaattgttccattttcttttcttttcaacaaatgcaactttgttgtccatacttttcacaacaagctaaacgaccagcacaatttgtagcactgaaataaaatgatcaaaatgcttataatttgaattaccctgctgccaacaagcactcatcaaacccatcggcacgctttgccaccatttttgcaaattctaaacaatttgattcaaaattgtcggtacaaaaagaattattacctagatattattattttaaattttttttatttagcttaatcaccttgttcttgtatcggtgttccgacaactaaaaacccaattaattatatgtaatgactaggagggatgcgatttttaggttttaactaaatttttttctcacttgatttgaagaaaggagctcaaaaaacgcatttctgcgttaaaaattttcgattctgatgtcactatcggtcactagaaatcactattttggctacttcgtcactatttcttcaatattttggcatttttactcactattttagttaattattttgggatttttcgtcactaaaagtcgcatccctagtaatgaccctaaatttgactaaccatcagcgaagccaaagaaggcaaaaagaataaaaaatgacaaaattagcaatttaaacatttctagctgaaaattaatagagataaaaaccaatcacaaagcattattttcaaatttctaataattaaatttggaaaatgaatttcatctgaaccaataaggaattaattgccttttaaacaaataaaacaattttttctatattcatttagttttccaattagttctaaaaataacccaaaattttttttcatacaattaaaatgagtaaattttgtcaaactcatttataggccaaattatgagattttatataatacggattagtgtattaataaaaaatgccaaaaagtcataaggatacagcgaaaagtgcaaaaatgtgatatgaaaattanaattccactttatatttctcattgtttgatttataataatttacttttgtgaatggtaaatcatttttcaggngcccactccatgtttttttcttttgttggttttatttgtccatactntttgtataaaaaattactttt

SEQ ID NO: 14185 - DNA, 1479 bp, Heterodera glycines
  misc_feature (1464)..(1464): n is a, c, g, or t
ttttcagttggcaacgctgagcatgaataaacaaaattgcatttttaaaatatttaaaaaaatagcatccatttttccgcattgtttgcaatgaagacgacaattgttttcaaactcaaagaggtcaattagccatattggcggctaatgcaaaaaaaaatttaacaaagaataagtattaatttaaatattactaataattttttgcactccaaatgtgcaattaagaaaatataaataataaaaaaaacaattttataaatttaatgatcagttttgcatgagcataaattaaaatttgaattgattgatttaattttactacctttagctgtgaacgaatccattagcaaaaaaagtatgaagaattttattcactaaaaattaatttaaaatatttaacagggtgattttaataagaaaatattgattagagcacaaatgcattataatttttggcaattggaaggccgaatggggagatgttgaattgcaaatacgatgagcaaaatgccgtgagtgaagctgacatttttattatttcagtgccatataaaaatttgcataatctctttggtaacaaattttgaaatataacaaacaaaaatttttttatttggtgtaagaatttaaaaatttattattaaaatttattaatttttttgcatttaataaaatttattctttagattcaaaattaatctttactcattgtttatcattgttctaggaatatttactttattgaaaaatttgtgttcaaaattttaatttactttttaaagtaagttttttggattaatatacgctattaatcgacacttttgatctataaaaatttttcatatttttaattaaatttttttagtaataatatcaaatttaattttttcaattagttataccaccaatttcatggcatttctttgtaccaatgctcagtgtccagtgcccgcatctttgtcttgccattcacacaaacggataaatttaaaatgaacagtcattaatttttttttggaaataaataataaaacccaaaataatgtttaaaaaagttaaatcatttcatttgtttattaattaatgaaaagatttaggaagcaacattattaagaaagtccacaaaacgacagaaataaattaaataacttattataaattttgtaaaaatatttagctaccaacttaacacaccaagtcaattttgagcctcacgtttttttcaacgaataaataaaaaataatgtcatattattctaaaatttttttgagtaaatttaaaaaacaaacaaaattgatcatccgataacattaatgaccgagtcttcatcattttcaccatccgaatgctccaaaaaattgtcgtcttctttttggtcttccagcctctaaaatgtttaaaattcaaatgatttctgggaaaaattaaaccctcccacgccactcaaaactgagtcgggngggcgtttggggccc

SEQ ID NO: 14186 - DNA, 1310 bp, Heterodera glycines
  misc_feature (127)..(127): n is a, c, g, or t
  misc_feature (178)..(178): n is a, c, g, or t
  misc_feature (1182)..(1182): n is a, c, g, or t
  misc_feature (1245)..(1245): n is a, c, g, or t
cattgctgacaaatgtgctccattgtgtagatttgtcggcatcggcatgcattccaccatgctccagtcgcgcaaaacgagtgcagcgcctctccactaatgtttcgaaaatagagtcaataatatntattcaatctaaagagcatactggttgctttttaattcttccgtgtttcanaattgaatatttcttatttttatcatttattttattaatgtatttaattgatttatgtttcacaaattcagacgtaaaaacaatttaactttttattttatgagttgtgttattggtgcgatttttcataaatagaaatttatcaacgtttatatttattgtaaattctttatataatatttaaataacattttttcaacagagcgcttaaattttcaaagatatgaattagaacttatctaagcatccacgataatcttttagaaggtcttgacgatcagtacgcttgcaaattatattgaaagtttcattatcatgaaagaaatgagctttttggcaagggaatggaaaaaatgatagacgaaaaataactcgcgatgttaatataagattttaggaattagtctttttttgttttttatctattttatattttgggttaacctaaaatgtgttgttttatcataaaaaaaatgtcataattaaatgtttatgatgaaaatttttattttaaaattaatttactaatattattgatagttttttcaatctattaaaaaaatatggttgaattttattatttttattctttttcgttcttaaataattcaaatttttgtttgtgtgtttacaaagtaaaaattcaagtgtttcatttggtttattattagctcaaaaatatatttaactcagtggtagaacaattacattacacaatgaaatgaaaaaaattaaaagcaaatcactcacctaaattttttattgtttctttattttaaacttcacatgtgtatttccaatctgaattattttgtctaacattatttgtttgtttataaacttcagattttaaaattctatgatgtaaacagttaagttctgttttatttgcgttttaattaatttatataatcagtcaggacgaattttaggaccatgaattaaaaaaaattttatattggataaatggacggcatttttttgatttttacgctttgaactgngcgcattgattttttcacaacagttttaattgattttgcttcattttcgaaatattaatattntggattttttcttaaatataaatcctaatcatatatatcttaaatttttttgaatattttattta

SEQ ID NO: 14187 - DNA, 2192 bp, Heterodera glycines
aaaacgataaaaaaaggaaatgcctttataagtttattattattttcaatttaatgcttttaatttattttcgaatatacaaatctgcttgtttgggtaaatattatttctataacaaagatattttattatttcacaatttattatttttctttaaaattaaaaatattatacgttagatttaaaaaataattaattgcaatgaatgtacataaacaaaaaataaaaccaacaatacaactattcaattaataacaatattctttatttaaatacaaataataaacttaataaagtaaacattgtgacaaataacataaaactggaagaataaaactttatttataagaaatattttttaaatactttaaaacatgttaattcataacattccttattattaaaaagaatattttaatttaaacaaattttataattagcattgaattgaagagaatcgatcataatttgttgcggttttcacacatatcggacaaatttaatgccgaaaatctgttttttttctagcactgacgcaatttaggtttttaaaaagatgaataagttaaaaaagttttgagtattattagtgctgatgatgcctatcattatatatgtttattttgatatacattttttatgaacataaaattacatagtttttaattgaagttttaatgtgacataataataatttttacttcttgttcccgagcgctattaagtgcgctacttcgtgtaatgtattcttttttttttgtttcaaatgaaatgaaaatgttaaaatattttgaaagaagttttccaaaatgaagctgcttacgattatcattatatgtttggtttttaattattaaattttgcatattagttttttgttattattggcaaagatgaaaaaatttcgaatagtatctctcaaaaattttttattaagaagatgtaaagttctctgtgcccaaatccaagcttcattttaacatgctcgtacatttttccattttaatttcgcttattgattataatataattactgtgcatataattatgatgatttttaaaatgacacaagtattcataattttttttctattaaagcaatttatgttaaataatctgataaataaatctcacataattttttgcctaatttttataaatatggtcgttataaacataaaacgggtcaacctttaagaaagatagcttttaaataaaataaataatttttgtagaataaaagttttatttttcgacatgcttattgttccatacaatgaatggtttttaaatattttactgtaaaatatttccttaaattcacaatatccattctgcttaattttgttttcatatacacaaatttcttaggttttgtttatttattttaataattatgctttaaacttaatgaaaataatattgcatttttacataataattaaaagaacactaatgttttataaatcttataatcacattttactttttcatcttcacttttgcatttttgtgcataattataaatataacttttaaaatgactctgaattcataatttttctattaaataaatttattttaattaaaaaatgattcacatttttattttaaaaatggtcaacactcttttatttaaaaaaggtccactttattataattcagctatcattaatttttttcatgtaaaaaatatcaataaaaccaattgattcacaggaaagaatacatcggttgcttgcgtcagaaaaaaatagaaaattattaatttagatttaataataaacgaaaaaaattattaattaaaaaattataaaaatattattttgctttttcgagtaatttgtgaacttgttgaccggatatttgggatccctacttttggtgactcgacatttagtgataaaagaacatcatttaggcacctgacatttaggggccgaattataaacccgaattttttgggctcggcatttgggttttgaatggaattcttccttaatatttaagtattgagcgtctcactttttggcttaatacttaatattataattttttaattcaaaatccaaatgtcgggcccgtaaattcccagtaccaagatggcgttttgtccccaaatgtcgtgatcgctgaatgacgggttcccaaatgccggtttatctccaattatcgagtccccatgatgacag

SEQ ID NO: 14188 - DNA, 2830 bp, Heterodera glycines
taaagcacttctgaattataaagaaaaatttcattttttcaatggaataatggcaccatcaaaaattgtgacccatttttggcgccaaaagttcactgtgcgtagacaataaaaaattctaacaactaaactaagtgaagcaaaataatgaattcacctggagaatatggcataacatagttctttaaaataagcttgaaattggtgataattactttttctaaaatcagaaaaaaacatcaaaacgggagtgatcagaaatcgttgatttcaatgaaaaaaattgcgcactgagtcaaaattaaaatggattcatttatacaaatagcaaaaattaattatgattattcctttattagataagaaaagccaattttattcaaagtaaatgaaaaaaagttatgggtctatgaatgggctaaacacaaaaaaataaatgtattgtggtttgtccaacttaaatgtattatagtaaatatttattagtatttaaattattttaatttcctattatttaagtgaggcattttaactctggccaaagcagacaaattttttttctttttcattggggcgcaaatgtggaggcgcaaatgtggaggcgcaaatgtggaggcgcaaatgtagtaggcgcaaatgtagcaggcgcaagtgtggatgcgcaaatgtggcacaaccctttctaatgtttttttgttaataaaaaaatgtgttgaaaggtgccgagaagggaaaatcaccaaaatattccttaatttagtacactaaatgtttgaaatataaaataaaagtggccgagtgtatttgaattcgggtaatggaacggattattttgggagtgccattggtaaaggaaaatgccctcgagggattgaagccaatgggaaaagggggaaaggcctgatatccttactgcacgcaacttggaaaatattttttcgggcatcaattttctaaattaaaaattgtttatattatactaaaaccatataatatagccaacagaatctgctctttcagatgtgattaactgctattgaaaactatttttatttcacaagatttcgggcgatttacgaaattggtcaaatttcatagattttgagggctcaaggggtcaaatgcacaaaaatagttactcagctgaaattctttggcgtggcataaagcctcggtccaagtggtagctcatgccagataatggcctttttgaggaaatcaggaataatattttgatgattggaatttatgactggttcaggggcaattttttgggttttatccatgataaaatctgggccttttattttcttaaagagagcccgagaattatcttgtgtagtccatttaagtgaccagggtcttcgttaattctcatgcaaaaatggtttcttttcgttaaacctttctcaggaaaatgaccaaaacattgacccgggagttgcgtgccaactgtaaaaattttttggcacatttttgtctctatcttatgactctctaaagataggataaaacgattaagtaataattattccctaatctgttgtgcacattttgaatatattttagtcatttttggttgcggttgaaaaaagttacaacaaaaaataggtaggtggtgcaagacttatttgtcaccctgtactaaacaattgaattaaaatgaaggcacgtttatccgtacactgagagatccaattgcagagcaaataaagaagcgaaaagcataaaattggagtaacaataaataggcatttgtggtatgatcggaaggcaatttgccgtgaaaaaataattctcacataattcgtgaaaaaaaaagaattggaatggtttcaaagaggaaagacctttcccagtaataaattgtttttgtgcaaaatttatgtcacgttttttcggccgattttcctcctaataataatcggagtcgtacaaatcataatcaatgtcttcatcgtaatcattttcccaatcattgttggcatcgtaatacgaataatgaccgtcataggactgaagggagagcacatccgccagctcatccgaaccgtagctgacctcctggcccaacacctgaaacacgcatttgtgctccctccccttcgggtcgaccacctgaaaaaagaaaatcggttagactcgaaaagcatttggcaggaaagtcacaggcggacggaatttacaattagtcaaaaaaaaaacaaagcaaagaaaaaatgaacataattaaatgttatatttagggtgttgaattatatagaaatccatatttttttcctggactgtgggaggcctgaaacgcatgaaagacatatttttagcttggtctggagcttctaggatgggtttctatatccatattttccatatttcgcgatttttgtccatattttggcatttttccagaaaacctctattagaacggcccccaacagctaaattgacctttttgaccccaaggacaggaaaatttttccaaaaaatcaattttttttagaaaattttttttcgagaatttgaatacatttaaattttattaaaaattggtaaatttatgtcaaaaataaggaaaataaatttaccgtgtttttttcttctaaaatgattattaacaatgtatttagcaattttgaaggcttttactttacatttagcgaatttgaagaaattttgagaaagaacccctaattttgaaaaatttatgtatgtccatattatgccattctatgtccatattttgagatttttttgccattttatgtccatatttcgcgatttgttgtcaatattttatggccatatttagcgattttaaatccatataatt

SEQ ID NO: 14189 - DNA, 1669 bp, Heterodera glycines
gcaggtctccacaaattggggtgaccatttcagcaaaatggtgcacaatccctcgtgttcgcccggacgaaattcgaagaaaattttgacgtcaatggttttaatttgggggcacgaaatgagcaaagaatggagcaaattgtgccaattcatcgcttttgcatcggaagtgccaaggccatagtcgaaatgaccgaacagacaactgaacccaattgcgaatttctccacccgatcggctgtgctcgcactaaaatgggaaggaagacaattaaattgtggtgtgaaattagtgtaattttcatattctaaccaaattggcgattcgaaatcgggcgatttcatctcgtaaatttccacatcaatatcttttgcgtttaaattgagtagggattccaattttaagcctgaaagtgttttatcttataaacgaactccgctcaaacacccacccaatccgttggtcacaccacgaactttcagtttgtccaatgcaaaacgaactttcgctgcctcctcatcaggaaagtctattttaattgtaaagaattaattttttacgtatattaaaacctttgttgagaaacaatttggaaaaggtttgaatgggaaatttgcaattgttcaacttttggtttaagtctgtgccagaaacagatgcaaaatgttctgtgtaaactgaaagagttaacaaagacagccttcgcagttcgagcaaagtctgcacaagttctttcgtcaccaaataggggccgtaaaaggcattctgacaaaaggagaacgaaattcacaaagggcagagaatggcaaatgacaacccacgtctttgctgttctcccaaactcgcttggtgtctttgaacattttgatgttatcgttgaattcgatttccttcattttgacaaaatgcgcgagaaaaactttcattgttgacgagttgagtccctaaattttttataaaaaatacgaaaatgaataccttataatttaccatgaaatttgtgaaagaattgtcttcacgtaaatccacttggtggccaaaaaacttcttaaatggtttcgtgaaaagcatttgctcagagacggcatacaaaagatcctcagacaattttggagtggaaattgacattgattaattttacaataaaagcaaattgttgactaaatatagtagaaaaatgagttgcttttcacacatgcactcagtgtctctagtgatcggccagacaaatttcgatagacgtagccaggataagatagacctagcctggggaaatgggattgaacgaagcaatcttataggttcgaaacggccgttttaagactttgaagtgaccatttttccaaggaaaactaaaccaaaatatatttttattcgaatattgaaaagtagggctataaaggctagacttggactcaacctcaacaaaaaacacatgtcttttgggtacttgtacagtttagaccacatgaaaataaaaaataataatttttttttcttgtttttaatgataaaacgtgtttccaatggtattcggggtcgctgatcacgaatataacatccattttggtcaatttcgaaccccggttccgaattcgacaaaagtcgaaaattccttttcagcaaaatccatctttaatgtccaaaatggattcaaatgcatggaat

SEQ ID NO: 14190 - DNA, 451 bp, Heterodera glycines
tcatggtgcaagatcagcttttccaccaacgatttgtccgcttctttcgggaaaatgcactgctcgtccagcaatgccaaaatgccggtgggctaaattttaatatttttttggggagcttcatttttcgactaaaagggattttcggtttcggctaattatcagccgcatatccgattaaacagaatacactctgaaaattcagtccgtcatccgcaccacaccttttcaatgagttcaatggtcggctgcaagtcgtgtccaaagtcgatgaattgccactcaatgccctccttttggtactcctcctgttccagcacaaacattgtgttgttgaacaactgttgcagcttctcattggtgtaactgaagtggaaaaacaatcattttggaaatcgtagaaatattctcaaaatagtaattgccaagcgattgagcttttcgaaaaata

SEQ ID NO: 14191 - DNA, 3602 bp, Heterodera glycines
agcaaagtccgacttggagcgcatttcgggcaccacaaatttggcatgcttctcatggtgcaagatcagcttttccaccaacgatttgtccgtcgctttcgggaaaatgcactgctcgtccagcaatgccaaaatgccggtgggctaaattttaatatttttttggggggagcttcatttttcgactaaaagggattttcggtttcggctaattatccgccgcatatccgattaaacagaatacactctgaaaattcagtccgtcatccgcaccacaccttttcaatgagttcaatggtcggctgcaagtcgtgtccaaagtcgatgaattgccactcaatgccctccttttggtactcctcctgttccagcacaaacattgtgttgttgaacaactgttgcagcttctcattggtgtaactgaagtgaaaaaacaatcattttggaaatcgtagaaatattctcaaaatagtaattgccaagcgattgagattttcgaaaaatatttatattatttttcgcctgtcgttccgataaatgccatgggaaaaataagaaatttgatgcgatttgttagcaaatttgtcataaaagttgaattttgtttggtctacaaaaagagaaatgagatggcctctaaaaccctcaacattcgccaatttatttgatttgtttttggctctccgcaaaacagcgcccaaaaacacgcacttaatgcacaactgctcaaagctgttcagcttgaagatctcgaagccggcaatgtccaggatgccaatgaacgaagtgccggtgcgccgcgagcggtccaacgatttgttgagtcggctgaccaaccatttgaacatccgttcgtaacatgctttgctgattgcctccacagcgaactcggcctgctccttgttctgcgccttttgcatgtactcacggccaacctttgcggaaataaaaagtgtgacttttgagactacctttttagcttgacacctatgattcattaaaatttcagatggccaaaattcatgaaaaaagcaatccaggtcaatcggtacatggtcatctccagaaaatccctctaaaaaatttttcacaaataaattttcacaaaaaaaaattcaaagttccatacaccaaacttccaaaaatcccgggacaatgtttcccacatcccaattcatacgcatgtccatgaagtgagccaagtcagcccatgccgattcacacaccttgagcttgggcctcaggaacgccttgctgaactcggccaccggcagcccgagcaaatggcaaatcttctgcgagactgcaaaatttgggtttgaaaaaattggaccaggacactggtaataatgatggcactcaccagtgtcgtcaggaagcgtggcctggtccgtgttcttctcctgcttgaactcaatgttgccgaacaacaacaccgcgctgaccatgcgaagaacggctgaaaaaaaggaaaatttaatttttaatgttttttggaattaaaaattttacaattaatttcctcgtcatggaagcccataatcttcattgagcgaacagtgttgtgaaattcggccgaatcgtccacattcggcaacgaaatgtaattgttgttcaaaaaggcgtaccggctgacgtcctccagcaaaaaattggctgaatttaattttatttcaaattagccaaattaaaattttttaaatttaatactaaaatgtttaaatttgcatgtttgtaaaaatcccaacaaaatcacacttttctcctcgggcgatgtgccgcgcaaaaattggtaaaaaatgtgaaaagagcgttcatccgtcgcctggcgacaagtgcgcgacttctccagcaaatagaattcaatgtttgcaccggaaatgtagccggacatgtcgaaattgatccgaatgaatttgccctgaaaatgtgaatggtaaaataataaatagacaatgaaaaaatgaatgcggtgaattcgtacaaatcgtgacgagttgtcattcttcactgttttgctgttcccaaatgcctccaggatggggttggcctgcagcaattgctgctccagctcgcccaccatgttgatgtggtcagccgaggaatgactctgaaattgacataaattaatggccgttgacattgatcaaagctcaatgattaaacccattaaattacgaccaaaatatgaattaaaaaggtatgacaaattcaggcatggcactttaatggtcgctttagcggaataaaaaaataaaaataaaattaagaataaccctggccggtgaagacaccgaatgtgtggaggacgagttgattttggcgttgcctgcgtgccgagtggcgcccgccacgtgcgcgaggtattgaatgacctttttggtgttctccgttttgcccgcgcccgactcgccggtgcacagaatggactggtcctcgtggtctaacaacatgaacacattgagaaatttgcaatatttgtttttgaattttgagactagcaaaaacattgaaaattggcggtgttaaaggaagaaaattttaataaattagctaatgtaagaaatttacgcataaaccaaatccccagaagtacgcaaacactcaaaaaaaagtaaaaatttcttaaaaaaatgaggaaaaggctttagatttttccattgggtaccccgaaattcttaagtttagggccgtcgttgcctttcccccgcctctcattggttaaggtaactaacattgttgagattgtattgtttgtattacaacaatttgtctcaaaaatgattaccctgcagcatcgaacggtatgcacagtcggcaatggcgaacacgtggggcggacgctcgtgccgcttcttgcccttgtacgcctcgatcagtgtttcggagtaaatgggcagtttcttgtacgggttgaccaccacacagaacagacccgaatatgtctaaaaaacaaacaaattttttatggcatttttctgcaatgaaattgcactttggcatcaatcaccgatttgaaactaattaacgcacataaatgagatcagagtaatagcgctgcttcaaattgtccaacacggaaggctcgttcagccatgtcaagtcggccatgtcctccacctgaaaaggcatttaaaattaatcccaaaaatgaattttctaaaaatgggtgtccaaaaaaggagtaccttgtcaaattttggcggattcatcttctcgcagtcgtccttgctcagcttggtctgttggccgttctcacacaactccaccgtgtacgtctcgctgtcgtcacgcaaaatgctggccttttggtgaaaaaaattttaattttggtgtcataaaaaataattataccttgacgaagccctctgtttcgtgaggcacccaaatcagccgtttgctggcccattcagcctaaaaacagcgttatgttaaaattcaaatattttttttggagatctgtttttccggtgtcaatttccgattaaaatgacagatgagtggaaatgtgactaacatgtaatgcggggtcggtgattgatgtgcgtttgaccattgaaaagctggaggtctgccggcgaagatgactgttgtgagaaagg

SEQ ID NO: 14192 - DNA, 954 bp, Heterodera glycines
caataaaactaaaaatatttatttttaaattggacaaaattatttatgcttttttttccctcgttaagcgagtgtaccgaatgcaggaattttattttgtaagctgtatattttcatatggagttatttaatcattttattattgaggtctatttatatccaaaatactataataaatattttttaataaattatttaaaagattttttatttttcttttatttcctttatagtcgtgaaacatttgagagtgtcccaaaattcggcaaaacggattatattttatgcataaacttgtgtaggaatgaaaggtctttaataattaaacaattaattattttgattttatccatttttattacttttttgtcttaactaaatattattattttcatttgatacaaaacttttttgattttttataatcatatttaaaattttgccatgttatgtgaaatatttttttatttgatatgacttttttcaatatatgcaataagcattcaaaaatgctatcagtttctcgaaaaataattcgttcaaatgagcatacaaattaataaggtgttagtataggataaatttttacaaaaaaaaagattaaatatgtaatatatttattaattatttttatataaaaaaatttaaattgaaattatattgttttaatataagtaaaaattaataccaattaattattcaaatattttttgttaagtctctttaattttttaagttttaattaatattgaggagcgattacttgtttaaatatcagccagaattggcacaaatgaaacatttaattcgaaagatcaacagacactcatagtgcctttggtttaatattttattcagtaatttaatttgtgaattcattcgttattgttgttattagcagttgtatagatgctcatgtagtcggtgcagttacttaatgttactgtttttgac

SEQ ID NO: 14193 - DNA, 2707 bp, Heterodera glycines
taatttttaaatttatctcattttatggaaaattccttacttttttggtaaactaaaatttataccaaacagggacctacctaaaatattaataaatgctttagcaaaaaatatattcttttttattttattttccgttaggtgttccttatttacgagaaggttttacttattcaaaattcagcctggattggcctaaatgaagcttttataaaagcatttatttgtttgtcttaaatatcattatttgcacaattaatttttaatagtaaaaaattatgaattccatattcaggcatactgtaaattttcgctaccaagttatttaccaattgtattggtggcacgtgtacttcgttcgagctctgcattatgattaaaaaaataattttcggttaattaatgtaattaatttcagaaatatataagcttttttacaaatattataataaaaagaaaaagattaaccttgttgttttattaaaatttttctttaatagataatggacaccacaattttgaaacatatttatgatggaataaaaaaagtgcattatttttattttttagtatcaatatatttttatttaaatctaaaatttgacaaaaaataaattttataatattatttagtattcgataaattttcttttatgtcattgaattcaaattattatttttttgcttttatattctattattttttattaaacgagagggccaccagagtccgccataacgtatgctgcattgaattcattcataaaattcataaattatcaaagtacaatgcacccattgcattaaaattacgtcatgcttttaaaatatttagtaatttaaataattaaataatttttataaatataatttttacgtagtatttattgttttatatactttactatttatcacttagattatgagaatagttttgttgagaatccattttaataattattttatttgtcttttggaatttttgtattttaataatttatttctgataattatttgtattatattacctagaaactgtattcgtgctgtaattcgaaagctattgtatttttgcgttttgtttaaataatttttttttcattttgaatttcttgttaaaaatattatatttttcactttgtctccatacttttattgatataaaatagttttttgtttttgttttttttgtttttaaatttgttattcaattgaagagtgggtcaaataattatttgaccatatacaaaaacactgttttaatactttatttattatatgattatatcaataaaaaataaataactttattttaaataaaataagtttataatttattatatttgaattacatttttatagttaataaatcagttctactcaagaattggttttaaagaataaatttttttattattgactttatctaaacgtatttgattattattgaaaacttatgttcgggtgatgaccccgagagagacattcaactcttttccccttccccacttctccacacaatcagtctctgtcccgactgcgaatcgggaagaggcggtccatccaattgtataatactcttgaataaatgattgttaacaacgccgctaccaaattgggaatgttaatggacccgcctggacccacaatattcaaaggcaagcaatggaagaagtttgggagtaaacggaaataaagagaactgcgacatatacgagaacgcaatttgctggcaatatttcgattgaactgatgaaaaaagagagaaaagtgataaattctttctaaaattgagtgttccaatatataaaattcatgttttcataagtaaaaaatatgctaatttaatttatgcttgtcatcttttcctctctttttggattttaaattcaaaacatttattttcgaatttttcaataaatattatgaagcttttggatagcatttccgttcagttaataattaatttattatcaaattcatggtgatttgtttattattgtgattctttttattcttttgcaattaaatttatttcatatttttttatacaattaaattaatttaattataattctcaagtctcgtgccaaaatacgaggtaggagagatgagaacaagacggtctaaaaacacaagattacgtgacacgagaacgagcaatatccctgctcacacgcaaaagataaacgaaaaacattaaattcgtatataattttaaaactgttttcaattatacttttttaaataaaaatttagtttatataaaaaaatccttaatttcatctatatttgttttgttgtcagaaatctagtcccttttcataaatattgtaagattgtagtaaaaacaacatttgaccaatttctaacgcttaaaatgtaaaattaaacagaattaactataataaatattttttcttattaaatatcaaatagtattatattatatacttcatatccaagaaatttttcactgaattaattatcttttgaacaatgaaaatataaacaatagcttatttaaattaaaaaatttcaagtttgaagaaacaaatttttcatcttttactgaaatatgattttttgataacgtaccgaaaaattaaaaaaaagatatcaaaataattttttaattaaacatatttaaataatttttatggcattaatacatgtttcactctttatgaagatattttttcaagaa

SEQ ID NO: 14194 - DNA, 2662 bp, Heterodera glycines
aggaaatcgacgaattcgacttaaaatgggtataattggctttgcaacggtgcccaaatggggaagcggcgatggtgccagcaattaaatggaagacagcgtaaatccgagtgccaatttgaacagtgtcacttttgatctgtgagtttcgataaatccattgggtgagcagcagcaatagcatttgattttgccgaaaaataaaatatttaattcattttaggccattgtcgccaccagcggaagaagaaaaagaagaagataaagcggatcaaagcaacggaaatgtcgtctgattaagtgtgcggaaatgaataattaattatatttgagaaatgatcgatctcaatttgttgtgcttattttctctcagaaatgcttttgttaattgtttcgttccaattatataaaaatatgcttttttgttgagcaatttattaataattagggtttgtaatagagaccggataagagggtcggtcgaacggtttcggttaaaaaaccgaaaaaaccgaagaaaaattttcggtataccgtttcggtttcggtttttttgaatttttttatcaactaatatatttttctagaatcttgcaggctattagagaacacttagacctattttgcggcgccaaaatgtcccgcgccaaagtgaccccgacccaaaaaattttggtagaaaaaaaataaaaacatgccgatgcacggtgggggtcggtttagtctggccggtttagtctggccgttttagtctggccgttttagtctggccggtttagtcagagggtcggtttagtcagagggtcgttttagtctggccgttttagtctggccggtttagtcagagggtcgttttagtctggcaagctgtttttgtcctacattgatccaattctgatttgtttctcgaaaattctttaaaattaacaccataacagattatcaatgtgttaacaacaaaaaaataacaaaacattgaaaaatgaatacgggcatatttaacaacgagaaaattgatgatattatcaggattaacattggcatggtaattttgatcattttggtgagcagggttaatgttgttgatggtattgtaaccctgtaagagtcgaagaattcgtatcaacggcacgatattttcgcgttttttgaggagggacttcaccagcgatgcatcgtgcgatgtctgcatcaattgacttttctcatatcgaattgtgttgatgaagcggaaaacagttggatataaacaagcaaaagcccgttgaatgaaaaaaaaattagggtttactttgcctgaagctataaaaaggcggtgccaaactgaaggtttcgctttgtttttattttctaattgggatattcatttatattgtagctaaacatagatattttaagtttttccttatttataattgacaaaaaacatttgtaagaattatgggcgaaaacggcttgccagactaaaacgaccctctgactaaaccggccagactaaaacggccagactaaaccggccagactaaactgacccagtccgagagaaaagcaaaaaaaaatatcgttgtgtcttacttcccaatttaacacactattttttcaattttatttctctgcccacgacatttagtgaatataaaaggacagagagtaatttttaattgcaaatttcgcttatttaagtcggaattttatgcgacttccattcattctgtgcttttaaaaattccgtcattttatcctcgttttgacgttcctttattaaatcttgtttttatatatattttttcttcttttacaagccaaatccatccaaagtttttgccggatctttgacaaaatattcccattgttctgtgtggcctaagaatggtgtgctttggaccgaaggtgtgaatccattaaacattttaattatattgtgcgaaatgtttatgtaccttataggcaactccaatcgtcgcagtgatcggctttgtgctcgacattgctattgcaattttcttagtctattatcaggagttaatccccgccttggtaaaagtgatcattcatcaatttacataaatttaagtgacccattgttactaatttagccttttttgatcatcgcttttggctatttggtggtcgtttttggacacattgagcgcaactgttcactgttcctgccttttctcgccttaaaagtgggcttaccgaagcgaaaaaacacatcgaaaagccttaattttaatttcattttagcctcttggtctgatcgttggtgttttgctgtttattatgtctctgtgcttgattatctttataaacatggcgaagaacatcgaaaagcaaccgttctcgccccgcgaatcgccgttccttacttaccttattgatcgcggtagtaatttttatctgatcatctccattacatatttgtttttttatcagtgccttatgtgattatcttcgtgattgtgatggggctcagcactgcgttgcacgcctggttctactccatcattttccgtgcttacgttttggtcaaggagaagtcggctcaggacaatgccaattcggagggttacgacgatgttgctgctggtcccacctgttgctgcgggccgttccgtgcaagaattgagacggtgtttaatgctttcatcaatttttatta

SEQ ID NO: 14195 - DNA, 957 bp, Heterodera glycines
catcgaggaccaattgagtgcactgtcttggtgcacgtctcagcgcgcaggccaaccctatttaccaagacgtgctccggacagacgtttggatggacattttcccatcgtttgaccatgcccaactcggcctcaaattggcacttctttcgccacgtttcaatgcgttggtggacaaacatttcaacggcaaaagcgaattgacaatttggaaaacaatcgaaattcgcaaggacaaaggaccagaaccgaaactttatgtaaagatggatgacaaatttgtgccatttccattgccagacgatcgtccgttgcccagcaaaatccgttttaagcgccttcagattgagtaattcaaattcagagagctatgacaataaaagcattcattccatttttaggtacatcgatcactcagtcattgcttttcttcgttccaatcagcaaattttcgacaaaagagacaccaatttagacttgtggattccatcaccacacaccacggatggccagccaatttgggatgtttttgttcgtgaaatttggcccattttttcgacaaacattcaccatttgggcttttcccatgatgatcatttggaccatttgcttcgtcgcacttcgccgacaattttcactgatctcaatcagttggtttcaatcaattccgttgatttgttgtctgatgcatctgaattccatctccaaaaatttggaaaatcggaattctgtgccatctctctggcgtggtcccacattttcgtcaaatcactttttgtttagcattttcttcgtgccaatgccatttcttacgtcagttacgaaattcatttttatgttcatgggctgtcaacgcaaattgtgccatttgaattggtgaacgaatggacaaatgaaaagctgacattggccaaagccaagaaaacggacgattggataatgaaacgatgcaaaatt

SEQ ID NO: 14196 - DNA, 824 bp, Heterodera glycines
gcagtgatgacttttagttcattttccgtgttcttaaacaaatttgagcaaaagagtgcaattggaaaaatttgaattttcgatgtttggttcgaattcgggtccggggttcggaattgggcgaatcggatactggattcgtgatcagcgacctcgaaaacccccccagcaccagctttactattaccgttttttctcttagggctatcgagtgataccaataatttttaataagaaaaagctatggtgcattaaagttgcaaaaaaaagcttatggtcgtgtgaaccgcaatagagtccaattttttgccatttttatgcgtccgatttatttaccgaaattgagaggtttttcttcataaaatgcacttgatcactgatgaattatgatcggtcggtcattcttaattaatacatttcttctgcggttgatcactgtttttgttgttttgtccatcactcattttgtcagcagaaaacggcccttttgtgatgctttgtcccgtttcttctgccggtggcggagacaatggccttaattaagcgcaatttgaattatctaagcacttttttttaattgctcacccaatgcaattattggcgctattataaagccaaatgaacacagtgttacaattgttgtcccaatttccgtctttccaatgaaccgctgccgtctccccaattttgcatcgtttcattatccacctgttgtcctcaaatccgtttttgattgctttggtcaatgtcagcttttcctttgtccattcgtttaccaattcaaacggcaccatttgcattgacgacacatgaacataaaaatg

SEQ ID NO: 14197 - DNA, 985 bp, Heterodera glycines
  misc_feature (954)..(954): n is a, c, g, or t
ctctccaataaaacattccaagcaaaatttgatgattttcttctaaggtaaacccccagcaaaatcacaggccgtagagccaaagaatgaaattttgagggcgacggggaggaatctccagcagaagagaggaggaggaggaggagagaccggttctgtttatttatggctttgttggacacttttcaaacagagcaaaaaaatttcaaagaaacttttttcgaacattttttccaaaaggataaataaaaaatggaagaaaaattaattaaaaaacaatttgttaaaaccaatccctggctttgaatgcctctacgaaaattcagaaccctaaattaataaattcattcatttatgtttgttactttaaggaatttttgggcattaaaacaccctccaaatatgtcggcatttttaggattttataatttataaaaaaatattattttattcgcttgccaaccctaatgcattaaagtcccatttatttttcttaattatttattttttgaaggtcattgcgatatttcgcgactttttatctaaggaatttttcactgttcgaaagaaaaagagatggaaatatatttttaataaattaattataattaattaattattcccaattttgacaaaagccaaatttccttctgatggactgcccttttgaaggtcgttgctaattgaagaatcatatttatttaattgatcacgggtttggcgatttttgacaaaaacgacaaaacaaagcaataatattaattgttattattatatcgccgcacttaataattaacgctttaattggactggtttaaacgtcaaatgcccacaacatcaacagacgcctgtcaacaacggttatttgcatctcgaattattcgacaaaatttaatttctgtcaataataacaataattataattatgataatggacgggacgacgcccactcngcaaaaaagtttgttggtgccaaaataaact

SEQ ID NO: 14198 - DNA, 1446 bp, Heterodera glycines
  misc_feature (1293)..(1293): n is a, c, g, or t
  misc_feature (1308)..(1308): n is a, c, g, or t
  misc_feature (1395)..(1395): n is a, c, g, or t
  misc_feature (1397)..(1397): n is a, c, g, or t
  misc_feature (1439)..(1439): n is a, c, g, or t
gaaggagattaccactcgtggaactcctttcaaacgtgccttgccataaacatacgcaacattttttcatggtaaatattttaatcaacagaatgcaattgcaattaaaaacctgaaacaagtgtcatagtatcattttcgttgaattgtttcaacttaggctactgcattttttaaaactttggttgcagtatactgtattcctttttctttttttgttactgtatttttagtttacaaaggggctacagaaagagtccgtcgccccctcggaacatcgtttttcaatacgtcggcacaactgaggtaacatttaaacgtttttaattgcttatttttgtgtaaaaaaaatatttttgttccgccccattttcttccgctgaaggtcgaactttcgtgggtcgagccaaaatttaatgcgcatttggtggaccattatttgatttatttgtacgagacgacaaacaatgggcacattgaccgcgagacgaaaattcgaattggggcgatgggcaaaagtgcacggctgaccttgttggagccgggaacaagtccatcaatcatttttaataacaaaactgttaaataagatcaaatggcggaggagcaagggatgaaattaaacaccaaaaaatggacaaattcgttgctggcatatgccgcttaacattttgtgtcaatattcaatttaaagccttcttttacacaatacggagatagatcgtctgaatgaattttctgcacaatattaattttaaaaaattactataattctttttgaatacattaaaggcaaaaataagtttatcccccccccccaaattggtcttttttgtaattaaaagtactctctgtaacttcgaggatcaaccacttgcagtgttcgttcactttagggtatgccgcacgaatcatagcactcgctgaatcggacgatgatgaggacagcgaagacggagaaagcggggcacggtcacttcccacggaagcgcattttaaagtgataaagttaattggcaacaatgattgagtggattagttaatagaaaacagcataaagaaaaataaataaaatatgctaatgagagtaaataggcaatttaagagtctgaagataacttctcagttttagttccaaaccttggtttccaactctcgaatatctaatctcggtaaattcaagaacaaaattcagaccaatggaatgccaccgcaaacgacggcgtacaaagagcaagtgcaagtgccgccaggcgcacattcagttttaatcgcttgcacaattcgaattangtataccaaattagntatatcgcaatcaaaaagcttggttaaatttaaaagcgcgtgcctcccggactgaggaaaccgcaattcgggtgggagcacaaaacngnacgaaatgggggggacgattttatgcaaaaacaaaaaaaccnaggcaaa

SEQ ID NO: 14199 - DNA, 2017 bp, Heterodera glycines
caaaaatatgaacataaaatggcaaaaatatggacataaaatgcaaaaatatggacataaaatggcaaaaatatggacataaaattttcaaattgagggtgtaatttctcaaaatttcttcaaattcgctaaatgtaaggtaaaaatttcaaaaatggccaaatatggtattaaaaatcatttagatgaaaaaaacaatgatagagctaaaatttactcatatttagacgaaaaatcaacccaaaagccaaattttcgcttttttgcttatttttgacataaattaaccatttttaagaaaatttaaatttattcaatattttcaagaaaattttgctaaaaaatgattttttgggaatttttccaatctttaggggtcaaaaaggtcaatttaactgatggggcggttctaatagaggttttctggaaaaatgccaaaatatggacataaaatatggataaaaatgccaaaatatggacataaaatatggatcataatgccaaaatatggacataaatcgcgaaatatggaaaaatatggaaaatatggatatagaaatccatcctagaagcttcaaaccaaactaaaacatgtttttcatgcgtttcaggccccccacagtccaggaaaaaaatatggatttccatataattggaagccctgcttatcacatcttttttgaaatttattttttatttttgaaaaaattcataaagacgtgcatctaggggttttcggagtcgttgatcacgaatttgaccctcatttcgtgcaattccgaatcccggacccaaaatcgaacaaaaactcgaacgttgaaattttcgaatttttcttttttcgtctaaaaatgggaattttcggaaaaattcttaacaaaaatgaaacttacacccctaagaatcgacccaaaaatttttcagaaaatacacccctaagaattgaaaaaatttccacaaaaattgatccccaaaattcaattatttttcttaataaaaatttttggtttaaaaaatgtcattattcgacaaaactttaaaacaattgaaatataagcacaattaagttttttgattaaatttttacgtgctttgctacattaaaaagcgtttaataaagttcggggatttttgtgtctttttaggtgcctatttcgcgattttttgtgcctaaaaatggaagccctattaattaaatttaaagaagttgtttataaaaaaaaaaatttaaattaatttttcttttttctttttcatcgtccgctgacatcgaataaataaaaattagaaaaataaaatacatttttttctttgcgaatttacatatgtatttattggagttattaacgtgtcatttcccgaagaaattacatgacgcctgaacaaaatcaatagaattttaatgtaaaatttttttttttcgttttgattatgaataaaattattattattagtagggattccatttttatgtaaatacatatttttttcctggattctccatagcttaattagtaggaaaaacactttcttttttgtgttgcgaacaaaaattgggacttttatttacatatttcggggtttttctacatattacatatgtacatatttttatacatattttggactttttgaggttttttgaggaaaatttttagatgccccaaaaaaaagtccaaaattttgcaatttttttttgatattttgaaaatttagaaaaacatcttctaaaaaacaaaaaaaatattttttttgaaagtgtactccaaaaatcggttttttcccaaaaatgagatatcaaaaattaatttttaaaatgctaaaaggtgattctaagacaattttggtcatttttatggcattttgtgcctatttcactttttacgaagaattttttccaaaaaataaccatataaaaaattttatttacatattttagtacatattttggggtttttgtacatatttcatacatattttagcattttttatacatattttatttacatatttcgcg

SEQ ID NO: 14200 - DNA, 1553 bp, Heterodera glycines
aaaaaccctaaaacggctgaagagagtattaaaagactgtattaaaagaaaaaaaagtgaaataagctaaattactattaatttttctcgaaaacaacctaaaaaatgagcaagatatttgaatttcggcgacccaaaacagaagatattttctaaaaatcccttccattcttcagctttccaattacaattttatttcttcaaaatgtctttctcacatggcgcttgcggaaactgtggcgaacatggccaccggcgtgcggaatgcccgcaagcagtttgtgagtgctgtggccaggccggccactgggtgcagcagtgcaaaatcgaggctgcagccaaatgttgcgttgcatgttctgtccgccagcacaaggcggcggaatgttgggtattggaatcttggggtaattattaatcccgcttaaacaaagcccattgctataattattttttttagtccgctcgcggatccgagaaccagactgctgtttgttggaaaattttgtggtgcggcgcgctgctgagactgcagacggattttgcgtcctttgtttccaggtttttttcgctttaaaatgttcatttgccaaaagatactttatcttttaatgaatcattaatttaagaacgaacacgtggccgaaaaatgcccgcaaaaagattcgctggggccgctctacgctcaaatttgcgggtcgcacaaaaactcggcggttttgcgagaatggggtgagttggaaattgtttaaaaataccgtaaaacctcaattacaaccccatggggctctattgtttatatttaacccttttgtaattcgtctgtgggcacgagaagaagaactgcagtcagcaccgtctcagactgcagttcgagcagattcgggccctcttcggcaacttgcaacgccggacaaacgccaaaacgacggattcgacggcaagccctttttgggcgtcgtggtcggggcggcgtagtgacgacatccgtcgccaccgctacatgcctatcgggaaggaaaacaggtttttttttttgcataaaagtattagaaaaatccaatggtttacagagggagcaagacgaaggcggaggctgcagcagaaggcgattttggacagaatgctgcgaaaacgcgggggccacaaaagttagtggtttttggtcggttccaacgcgggtgggtggggagcaggaaaaaacgtcgccgccgaggtactaattcggccgatataatgctgagggttcggaaaatcacaatgtctttcatgttcgggtggaggattgatgggtgtgcctccaggcacagattggacaggcacgatggaatgccacactaacttatgcccaactcaacagcaccaccgaagatcagaagaaacgcttcagaatttggcatttttctacaaaatgctgagagaaaaaaagtaattaaaattaattattattaaaaatatttaatggaaattaaagacaaaatggaaatatacaatacgaagataactactggaggtccaaaatagcgcaaaaaaagcttagcgcggaaaagtaa

SEQ ID NO: 14201 - DNA, 3407 bp, Heterodera glycines
  misc_feature (353)..(354): n is a, c, g, or t
  misc_feature (380)..(380): n is a, c, g, or t
  misc_feature (438)..(438): n is a, c, g, or t
  misc_feature (492)..(492): n is a, c, g, or t
aatcccgaacccaaattccaaactaaattaggaaaaaataccgccctttcgatctttttttgcatcccaaattagggttcatcttcgatccaatgcggggaattacgaaggtcgtctctattagaaatttggttatgttttctcgaattttataaaaatccctgacgaggctaatgcttctccccgacattttttttaaatttctccagccatccctgacacaacattttgtctgggatttcctctccgacccccgacttttctctccccgagttcggggaccaaccctaatcccaatatggagtgtgatttggtcaaatgtattcaattcatggtcacgatcacgaaacccnncggtttttatctgatattataatcangcatttctttcatggctattggtgctgtcggacacattacacctgatcactatgtggntggtagcagcatttatagtgatggatcaaagcataaatttatatttttttgccnttcactgaaaattttctttaaagaatttaaaaattttgaaaattcccaattccttaattggaacgggaaaatcgcccccaaatcagtgggaaaaacccccgtggaattttaaaaatttaaacccaaattttaaaaaaattttaaaaattttttagaaaatttgggaaaaaatttaaaaatttcggttttttttgaatttaaaaaaaaaaaattttttaaaatcccctttttttaaatttttaaaaaaaaaataaaaattttttaaaaaaaaagagaaaaaaatttaaatttaggggggttttccccgttttttccttttttttttggggttttgtgggcccaaaatttttttttttttattatttgttgggggggggaaaaaaaatggggggagaaaaatttttttttttttttttttttaaaaaaaaaaaaaaaaaaaaaaaaaatttttttaaaatattttttttttttttttattttttccaaaaaacccgggtgtttgaaaaccccccatttttttttttttaaatatttttaaaggcccctttcccaccctttttattttccccccccaaaaaaggaaaaatttaaaaatttcgggcaaaaattcattggatttttttgtttttaaacttatttatggttttttcaccccccatctccaccgccaagtttgtccaaagatccggcacttagcaattgccctcaaattttttggcaattttgtttgttttaatattccattccaacaagaagcagttttttgtacatcctcataaaattgttccccaaactgtccaatttatgttcaacaggatctcgaaagcctacaggtgggtggtggacaaattattatttgttaaacttaatgactcagccgatcaatggatttctacattttcaaaatgctttactcgactgatggtgaggaaggaaaggtattcggacaatcgctcagtggtcaatccgtcggtaaaaatttttttcagacaattgataaaaatattttagaatgacattataaggaaatactttattaaaaaaatcttccaaggattttttcatcttttttagctactcaatacttttttatttaaatatttcttaagatttaccagacaaaataattattgcgctgagagatttaccattgatggattgtccgggagccaaggaaatttaagaggggggggggggggtcaaactgctccctcccgacgttgattcccctgtgttgcacaccttttttgcttgtcgaattgcttcttcgaattgctttttctgttccttgttcagaaatccaatggaaaagcgatcggcgctttgttcggccaaattgagtatttccgccacttcctcttcttcaacgaccaattgtggcattaaattgccaatttgttgcagcagattttgtgcttgtttctgtttgctccgcaattccaattcgcttgtcagtgctccgccgttttgaacgcgtaatttggtgatttgtttaatggtgtcacttaattttgtgccatattcttgcacatctgcttcggttgcggcactaatgtcaagaattgtgggcaatttgagacgacgaagcacacgacgagcggctggcaacggatgctccaccgttgggtcgtcactttcgccatcactttcatcttcatcgaaagaacaattgtttctgttgtccctgccattgtcctccccatgttgttgttcaacttcgtcgggatttgggatttgttgttggatggccaatacttggagaattgcttcgcccatttgtgcgcaaagccggccaactttctcaacttcattgtgatgatgagcaagcaacatttggcaaatatcggtgatttgtctgttaaagatttccatctcagattgatcttcgtcgtcatcgtcgtttttgtcgccctggccttcgtttctgcaattttaaagaaataatgcaatttttgagtcactcaattaaattcatcaatttttaaaggagatttttgtcatttcatttaagaagtggttatttgaaaaaattttgttttaataccattagggggcgctgtctttaaatattactggcgactaaaaaaaggttaaaaaaaactatgggtaattaattttaaagaaacaatcggatggtatcgggaacagaacacaggtacaaataataataatgataataataataataaattaataatattaatatcacttggcctgtgagttagttgagttggtcagtttgtagtacagaagatatgcgcttttgctctgaaaaagataaacaaaatcttcaaaatgattccctaatgaatggggagaaattctcactgtgggcgacggggcggcacacggaatgcatgactcatcgttaaatctcagccattgctgatcagtgcttgtcagattaaccacaaccgatgtgtaatggcctctgtccaaactgccgctatgcttcttaaaggcattaaagcaattagcgtaattaggacatttttagccatttgatcaccgtcatggcatagagagtaaatgccgtgttgggaagcagagacttttcgtgaatatatggcgacaaatccaactcattcatatcgaaagtcacttgagcctattttacaataaaatttaaatcgcaaaatgcgacgcccgacggaaagcgacctcatttttgacaaagttgccatcattatgcgaaaatctcttcaaatggacgatcagaatttcggggatcttccaaatttttgtgctccgagtcgccggctgtttgcttttgcaatttgggcaatcccatttatcatcgagattataaaagggaaaataaattagcataattaggaacctttgcaaaattcagctgcttactgtagatgaaaaatatgcctcgagacagtctttgagcttcaggcagtcaaaat

SEQ ID NO: 14202 - DNA, 1062 bp, Heterodera glycines
gaaagcttggggttgaattgcattgaaattgccaagacaaaatatgatcaatcagagcggagaatgatccgctaatggttcccttcgttccatgcggaattgtttgtgcaaaaagcaaaacgatttttattgtaattcgtaattaattgccccgacttacctattaacgaatggctgagcactcttttgccgaaacagttgagaaaagccaggcgtatggaaaagcggctgaagaatggcattgataaagcacgtgttgcccaagttgatgagaccggtctgaccaagtggctaaaatatgaaattgaagcctaagaaattttctcaacaagatgccccaaaaatgtacccttttcttccgcttcgattcgttgccaattctctgcgcagtcttttcgtacgcactgaggaagtaattgccggtgccattgtcagtcctaaaagagttgaacaaatgacgcattgttaaacatcaaaaattgtgccaataacagacagatgatgggctgctgcttgtcggcatgggacaaatggcgacggcatcgtcggctcttccgtctcgttcgacctttgcaaaatgaattacaaaaaaaagttgttgtaaagaatataagaattgtattctcagtataattgtgttaaattctgtagtttaaaaattatttcggccaaaaagaacttttgttatgatttaaaattaaagatgactcgttattagcagggcattaattaccgttcgaagccttgcccgactctgtttgttccgtcaaactcagcttctttttccgtgacgccatttccatgctaatttgaaacggatttttttattttgataaatcaaatttttttgtgattttttctactttaaggaacatattccattattgtcaatttaccggctttgaagcagcggtcaggaattgcgttggaccgtccgccttttgtacggtttcttgcattacggtaacattttgcttgaacaaattgaatttaagcattggataagaattattcaaaaatatagatgagcgcaacaacagcttctcatatattggcaaagaa

SEQ ID NO: 14203 - DNA, 1133 bp, Heterodera glycines
  misc_feature (979)..(979): n is a, c, g, or t
ttggccagcaaacaaatcattttcacgaagaacggcgtcagattgaagagtgggccaaacataattaacagaaaattcaatttgaaaaaagtggaatggtaagccaaaaatttccgtatgcaatattaattaggtaaaattggtttttgtgttttccatagtttataaactaattgtacacaaaaatattaaaattaaatttagctgaatccactcattacgtccattcaactgatgatgacctctacccggcggtgtccttgttcaaccctggcgacgaaatagaggcaaattttgggccatttttccaatttaacattttcgaggaattatctcaatgaatttgttttgcttttggtttataatctgattatacaatatttcaaatcagggaaaatacaatataaaaggaggaagaaattaattttttttaaaacttttatagttgctagtagaaaaatttctaattaattacattattaggtatccattgaaatctagaagtctgtagatttttatacaattaaattctgggcgaaagataacatataaaaaattgttcttaaatatactctaaagtcattgattggacgcgtaaactgcagcagtagagctgttgctttattctctaaccaatctctcaagaatcgcaaaatactcccattttcgccattaatccatttgctcatcatttatcccattcatttgaccaatgaccttcttattaatatcaactctattagaatatttctcattctgatattctcacttgtgttgaaaggaaataaaacgagaaagaatattcctttttaaaatgccttataaatagagtgttcagtttttagcacaaaaaatcacctattaagcagtgtaaaaagcaccaaattttctcaaaaaaagcgtgaaaaaagcaccaaaatgtcaaatcagcacaaaaatcatgaaaaaattggacttagaagcctcaaaccaagtttanatgcgtttttcatgcttattatcacacccaaagttagcaaaagatttcagcatatgcagcaaaatgaacactctacttataaatttataagatataatttatatcattctatatcgatactgctcttcatgtcatttggggggggggggggggg

SEQ ID NO: 14204 - DNA, 2489 bp, Heterodera glycines
gaaacgcaaaaagaccacagaggcagttacataatgattgatctaatttttccccaagatatttcatacgaaattccaaaatctgatacttttctcgcatggaaataaaattggattgcaataaagcaaatttttaaattaaatttaagcaaaataaatgaaatgaatttctacaaactggcatttatttttatatttttttcaggaataaaattgccatcaaaaacctttgctgcgcatgttaatggcacgttctttgactttcgcttttctatgaatgttaaatgtgacataaatatctaatttatatggctaatatttttagttttttgcctatttttttcctgactcctttggtctgaacgacaaaaacattttttttttgttaagctacttttcgagttattagcactattttctggttttttatttttagcacctaaaacttaaaattattttcaactattttggagttttgcccaaatttgttaacaaaaatgcaaaaaaacgaaagataatgaatttctcaaaaattcatctcctgatttatttatttattttcttgaaaagatttttggttttaaaaattatacacctcaatactaatttggcttatgtttgttactttttgaataaaattttacgtttttaaccctaaatttgaacgtttttagcaactttttcctatttttagcaaaatatttttgggggtttttagaacctaaaaactaacaattttggcagtttttagcaactataaataaagtagagaccggcaggctccacttcgtttaggtgctggcgtttgggcgctcgcgtttcggcgccagcatgtttttggctattgttctttgtcatccaaatccaacattgttgaaaacattcgaaagcttaacatgtttagaagctttttctaagctattgcttcacgattagacaagatttatcaatcggttatttttggtcttgtatcgaaaaaacgatcgaaccccttatctgatctctactaagtacgccgtcgtatttccaaaaaacgcctctataatgtcaaaaaatttgtaactatgaaatctaaaataaacaattttattgaaaatttaatttttttttttttttgctttggcatttagcctaaactgcagggcttaacagacatatttcctctacttttccagaaacaaaccttttaactgctgaaactgaattgcatgggaaaatggatgaaattggtggaagaaaaacgaatgaatttcttaggaaaattagccaattccgtgacgtaatgaataaaatgaatggaacaacaaaggatataattcgtgggagtgttgcattatatttacttagtagcttagtacgtttttttatttttattaatttagtaatttaaaattttcgctaaaaattctgcagacaaagaccaaattggctcagcgaatagtggacggaccgacgagttttacgaaaagccaaatggttatgcaaagatacgagagtctcgactcatcggtttaaaaggcccaaatttggcgatgtttcattttcaggctgtacaaatgcgcgtgcaaaatctatcggattgtaagaatgaactcatatttttcatgccaatggatctaattgttgttttggacggagaggaaaaaggtgtaaaaaagaaaagattttggaaaaggaacacaggaccaaatttttgtattaaaaataggaaaaataaaaaataaataaaataaaatttagatatataattgagcattattttcatcataaaataaataccaatttttttaggttttcgcattgttcgaatttgttttgtaattcctccagataatctcggagttacatattttgaagtgaaaattatcaaattacaaagagaaaatgggtgagttaacagttactaagaataatatattattaatagggcgaggatttctagttttttaactatttttttctgcggctttattttgatgagaaatgcacgaaaaacacattctttttcaaaaaattttcgtttttagtgccactattcatcattaaaaaaaattattttggaagttggccactaaaataattatttgtcactattggcgtttcgtcattatttttgccactattttggcattttttggaaaatttcccaaaaaatgcaataaagacgaaaaattcacccctaagaatctacctaaaaattttcaaaaatacacccctaagaattggaaaattttcacaaaaattcttcccccaaatttttttttcttgttcatgctaagaaaatattttgtaactgcaatcagtgaaaaagttgtttgccttaattttaaattattttcaaattaaaaaacagctatttaaaaaattacacccctaaatttggaactttttcgcctccatttttgtcactattttgccatttttttgtcactatttagttaattatttaggggttttttgccactaaaaatcctcgccctagccataac

SEQ ID NO: 14205 - DNA, 2002 bp, Heterodera glycines
aattcaggacatagaacactaaaatccctcacaagagctcaaaattcagattattgcaaaacaaggggtctgcagccaattttccaattttgcgaaggggtctccggccatgtaaattaatgtaaatcaatgacctttttttgctttcaacaccgctttttacgcggcacgttttttccaagacttttgggggacaaggagggccggcggtgccgataggcgccgccgggaaaaattttgtaatttttaatgcgatttgttaacaggatttgtaaaaaaaatgaccaattgattaagttttgggtttttaggatgcttaacatgaaagaaaaaagttggaatattttttaaaattaaaattttaattaaaataatggtaaagaaaatgtgaggaatattctatccaagtggggaattgaacccaggcgaaaaattatgaaaggtagaaagtttaaccactacaccacatgtgcatgtgtgtaatcccatgactaaatgaaataaaatttaattttttctcaaaaatttctccttcttcaccaatttcctactcttttctcgaccagacccccattcttaccagtgcaaatttttaccggcggtaccggtactagacaaaccggtaacggtaatttaatttttgaaaaaaccggtaccggtaccggtaccaaaaaaaccggtaattaccggccagtaccggtaccggtaccgctcaaccctaaaaataatccccccttctccattttccccccgtatctaataagccccccgtttctgaggaggttgaaaaataatccccccggggggataaaaagagcaaatgcggtatgtattatcttcattttttatgagtaaattttataggtaaaaaacatttacttcactctacaaaactttttttccgccttaagataattacgtgattttaaacttcgtttaccgcgttttgccccttccttctgaaattcgccgtctctaatacacatttatttgtgcatttgatgatgaccaacaattcatcagctccctataactattcttacatcttcaagtacattatcatcggtgatatgggcgtaggaaagtgcgtgtgatcttaaacttgttactccaacttcgtcccattttcagatcatgtctcctgcaccaattcactgagaagaaatgtttgttttagtcgttgatatttgtttgtaattttttataaaatgcaatgagtccctttgtttcatcgcttctccgcccattttccctctaagtcatggccgattgccctcacacaattggcgtcgagttcggaacgcgcattattgaagtaaacggccagaaagtcaaactgcaaatttggtgcgagtaaaccccagcgtacaatgaatgcgaaattgcatttcagggacacagccggacaggaaagatttcgcgcggtcacacgttcgtactaccgcggcgctgctggggctctgatggttgactaaatacaaatgaatgcgttttgtaatcattcaacaacaaataggtctacgacataacgagacggtccacctacatccatttgagcagttggctaagcgacgccaaaactctgaccaacccaaatacggtaagagaatgagcagtgacacaatgggccaataaaatagccgaaactctcacaaattaccatccgtttctgtttaggttatttttctgattggaaataagtccgacatggacgcgcagagagacgtcacttacgaagaggcgaaagcatttgcagaagagaacggactcactttcttagaatgttccgcgaaaacgtaaattttgatgcgttaatttaacagaagtctgctatggtttatggtccattgtacctgtatatgaattttttcggaaaattcatttttctaaaatactttttaaatccaaactatacggtgaggagctttagtcattggctcattagagaaaaaatagaaattgtaatttaataaaacgtgtttctataagcaataatttttgt

SEQ ID NO: 14206 - DNA, 1778 bp, Heterodera glycines
  misc_feature (1762)..(1762): n is a, c, g, or t
ttagaggcgaaaatgttgaggacgcctttttggaaacggcgagacgaatttaccaaaacattatggacggaaggttgcctcattttcccagtttggagtatacggaatatttctgtcttaacagtttggatctgaattctgctgacagcggcgttcagtcgaaaggcgcagtgacaggcggcagagggacgcaccaaccgaacgcgggggaggggcgcgagacgaagaaatgtctgagctgttgaggggggacggaggggcggccaccgaacgacaaacgcacaaaagagggacggacgcactttcgcctaccaatcccatttggtcaatttttattggatcaatgcatattcttacaaagacaaaagtccacctgtaatataccataagtgtgcaaagggttcatggacaacattttcggaaaatgaaaaacactcaaagctttaagaaatcggcaaatttaattcaaaaattgtccagtgccttttacacagctggggacacccactctcattttcatgttcgttgtgttacctttttctaatcattctaaattcaaatatcttttttttaaattttgtacctaaatttcttaataaatttatttaaaaaacctatggattttccttggtggtgcttgtcgaatttcctaagaattttaccactaattaaaggccagaagatgacctcttcaaagcacactgacaatctacattgtctaatatttacattattattaaagcattctaaaaataaataaattttccaaaattattgcttcctttcgacggattgtaaaatgattccattccggtcaattaagcggttagtgaattttcccggggatttcgttaattcggaatatgtcgctgtgtttctctctgaatttgtccttttgttggtgcttgttaattctgtccattccttcacagaatctttatttactatatttatcagttaattattggaattgtaattccttttttccttggcctaacaaaagtaaggagcatttggcctgggagaaagacactattaactattagcacttatgttatcgcctctatcaattaattatcctaaatcattttgtaacgtttgcattgttaaaacaaatgtattttattacttatcattgtattcctcgtttattaacacaaatagcaaagcattcgattgataaaaattgggccatcagataaataaaatttaaattgatttaaataaaattcattgaaaagttaattggaaagaaaaattacctaaaaatgtttttaaaacggtaataacttctcgacgtttctctattggctcataatttgtacaacattttctattattccactcccaaataagcaattcgttattatgtccaatattcgttcaatttcgacgccaaatgcgcccgcggcgattgggccttacaggttggccaaatgggggaggggagggcgaggcctttgttgttttgtttgctcagtcaagccgtgctcgcccataacacattgtatgtgagtggccaacttgggcttgtgccggggaagtccgaattggtggcgggaggggtcgaaaacgaagcgcgacaggcgatgaccaatttgggtgccattctaagcgctgccggcacatcatttggcaacggttggcacttttagaagccaagagaaaggcacacccgattcagtggtcaaagtcaacgttttgctggccaacatcgacgacttccaaacggtcaggggaggtgtacaaatcctttttcagncggggacactttcccc

SEQ ID NO: 14207 - DNA, 3004 bp, Heterodera glycines
tgtccgatatattagttaagaattttgtcagtaatgtcttatttaattgttctcctaacgatagtcggtcaactcagtggagaaagggttactattctttctgatacacaactttttgacgacaagtatctcactatgacaaagagttcggtcaatgaaagacagttcggattcgatcgctcgagattatgtacgataaataggaatctgatttcagggtggagcctatcaatccaagaaattaattcaatagaaaagagcggaccagctaatgttaagcgttaccaggattttcgacaattaaagccccgagcgtgtttttattacaacgatcatagttatttaattttccaaaacgaaaatacaaatgaaacttcgataacaagagggagtcaagaaaaggttgttaggaattttcccggtggggaccttagatttgatcatattgatggtcgactttttgtaatcagagacgatcgaatagacgagattgacattagatcaatcgagaatttatggacacatcataatggcaccgaaattattactaaaccgatcggatctatgccatcatcatttaccgatttcctaataattgagggacaaatttatctgattaaggaaaagaaaatatacaaagatcgatttgactcaaacgagatacttcccaaatatgtggcagacacaaatagtgaattctttaattttgtcatgttcaaagaatttgagaaaattaaagtttcaaatcctaatatttgggtatattttttgtcaattgtcgatttggtagtggtcatcatctgtatttcagttctcagaattttaaaaataaagagaaagggtaaaaattcatcatacggcggtgaggtaacggtatataaggatttgcaacgaatatgaaaatgcctactggtgctcaaaatgaattctctcattgaaattctatgcgattttaacgaatgcgaacctcacgaattatcagaaattctacgacagcggaagaaacaaaatttgaaatttttgagaagacacgccctaataacgagacaccttaggcacaatcagtttatctcaccggatgacatcgcatttagaggttccaataggctttttgcctaccgaggtttcctcggggttactgtcgaacagcatctctactcgagacaccgtgtcaagctacaattccctcaactcccatgtataactatgtaccagaataacggtcatagatgctattttccccttgaacttttggattttttataaaaatattacggctaacagcagtgggccttcacgttagaccgttccacccccgctagtcctaatatcatttaatttttattcaactttatttaacaaaaaacaaaaataaaatacaaaattaacaaaatccaaatggcatcacattaagctcctcatcgatgatacccttctgacagaccggcctgtacattttatgcttctccctcgtcaccactttcgaatcccttgtcggcctaaatattgatttattaatgaagcaaataatttttaaaaactcacccaaaatcattcttatagacgaagaatgccgggtccacctcccctttcccataattcaaaaccatctccctgaatgtatcgtagtgcaatgttttcctgttgtccacatcgaacgtaattcctctaattttcataacgtattcagtctcccccgtctgcttgcttctcatcttcagtgcgtactgcttcgcccctccacagcaatattcttcaatctcatagccgccgtattcctcgctcatctctcccaaatatttccccgtcgtgatcggctccacatcccgatcgtgcaaaacaaaaatactgtcagtgtccgtatacaaaatttcccctccgttgctttcagcctccctcataaattccaataattttaacctcgccatactcgtcgtcctaaaaattaggttatatacaaatttataattttttgaactcaccataagctaatgactatgttgctcgacttgtgctccatcacaaagtcctccttgtccctgtatatcaatctaatcgcctcatccgaatactcaacaatatcacataattcaattttatgatcacacgcaattttataaaactccgacgccctatcaattaccgcattcttgttcaaacaatttctcatcgaaaactttccctgaaagtgaaaattacctatcgtaaatttattttcaattttcttacccataaactatttagcatcaacttgcttatgtaccgcaaccccggattcttcttcactttagccaattcaatttcaattccatatttttccttatattcttctctccacatatccttctgctcccccgtctcaacccccttcgggaaaccgctcgcctcctccttcaacttcaaaaataatcgcacgtatcccttgaataaatcattcgcctcctcttcgtagtgccacgctctataaaatctgtccacagtataaccgcattccaacgcctttgcctgaaaatgtcaaattttcttaaaagttttctctatccccccccccccccccgcccttcagaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccagaaataatttgtaattgatcaggggctcaccaaactttgaagggatacgtatcggaacactacaaatgcttactaat

SEQ ID NO: 14208 - DNA, 1108 bp, Heterodera glycines
aaatttaaatatgctaatttccccccaaaatataaattaattagtaataaatgaaaattttgctctttaaatgcattataaacaatcggaccagatcaatgatgttcgaaagctgatgcattgcgaagcgcacttgcggcttcacaccgatcgcgatcacgaggatgccctggggcagttcggtgatcagaaaaacggcgacaataatctaaaaaattcaaaaaaacttttttttttttttttgaaattctaaccgttaacattgccgtcgtgcgttcggcctgcgcttttgagcacgaagaaccaccacctgtgatatattattggtgaatgaattttagtttcggcatttttttaaaattattttttaaattaaaattttatttaattttttttaaaatttattacaataaaaatttaattaattaaaaatatttttaattgaatgtgtttgcatgggaattggactaaaaataaacaaaaatacaattgtaatcaaaaaaattggatttcttataacaatttctcgcaaattcccgagaaaataaaataaaaaattttaaaatatttaattaaatattaaataaaaatatttaaattaatttaaatgtaattagaaagaatcttcttcttcatttgtttaccggcagttctctccgcttggcaaacacttcgcgaagattcgttttgtgatgctgccggtggtggcgcttgttttgcgatcagtcgtgatctgttgaataaacaaataaataaataaaatttaattctaaatttttaaaaattattttttaaagagcaaaaaattaatttaaatcgcattaattaaataattaaaattttcaccttctctcgcgagcctcgacctaaaaaagaacaaaatttaaaattattttttagtgaaaattcgataaaattgttattacaagcattcggacgagcaatgtcatgaaaatggtcagcaacaaacatggcacaagtttgagcaaaacgcctgaaaaattaattactttttcggataataaataattatttttgatatttaaaaaggaaataatggggcatttaataaataaattttgaaaaataattgccaattgataatttt

SEQ ID NO: 14209 - DNA, 4106 bp, Heterodera glycines
  misc_feature (4023)..(4023): n is a, c, g, or t
  misc_feature (4091)..(4091): n is a, c, g, or t
aaaatgtattttaatcgaatatatatatttttttcttttctaaatatttcttatttttctttattttctcgtttcattgaaatcctattgtagatgaaggaagtataatttaatattaatgcttgtctgaggtacaaaatttgtaaaaaatgattgatattttttccattcaataaatcataaatatcacatgtactttgacacagaaggaaatttgagatttaattattagatggtaattttattctttgaatgagatttgccatttcagcgccaacctcgtatctgagcatgctcggcgctgaaccgaccgcggcgagcaggacggcggccgccacagcgccgcaagcggctttgtacgagccctagcgaggcaccgccgggaggaggaggaacccgacttgagcaccaaatacctgcaaattttcaaaaaatttatgccaattataaattagccattaaaaaaataattttaaaatttaagaaaatctaagaaaattttaaataaattttgaaatgccctcgaaaaaaaatacaaaaaataatttaatgcatttaattttaaattagattttcaaagagtaaaaaatactaaaatttaaaaattcataaagttactaaaatttgacagtaccctcgaaaaaatacaaaaaataattaaatgtattttaattagaaattttcaaaaatttataattttaaagaatccatgaagaaaataacttttcaaaattttaggaaaattttacattgccataattgaaaaattcaactaataatttaaatgcgaaatttaaaaattttacaaaaatccaatccctaaaaaagggtttaaataaaaatgcaagccttagcaaattaaatttgtttttttttccaatttttctacctcagcacggccatgttgacggtcagccacaatgaggcggaatggacgaacacggacagcacggcgtacccgtaggtgtacacaatccagaaaaatgtgaaataccagggatggcacatctccacctgaatgaattaaaataaatgaaaagtgaaaaatgccaaaaaaaatgtggcaacaaaaattaaattaaacgatttttaaatatttcttggcttataatttcgatcagattatttcatcactgatagaaggcattaaattgaattaatcagttcaagctgtccggacagtccgtcagtaataattacaatttaaattacgttaattaatccattaattatgcgtttgggataaatgccaaatgagacaaaaaaacaaaacaaaatccaacagtttcgtaattctttttaaaatttcttgttttgtaatttcgatcagattatgtccccactgaacagaaggcagtaagtcgaatatacagttcaatgctatccggataatacgtcagattacatattaaaggtacattaattaatccattaattacgtgtttgggataaatgccaaattttatttaaattttactgacggattatccacgggaagccattcaaaaaacggatgatgaccacaataaaacaataattttcatatttaaactaatttttacttgtttataaataaaatatgaggccattaggctcatgtcacagattgcgatgacaatcaaaaacaaattgaacggatttttgcgcattgttggccttgaaatcaaatcaaataaaattaaatatttatttaaaatgcttttaaatttaatttaaaataattaatttttattaatttttaccttaaaagtacgacaacaaaacaaatgttagcgatgacaccgatgatgcacaaaaattggtagatgaaccaatgaaaattgttgtaacgttcagagagtccgttgagaagctgacaaatgaaaatgatttaaatggaaaattaatttaaaatttttaaaatttattttttatggtaataattacctcataataatataatttggcctgtgcaatggtctcgggatcgagttctaaattttggacaagaattaattattgctttttatttggttattaaagaaattaaactaatttactttataatacataattaaataaatataagtttaattaatccaaaatatatttataatccatgaaatattatacaaataattttaattaaatttaaaaataataattatccaattaattaccttcacatagtccagacattgtttccaattcgaagaacaataatttattacaataattaggatagaacttctcttaaaaggaaatttaatccatttgattttttgccaattattttgaaatttgaatgccattgtcagtggcaaaaaatgaaaatgccaaaaaaaaaagttaaaataactctaaaatgaggctttcttcgcagagaagggcaaaaaagttgaaaaattaaaaaaaaaatcaaatttaattgaattgaaactatcacgtcatttttaattattttacggttgtaagtaaaataattcttaagtgacattttgaaaaatgaaatttttgggatttcttaggttttttttaaaattctaagtcttgttcaattgtttggcattttgtgccaaacaataatttaaatttctttctttaaatttgttgttcactttacaaaatgaggaggatagaagaactcgcaatttggcataatgaaatttggccaaaaaatgggaagcaaaaacaaaatctgcgaggcattggcccatcgttgtttcaaattcggtgccggaaaagccactcttccgcgccataaagcgtgtgccgtagtgatacgctccatgggaccgaaactgaacggggacggcacggcacaatgtgccaaattgggccacaaattggattgggttgaacaagggcacaccacattttgcgggaagagagagtgggatatttttgtaagcctcccaaaaagctggggactaaattaggaaggccgcggatgagattttctcaagatggtgagtcacattttaaatttaattttttttaaattgccgaaaaaaataatattaataaaattctgaataatttagaaagcctgggctgagatttaatttaagacggtgaaccattttaaaaattattttttttttaattgacaaaaaaaattaattcgtaaaaaattttttggcaagaagggtaaaaagcagaagcattaatcagtaaattaggcattttttccttttttatgggaccaatataatctccaccattaccagtaaattatagaaagaaacaaattaaaatgaaaaattttcaaatttgtgaatttttataaatgccaaaaaattccaaacaaataaaaacagagaaaagaaacactgaaatctaagcagcaaaatctggtagttaattgaaaattattttaaaaagatatttattaaaataatttttccgtttttattagaaattaatattttttgtttgactacagtatgccgaaggtgccaaattttcattttaaattgaaatgatatgtgcccaatttcatggcattttgtttattttagcacattgtgagccaacatttttcattgcctataattaaacaaaataggcgtgaccaaatggcacaaaatgtgtggacggcaaaatgccgtattttgtgctcttgccggaccggagtttggcacacgaattgttgcctcgggcaaaagctggaaaaattgtgcctcaggcgacaatttgacgacggaaataatgggaaaatgaaaatgctaattgagagccaagggggggcaattagcgacaattaattatgccggaaacgccggcggcgtcaggggaatagccctggagcgatgccaagggatgaatatattttgtaaactgaaagttgggaaattcctgggaaacatattgtttgtttgctgatttgaaaagcatgtacttaaagggggaggtgggtatctgaccgatcattagggactcatttgaaaaattacaatttcaaaaaatgaaatttgatcagaagccaaaaacggcacaaattggacaaattagtgcggcacatggatatgagaatgtaaatgnaaaaactataaaataatataaattgaattaagcatgggaaagggtcacacattcttattattgaattngaaattggcgctttt

SEQ ID NO: 14210 - DNA, 2623 bp, Heterodera glycines
  misc_feature (27)..(27): n is a, c, g, or t
aatgttcttttatcaacaattaaattntgtttaaaaaatgtccgattagaaattaaaaaattctcataaaaaataaataaaatttttaattacctcctaacaatgggcatgaacaatcgtcaatgcttatgcatgagtaacattcagagatgagtgaaagcggcttttgagctaacttttctgcttctgtcggtattcgatagattggcagtcctatttttggcaatttttaatacattatattaaaatattaattaatttgacagggacaatttatattgtagcataaaattacagaatgtaatgttttattttttgtttatttgtgtcatatttttggaagtgttcatctattaccgggtgaagaagatgctggaggtatttcataccatcgaataaggcttccagcacgttcagcctttaataaataaataaattgaataattaatttttattaattttgaaattaaaagtgggttgaaattattaattatataattaaaagtgggttgaaattattaattacaaattaaataatatccatttcttcctctgccagttaacccggctaaaaagaaattataagtatttaaaaaaaaccatttacgttaattttttggaaattttcccaaaattttcgattttaggacgtatttaattgataattcaaatgcattaaaaaattgaaataatgatttaaatatcggaaaaatgcataataagaaaattagtaaacatataattaattatttttttcgtcctcaatcagtttcttctccgttttttcacttttcaactttctttccgctctaaaattttaaattattaaaattaaaatgtttttaattctataaaaatgccattacatccaattcttatgccgaacaagcagtccttttgttcacatggcttctcatcaatggtttttgcttaattaattaaaaatatttgacgctaaaattgttcatattgtaatgtaccaattaatttgttccgagaaactcaaaaaagttttggccaaatgttcaaatgccatccttttttccgaaactcccgcattggatcggtaaaaaccccaattttttttacatgacatcattttgatgcttttatcgaccaacacccatccgtgtccattaattgcttacatccacggatgtccaagccgaacaagtgttgttttacggtagttgtcggagtcgtcgtggtactgggagttgtcgtcgtggttgtactggtcgaagttgtcgtggttgtggttgtcggagtcgtcgtgctagtgggagttgtcgtagtttcctccgaactgtccgtcatttcgtctgtcgccgaaatgtcagtagtttcgtttgtcgccaaaatgtccgtagtttcgtttgtcgccaaaatgtccgtagtttcgtttatagccgaaatgtccgtattttcgtctgtcgccgaaatgtccgtattttcgtctgtcggagtcggagcctccggagttggaataggtgttgttgtagtcgttgttgttgtggtggtggtggttgacttaaaagaatcgaggcttaagaaaaattgacaccgaaattaaaaaacaaattctttataaaaataataaaaattttgtaagaaaagtggggccaaattaaaaaaaacaattattttattgagacatttttttgtatattctggtataaaatttagaaaatatttaattgtaataattaatattatgctgattatattttatgtaataaataaaattattattaaatttaaatttaaatagttatttattaaatctaaatttaaaaaattattataattaactaattatatttaagtaataaatattattattaaattttaataatattattattacatttaatttaaataatcatttattaaatttatatttaaaaaattattgtaattaactaattatatttataaaattattataaatcctggcaaaaattatgtgcaaactgaatggaaagcccattgttgaaagatgcgaggggccaaattaaaagcaaaataattatttaattgattataataacaatgtgtatttttttaattattcgctaaataattcttttataaaataattattatattcagacatttttttgtatacatattttggtataaaatttagaaaaaatatttaattataataattaatatgaatgaatgataaaatattactgtttatatgatcattgacaataaaaattttaattattttaaagtaataattagggttcgaatttctagggttaaaattttttgatttggtgaagcatttttcaggcatatttcagtgcatatttggcattctttaatacattcaacttccaaccctagtaatagcaattttattattaaaattcaatttaattaattattatctttttaatgagggaccaaatttaaaaaatttcgatttaccgcttttgtataaagcaattcggcattgcaattgtcttgtccgcacatttcacattgcacaacatagtcctttgccgggaaagcattcttttgaagggccgcgcaaaatgtttgcaacgaatctctgcgatgggaatgagagagtgagtcaactcagtccccggccagctcagtcccgtaa

SEQ ID NO: 14211 - DNA, 1592 bp, Heterodera glycines
  misc_feature (1529)..(1529): n is a, c, g, or t
ttggcaccatcactcgatttaggtgcagcaaaacaaattctgttggttttccccaacctcatgtgcccagcgatcacattccgatcatgtcgcaatatgccgtcattccaccaaacttccagagatctttgccgcccattcaccattacggaggctccgcacattccggttccttctatgatttattggcagaataaaacattacattttcaggtggttttggtgcgatcggacggtaacgacggcaattttacaacacatgtgacagttttcatttttaaacgttgtcaattatgtaaattcatctcttatcactcataaaccaaaagacatgttttatgtatgtttgttgatgatgctcttccacacagactaatggtattgacacgttttgtgtacatactttttcttcttttctcgattctttctcctcaacagaataatatatataaaacagttaattaggagatgggttgggatttattgtaactccgagaaatttttgccatctcaaaagaatcagtttttcttatcccctcctcatcttcttctgctgctgatcgtactcaaagtccattcacctcatatgtgttccattcgtttgtgcttttccatgtaaaaaacggatgataatttcgtgtaattgtggtctatgtgtgaattttttaaaattcctttccgttgtacctaacaatatggtttttattttttcgttccggattttcctgccgtcaaaattttttttatgtacttatattaacatgggcattttgttttttgatatttcacatttggcccataattttaattttcttgcttttgattaatgcttttctttcgaaggataaattttacaactgttcggcatttgactgttcaaatttggccgttttgtttctgccttgggttatatcgaacgtttattcttcagttttcataattttgttttagtttttatgccttcttcccccgcacaacaacagcagaagtcgtccgttggtcggcctctctgccgttactttgccagtaacatttgcatgaagggcgacgcttgtgccttttcgcatgagcacaacgcccgtccggaaatgacttgtcgctattacctcgcgggcaattgcacttacgggaataattgccggtcagtggagaatggacgggcatttaattgggaaaaagcgtggtttttgtcacttttagttgcttaaaattcataaaaaattggtttatttttattcggggggtgacaaaaattatttaaaaaaacgcaattatagtaattactttatctagtagtaaatttaacttttgtcgtgacataacaacaaactttttaaatgcccattaattaggtacgaccacattcgccttcaaagaaacgaagggcctttaggcggtggcggcgcaaaagttacgatgaacagcgcagcgcgaccagttacagaattatcataagttacgcaatttgaattcataaattcagtttgttcctgcacaacaaattccaaagattcccgaaaagaaattgngttttcctctcgaacctccggcaaccaatccgtggaaacatcacccgttgggaaacttccatc

SEQ ID NO: 14212 - DNA, 1753 bp, Heterodera glycines
tacttatcccaaatgacttttcaatttattttaactgtttgcatttgcctttagactcatcgtctcgaccatcacagggagtgtttagcggagcacgaaaaacaaatggaagaagcatttgcgaaggcgcggtcagaggagaaacagtgcggcatttgtatggagcaaattgtggagaagggactgcgctttggcattctgcagaactgcacgcactgcttctgcttggattgcatccgaaagtggcgccgtcaaacggatgaggaaatcaaaacgaaaacagtgcggttagttggcaaattgggaatatttaacaaatgaatgaataaagaaactttaagtgggtatatatgaaatttactgaccatgagtaattttttgtgaaaattaggctattcccaaaatctctccaggtcgtgtcccgaatgtcgtgtccattccgattacgtcatcccgtccaaagtttggattgacctcaagtcagacaaggacaaattggtttcagtcttcaagggtaacacgaaaaaggtggttgtggtaaaacgattctgttttcctttaccatttttttaagattgcttgcaaatacgtcgtcaatggcgacgtggacaaatgcccattcggtccgttcattcgtgaagcatttcattaaaattttgtttttttttaattttaaattgatccttttcaggtaacaaatgcttctacaaacaccaattgcccgacggttccatcgtcgaaggcaaatcgccgacgcaattgcgcaagaaccgtcgcaacgatgccatcatgttcagtctgtacgactttttgccctccgattcggattgggaggacgactttttcaacgataacagcgatttgtacgattgattcgcctgctttttgtgttatttaaataatttgattgtgtaatgtaagcagagtttcgacataacaattaatacatcagtctttccggacataaaactttgtacgagtaaatggtccagattttcatgttatttgacaaagcatattttagcattaataaaaaataattaatgaaaatttggatcataaaccttcgtatttttaaactttaagctggcaatttatgttcatacaaagacaaatattaattacttgcttcgttttgtttaataatcgaaaagttttctgacaaataaataaataacactgattttgaattggcatttcaaaaagtcgggaaacggtcgtgtttgctgccgaggaatattgccttagaaacaaacattcaaaaatttcggtcacaaatacagtatttgatgatgcgttttcttggcaccactttaaaaattgttggtggcctttgtgtccctctcactttcttcgacttcatcgcttatccaacctctgtcattggctcttcgatggaggtgggcaaatgttttcatttggcatgacatattccgctaattgcccttttccggtactaattgcgctaaattggcctatttagcccacccttttgcccggtgacttcgttttggtcaatcgcctttccgtcggttcgccgtccgtcggcgacattttttgcttttggtgtgattaaataaaaatgtggatggaattccttgttttaaactttcacattttttcgtcagctctccttttgacccgaaaacaacgcatattaaaagagtggcggctttggggggtcaaacggcggagaacaaaagggagcagcagatggtcgtgccattgaaccacgtttgggtccacgcggaca

SEQ ID NO: 14213 - DNA, 1504 bp, Heterodera glycines
cccccccccccccccctcacccacgaccaacacattgttatcatctgggcttagcttggccaacccattgcacgtatataatgtagggaatgattgatttttcgaaacaaaaaaaaatgaatttagaattaaaattttgccgatcactgctacggtggtgatcaacgccaaaacccaaacaatgcaatcaatgctcaccgctttgcggcaatttcctgctgttgaaatgtgccaagcgttttcaatgcttcattgacaattgccgaattttgcaacaaagtggcgtccgccagtgtgaacagtgaagcggatgatgactgctgctgctgctgatgttgaactgtgtagcagctgctggcacttaaaatttgctgttgaagatggtgctgtaaaatttaaaaaaacaattaaactaattaattaattaatatttttagtaaccaaccactgaatttgattgactacccgcgttaggtggaggaggaggacgtttttgaccttaaaataagttttgtaagtttgaattcaaatttataatttttatttaaaatatattttattacgcaaattttacccgggttaaaagtggccgtgctgctcgttattggagacgtgttgctaataaaatgattgaaaaaaagctaaggcctttatggaagcctcaattaaaaagaaatcattcgatgctggaaatttgcttttaaataaaaaattaatttaaaaattggaatggttttttatttgaaattttatattcaagatactgcacccatcacaattactgtacatagttgttattgtatataaaaacttgtttcatggcctactagtcatacaaattttagaccaatgaatgataatttgaaaatcggacagagtaatctaaatgtttaaaaaacgggaccattgattgaaaagggatcgttgggacaacaattttgtgagttctcgggactttcggtaccgaactagttaatcacttaaaaatctcgacaaactgccaccagtccgtttgatcaccataattaataataataattaataataaattatattattttttaaaaatatcagcttaaaatccaatggggcgctgctgctgtccatcccatcttatccatttttacatagtgcagatatttcagaatttttttttgaaaacctctaaataaaacaaacccatcaaatacataatgtaagcgcatgcatttatttgtgcagcggtagcagcagccgcggaacagccacagcccccgtaaatgggatgtgtatttgtggtggtggtggtcggctgctcccgcactctcgactctcgacatgtacgtgtaaatggcgagaaaatataatgttgattaaagaggacgcgcttgtggggggagggaggggcgggggaagaggggggagttgttgcgctcatcatgcgccgggaatggaggggactctcgtctgtccttacataggtgccgggggtcgggaatgggacccgtctgctgccgcccttcat

SEQ ID NO: 14214 - DNA, 1202 bp, Heterodera glycines
  misc_feature (1124)..(1124): n is a, c, g, or t
atgccgcatccgccgctgcgccactgcactgctgacagccgggcggaggacagcggcggctgctggccataaccgctagcaggcagcgccccgccaccaccgtcagcagtacacacataacatatttttgtggttgcgaggagtggtggaaaagtggagtgggaagcggggacatggcggggggggggcgggaatgggactttaattaaatggggcacccgccggaggggagagggtgaagtaaatgagacgtcgacgacgacgacggcggcgcggcgaccctccagcagaggtagaaagggggggggcggcaatgataggggaaaaagccgatgaagccacctatttatatggggcaaattcccgtggcttcacacaccacacacacatttccgtgcgctgcgccacatgggagggtatagccacaattcgccgacgacgacgccaacgacggaaatcgggggcgaggggagcgggagcggagggcaaagcttttcgcgctttaattgggttgaaatggcacgggaagggtgagccaaaaatgtgcccttaggggaagacagaaaattatgtggttagagctttaaaaagtaaggcctgaataaaaaaaatcagcgagaattaattaacaccttaaataggggacaacaacagtctctctttcactttaaaacgaagaaaattagtgggtatttttctgttcatgtgctgtgatagaaaatatataaaaatttgaataaatgcaaatgaaaatgtctcaaaaattaaaattatatatatatttatgtatataggtaaggggtttcgctgtcctaaatctcgggaaagggaaccgggagcgggctgaaacttggttacataattataataaaaaagaaaactctgagattgaagtttttaaataatttgccccattcctctggccttgctggtcttgctcaaaatgccaggttaagcgtccgggtgatgacaaggtttgtacaatagtagctttgctcgtcagacattggttcaagctcattgaatttttaaaaattgcgatttccaatagaatttcaaaggaaaatggaaaatttttgtgaggagaggaatgattaaaaaaccggaatttcttctctaattanatgaagaaaattcctgtcactgtcaatgaccgaagaaaaaaaaatggtcgatggagctgggatgttggttggatgatg

SEQ ID NO: 14215 - DNA, 4237 bp, Heterodera glycines
  misc_feature (12)..(12): n is a, c, g, or t
  misc_feature (23)..(23): n is a, c, g, or t
tgcaggtctaancaggtgttaantttgtctacaatttttaattaatttttcattattttattttaaaatatttaaatttaaaataaaaatatttatttttaaaattaatattttaagcactgaatatcgccaagtgttcaaaaaagaattccgttcattgtttggtcgtctcagaaaaaataatggtaacatttttaaaaattaaaaattaatcttttttcattttatttttaatttaattaaattttttaccgtaatcttttttagttgttcaaacaattggtatggcacaaatgtgcaatgtcaacccaagcaacatcaacaacaacaaagttaaccgttcaagtcaaatgacaattataagaaatgtgaataccatcatccaaatccgtcattaattttattaattcatttttagtgaaaaataataaaaataattttgaaaaatatcattttttgatgtccctaactcaaaatggcctaaaaatgatcgtaatcgatttaaaacggcccaaatgatgagaaaaacgcaaattttcctacatttttggttgtggataactgagtccctgttaaaagtggacacttcagtacccaattttttacacgaaaaaatggctagcaagcctcttattctgaattttacaatcactttgggccagttttaaatcgattcggaccgtttttgggcaatttcgagtttgggacctcaaaccaatgtttagcaattattttcattaattgattaaattaaattcaccgattagcaaaaaaatcaatactaactttttatttcatatttaatttaaaacttaaattgtatgctaaaagtggaaaaacaaaggatgaatggctttcggaaaatgtgtcaatggaaaatgcgtcagtaatattatatttctgaaataaagtactatatcattaagtattgtattacaaacggccaaaattgcttaaaaactcgttctgcgttttttcaattaagttttctaaggattcaagaaatttgaaatttccggtcacgcaataaataaaagtaatggaaaactggtgcgacaaaagttcccgcactcttttaaaagattatcttaaattgcatttttgacaaaataaacgtggcaattaatcaggtaactaggcgatactatttccacaaatttcaagactgtgggcctcattgctaattgccataagcaaaatagaattttcataaattttcaagacccggtttcaagccatctaaatgcgatcactagctccgagaggcgatggcgtgcgtataacgtcgttgcctcgtgccaaattgtcgattgaagttttgtaccattttctcgtctcatttcgagggttgcgaaggcggcagtttcagcaaatttagagtggttcgcgttttgcaaccaagagcatttcaaccggggagtttaggtttgggagcaaatcactgggtgtggtcagaaaagtgaccaggaacgtttcaatatcctgtgaagccctccccttttagctttcgaaaagccttcttaatgctccacttgtccattagacattgtatgtatgatgctgaaaataattgtgtaattccgtttgccgttgtaaatttggcaaaatcattgattgtcagttttggtaaattattccatttctgagtacaattttggtgaatatacatgttgtcgggccaacttctgctgactgatttttggaatcacgattctgtcgcgatacattaggcatcctttaataatagacaggtcatcttttcttcgtctgagcagttggacagtctcagtttcctgcttcacttttatgccaatttgatctgacgaactttatcgccgtttgaattgatacgtcctgtttaggcaatgcgtcaaattgacaaatttgataggcaacttttccaaaattaaattaaaaatggatgtcagagtactttcaacaaagacgatcacttttttctcttcgcattcattctttttgcgatgatttctacaaaaatgcttgctgtttctgcaagaaggtgcacaaattcagggcgatggcgaatttgtagttttatgtaataaaaggaataattatcttcagtttaaacacactaaaatttaacaaattgccacaaaatttgaccataaaatgtcctcaattaacaccagctcagacaatgcggtaaaacaacaaaaaataataatgaaaatattaaccaaatatttaagtgaataaaaaaatcccataaatttattataattaggtatttgaaaataaaaatttactttttcagctttatttggcctaccgttctgtgggtccatccgtcgatttgattgtgccggccgttgcgctgtatttggttgcgttaattggcattgtgatgaacggcacagctttggtggtcactgccaaatcgaggcaaatgccattggcattttttattttaattatcataattgaatttaatttcaatttcaatttaaatttcccatttttcagttccctccgcggctccgccaattttctgatggctctgatttgtctttgtgaattggtccaccaaattgggcacacttttttactggttgttgtcatttcgggcacaaattttgtcagtttgcacactgctgacttaattatagcggtaaattttaaatataaatttaaaattttcaaatttaattttgaaacttcaaaatttaagccttctgtttttgcgttaaattgcggcttaatggcaatgttttgtgctgcggttgaccgtctctttgctgtattaatgccttttaagtgagaaaatttaaatctaatttaatatttcttacgaaaatttattaattactttttttcatttttttaaaattttatataattatttttaaatgatggcttttataatttagacatttctccatttgtgcaaagtataaattaccatatttgtttggccatctgctcatttgcataatttatggtacttttatacagtatcatgtgctcgcatcggcattcgaaaatgcgggaatgtaattaaaatgcattaattaacattttaaatttaattagtcaatttcattatcttttttaggccgaccaatggtttattagccgatgcttttcaggatgatatttatcaatttttcatcggtggagtttacagcatttcatttggttgcatttgctgttatgtgaccatttttttgattgtcaggcttaaaaaaagtggtaaattcattggcatttgtcttaaagtgcctaatttaaatacactatacatttgttacagtaacccagcaaacaaatacccgactgttacgttctttggtcatcattttgtccataaacattggcggctatttgggcactttgatcatgagtcagcttattggaaccattggccaagtgtatttgtgagtttttttttctttttttccaaaatttaaacccccaaaggtccccaatccaagcttggcaatttactttttgtgcttacattcttttaaatgttgttgccggatcaaatgctattgttctttttttaaacaggtccaaatttaatttattaaaatatttaatttgctgatttaatttaatttaaaaaatttattttttcattttaaatttttttaagcactgaataccgtcattgtttaaaaaagaattacgtgcaattaaagatcgtttctttaaaaagaatggtaaaaatatagttaaatttctttaatttttaaaataatatttaatactttttaattgaattgcttttttagctgttcaacctatttgtacaatcaaagtcaaaccgaaaacataattcgattacatcacatcaaataattgtttttctcatgaaaattcattttgaactctttttcattatagaattcattggtttattctatgtattgtttttaatttatgtaaaatggcttaataataataataatagttaaatacatttttattattaattcctttaaaaaaaatttttcaatctctatgtatattaaagaatttggtttataatttcttttttcatttatagcctttttctattaatgtgctcatatttactttccaaaaaatgggggaaagaatggcgcgcaatttaattaattgatgaaaataaattttattcatacacttaattgaatttgcttaaataaatagtaccaaaatttagctaaatatttaattatttattggaaaataagcgatcaaaaaaatttatttaaaaaattcgaagaag

SEQ ID NO: 14216 - DNA, 1519 bp, Heterodera glycines
  misc_feature (53)..(53): n is a, c, g, or t
tgtatacgatactgaagaatggcgtacggtcgttaaaagcgttggctgtgacntcagtcaatttacgaatgttcggcatgaaaaattggcacaattttacggccaaaatggcttatacacattaagcaaaagcaaaatgtttttgaagaaaaaggcatgaaaattaaaaaaggttaataaaatatttatttaaatttgttttccgttagatgatattttggtgtttgtctccggttgtgttaattacccatttaatgagaggcagctaattgatgtgcaaattgtccaaagtcattcaagtccgaattgttgctgttttaggaacagacaaaaggagaaaactcaaatgtaaatttgggaaagcaaattaaatataaaaaaatattaaaaataaaataaaatttaatttcatgtgcaagaataaacaaaatacagagtaatgatgctcatttaaaaaaagacaattcatctttaggtcaaaatcattcatcaatggcactgaaaatgcaattgcttttttggtcactgccaaattttctcgtccaaaatgctttttcataaaaagcgaaggtttttttaattcaattcaaaaataatttttcattttaaatgtcttttaattgcttttccagaatcttttttcggctatttaactttcaaatggcgcaattcatctgttgagactctgcgacaatttaaatttccagaaattaattttgacaaaattggcaatcgctttgttgaatttcttgcactcgaagagatcaatttaaacgagaaaaaaccttggaaagtgccaaaattccatgtatgtaataaaatgatttaattgaatttataaaaaaataggggcaaaataattaaataatattttattaaatatatttaagcaataccgtggattgcccataatcttagcatggaacaagcagtttttctaccctcaccaatgggatttttggccatcatctttgtcatatggcgaggacccaaattcgaattgtcctttccaatgcatttacacaacggaacgaaaggcgtaatttattatttttttaaattcaaaaatttttgaattataatttttaaatcaattttttcttagcgagagctctgcctcagtgctgcttttccatattttttggtcaaatccaatcggtttttggcctttttggagctggcctcagcatcgtagtcaagaacaactgtaattttttgttatatatattttatttttatatttttttaaaataataattattatataagcctaaaaaattaatttaaaatcagaacccagatgaaaaatttttatcttcatttgggacccaaaaagcccttttttaatatttacagtttgctcagtcggcaaaaatttgaaccaaaactttttttttagaaaattataaaaaatcaattctaaaagtaatattaaaatttagcacattcaacaaaacaaaaaaagcaaacgctccaaatctggaaataaaacggttaactcttttattacgccttcttc

SEQ ID NO: 14217 - DNA, 2251 bp, Heterodera glycines
  misc_feature (32)..(32): n is a, c, g, or t
  misc_feature (39)..(39): n is a, c, g, or t
  misc_feature (75)..(75): n is a, c, g, or t
  misc_feature (2228)..(2228): n is a, c, g, or t
attcatctgttgagactctgcgacaaattaanttcccangaaattaatttgacaaaagtggcaaatcgcttgttngaatttcttgcactcaaagagatcaatttaaacgagaaaaaaccttggaaagtgccaaaattccatgtatgtaataaaatgatttaattgaatttataaaaaaaaaaggggcaaaataattaaataatattttattaaatatatttaagcaataccgtggattgcccataatcttagcatggaacaagcagtttttctaccctcaccaatgggatttttggccatcatctttgtcatatggcgaggacccaaattccaattgtcctttccaatgcatttacacaacggaacgaaaggcgtaaattatttttttttaatttaaaaattttagaattaaaacttgataaatcgatttttttttagcgagagttctgcctcagtgctgcttttccatattttttggtcaaatccgatcggtttttggcctttttggagctggcctcaacatcgtagtcaagagcaactgtaaatttttgttatatatttttattttaaatttttttaaaataataattattatataagcctaaaaaattaatttaaaatcagaacccagatgaaaaatttttatcttcatttgggacccaaaaagcccttttttaatatttacagtttgctcagtcggcaaaaatttgaaccaaaactttttttttagaaaattataaaaaatcaattctaaaagtaatattaaaatttagcacattcaacaaaacaaaaaaagcaaacgctcaaatctgggaattaaaacggtttaactcttttagttacaccttcttcactcaagagtcgccgtattatgcgggaagagttttcgataatttgcccaatgattggttcaatttgtccatgacttatcacggcaacagcaccatatgcaccaaatatgatgaactacatgagcatcgaagtggcgaaatcacgcaaattgaggatgaccaattttggaacgagcaaaaagtgagagggtgcaggggactcaaatgacaaacataaagtgccaacggacgagtggccgattcagcgcaaaaattaccgagcgattggctggggacagtggtgccaaccgagtcccgaatccaggcctttttctcatcccgaatcccaacccaaaaattttcgccattcggcccgaattccatccaattttttctcgtcccgcggggattgctggcggagacagaatgggcgggcagcggcgtagaagcgaatagtgcctaattgcgtcaaattgaagatcaaagcgcttgttggccagaagagcaaatttgcgctgcaaattgtgtccaaatgtggcgcatcctccgcaagggatattctcactgcgcaattgggccaactggtccctgtcgatgtgtttggggcatgcagtgggaacgaatgtgacgaacaatgctatgggcaacaaatgagtgctaaccaaaccaattaattaattaattccaccatttaattggatgatcaagcaaaatgatgagttaaaaattcctatttgaatttccttcagagtcccatttcttttatttggcatttgaaaattcggtgtgctccgaatatgtgacggaaaagttttggaacgcgcttcgcgcactgacagtgccggtggtgctgcaccgcactgtgctccgtggggtgggcgtgccggacgacgcttacattgcagccgacgacttttgcagtgtgcaagaattggcacaacatttactggcactccgacgcgacactgacaaatacattcagtgaatttattaaaacatacaaaactcattctaggggttactacaaaaaaaaaattatgtaattctacgactcggctttttggatgtgaaaaaatataaagttttgattagttcaattagcagcataatgagaaaaaaagagagggggcggctgtgaacaaacgaaaactttgcgaaaggcgtcaattaatatgtaaaaatcttttgtttttttctttgaacaacacattttgtgaatggtttttcattaaaaaaaattagggttgtgggttaggcgccgccgggcaaaaaatctaggaattttaatgaaaattgctgataattttcgtcgaatagtttttctcgaaattaatttataaaaactgcgagatttttttgcacttccgttcttttacatatcttatgttttgtctcaanttaatacagtttattaattttaa

SEQ ID NO: 14218 - DNA, 505 bp, Heterodera glycines
ctacttgttttgtttggatcggccaaacccacccccccccccccccggacatcgggagatcacacccttacatgaaaaatttttttatttaataaatttttcttttttccgggcagtggcatatcagcaccctaagcctccccctactgatcaccccctttcacacagtgtttcacatatatttctttttatttgaaaacacaataaaattgttgaatatttaaaattcaaataaattttaacaatctcaagtcgtgtaatccgaaccgaccgtttttggttttcggtcaattcaaagatttgtttctgaattaagcattattaattggaattaagaaatgaattttcgttttaccattttcaaaaataataattaaaattgaaatatttacaataatttgagagaattaactttcgtttattaaaagcaaataattttgaataaaaacaaagattttacgaattttttggtcgaaattcaaaaatgttaagggaaaaatcctga

SEQ ID NO: 14219 - DNA, 1231 bp, Heterodera glycines
  misc_feature (1185)..(1185): n is a, c, g, or t
ctgctccgcttggcccatttcttgctgcaccatctcggcttctcattcctcgtcgtcaatttgttgctattggattgctgaaatcatataaatatatttttgggactaaaatttctttgaaactcacttttcttggctcatcggccgccttgtctcgccctctccgtctgcgcttttctctcctctcgccttttgtttgcctcctccgcgcctcttttgccgtgaactttaggtaataattttatttttgccatctaaaatttaaaaacgccaattttttctataattataattatcattaaaaaataatttttggcaattttttttcttttttttgccgtccatgtagggaagacaaagataaataaacgccaacaaattattgcaaaaatctttgaataacaaatttttaatgaaatgataattgaacacaaaaaaatagagagaaaaacatacaaatgaatataatcctttgggaaaacaatgcgcagattgattaatattatttaggcaatttaattaaaaattaataataaagtaacaaaatgaatactgtagcataattacagtaaaaaaacactgcttttgccggatgcttttgtgagcaaagttcactcactttatctcgtcgtcaatctactgggaaagtacgcgacgcttgttgacattatcaataatacaataaatacggtaattcgggtctaattttagagaatgcgataaacaaaatgatcatccacttttttgcaacaaagcccagatccaattcatttgattaaaccatggtaaatttcaattaaatgaattcacaaatcataattattacatttaatcaaaaattttattggcagatatttaaatgttttttattatctatttatatgaattgtcaaatattatgggtttgattttttcgttattttttgaatttctgatcaaaaattgcctatttaaaaaaattgaaatttctaaaaaagtatttttaatttactttttaatttaaaaaacaattactaatttaaatcttttatgatttattaattcgcaatacgtttataaggtattctttttttattaagaaaaaccgcgacgtatgtaaataaaatatatatatataaaaaaagctaaaatatgtatgaaaaaatgtacaaaaacccagaaatttgtacgaaaatatataaatanattcttttaatagttatttttggaaaaaaaattctttcgtaagggc

SEQ ID NO: 14220 - DNA, 1288 bp, Heterodera glycines
ctgctaggaacaggcacaccttcaccctcaaggccagcgagtgaagggcccccgtccacaccagaccggctatctggctgggcttaaacatcgctgtgactgacacccggcgggctatgacggaaacatggtttcggtcataaaagggtttagtaccgagtaaaccaacaaaatggggagagaaaggacagcacaaagtacttttaatcaatgaaaaaacaagaaaagtcgaaaaaaagataaaatttgggaaaaaatgaaaaaaggagaaaaagagtggaaaaaatatttaaatttaaaagaaaatagccaaaatttgaaatagtttgaaattataatttttaaattggacaaacacaatgccagtagaagaaataaattttaaaattagagaacatcagaatgccaagatttgaaataatttttaaattttataaaacagaatgccaagaattgaaataatttttaaatttgataaaaacagaatgccaagaattggaataaatttaaatttgaaaaaaacagaatgccaagaattgaaataaattttaactatgaaaaagcacaatgccaagaattgaaatgaattttaaatttgaaaaacagaatgccaagaattgaaaaaagggtgaacaaatgccaaagaaggaaatgttgtggcaaaataaatgataatggattattgattggtttttccatccgtaaagtgaattaaatgaaatgaaaatgaccaaatggacaaaaaatcaattaaaaattgtttattgtctgaaggtgtcaaatttcataataagcgtgtgggagggatggcggcaccacaaagtacgcgacaaattaaaaaaagcgaattaatttttattgtccattgccaatgtggccgagtggttagtgcgtcagtctggccgccccctctggggttcgggtccgcttttgcggggaatttttgatgaattttaaatgaatttaaattcatcatttttgatctttaagatgtttaaaaattaaataaaattaagtaaaataatttgaataaagtcgcgcagcaaaaaaagtcgcgcacccttgcaataggtttgggtttgcatgaaaaaagtcgtgcaataggtttgggtttggaaaaaaaatcgcgcaataggttttggcttcagtactaaaaattttggcgctcagatggccggcgctcacttggcggcgatcaaatggcttgcgctcagttggcctgcagccctcccataggcatggggggctaccataatccggtgaaaatggagtgggtaactactaagat

SEQ ID NO: 14221 - DNA, 3675 bp, Heterodera glycines
  misc_feature (3663)..(3663): n is a, c, g, or t
ctaattttaaatgaaaaatgaacattaatgaaaaaactttctcgaaaattttagattttttttactctgttggttcgtttcttaaaaactagggttagacaggtccgagtattaagcaaaaactgggtccggtattgccgggtctacaaaagccgggtccgggtccaggttgtccaggttttgcaaagtcccggtatcgggtccaaccgggtcctgaattaatatttttcaaaaactaaatgaatatttcacgaaagaatttgtaatttttcatttaaaaaaataaaaatattttctttagattcggtagcaaatcaaataagttatttttgaaaaaattcaataaatggcaaaaacactattttttgataaatggttcttcaagtgtcttaatgaaactgctgattggcttaataacaaaagttaaccgttacctgattttatacataatttagtttagaatttgttatactgatctgttcatgtaattgtcgaacacattaatgaacagttaaagaccatgggtttctaattgtttttacactttaaataatcgctttttttcttagcgcctttgctaaataatttaaagtgagtttttaatttgtgcattatttaccctgatcaattggtgcgtctgttcgtcgtcattttccaacccccaaaggccaacgaatgtttgccgaattgcctccaccatttcccggtctttcggttcgggcatataccgttcgattatcccaggcagggccaacaacttcaaacaaaatgttggacatttataaggatgcaaaaagcaaattggaaaacagattgaacaaccacctgttgcacccgtttagaactgctcaaagcgctaaacattgtcgaagttttctaaaaagaaaaaaatctattaaaataatattgctaattaacttgaatttccaatcactttttttttgtcaaattgggtatattactaatgggtgttacatattttcgagcagggatataaaaactgagctcaacccctgctcgtcacgccctccccgtagaaatgtgaaaatcaaaatttcaaatgttttcttcataaaccgatccagattcttctacaatttaatcagctgcgcctttcttcattgtcggacttgcaaattcttcattttctcaaaactagtgaatttttggctatttttgactcaaaaagaaataacaaaaaaagaagacccaaactaaaacttataaggctttgcaccaatttgaactagagaccggacgtgcgtgggatctcgcgggattaaattacgggatccctacctcgaggtccgtcctgagccttaacagagactgggaagaaggtttccaaaaatatatataatttaaaaatgctttgttctttttccttacaatcgccgtcgaccgttcaattctcttccgtgcctcccactcctcctccgtccactccggcaaaggtccactgcgcgagtaaacgaccgcaaccgcgcccatcggcggtcaaacgcaaagtgaagtcgttagggtcaagctgcaacctgtgaagtggcacagcggaattcgggcaaaaagcaaaagcatttccccaaaaaaattgtacaattttcattattgaagaaaatttaaaatggtttctctaattagggctaaaaagcgaattggtgttgagaactttcagggccaattgcgttagaaatcatgtggatgtatcttcgaaaatggctgataaattttccgaaattgaatttatttttcaagaaaaagggctgtgaattttttaatatgggtaaaaacccggcgccggccacttcccctggatgttaccgggatcaccgttaaatgccaactgtcaaaggcgccggatttatcgtagatcgaaaccaactcactttgaataggcctctttcgacgataagcgcacaactttcacttgccaatcagaaattcgctgcagctcatattcgacggcgcgctcatcgaaacggtgcattgacccttggaaaacggcaaaaacgaccacggcattcggatcgccgaatcggagccttaaaaataaatgctttttaaatctgtgtaataaattataagagaaaaaaaaatcgccctggacttttctcttagcaaaggggtcaattaaatagggttttaaacttagaaaaatcaagtgaaaataattaatttctgggcggagtggacatgatcacggatcaagcgaatcacaacgtttttggttgtccgtgatcagggattgtctgtgatgaaatgcagttacgttcagcttgtgttaattaggattattttttccatcatgcatgattgatttgaatctttggattttaagtaagtttctgaatatttgatgggtcggaagattggcaccaacgaagaaaaaattgtatcgattttaatgaaaattctaagaaatttctataaaagtgacacttttctgtgctctcttttgcacttaccaggcttggaaaagtccccgtgccagtgtattaaatgctcgattttccggcacattcgacgcgtccatgcgcatcctttgcagcattcgacggtgcatttcggctgtccgagggcccatcgccgagcccaccacactgccaatgttcatctcaacctttgagaatttaaaaaaatttatactctcattgttataggttatttcattaaattatttttcagcttttatcggggaactgatttaaaaggttcccggaaaaagcgtaagtgtaaaaagcgtcagtagaaaatgcatcagtaatacagaatttataaaataaagtactgtttcattaagtattgtattacaaaaggtcagaatgtagaaaaatttcgttctaattttttcaattaagtttttaaaggttcactaataacatgaaattatactctaatggattgttgtaagcttgcttaaataccaatcaacgcttatgctttcaggtaataatactaaagtactcgtttttgaataaatcctgattcactgacgcattttccatcaaaatgtcaccttgtatatgtttttttgcttttttccgtaaatatgtagtagggttataaattatattgaataaacatattttttctgcgcatatgctatgaagaaaggggatcaaaaatatcatttttacgttaaaattttttgatttggtgaaggtttttagtccatataaatccatattttgggggtttcgggaataagtccatatttcggccatttttagcaaattttcacatgaaaatggaaaaaaagtgaaaaaatacacccctaaggatcgactttttggaaatttcttaaaagtaaacccccaaaaaaatgaatttttttagaaattttggcaaattttttaggcattttgttcgcttccgaaaattttcgctgacaacaaaatgaaattattgcccaaaattttgggatgtattttttgcaattgttgtgaagatagaatttgagaaaatttggcttttttttaatttaaatccattaattaataatttagtgtttttatctctgtttaagcaaaattgaataaatacacattttttggagtttttgagggttaaagcttatatttttggagtttttagtccatattttgatccatatttggccatttttgagcattttagtaaagatttcgagctttttaagtccantattttatgtcc

SEQ ID NO: 14222 - DNA, 1715 bp, Heterodera glycines
  misc_feature (1689)..(1689): n is a, c, g, or t
attttggcagtttttagtccatattttgatccatatttggccatttttgagcattttagtgcatatttcgagctttttaagtccatattttatgtccctatttggtggtttttaatccatataatttataaccctagtaatgagtcctcctcccttccccgtcaaatgcattcattaatcaaatgaatgctttgcaattatttacctgctttatgccaaagcgctgctgcccatccctttcttcaattgtgctgtccaccatataatccttaaatcacatggcaaatttattgataattcttttaattataaaatatttttattatttaataaaatattgcaatgaccgatcgtgtcaaaaacaaagtgtacggctgccgttggccttctcgatgaattccttcatcatttcgatcattcgaccatacaaattattcgacttgcccactccttctgtcgctttaaccaaaaagtcgaagtcacaagaaacgagaaagtacaatttttgcatcccctaaaacaaattggtgcatcatcgtagagttagcattccatggcattgaattacaatagaaaacgtatggttttaaaaaatcatagttagatagaaacaataataggctaaccaaaaataattttgaataaaaaacttttggaaaagttaatgaaaatccaaaatttgcacaaaattttttctcattccctcacaaaaatgcaattcttagggttgtacgactcggggtgacggttcgaggtcgggctagtcgggggtgcagagagtcacggtttcgtttgggtcagggccccatcctggattcggctaataggaattttcaggacgaatcccagaccctgaattttacttgtacccaattttgaaaaacgacaaattttcaatgctttgcaaattattgtgaaaaaagcgtacggtgtgcacatccatcgcctgttggtaagccgaacgtgggaatggggacgggaagagactgatcggctgaatggaagccacatcgctgttccttcttaaacagatttgacttggagttgtgcatcaatcaaattaagcgcccaaagtggcatcgatttcgttaaaatgggcaaaaatgttcggcactgagtgggaagcgaacccacgccctaaacagctgtccttgcgccgttctatcacatgcgcaccgtttccgcgagtcgtcgtccgacaagcgtttgatcagtccaacttcgtgggccacatcgacggcggcttgcaccagcgtggccaattggtcgctgctcctcaccgcttcaaccgctggattgctgattgatactgcaaattggtgggaaattttagagtttcacataattagaggtgccaattgtaagaaaatcataaaatatgtaaaaaaattccgaataatttttttcattacgatttatttttataaaaaattccctaaaaatctcaaaatatgaaataaaaaagaaaagagtataaaaaagaaaaatttaaaaagccagaaagaatccatcggtttttaggtttttacacatttttgaattgcgacaaacctagttaacaccctaagtagaaaaatatgtacatttgttttatgtaaaaaaaaacttagactacctatacaatgtatttaatgtgttctttttcaaaattttaaaacactccgtcagattagagaatattttaacganaatattaattaagaaagaaaattcat

SEQ ID NO: 14223 - DNA, 5096 bp, Heterodera glycines
  misc_feature (5089)..(5090): n is a, c, g, or t
atctctaagttttaatgttttgcaaatgagaactttcttataagataagttcaaatccgaaaaatttcggagattttctttactcaattttcttcaaaataaaaattttagctttaatttatattttctcataaaatgatttttcatgccatcattagccattttcgagaatttaacgaatttggagaaaattacgctcacttttggaaaattttatgcccatatttttcgctttttacgtatatattttgcatatttgtacaatttcgcgaaataggatatttatgccagaaagtccaaaaatgtaaattattccgtttttaactcaattttttcaaaattaataaaaattcgcttaatatttttcatattattttcttagctattttcgaggtttaggtttaaattttttggaatttaatttaatttaaaaaaatttattgcatttgctgctaaaatttttcgattttatgtgtcctaatggtcactctctgacatttcttactcggcatcgtccgctgcgcgagttggcacgaaaatcagcagcatcaaagcccagcttatcatagttgatgatcacgtagctcaaccttcccggctgatcagtcaaccaaatggcctggtaagtggctaattgtcctccgtccaaatccgatcgacccgacacggctgagcccgtgttgtaccatgtgaccacctataggcatcataataaaatcaataatttactaggcagtaacacaaaaaatcgatattttgaataaaaatggaaaaactcaaaaagtttggttatagagtgaaaaaaaacttttttaagcttttttcaagccaaatttcaaaaaaaataatcgcagagttgacagattaagatgcgaactcttgcattgccaaaaccgattaaagcattttttttctcgtcagtttgaaaaaccattcaaaaaattttagtgtcagtgaggacatatgagggttttaaaataacacaaaaagatttttctgcaattaaactttttgagatttttacacttcattatcgaaaagttatgttacttagtaaatattttttcatttttgcttaattttaataatgtaatacttagtcgatcatttaattccactaaataatttgaataagtaattctaaaaatttttcaatgaaaacaataaaaaaaataaataccagagcggcatctgcacgaaatgccgaagcaccagcgacaccctctaaaataaaaaaatttcaaaaataaaaaaaacatttgattaccctgaagccatcgcatcatttcgtccaaaaaatagtcactgttcgcatcacatcgtacataagagcctgctgtgcttggacaagcctgtaaaatttttttttaaaaataacaaaaattaaatggttttgctgatttgccggttgtccaaagaaagcggattgcataattgtgccatccgcgttcaaatttgtgccaacaccacggccaaacaaactttggcgcatcatcagacgaaagaaaacgccggcacgaaggccaggaattgcgtcctgagtgatctgaacgggggccaaaaaaggatacaatttagataccagaactcgattttttttggtttttattcaaattttaatcgacaaaaaacgatttagaaaattaaagtttttcggttttttgatttattttgtcaaccgaaccactttttgctttctaaaaaattcaatagtgttttaatgttgcttgactcatcattaagggaagcctcttgattggtgcctaattaccctgataatggctctaatttaaagcattaggttcgatacttaattaattattaccctaatttgtgacctgctgtttgcataaatatggagcaatcattgctgggtcttgtacccgtggccaatccgtgctgtccgggccaacattgatggttgggccctggtccaacacagtggcaaagcccaaatatccattcacagaaatctgagcattatttatatcgttatattttaataattttaaaaaattaaaaaatatattttacactaaaaataaacatatttgaatttttgaaaaataaatttcaaaattaaatgtttagagcattaatataaaaaaatgcaaaaaataaaattaatatttgcttaaaaataaatatgaaattaggtaattacaaaaataaattatataataataatcttattcttactgttgtgtagttgtaaaggcccccgtaaaatgggaagaacagatgaaggtcaatggtctgaccggacgtcaggaaccctggtgacacttcaaggtcgccattttcgggtccaaaaggcaccaaatttactacaaaatgtatttttcaaattaattattgtcaatgaaaccattatattttaatttttggtatcattcaaaagcctaatattttctatttgtctacaaaattaaaaaaaaattttcagaaaacttatgtcaataatatttctatctaatagaaaatacttagagctacgaaagatatcaagtattaaaaatttggttattcttaagaaaaatagaataatttttcgtcaaaaatttccttttggtgttttttcagtaacgactaggcaccaataatcagccattttcagaataaaattcacaaaattaactaagaaaaatttgaatatgattaattacagtaaattttttacttttattttagatatttcctgaatatttttttcacagtcaattttcaattattattgaaaataaaatgataattaccatagtccaatcatttggcaaaaaacactgacagtaatatcgtatacttctgttaaaaattgtccaattacctccataatacatgttggtccctgtgccggtgaatagcattccgggcccgcccggtcccaccgcttgtccttgaggagccggttgttgtggcggcggtggtggcggaggcggtggctgttgtccgcccaaaatttgtgccaaaatcaacagtttttcgtcgattaggacgacgagaaggacaacaattaaacaaaatgacggcaaatggcattggatttggcattttttattgcataatgccattttaaaatagactgatcgtgcaaataaaaatgtacatttatgaatgaattattttaattcccattaaaaaaatatttaaataagtaaaataaaaaattattgtttaagaataacagttgatatgtataattgattgtatcgttactcaaaacaaccaaaaagtgcgttactttaaaaaattaaaaaaaaaaattggttttcgattaaaactggttgtttttaaatggtcaaaaaatttatttcaaatcagaaatcaaagagaccgcaaattccaaaaaaaaattaaaaaaaaaattaaatttaattttttttaatataaaaactaattgcacttataccaggatgcataaaaaataaaatgaatagttaaaaacattcaattgcagataaaataaaaaataaaagaaattaactttgtaataaaacaataaagaaattaacaataatttcacatttacaacaaacactacattagctgacaattagtaaccgaaaagttcattagcagctgtcccatcaaaattagagagggagggggcgacgaggcatcggcgtggtgcgtaaaattttgcgcgtccgcggcggtgggtggcggcgcgttatttaagtgtgttgtgatgtgcgcgactggctggcccttaacggcgggcgggagtaggtcatttatttgcaaatattccaagcagttggtcagtccgtccgcggccactcactcactctcgaccctcattctcgacctccccccccccgccctataatgaccggcaactgcccgtccgtcagtcggaggttcgtcttttgcccccgcgtttcccgcgttttccattgtttacagacagttgccaatgtgacccccccaggcgggcagttggggccaaatcagcagcacacacacgcggaagtgttgtcgtagacaaaattttgccggctctgtccatcacaaaatgaagcttatagtcccccaaaatcgttcataatgtttgccctctgtactgcttctgctttggccactacagcaaaatttctttgtttgcttaatggacataattattttggaaatgaataagccgggccgggggcatagacggattttatgtggacaattcaaatatatttaatattataaatttataaaagtaataaattggtcgactggcggtaaagatagttattgctttattaaattggtaatttttgatgaaaatttttaaatattttgcccccaaatcagtatcgagtaatttctatcaaaaattcccaataagtgcttgttaatcctataatttcgacctattttgtgaattcattttttatgcatttttaaaatacttctttgtttaaaggcaaattttttaaaatttaaataaaagcaatataaagaaatcgatcaatatttaatgaaaaacaaaaaaatatgtaaaatgatacataattttttgtgatctattgactacacctgggatcggtctacctcagttgggcgttcacgtttaggcgcgtacggttgggcgccagcatgtttttccagtataactttctataattttttttctttgtcatccaaatccaacattattggagtcattcgaaaacttaatatgtttagaagctttttctaagccattacttcgcgattagacaattaccaaaaaaaggtatacacgaaaatcgaaaaaaagttcaaaaattttgaaattttttcataaaaacttttttatatgcacgaaagttgtttgttttataagtataatagagcatgttaaaagcttttcaatgataccaagatttttggatttggacaacaaaaaaaagctatagtggatcttacatatccattttattttaaatatcatgaaaattttattgacaataatattttattgttaacattcaaaaatgtgattagccaaattaaacctgaaaaaataaagcaagaaaaaagttttgataaaaatatttggccaaagatgaaacgatggaaaagaagaaaatctttgccaaattggtcaaataattcnnatggag

SEQ ID NO: 14224 - DNA, 5181 bp, Heterodera glycines
  misc_feature (5138)..(5138): n is a, c, g, or t
gggggcaaaaagtcagcaaattattggaaaaataggggggctccccaaaaactgttcaatttgtgatccagcaacattatgatgttgttgatggccaaagaaaaggccagctaattatgccttaaaaagttgaaaatagatcaaagcgggtagagggggggggaggggattgggatcacttccattattttggccaggcaggggtttcccttcatctgtagtgaatgtgaccgggggttggtatgctaccatcccggtaactatcgtaaacccatcctctgtttacactccagtattaacaacctaaccgagtttttgagggagggcaagactgaaacgacatgtccaaccgagacaacagaaacgaccagcagcacaatcatctgtcctccgcctccaccaacgacaactcacagcattctactgttgttcatcacttctctcctccttttggtctttttcgcgcaggtccacccccctcccccgtctaatcattaattattttttaatcctttttcaatttacaggctttcaaaatgggcattgtggcgcggcgtctgctaaaaaaccgggccattcaaaagcagttggaccgtcgacaaaaaagtcggttgaattatgtggaaaaattttaaaagaaattttttttttttcaagatatgaaaacacttcgccgtcagcaggcggcagctggtcggtcgcccattgttgtgcattcggcgggcattggtttgccaaggaccgagccggttcatcaagtaaaaagttttcacatttttttttgtttactgaaaacacttttttttttttttttttttttagcgccaggaaatctgcacagtgcccgcccatgaagtcatctacgacgtgccttttgatggaaaaagagaggaagacgaggactcattctgatggacgattaaatttaactcgataatcatttaactcattttttcatttcctttttaaatttaactccataatcatttaactcatttttcatttgccttttaattacatacttatatggaaaataaaaaggataaattgaaggagagtttaaaataaattaaactgtacactgacaatggtaacaaattaggcgaaatgttaggcttgggttttacaaaaatttgaattcgtcatgcatatttaattaagagaaatatttgatcatacaaattaggccagatgttaggaccaatatttgaattcgttgtccaattattgcatatttaattcgtatgaatattcaatcattcgaattaggtcaaattcgcggcttggatttgtcaaaatttaaattcagcgaccgatttgtacatatttaatttcaattgtgtggcttgggctgatctaaatctgaattcgtcgtccgatcggtgcatagataattagggaatttttaattttgcatatacatcaaaattttgtcggtattaagtaaagcaaaaattcaaatttaccgacaacacaaaacaattaaaatgggtcaagaataacaaatttgtttgtgattaattagattttttgaatataaaaggtgcagtacgaaggtttaccgttcataaaccaaattcataattcccttcatatattgtttttatgcaaaaataaaatatattttaaattgactcattcgcctcccaccctgctcttttcgtttcttaaaatttttcacatttactgtttacattttaccatattgcattattccaataaatttaaaaataaaattttgtttagcatttatccataaactaacttttatttattccaaattttaaaaatgtctacatcggaatcaaaaaatggtaaaaaatctcaattcctcccttaacattaacaatctttcacctacagcaccggacaaaggcgactgcgaaatgcccgatgaacgtgttctacacctcgagtgctttgagagcggtgattatgatgtaaataattgttgaaaattccatttttttccctcaattttaatccatttcagatgatggaattgtacgggccggaccgtgctaaagagatgctgatcgaattgcgcgactatgctgaggcgcacggaatgccatgtcagtatgtgaagatgctgctgtacaaactggacaaaggactgatcaaatggaagggaaccaagccatgaaatggatgatgagtgatcagatattttggtgacaggacgaaggggggatgattgaactcattggtgatgaatgtgattttaaaaaaaaataaataaaatttgagaagaaatatttggaaatgaaataattgttcactgtttggtcatccctgatcggtcacacggggttcatttatgagcgcccatctcgccaaaattatcgttataaaatgggcgtggcacctggcccgacttttttgcgtataaatacgggctcaccgggtggcatttttcatttggcgtcccttttcaaattcacaattcctatggcgatcaatatctccgacaaaaaatcgttgttcaaccaaatcctcggccaaacggacctcaccgtgacctcgagtggtataaccatcagcggtccccgcctctcgacacctcgcttcatcccatttgatgaagccggtcgttgtagatgctgtaagggaactgagtccgaaattgacactgtgattacgaaagaaggcatcacgctttggtgcacgcgcatagagaaggcccaattcattccgttcgatgtggtgtacgatttgccgggtcattgctttttccgtttgaaaaataagtctcgagtgttcaacataccctacggcgacataccctcttctgacacgcacaccactaaacggccccgcaccaatgactatcatcaacatgagctgaagcgcaaagcaaaggtagctcttgacttagtggaggccggactaatggccgatgccatgcaggacggcgcacgctggaagaaggcgaaaacagcaatcaatgtgctcggcaacctccttttggcggaatcgctggacaccacctccgctactccgctgaaaaatgatgtcgcggacatcaaaaaagaagaagaagcaactgtggcggaagaacacaaagaagatgatgatgaccaacaaaaagaggacctcggagacattgacaaaacgcttgacgatttcttcaacagtattaaagcatccacagcaaacatgtagaccctcattttgtgtaaaaaatgttaaacagccaagcattcagcgataaagacatttgctttaaattaccatttggtctaatcatttcggggccttcgtcgtcgggaaaaactcaatttctgctaaaattcattgccgaatcggaccaattaatcacaccaaagcctgtgtccatgctctattgttttggtgaaatgaatgcggcggtgcctgtgcttcaaaaggcaggagttgatgtgtacgcgggagtcccatccgaggaattgattaagcgcctccctaagcctcttttgctcgtccttgacgacttgatgctgtccgttgatgagcgatacttgtccgatttgttcactaaaaaggctcaccaccatcagtttgcagtggtgtttgtcactcaaaatttgtttgagcgaaagataaaagtggcccgcctgtccgctcagtacttggtactgatgcgggccccaaattcactgctgtccatccgcaacattggcgtgcagctctttccgcgtcagcttgacttttttcttgacgcctaccgtaaggcgaccgcccggccctatggttatctgttgatcgacatgcatgcagcatcggacccatcgctgcggcttcgcacaaatatatttaaggatgagcaggaggaagatgaagggacagttgtgttcattcctaaaaatggagcggcataagcaacaacaagcagtggttggccaactgataaaagaaaatgcgcagtggctctgtgcactggccagaacgaaatccgccaaaaaatgtaaaaagctgattcgaatggcaagcaccgaacagctgctctcacttgttgaaatttgtttgaatctcgtcgcttcgcgcttccgacttacaacccgacagaaaaagcgattaatgccccatgtgaacactgtacgccggatgagcagagcgagaagtgagcggggcgccaggcgcgtgctggtccagaaaggcgcaggatttggcggattgttcgctgctcttttaacacccgttttggttgaattggcaaagaatgttgtgagcaaaaatgcataaatacccccctcatcattgttgtaattttcatgcaccaatcattcattattcatggcaaataaatttctacttgttcctcaagaaatttaccggggtctcaccactgcgacggacacgggcgatttaaacttggatgctgttcgacacgatttgaatcgtgcccgggccgaacgagcacatccctctcgaaaaaatgtcaactacaaccagcagcttaggcgatatttaaaaatgcggcgagagctagcagacagaccggccaaagttgagctcaccaaagggataagcgtgctgttgaggagaggtgctgaagatgaagagggtgaagttgtggacactccatcccgtcctcccccaccaccaccacctccacctggaggacgccctcggctcccaccaagtcctccgggtcgcgctccgtccccaccagggagtcctccgcctcgcccacaacgtcctcccagaccgactagggcttctcggagagacgatcgcctggagcagtgggagaaaaggcgacacgatatacaaagacggcgaccggttgtgcgggaccttcttgcggaagcagctgctgcccccttaccggaaagttatacagatgatgagtacatgttggagagtgggttagcgctgccaacaccatcccaatactatggggacttgcctgtggtgccataccaacatcaaattgagcagatggacactgctgctgctcagcacaggattgccatcagaagaaaattaaaaaaggacgaagcatatgatgattcggaccgcaaaaaatacagggtttattatcctccttcacctccccggctcccgctcccgcctcgtgcgaaagcaaaaattgaaccaacaccgcgtcctaccgccaagagagagcctcagaagccaacaaagttggaactaanaccatcaaaatttgagcccgatttacgaacaaaagtcgcaccg

SEQ ID NO: 14225 - DNA, 765 bp, Heterodera glycines
agttcctttcaatttcaataaatattctatattataaatttctaactttatttttaataagtaaaaggatttttttaatttgataaatttataatacatccaataatacaattttcttatttatttcattttaaaccatgattgtacctcttctaatcatttttttaactcttctaatctctgttgtacctcttctaatcattgtttgtacctattctaatcacttgtacctcttttaatcactgttgtacctcttctaatcactgttgtacctcttctaatcaaagttgtacctcttctgatcacagttgtaacgggcgcgaggcgcccgtccgatctcaacaaatttaaaaaacgggcgcgaagcgcccgtcagaggccgcgaagcggccgaaaaggcccaactaaatttaaaaacgggcgcgaagcgcccgtctgagcttaacaaatttaaaaaacgggcgcgaagcgcccgtcaaagcaaaacaaaatatgaaaaacgggcgcgaagcgcccgtcaaagcaaaacaaaatatgaaaaacgggcgcgaagcgcccgtcaaagcaaaacaaatttaaaaaacgggcgcgaagcgcccgtcagagcaaaacaaatttaaaaaacgggcgcgaagcgcccgtcagagcaaaacaaatttaaaaaacgggcgcgaagcgcccgtcatagcaaaacaaatttaaaaaacgggcgccaagcgcccgtcagagcaaaacaaatttaagaaacgggcgcgaagcgcccgt

SEQ ID NO: 14226 - DNA, 1147 bp, Heterodera glycines
ccgtcagaggacgacaaaattttaaaaacgggcgcaaagcgcccgtttgaggccgcaaagcggcctaaaaatcgctaaaattttaaaaaattccaaatctcttcaccacccaatatttaaaaacgggcgcgaagcgcgttacttctttttatcacagatgtacctctatttatcacttttatacctcttctaatcaccgttgtaacgggcgcgaatcgcccgttcgaggccgcgaagcggcctaaaaatccctgaaaaaaccgtagttgtacctcttctgatcagaattgtaccttcccacccgtggttgtacctcttcccccgtaacagcctaggtagcgaagctccgaaagcgcgaagcgctttttcccagctaaatagccgacggttcacgcacccgctagttatatatatgttatattgacaaggcaactcatcctcaaaaaggatatctcaagaccgggaatagctagggggctgaaattttgcaccaaggggtaactcgagacggcgcatctgggaaaactataggttttttggtccgaggcccaactgagtaccaggggccgatttcccgtttttgctcgcagttcaaggcccgtaactttttttctgaaactctaatcgaaaaatgtccgctggtaggaaactaagttgaagtgttgactaaaaaacaaaaaaaaatccaggcctctacctataataggaagggctgcagaaaaatggagaaattcagtaccaactttgaccagttcagtcccgggtgaataacacgtcagggtttgaattgatcaagggggtgccagcgggactattgtagagctttaaaagcccgatttttccagtttttaaaatttcgaaaattttcaaaattttccgagttaggcctaaaagtaggttttggggtttttgaattttatgattttttaacgatttttcccagacaaacggagaccactttcaagcaaccgtttttgatgctctatcgattggtaatttttttgaaaaaatttcggttttttcccggaaatagaaaaaaatttgggcctgagcgggacatttgagtcccgggcccataactcgtcaggggttgcttttagccgggaagtggccttagagcaaaattgtagagctttttaaactctat

SEQ ID NO: 14227 - DNA, 3824 bp, Heterodera glycines
  misc_feature (3817)..(3817): n is a, c, g, or t
attaaaaatgcttttatccaattcagcaatttaccccgtataccaatttttgtgttaaatattaattatactttgttctcattttaaattattttatttggcgttttgttttctcaattttcttcccatttttacttctttggattttttgattattcgtctccggtctccaaaaatcttctgcatttttgatattttgattgtgcttaaaaataagtcttctctcgcctctgacgtttgtttggattgttattttgttgttccgagctttattctaatttgttgttttgtttctcaattaaagtgattagcctaattgtgtgtctgatttggcgaattcggttgcagcagagcgaagaaaaaatattcggttgtgcattacgtggcgctcctggcagtctcgggtaagctcactgcgtttaaagtttttctatcttcgggtgaaatcgaagcgtccttgggctttttggcgttgttgaccccgaagaccgggaataacgctgcttgcagactgctcaaagactgagactgcagataaaacaaaatttgtcgaaattcgaagttgctcaaagactgaggcttgctcaccattcaactgtattatctcaaagactgagaaacgttgtgaaatttggaaatacattattgattgtaaaatgaaccaagacggttaaaagaatgattacgagatcacccccattaacacgacagcgagctctaaaccttggaattgaactagacaatggcggaaagcaaattttggaaagagtgaatccgaattcgaaccagaatccctctctaagtctagaattggggaatggtcacagagaaatggttgatgatggtggtggtttaggacaaagccgacttttgaacgaacaacaactgcgaaatcgtttgctgacagtgaccatgctcgacaacaacaatccagtcgtacatgtaccaaatgaaaatgtgcagaaccaacgcattgcaatgaatgctccgcttgtcaattcgggtatttttggctcaaataacgggaatgtgggtgactattctgaagagttaggaggtacacgaattttgcaaaatcgaccaaacagtaattcgggtgcaatcaatttgaataatgcggaaatgatcccaacatatccaccagcactcgcatcaacccctgttgaaaattttggcaatttggcacgaaattcggaaaatgaaaattttgcgttcatcgagcataacgaagtgcgcgcacaatacacgcagcctcggagtactgaaaacattaggcctatttttgtgcgccaaacagctattcattcgcatctaagtgctatgcgtttaccacccatccaacagccggttgtggcaatagatttccctgagcagtttgtccagagaaatacccaaactaacatgccgcaaccacctttctatggcaatcaacgccaaaatgaaaatttgcaccaaaatttacaacgagttgctggcaacgaagtacaacaaagaggagtgcatataaacccaggaaattttccggaaagggttaatgctccaaatgccgatgcttttcatatgcgacgggaaatgcatgatttagttctgacacaagcaattaaaagcttggataatttctcttattcaatgacgttgaattcactcccagagctgaaagggaatacaggctcagatgcggttcgagcatttttccgtcattttgatgttgcaactgaagaatggccagaggctaagcgccttagcgcacttaggtcaaagtgttcaggccgtgctgaacgcgctttcaatgtcgccgtctcgaacaatccatttcggtacgagaatgttaaaaggtctatggtgcaacaactggaagagacggatgcgagacaaatgtccgcatttgacgagcttatgtcagggatttctcgccgaaataatgaaaggattgacgatttggcagatcgggtctcttccctagtcagaaaggcttaccctggcttgttggagcatctttatgatgattactcaatccgtcattttatcagagcacttcagaaccccgaacttgcactcactcttaaattagcccgtagaccatcaatgatttttgatgagtttgtagcattagctgctcgggccgaagcaactcaaaaggcgtcaaagatttcattgcaaaaacaacgaaatataccaaatttccaagaccataatcagtctgttcactacaatccccggccaatgcaacagactttccgcaatgaaaattttccgcggatcagtcagagtcaaaaccgacaaaattgttacaattgtggtcgtttcgggcattttgcccgacaatgcaattacccgcggcaagttagaactgaaaatgctaacattggtactccagcgactggtgccaacaaaacatcagtcgaagtgcctaaagacacgtcacagccacaatacaacaaaccgctaccgttttcaagaaattatctccgtcaaaattttcttgttgaacaacaagaaaatcctccaccgacgtcacaaaattttttgattggaggaatttcaatgagtaatgatgaattggagaaactttttgaaagagacaaaagcgttgaagccggaaatagtcgagcaaagttgttgaatgtctctgttggtaaaatcatggtcattaaagtttttgtttgtgatttatcagccacggccatgttggacggaggagcacaagtttcacttgtgtcctttgcttttttctcgaaaattatgactgagaaaaacatcgataaaattctactttgtccgacccgcgaaagcactcaagttgttgacataaacgggaaaacagtagagtatgttggagttgtgtcattaccaattgtcagaaaaaatactaaagtttggatcagatttcatgtgacaaatgcgtcatttggttatgagtttctttttggcaccaatgcattggcgcgtctggttttaagctttatgacggcctgaacaacgaaatgatcaattttactgaagttgataatgaggagaaaaatccggtgcatgttatttaccggacgactttgttgcctcgtgccacaaccttgattgagatgtcaggaccaatgagtttggaaggaaagaatgtggcaatttttccaaatttggaaactgaaaaagaaatccgaattgaaccaacaattactgtttcggaaaacggaaaatttgttgcacctgtaaccaatttttcttcacttccaatgattatggaaatgaatgaatgtgttggaaatgccgaagttgttgaggaatttgccgaagtggaagatttccttctctcaccattggttgctcatgtcagtgctgggcatcaaaatgaagaaaaattaccaaaatttgagtcaataagggaggtttggttgccaagggtcaaagaccttcaagaaagtcaaattgaaaatttggatcagttgatcaatcagtttaaaaatgttttcgctttgcacgaccatgaattaactcagacgagtttggttgaacatgtcattgataccggagatgcgacgccaataaggagcagaatgcggccagttccgtatgcttatcgagaaaaagtttctgaaatgttgagggactatttgggtcgaggactcattcggccatctaattcaccgtgggcaagtccaattgtgcttgtgccaaaacgagatggaactttacgattttgtatcgattacagagcaattaactcagtaactaaaaaggacgcctttccacttccaaacatcgattacattttaatggcgttaggcggaaaacgctatttttcaactcttgattttatgtccgngttattg

SEQ ID NO: 14228 - DNA, 2018 bp, Heterodera glycines
  misc_feature (1951)..(1952): n is a, c, g, or t
  misc_feature (1983)..(1983): n is a, c, g, or t
  misc_feature (2001)..(2001): n is a, c, g, or t
tttttaagggttagtgaatatagaaacccaacttaaaaagatagccccaggcaattccccctggggggttctttccgtaatcaaaaagtttagcgtcgctatcagacttaattaagcaccgccaatcacctgccaatgatctgagctttaccctcagcttctcctcctcgttgttcatttccttcagttcctcatatcctccacccttcgtaataaattctctcctccgattggccaattggccaaaaataatttaatttatttaattattttttaaggcttagtgaatatagaaacccaactaaaagatagccccaggcaattccccctggggggttctttccgtaatcaaaaagtttagcgtcgctatcagacttaattaagcaccgccaatcacctgccaatgatctgagctttaccctcagcttctcctcctcgttgttcatttccttcagttcctcatatcctccacccttcgtaataaattctctcctccgattggccaattggccaatttcgttggccattttcgctgacaatgcgtcactttgttcgtaatttattcgttcttcggttttaaaaatttcttcttggggtgcgaaggtggtgagtccaatgtcaaaagcaacgaaagtgttcggactgatttcgaatttgaactcaattagcggcatccacgcgtccggcgtccgattgagcttcgccacttttgccacctaaacgatgggcgcggaattttaattttgcccaagcactagcacttttgtaataaccgtaatttcacattgaatttgatcaatatgtattttctgaaactcgaaaaagtttgttgcaattcttaatgcttcgcggtttttgaatcaatttaaaaaattaaaaatcaattttggggtgccgataggcgccaccggggaaagttttcgaaattttgttctaatttgttacaaattttctgcaattttgaaaaatagaaaaaagtgtcattcttctttcttgagcccataatttgaacttcgaatattttaacgaagctcgaagttcgatgcccaaaaaatcgattgggctttaaagtacgaagcccaaagtttcgcccgtcactgatctcagcagaagtattttttaagtttaaaccccaattttttgacactcaccaaacagagatggcagaagagtgaattgtcggcgcattttctgtcgccgttcgactgaatttcacattttgcactcccaaaaaactgtgccgcttcccatgagggcaattctggcacaacacaaatggcatcgatgtccgactttttggtgagtgcgcccaattggtaggcgcccgtgacgataagtttcgacatggaattcttaaatttgagaagcgttttcttttcttcttaattaccttacccatttccttataatttgttcaagttcgctaattgcctcttcaattttgagtttctgttcgttttctatgagcccaaagccattttttgaaatgaatgaatccaactaaacgttaatattttaaattattttggctttttaatgctttttcagcttccgatttaccgaggcttcgatatcattggccattaattgtccattttgtccaacaaaatgcttttttatctcctgcaaatgcaatgaaattccgaaaatttgagcaaattcaaattcttgtcgcaaatattttgacaattccatgtgcaatttttgatctaaataattcgatttgtaaattaataaaatttatttattttttatttgcttaccctgctcaatttgctcaatcattagagaaaatcggttgaaaaatgggcaaaataaatccaattccgtgccaaccaatggcttttcctcgcttttatcacgcttttcatactttttcttatggcattttttccaagtgaattcaattagcgtttgtgcaaaattttcttttggcgtttgacccaatttnngaattcgttttttcgttctgctaaactcaanatgatttttgtccgctanaagtgccaatgccattt

SEQ ID NO: 14229 - DNA, 3047 bp, Heterodera glycines
cctttttctgtgctattattattattattattagttttatcttggtctatttttgtatttttattctgctgtttatgtttctcccttctgtttttacttttttttgtttcttttttcttttgtgttattttttcctttttctctttttctttttctctcattgtttctccttcgcttccattgtctttttcgttttctttttgtgttatttcaaagtttgtgccatcatttttatgtgtttttggcattaattttgcataagattctttctcaacaaattgtccatccttttcgcttaaattactttctgatggaattctgtcagctgacactttgacttttttcaactttttttcttccattccattcattggcattttgtcttcgttttgattttcttcctccgattttgtgccaatttctgatggcattttgtttggctttggctttttctttcccttttttttctttttatcttttccctcattattctcctccgaattcacatatttcagtgcttcgtccacatcaaaaacttttgttttgtcggcttcttcttcatcttttcccaatttatttccattttttctttctttttcatccgagtaattttcttcatttttttcattgaaattttcattttgatttttgacattttcttcgaaatttgcaaatttttctttgcatttttcggccaggtcgaaaatttcgctgacattttctacttcgcccacaaatgtatcaattcgcatcacattgtacgctgctccttaatcagcaattttattgtaaacaattgatgttaatcaaaacttaattacatcattatctgtcgttaatttttttttattgttacattttttatttggcaaattattgaatatgatggcctaacatttcccctatttaagatgttcaatgtgataacgttctttattccgtaggggtaaatgattacatggtgaaatacccgaaacgtaacgggaggggggagtttggtcgggatccggcggatcagggctgggcgaaacttcggcttcggcttcgaaaacttcgggttttttgagcttcgaacttcgtgcttcggcttcggctattttacccgaagtttcgggaaaaatacacctctaaagattgagttttcaatgtgaaaatgcaccactagtgattgacttttggtaaacttaaaattaatatatatttaaactatttgcttatttgtgctttttcgcatgcttggtcgagtggtaattctctcggctcttttcattatgtttcctttgggtcagttcccatcaaagtagttgcttttcttctaattttcaaaaatattcatttttttcgacagaaatttaataaaatttaacaattaaaatcgcaaaatttttttcatttttggactaaatctgttaacaatgcactaaaaatttcaaaattttcaccggcggcgcctatcggcaccgccggagctccaaaatttcctttattttttaaatcgactcaaaaactgtgaatattctaagaagtataaaaatttacaaaatacattgctaaaaaaattcattatatttatttatcgaaaagggttggttgggctctagaaactgcgtcaattgattaaatttgatatttaaccgaaattatgtgatgaaaaaaattttagaattaaaaaaaattttgaaaaaacttcggcttcgaaaacttcgggttttttgggcttcgagcttcggcttcggcttcgaataaaaattgggcttcgccttcggcttcgagtgctaagccgagcttcgcccagccctggtggggagagatattaatttgtaaaaaaagaattagaatttttgtgtaacttgtgctgcaaatgtctgttctgctgcaagtcaatcgaattacatacaaattacagtagtgattataccacctacaaccgcgcctttcatcactcatttgttcagttaacaagatgagagtgtgtgatcagattttacattaatatgtgagtgatcagtgtgatcagagtgatcaatccattcgtgagtcgatcaaagggtcgtcaatggcactgtgggcgtgtgcgctcgatgccgtgccgacatcatcgactgcgcggacggtgacagctcctccagcgtggccaactggacaaccacctgcaaagaaaatgcgaaaaaattaacacaatgccaatttcaaaaaatttaaaaaaaaccataaaaaaattccatgaaaatcctgacgagattttccgatttaaaatagtgtggaatttccactaaaaatgccatgaatttcggcacttccccccacctgtgaactgctcgagtgacgatgcaatgatcggcgcttgaactgctgcgtgtaggcaacccgcattgattccacctgcgcgagaatgtgtgaaaaatgtgcaaatgccattggttgagcaaaaaaaaaatgggccaaattttcttaccaagaaatttgtgagcgttatccaggccctgaatgcttcgcgctttccgcgcacggattccgtctaaatacacacataaaaattgtacaatcagcctttttttcatcggcatatgtagattaagccctttccaaaattgtttattaaaatttggtttatttatagaacataaaaggtaactcgtccggtgggattcgaacacacggcttttacataccgtggaatgctcgaaccgactgagctatggaggccgctcccttttgacccatgtccttctttatcccactttctcctataatccgtgcttcctctggcatcaccaattataactttttaattggcctaatattttttaattttctcttagaaattggcccatcagcattatgtaaatttgccatttttgtccacatattttaaatactttgtgtattttttaatagggtcgagatcgttttcgtatgagacgcaagtttttggctagaactttttcctttgccaaccaaatccaacaatcttggttcattcgatagtcctaggtgtcctctattagcctccaaaatttcgaaaagtttcgttaagggtcaaaaaa

SEQ ID NO: 14230 - DNA, 1654 bp, Heterodera glycines
tgcatattttattttttatcacttttttacccattgaatcggtgcgtcgggtcgaaaatgagcaagaaatgattaaagtaagtcatttaaatttttgaaaattaatcacttataaatacttttgatctaatgtaaggcaaaaatctttttcattttgcaattaggataagccaaacgaatatttagatttgctgcaaaaaataggcagcgattatttcttattttccaaaaattccaatttttgtcactgatgaattgagttatcccatttctaattatttaatttacaaaaaatttatttctaattatatatggttcaataaattatagtttaaaaacaacggcgaactcaaagtggcacagatttacccactttcaatcaatcaactcattgatcaggagataacagtggaacaaattgccacaaaaatccgaggaaaaagcaacgatttgtgggaggggcaagtggccaaatgggcaaaaaaatgggtgggaacgaaggacaaaatcagcgagaagaaaaaggcaaagggcaataatgggaaaagcgcgtacttctccaaattctatgacagtctgagaatggaccgtctcgtgctgttggccaacaacattcgtgaagcatcgataaataaggtgggggccgggtcactttggcgcgggatattttggcgccgcaaagtttaaagtgttcattctcttttctatgaaacgaagaaatggcattcggcgccaaaacggccagaaaatttgaattttttgaggtttttggccataactttttttgtgtctaactaaattttttgaaattttgcaggtggttaggggacctggatacccggtttttcaatatccggaccatgttttttgaaaatccaatatctggtacccgacccggtaggtccgggtctaaaagtacactgataagaatgggggtctggtcaaattgttaagcaaagttggaggagaaacatacaactgtatttaaattataattttatttgacctcgcaataacatgaatataaaaataaactttatttgtagaaatttactgatagtactgatgtgatcgaaatccttgtcacgacaaccaatcaggaaaaggacaagacggggattagtgagacattttgtcacaaattagcccaagaaaacgaagtgtccggcaattataaacacattttgataccgttatgcatgaacaggcgcaacgaagtgttcagagaagatgaagaagtgatcaaccaaacagacgaaaaggcaattttactgagaaattatgattagggtcaaattttagtcatgtaaaaaaaacgagaaaagtcacgaaaacgacaaaacatttttaaacaattttaagtagcaaaaagcctaaagggtggatttttctgtttcaattatagaagaaacaaatccaacttcgaattttttgaaattaagcaaaaattcaaaaagaatatttgataaagaaaacaattttaggagaagcattatggaaaatatactttgtcacgaaaaataatgtcttagaaatctttaaatcaagttaaaatgtcgttatgtgcatattaggccaaccaaagtcagtagataaaaagtcaattagtggtgagccgaagtgacaaaaatatcaatgtttatattatttaaat

SEQ ID NO: 14231 - DNA, 1283 bp, Heterodera glycines
  misc_feature (58)..(58): n is a, c, g, or t
  misc_feature (63)..(63): n is a, c, g, or t
  misc_feature (102)..(102): n is a, c, g, or t
gaccataaaaatatataacctataattccttcatacttttttcagaaacatccaattntaatntaatttatataattagatagcccaaagattaatgaattntaaaaagttagggtcaaaattgttgagtctaaatttttgattaagctaagttatgctttatcattaagcaaataaaaataataaattaaatattacaaacattgaaaatacttttgtcacttcgtcctagcaccaagtcaattgacggaaaaactggcctaataataaagttgatttttttttgtaaaatttttaggttattgaacgattaaacgaaatcgtcaaagatcctcataacttcgcagaattgaccgaaaatgaccttttggtgaatgcgctagtcacttttagttttcccaaattgcgtcacattttcaaaaaatacgaagaaaaatatggggaaaaaattgaagagcaggtggacaacgcttacatcaaagaattcaaacatttatcaaaaaaccgaataatgaatctacttaaactggaccttcatgtcgagcaacatttttgggtaattattttttgtgttaaattttttgatagatgcattatgtatttgtttagcaaagttaattaattaaaagagattttagaaggaaagaatttttaaaaaatgtgaaattgctcacaattttttgaaagattcatcatgcatttgtttagcaatttttcaaaattttattcctttcgctttttagctttttctcaaaaacttttttctgaattcggaaaaattttcacattgcaaaaaatccttgagtctgacccggacgaaataattaaatttagcaaacattgaacgcaatcttaacggacattcaaggtcgcccatatttttttgcacaattattgaaagaaaagcttgacaaattgcgaggaaacgaaaagtgggcctcagcggacgcgctgaaagacgtgacgcgaattttgctcactcgcgcacccatcgatttggccgacattgaccaggaatttcagggattgagtggcagcttgaccataagaatttcgatttcggcttacatcgagcaaattatcggattcgaaaaagagaaaaagcaaaaaaagggaaatgtttttcgaagcttttccatacgttcaaaatcgcacgaagacattggcaccgccgttagtagcgaatccaatacggcagcagcagaaggaaagccatcgcagaaaattgaactttgaaggcattcaaagaaattgtcgattgggcaacggaacaccgaaggctg

SEQ ID NO: 14232 - DNA, 2487 bp, Heterodera glycines
ctattttttgttagtttgaccacttcccatgaaccgatcgagttgaaattttaaggcaattgtgaaaatattaagattctaacagtgacaagacgaaatgacaacggaaaaaaaattttacgaatttttttccaaaattggggtgttaaataaatataaggacacttgtgaaaaacggacaaaatctcaacaactaacaaaaagaaactgataaaacaagttaaataagaaagaactaatctttttacacatttctgtttattttactgacagaaatatgtcttttagggagagttatgttgaattttctaagttttccgtagaaattaagggccaaaaggcttaaatcgcctctaacatttgaccaaccgaataaaactgactgcaaacaactctaaaataatgtacagacatcctataaacattttctattcactttatgtcagaaaaaagtcattaaacacaaaatttttgagggcgaaaaaatgcgtaaatctgggtaaattcgtaaaaaatttcttatatacatatttcgggatttttttacatattacatatgtacatattttggaatttttagtacgtattttgcaattttttctttttattttttttttgcatattttgggaatttttgagaatttataaaaaatttcataagaaaaattcgctgacccacaaattgtccaagccacgaattgtccaagccacgaattgtccaagccacgaattgtccaagccacgaattgtccaagccacgaattgtccaagccacgaattgtccaagccacgaattgtccaagccacgaattgtccaagccacgaattgtccaagccacgttttgtccaagccacgaattgtccaaaagagtaaaaacccacgaattgtccaaaagtctaaaaagctcataaaaagccggaaaacgggtctgttttaggcttttcggggtcgctgaatacgaatacgacatttatatagccccttgcctaaccctaaacacaaatataaccatgaaataggaaaaaattttaatttctaagcgaccaaaattcgaacaaatttttaatgctcctattgtgatccgaattctctctatagacacaccctcagcttcacatattgaaaaaaataattttattaaacattcaataaaatcatcacggaacatggacaattgaatcatcgtaatttttaaaatctctcaattttcccgcatatccttcaacttggagaccaagcgccgacatcagatcactaatttcaccattgctgttgtacgacgcgtccgccaaaattcgcataatgacagcatcctggaggatgtatcgtttgtgtcgcttgtgaatgaaatggcgagcagatcgggcagcgtccacctgtctgtcgatgcttttattaaccccacaaatgaagtccgagagggcggggtggtgacagaggcctttctaaatgtttcttttcaatttgtttttaataaattaaagaccataaaatgaagatgagttgcctccagtccgttgtttgtacgagcgagggcagatgttgcctgtgagtgcatgttccaaagcggaattggaaaatgtggcgcacgaacgatttcgtcctcccacgctggaactgaatttttttattaaatttaaacggatgattgattaaagattttgcctgaaggagctgtcaaagtcggtagcgggctcaacgaatattgaacaagctgctcccgtggactcacagtggttggccacgtaagagttgatggtgccgatgccgaactgtattggggtagccgcatagctgtgttccgaattgatggtcgaaattgttgtcccgagtgcagctaaaaattaaatttttggaaataaaatgcataaatttaaacaaacaatgattgccaatgggtgaaaaattgagtggattatctccaaatgcgttaacaccatccaacaactggcgctgtgtcaagccgatgtatgttcgagagaagtaaaggaagaacactggcattccaggaggagaagacgccacgataattgagaaatcccagcaactttttcttctcacgccgcatcatttcagtcaacgcattgttggagctcatggcaacaatggcttcatccgttgctgatcgcctcactttagccaaaagtcgtctgacagataacgcttcttccgacttttttgtagactttcaagtttattacgaatcatttgttcaattaatgaaaagaaaaatctgaagtaaaaaaagagcacatattttagacaaatgagattttttcttatccgagtggatctagggttaggcaaggggctatataaatgtcgtattcgtattcagcgaccccgaaaagcctaaaacagacccgttttccggctttttagacttttggacaattcgtgggtttttactcttttggacaattcgtggcttggacaattcgtggcttggacaattcgtggcttggacactttgtgggggcgccata

SEQ ID NO: 14233 - DNA, 1206 bp, Heterodera glycines
  misc_feature (33)..(33): n is a, c, g, or t
  misc_feature (47)..(47): n is a, c, g, or t
aaaaactataaaaatcttgtcacatgcaaaatngtaagaaaatgtgnaaatataatacaaaaattgaaaaactaagggacataaaactgatacaagctcaaatgaatttgtaaattttttaaattaaccaaaaaatttaattataattggaaatctttaaaaaaagaaatgttcgaattgtagcaaattcctttttcaatcttctcattgttgcacttccaattctcaattccttgccaattatttttattgagtgaaaaagccgaataataaaactattttaaatcacataatggtaaaattcgggacccgtagtgccccgggggtgataggtcgtttcttaaatccgcaaaggggtaggaaaacataaaagaatcacacctataaattcataacttggctcaatttcaattaaatttatatatttgttggtatccattcaatagagctctaagtgttctctttcagaatataattttcaaaaattaaaaaagtttaaaaaaaagttatggttataaaatttcaaatacttaagtcaggattttttgtccataacttttttcaaactctttgatttttattaaaactttaaaatttatagattatacaaaagtgtattaaattattaaaagaaaatttaatataattgcatcagaaaaataaaacttataaagcattaaatattctatgctttttgacatggtcatgcaaatatattataaccgtttaataattttaaataattccagaattgagccaaattaattttatattcaatagccgagtttcaaaaaaattcattgagtttcaaaaaattatggacaaaaaattcttacttagacttaatgaaattttataatcataattttttttttttatattcgtttaaaaaatttttaaaatttatgttctgaaagagaacacctaaagcaattgagtgatacgaagaagtattaatttggttgaaattggggtaagaaaaacgaattggcccaaaatacaattagggtttttagtccacacaaaataataggaattatccaaatcaaaattcggaaattgaagcaaatttccttttccattttctcagtgtcatatacgaaaatcccaatttcttagcaattatttcctcgctaatttttgagttcgcttctttaatttcaaaatattgcttcatcttttctaatttctcctcattggtatatg

SEQ ID NO: 14234 - DNA, 1826 bp, Heterodera glycines
  misc_feature (1085)..(1085): n is a, c, g, or t
  misc_feature (1102)..(1102): n is a, c, g, or t
ttttgttcaattttaatcaaactttcttcactttcatttttgtcccatccgttgccaaaaatttcttcaaaatttgctctgagtttgccggattcatttacataaattatgaaaaatataataaatattaaattccacaaattcatttttactattcgtgaaatgtttgtgtagaaaatatttttatatggaatgcattttattgaaattatattgcttaatttcaacttaataatcaatattaaatggttagtgacttttattatatttaacaatctaatcaattcaccaaatcattttataattatttggaaaaaattatactgacttattttttgcaaagtaattttttttttaaataatacccaaaagaaccccaaaaagtcagagttttcaaatatttgtgaaaattttcagaatgagaattgtttaataattatttcataatttattttattgcctcgttaaaaacatctttaggaatataattatcccactaattattgccttctttttgcttttcgccaccatttttctttgtctaaaattgattgataattatttgcctcctcgtctccccttaaaaaaagtggtcgtccgcgtgcactcttcgtcatttatcatcaaattaatctgtgactgaccgaaatgaaatatttttatttcttttcttaattaaatggttgatgtaatccaccaatgattttcgtacatatttaatacataattttctttaacttttctatatttattaatatctaattttgtaataaaatattgactttaatgcttttctaaatatcacaccttacctttttagtatttgacaaacaaaaattgtcataattttttaataaattcgctatttaaatataaaataacatttttataatatttaatgtattaaatttaatattaatatttttggaaatagacaaaatttaaatgtgaattttaaatttttggtgacgtcattaaacaattatttttccaataaaaacatcaacaaaacaatacttttctgtgtggaaaattgtttttggcatcggcatgaaataatttatgcctgaataagcccttccttntaagccactcaaaagcnctcttattgagttccctccccaatgagaaggagcacttgtcaaacaaacgaaaaatgcccaattttcaaatatttcattattttcagtctaaaatatttaaaatttaattaagactattttaaataatttttaataaacaattgtttttttttgattttttaaataaaattctgactacaaagctagttttttaaattaatttccccttaattaattcttcccattttaagtgtccgacaatttaaaaaaaatccaaaatgattcaaaataacattactaatgacaacaacaataacaataataataatgccccgaataatggcaataatggcattttcaaccacattcatcaccagcagcccacaactgatgaagcaaaacaactccgtgccaccaatattgggctagccgagtgcttgaagggtggtgtgattatggatgtgatgaatgcggaacaggcaaagattgcgcaggaagcgggtgccgttgcggtgatggcattggaacgcattccggcactgatccgacaggtggtgtagataaaaactgagaaaaaaaagaaaattttgtgctaaatttttataaatcattttttttattataggaatattaaattatttaaaattaagatatttatatttttctcgttcgaattaaaaatatttttcggttgagtattttcaacgtggaatgccacagttttttttttttgaaaatccaaag

SEQ ID NO: 14235 - DNA, 1183 bp, Heterodera glycines
  misc_feature (1167)..(1167): n is a, c, g, or t
cggtcccggtttgcccaagattccgggtcccgctcaactctagttaattcattttgtgagcaatatgaaagttaataattaataaaattaaaaagtatatattaatttaaaatcgattttttaaaataaataatgaacattccaaaattaaaaataaaaatgtttaggcagaaattcggaatctcacaaagatgaatgaagaggaactgatgagctgggctcgtttgaacagtgcaccaattgaattggtttttcaaactgcacgcgaaggtgggcaattaaagataaattaattatttaatttttaattcatttttattatattttctttaattggccattttttgtggctttttgcaaaaattataattatttttcaattttttaagggagtttgccggtgccaaactttgctgcaggcggtgttgccacgccagcagatgcggcattgctgatgcagttgggtgccgaagcggtgttcgtcggttccggcatttttgtatgttggcataaaatgtcatcatcgaaatttttgttcaaaaactttatgataatgtactaacaaataagaaaaattcttaattttttcagtaacttaaaaattaataaaaaaaaatcccaacagaattttaaataattattactataaaaaaccgaaaatttccttttattttttacgtaattttcgtttgtttaaggattttctatgaattgaagttttgttttttttaaatttattctaaaatttttattggctttctgatttttgttgcattttgctgccaaagacaaaaaaatgccagaaaaaatatcaaaattttttttaaacatctcggaggggtgagtaataaataaaaaaacgataaattttaaaaaccatttaaattcctaatagatgagcgacaatccggcaaaacgtgccgccgccattgtgcaagcggtcacccattttgacaagcccaatgtgttggcaaaagtgtcacgcggcttaggcattgcgatgaagggtatggaccgtgttggtgccggaaaaacggtcacattggaacaataaaaaagaagagtgactaattaactgttaatgagttatttgtgtgtttatgtattaattaaataatggttttttaaattttattctcttagataaatttgcaatggagccaagantttaatatttattatt

SEQ ID NO: 14236 - DNA, 3176 bp, Heterodera glycines
atgcgtttttgagctcttttctttaaaacaaatgagaaaaaaaaagtttttcactaaaagttgcttccctactaattatttccccgggggattattgttcactttcctcaaaacgcgtggaataattgaagacggggtgattaatggagacggggggataattagagataatacggtatattaacatttcgagttaagatggatcgggcacacgagaaaacaaatcattttgaaatttaatttaattccttttttctgctaatttaaatattgacaatagcattgggatcggggacggcgaataattcatcaaaaaatgtatttattatatttccaggctttccacgtgtacccaatatcacatcagtcggggtaagtattaattacaattaccgtatacttcgcatatttactattcattttctgatcattttttctttgtcaatttgccaaaattcgtaaacaaactttttggaccaacattcttgaacaaaaagagaaatgttcaaaagatcataaatagggcttccttttttaggcaaatgcctaaaattttgcgcacttgatacgcaaagataagcacgaaaaacgcgttttccgcttggtttggggtgtctacgatgacttttataatgcctatttcgtggtttttgtgcctaaagtgcctattttaggctttttgaaaaaatccataagaaaaatgcaataaaaacgaaaaaaccacccctaagaaatgaccctaaaaaatttcagaaaatacacccttaagaattgagaaaattttcaaaaaaatgatcccaaaaatttaatatattttttcttaataaaaatttttggtttaaaattttgtccttatttaataatttcatttacaattgaaatatttaagtttttacttgttttaataccaaaaaagcgttaataaaaaaaaattttttttgcctattttagggtttttgtgcctatttaatgcctattttgcgatttttttatgcctaaaaaaggaagccctaatcataaaatatgacaaatgaaaaaatgatttcactcaaaaatattgtaaatttcagtaaaatatgctaaaagggattattatatacattaatttttaaaattctttttgaatattttttaggaaaaggcgtttctattccaagatgcgaattgtggtgacaatcccgaatacaaagatggtaattaattctcgatattggttgaaaatagcttagccttcttcccagcgttttattcttaaccgaattaaaatatcataaaaattaaatttttattcgaaattaaaaactaatttaagatttattcatcaatcatttatccttttttattttactattattctctgcttttgttattttaaagatagttttgtcaccccggtgtccagctgtcccggcggaagttgcatcgaaatgttggtcgtggcaggtgggaaaaagctgtggtgctattagccacacagaaaaaattatatattatatttagcacttaatttttgcgtaggggatgccattttgcctggaaagaaatcggcatttgccaggatttggaggtcatagttcttacgttcgatggcacccataaaagcttgaaaagccgccccccccccccctctaatatatcctccccgctcctaagaggaggtcgaacggtgccaggtctttactcaaaaaccatcaaaatgaaaattttgacaaaaaattatataatcttgatattattcgaattagccctaaatgttctattatcttgcaaaattaaaaaaaaaattcattaacattcaaaaatgttatgacctgagaaactcaaaaaagcaagtttttttgaacagttttggtcatgacataacttactttaaacttaactaaactttttgaaattttgcaggataatagaaaacacatagggctatcgaatgatattaagaattaaaaatttgattgcctttgagtaaagttatatcaaatattttttgattttggtggttttttgagtagcgcccattttgatggttttttgagtaatgtcatagcaccggtcgaacaacaggagcccctggggctttataaaagaaacaccggtttaaaaaaaaaaggattaccaattttcgtacatttaagacggcatttactcggtgctgcgcggctgtctcagcgactttttcgacttcccaccctccaacggagaggagggctgcacctgggggctgtcctcggagaatgcgctgatcgccaccagcgaaaagggcgaattggtgcaaaatgtgcgagtgggcgtcaatctgtgcccggcaaaagtgagacggacaaattgccaaaaattaatccgctcacatcaaatagtgtgaactggaattcaattaatggagttaattaattagatagctgatctgattgattatgctgctaattccagactttcttatcgcgtcagtcatttttctgctctattgcagttttatgcgactataaaataacatgactagggctgccaaaaatatgtacaaaaagtggtccaaatatgtacataaatatgtaagaaaaatcccaaaatatgtacaaaaaaccccaaatatgtaaataaaatttttttttaatggtattttttgggaaagaaattccccgtaaagtatgaaatagccacaaaatgacataaaaattactttttttggtatttttaggcaacattttcaaacttattttgtctttataaatcttcaaaatatgtaaaaaaaatgaaatatgtacaaaaatatttgccgaaattttggatttttattagggtcgtgtaaacagaaatagatgccatttttcttactaaaataaaaccccgaataataattaacaaaagcttgaaaaccttctaaaaattctacgacgaactttttttcaaattatttaaacaacaagaaactagggccagtcatagttaccaaacccaatccctagcaatgaccattttgagattaaaaatttatcattatcaattaacacaaaatccccaatttttaattgcttttgtttaaaaaaatattttgaatcaatttgtaggaaggcactcaatgcaattcgttgttgagaccctccgtggaatatgcccagggcaaacagcaaacggacgcttcgacgagcgccgccggcaacgcttggccgtacagctgc

SEQ ID NO: 14237 - DNA, 1306 bp, Heterodera glycines
aaatagatgccatttttcttactaaaataaaaccccgaataataattaacaaaagcttgaaaaccttctaaaaattctacgacgaactttttttcaaattatttaaacaacaagaaactagggccagtcatagttaccaaacccaatccctagcaatgaccattttgagattaaaaatttatcattatcaattaacacaaaatccccaatttttaattgcttttgtttaaaaaaatattttgaatcaatttgtaggaaggcactcaatgcaattcgttgttgagaccctccgtggaatatgcccagggcaaacagcaaacggacgcttcgacgagcgccgccggcaacgcttggccgtacagctgccgaaaatcgacatcaagtgaagcatttaatatctaaatgagaccagcagaaagtaataacgcccaattgtcagattatatcatgaaagcccttttagagggaggaaattgccaaaaaaggataaaaatttgattaaattaattgcaaaattatgaaaaaatattaaagtggttcaatgcttacaatgctcgcgctatgattgggacggcgactgtcactggaactaccgggagtactgtaccggggcatggtaattatgcacagaaaatttcaacatactatctgaatatgtattttcagaagataaattaaaaatatttaggtgcacaaaaacaattggatatgttaacggtgtgtttttgcattaaatatatttttgataatttataaaataattatttatataaatgtttcattaatctgtttaaatttacattttaaatcgttaattattcatattttaattgtctttttaggtcgttggcttgagcagcgcggctgtgccccattcaatccgttgaacagccaaatttgcacaaaagtcgagacgaatgccgcgttatcagagcttagcggacaaaatattgacattgtgcgttatgcactaaaaacggcaattagtcaactaattaacattaattggctctcgattttatctttctttttttgccaatattttttttttcattttttagcatgtgagctccgaacaatgcttttgcaatcagaaccgatgcaacggcacttttacaccaaaaacgctgactgcgctttctgtgctgtggccgcttatgttggcatttttccttgtgaagaattattgaagtcgcatttcaaatcgatgacaaaatggcattttggattatttttaaatttttgttttataaaaataaaatttaaaaacatttacaaaatgaatagttttacaattgcacccttt

SEQ ID NO: 14238 - DNA, 1504 bp, Heterodera glycines
cccccccccattgtttgcgttccttttgcttatgtacgcactttgttgcaaaagagccgcccggcctcgggctgttgttatgcatcgtcgccgacgtggtcgattgggtgagcagcaactcctgcaacacactttgctgctgttgcggtgtccctccggcggttgaactgctcgacgaatgcggcggagggggcggctgttgttggggggccatgccaccgttgagcatcatctgccaaagtggaggtgaaacagtgacagaaataaacattttaaaacaaactaacgaataaacattacatccgtaaacaaaaaatgaaaattttggcgttttgaaaaacaaaccgtgccattctgcaacattgtgcctccgttgttcgtttgctctgcattcgcgccagaccctgctgcggcagcgaccgccggctccaacttgtccaactcactgaatccatccaggtccaaatcgtcgtcgaagctggcctgagctgccaacttccgttttgtgcccgttccaacctgcgaatggacgaaaacatagaattgcagtacaattcaaaatatcaatatttccccaagttttttttatagagcaaagacaattcgctaaaacaataaacaaaagcgtctccgtattctagtgccattggcacagcattttgcaatgtttcattcccttcaccattgtcccgctaattattcattaattaccgtcgactgttgcaggtcctcctgttccatttgtcgatcttctccactgctcattttgctctgactaaacaagtttccattttaattaaacataagaaaacgcttttgaaaatgtgtctttaaataaaaggttgctcagaaagagatttgaatttgcatgttttagcctcagccccacacaaatcggcacaaaactatacgatgccaagagtaatttatccctggttggcaagtggagagggggaccctttctttttgttacgctgtatttgctttgcttttctccgtgcctgttttgtgttctgccgccgttgttatttgttgttgttgctgttgtgttgttgttgcgctctttctaatgccacatgcgctgatcagcggttgccaaagtgtaaaagggtgagtttgtggcgatcaatccccgttttatgtatttgcgttttcagcctaaaaaagattgattttcaaaaatggtatattgggaataaaaatctaagaatatggcgagtttaaaaaggtcaaggggaccaagcattcacaaatgaaatgcgttaaaataaagcgtgaaaagattcgataacacagtgtttatcaaagtatgcaaaagtcatcaaaacgaagtcgcaacacgcggagagcaaaacgcggagaccatttgaaagggagaagcccatgaaaaaacaaagtctcacgcagaatggtgcttaagaagcagtaaactctcgattaatcaattttgatgtgaatttttcttgatcggatatttcgatacaaagttttgtatgtaaaatga

SEQ ID NO: 14239 - DNA, 1965 bp, Heterodera glycines
gtgaaagtttttagtccatataaatccatatttcgggggttttcgggtataaatccataaatccatatttctacatttttgcgtttttagtccatattttggccatttttggcaaattatcacaagaaaaatgaaaaaatgcgaaaaatacgcccctaaatatttttaggaaatgttttaaaaatacacccctaaaaaagagaattgtttaatttaatacaaattggcattttttaatgttaaatccattttttggcagtttttagcgtattttaagtttgtttaagcaaatattgaatataaatacctttttcggaattttttagggtttaaaagatatatcagtttttagtccatattttagtccatatttgaccattttgagcttttttgtccatatttggtgttttttggtccatataatttataaccctagtcataagtgttcgttcattttgttcccaaattgctgttttgaaaattcacatcgattcaacggcggtacgacaattgcggaccgtacttttgccaaaaaaattaactggaagggtgggcctcgtcagtacgatcccttccgtattacaaattcaaaaagctaagtgtgtttcggcgcttccgtagacacaccaaataagtaagctcagagcaataaattaataactaacaaatagaaagcataaattaaggagcaaaaaagcaaagcataggatgataagctaagctataattatgtttattttattggcttgctgaaggcccaacaacagcttctacattttttctatattcaaagccttcaaaaaagagaagctcttttgcctttttctgttctaactccgatgtataaacgtaggagattagaagttaaaagaaattaaaaaaatgtttcatataaataatatgaaataaaaaatgaaaaaataaatattttgggctgacaaatattctacactgcgaaatttttttcctttttaaagagccttgggcaatttagcaacgcgactttaatagtcgtccgcaaaactacggtccgcaattgtcgtaacaccgttcaaacatttgtgttcacaaattttgattgttacttgcccaaagatacgttatttcaaaaaatttttcaattctaatttcgtgtaaatttttcagcgtttcttctaatgcagcgatattagaattaaaaatactttacacagagccaataaccgtattttgtgcatttttggccgatttggagcaaattagcatttttgaaaatttgaactttattttttagtcggatttggtgttcgaaataagtcgaaatggatgtcagaagccggaccggtcgggtgttctgtccaaaacgggatcagcagacctcgggcgccgcttttctgagccggccggtcaatttctgtaagctcgagcccggtagtttaaaaattccatatttaagttaaacattattttgaaaaacatcgtttaaaaagtattattaaatacgtagtgggaaatgtactttcttatcccagccgatcgctttctccaaatacaaaagtgaaattctataaatgcaaattcttcaataaaatagaataagtgaaagatgacccgcgtttcaaaatcatttatttattttatctgatttatcaatttgaatataatattataatagaaatggatggacccgcttcttcttcaaaatgcaaaataataaagggacagtttttgtgagaacatttttatactctgcgcgcaagttcagaaacaacgcgacctgcagaaaattcgacgcaaaatgcgctcgaaggccaaccctaaaataagcaatattaattttatatttttaaatattaaaattaaattattacgaaaatccagcgagaaaattgtgtagatgatcgggttcagtgcagagttcaaatacctttttgggagaaatgaagttgatatgagtagtgggggggggggggggggggggggggg

SEQ ID NO: 14240 - DNA, 4436 bp, Heterodera glycines
  misc_feature (4308)..(4308): n is a, c, g, or t
  misc_feature (4378)..(4378): n is a, c, g, or t
aaaattatgaaagagacgaagaaagaacttcttttttgcacttttttcagtactaaccattttcttttttattttttaaatatgtttgtaaaacctacctgaattattttccaaattatttataaaaacaaaataaatatgtatggaaaaagttattgatcgatcgatatttcagcgatttgtttttctgtttccttttcgtagacacatttttccaaggaagataaattcggcaaactgttgttttcttaaatccatgtctttttatgcctaatttttttgttatttagtttttgcctaaagagtggttctaatataatgttaaatttaatacatgattaaatcatatttagctattataatttcagttattacctaattcaatttatttttataaatcagatatttaattatttttaattttagatattaattaatttcttattgttttattaaaatggtgcgcaaaaaacaaaacttccatgaggaagaaaaacgaagtgattttgatgataaaaagggttatacgctcccttcaaaagctgatgagaagggttatacgctccctttaaaagctgataaaaaggttcaaagctcctttaaaaagcggtcggaatttcaagagacagaaaatgttgttataaacttggatgattctgacaatgaaatagataatgttcaatcaatatttgatttgcaatcttcaactcaatctgtttttactaaaacacaaaacatagatgaaaaggtttttagagaaagagaaaggaaaagagcagagcagtggcgcaaaagaaaaaacgaacaatctgaaaatgatttacaaaaatttagaaaaaaggaaaaagctcgcttcgaactttggcgcaaatcacaaatagaacgatctaattttgctttggaggattataggattcacgaacaaaaacgttttgaactttggcgaaaaaaaaataaacaaagtgctttatatcaagcggccaatgattcaagaaatgcaattttttattcactaagtgcttttgaaataatatgtaagaaatgtggtgctttgcattttaaagaagaaagtgcgacaaaaaacgccaacggagaagcattctatagctgctgtaaagatggaaagatttctttactttcagatcatttagaagaatatccaatggaattaaaacaattatattttatagaccatccctaccacaaaaattttattacaaatatacgtcgaatcaatagtgcattttcttttgcttctttaagttgtttgcgtttttcgttcaaaacacctgggcccccatgtttcaaaatacaggggcaggtttatcataaattcaatgaaagtgcaatgccaaacaataacgaattgccaacaaatggacaactttattttattgacacaaatgatgcggctgagttgcgttgtaaaatcaatataagttgtgaccaaaatttaatggaatacatcgaaaattttatgagagaacaaaataagtttgctaagtcttttttgttaatgaaagaagtttatgaggaacaaaatgaaatttctaaaaaagaaggaaaggaaataccggaacttagattgctttttagtctcaaacaaaattttgataaaaggcgttataatttaccacaaaccaatgaagtttgtgcaattatgttttgcgattctaatgatgaaattccaccggctagaattgttgtatacccaaaaataaataaaaaattaaaaaatttatatcctcttgataagtgtgtggaaccaatgacttacccgttactgtatccactcgataaagaagggtaccatattggcctaaaggataaaaacggcaaaaaataacactttgtgattattttaaatattttctatatttccgtgaaaaatttttccctcatttttatgcaaaaaagctctttcaacaatggttagtggattctgctgcaaaaatcgaatgggacagacttgaatacattaagactcatcaaacggaattatgtagtagcaattattcaaatgttgaggattttttaaaattgaaagcagaaaaaagtggtgccgaaatccaaaggaaaataattttgccttcgactttttccggtggccctcgcaatatgcatgagcattttatggatgctatggcaatagtcaacgaaacaggaaaaccagacctttttgtaacttttacatgtacccaaaacgaccctgacattttaaaatgtttaaaacctggtcaaacaccgtctgacagacctgatataatagcaagagtttttcaattaaaaaaagattatttattgcatttaattttgtctgaacaaatatttggaaatgttgtcgggtattgttgggttatagaataccaaaaaagaggtttaccacacctccatttattggtaacattagaccgtaattctaaatggcggacaaccactgaaatcgataaatttattgctgcctctattcctaataaaagtgaagacgctgatttatatgaaattgtttcgagttgcatgatgcatggaccatgctcagaaaaaacactttgttgggatcacgcaaaaaacaaatgtatgaaaaaattccctaaaccatttttagaagaaacaaaaataaatgaggatggttatccttattataaaagatcaaacgatagtagatttgtatttaaaaagggagttaaattatcaaatcaatttgttgtgccgtacaactatggtaaaagttttgctgatctaaaaactgttaatggtaaaaaatatgattcttttgcaaaagcatgtttagctcgagggctttgtcgagatgacgacgaatggtttaaatgtatggaagaagcaagtattttttctagaaaatatccgagaggacttagagttctgtttgcaaacattttgattcattgtggaccaaaatacccggaaaaattatgggatttttttaaggattatatggttgccgacataaaattaaaaaatccaaatttgacgacagatttccattatcaaattggcttacagctaataaatcaaatcctaataagccaagaacgttccttatcagattttaaaacaatgccacaaacaaaaatgctaaaacaaacttatcaagaaactgataattttaatcccatcgaagaaacaaaaattgcagataaattaaaaatgatgttaaatgaggaacaaatgaacataattaaggaactgactgatgtttttgaaagtaataaacaaaaatgcatttttattgatggaccgggaggaacgggaaaatcgatttactttaaaaacaatttatcattatgcgagagggaaaaacaaaaatgtttgtaatatggctttttcaggaatcgcagcaacaatccttaaaaaaggaagaacgctgcgataatcgttttaaattgccacttaatattaataaaaattcaacttcgggtattgaaattaatagtgaagaagcgaaatgaaattaaagaaacggatatttttatttgggatgaagctccgatggatcgcgttttattttggatataattgaccggaaactaaaagaaataatgcagaataatttgtcgtttggtgggaaaacgtttatattaagtggtgattttagacaatgccttcctattaaagaatttgcgataaggtctgaaataattgatttgttgattaaaaattcgccattgtggaaagaatttacaactttaaaattaacacaaaatatgcgagcaaatacgaatgaaaaacagtttgcaaaagatttaattgaaattggtaatggcacaatgggtaaaaatggttatttcaatgtaccggaacactgcatttgccaagaaaatttagtttgtgaaatatatggagaaaatttaaaaaaccataattatgatgaattaagcaagtgcgcaattttgtcaccgtataataccgtagtggataaatataatgtagagattttggatttattacctggtgaacaacattcatatttaagtattgatgaaacagatttaagtaaaaataacccagtaactccagaaattcttaattcattgaaatgttccagtataccagatcatgaaattaagcttaaaaaaggggcgatgataatgttattacgcaatttaaatgtaaaggagggattgtgtaatggaacaaggttgcaagtgattgatttgggcaaacatgtaataaactgtatcattaaaagtggagatcgaattggagaacaaacttttattccaagaattactttaattgaagagaaaaaatttccttttctactgcgtagacatcaatttccaatanagcttgcttttgcatttactatagacaaaagtcagtctccaacatttttcgaaaattgggtcttgatttncaatgatgatccctttttcacatggccaaacatacgttgctttatcaagagcgaaatc

SEQ ID NO: 14241 - DNA, 3493 bp, Heterodera glycines
  misc_feature (9)..(9): n is a, c, g, or t
  misc_feature (3385)..(3385): n is a, c, g, or t
  misc_feature (3421)..(3421): n is a, c, g, or t
ctctatccncatctgaaaacccaaaaatttgggatttttccctctataaatatcagaccctgtcaagttatttcaagattagtctaacctttgaaaaatgtagcctgatcaaaaatcacaaaaatacaggatttttaacccaagaatccgggtctaattcctggaacctagccctaacaaaatttttgaaaatctatgcaaatcctcataggttcgctggacaacaaatggagtatggacacgccgcggcgcgcgtatgataaaagtatgcagctggtgcggcttgtcggctgcaaccgcactttgctcgcggatgccatccgctgtctgcgccgcattccacccgccgacttcacggaacagttgtggaacatgcagttgaacttcctggagtttccgctcgtcattgtgtcgcgggatgccaactttttcagcgccgaggacgcgtttgaggcgctgcgcaagcgccactacgcacaggacgtgaacctaatgatcggtaattagtttatggacgaagtcggcacagattaattaacatatttaaagcgtatgcctttctacaaattagattttaaaattttcattccggatctgtaaacggaataaattcggaaccgtattttctgggttgaattctagattttttcgggttttagcggcttacattaactgggttgagactgtatttcaacgcactcaatccgttttttaaatcaaaatacgatagttttccacaattttaggcattctctgcatttgggcaaaattcagtgttgcctatgggtggttcttatattagaaaatttagaaaattagatataaaataattgatttcttttaatttaggcatcaatcatgacgagggcactttttggtaattcacgataattaacatccaaattaaaaattatgcattttttgtatctaatttccaggaacatttacaacatcccaaaattctttgatgtgccacatcagccaatgcttagcctggataatttcaatgaatgcgtgaagacggcattttcgcgcttgccagacattgtccgagacgcagcatcggttaaaacaaaaaataattttttatattaattagaattaatgatttttattttatttaaaatttaatagaattttcaatttattaacattattaatatttctttaaaagcatgtttatttgggcgcacggcgttgtgagtacgagacgggaatgcacaaaaatttggccgatcaagtcaatcagatggttcgttcgaaatttttacataaatacataggatttaaattatttttttaaatactattaatttcttaatttaatcattctttaggtcggcgattattttttcacttgtgacagcatttggctggctgatcaggcaagaacatttaggaaaaatttattgtttattgaacataaataattatacactgatcaaaattgaaattttatgcttcaatacatcaataaatatcataaaattatcactatttttctgcgatttataaaaagaagaaaccatttttagcttgacaactcgccagcccgtgtttacgtttattactttgaccaagcgtcgagcgctgtaagtaaaaaaattaattattttaaaaataatcaaatctaattgggtaatttgttttatcaattaaaaaatttaaatttcagaatccgtggccaaaatggactggtgtaatgcatggctatgaaattgaatacgtttttggcgtcccaatttataatgagagtgccggatatacaaaaagtaacaaaaaatgaataaataaaaaaatatattttcaattttaggagagcaaattcttagccaaaaaatggtgaacattttcaaaaataattgaaatttaattaaaatttaattaattttagattaagctgtggacatcatttgcttccaccgggtattaatattttcaaatataattgttatttttaaaatgaaaataaattggtcaacttaattgcattagtttaatccatataaaaattacataattaattaattagtgcttaattgataagtttctcgggatttcttgttttcggatttctctgattattttcctattattttaggattccaagcttggaccatcgtgaaggcttctcggatcggcttcattggccccaataccattcgcagaacaaccctcgttggcttgagctccgagcatcgcacatcaggctaataaaattttacaaaaattttatttcgttttatctattttgaattttaataatttaatttatattttttgtaggccaatgcgcgcaacaaaaaagcaggaatgccgtatatggcgagcatcgcgagacatggaatacaacgaatacagtaaaacattattaaaatattatgcaatattaaaaattaaaaataaataataattttgaataaatttaaatgatttataatattttatttaaaaattttcagtgatggaaaaattgacatccgctttatctgcatcatttgcaaaaacgcgactatttccacagtcaattgtagctatttttttcacactgatctctgtgcaaaaaattctcatttactagtaaaaaaaaattgtcaattatttttaatagataatatatttatttctatttactactattgtaataaaattttcttttaaaattattattttataaattttcaatataaaatttcctatttttcgacatcaaattaatgtccagaatttttcattatggcaaaagtttgaatatccaatcggggccattcattagatgattcaatgtgaaaatatcataaattaaataaaacaattcttgcaaaaaaataaaatatcacaaaaattatgccgaaatttgtaagaaaaatggaagaagcaatttggaaaatttcaaaaaataacggatgaaaaaaattttttcgtgattttctttatttaatttttaatttaaaaatgctaaaacatttcataaatcttattttataaaaaatgttttttggtgagcaatagagtattgtcgtattttgtagtttgttttggaaattcaatatgtttttctgcacaataatataaaatttaatcattttctattttataaaaagaaaattataaacaatttcgaaattattttgaagaaaaattaaattattgcttttgttctatttaatttccctaattaatccaaacgaatcaacaaataactcgtcccgaaacccgacccgatgactttgggtccggtttcgggacaagataagaatttatattttgaactgattgagttcaatgaaataaaatttttctcttaaaaaacacagtgcaaatattgcaaaaaaatggaaaaacttagataaattattaaacaaaattgataattatatttctnaactaatctttttaattagctcttaagtaattcaanaaataaacgaatcactacgactcatagaaaaaaccggcagggactctaagccatccacaatcatatatatcg

SEQ ID NO: 14242 - DNA, 1194 bp, Heterodera glycines
  misc_feature (1037)..(1037): n is a, c, g, or t
  misc_feature (1051)..(1051): n is a, c, g, or t
  misc_feature (1066)..(1066): n is a, c, g, or t
  misc_feature (1092)..(1092): n is a, c, g, or t
  misc_feature (1095)..(1096): n is a, c, g, or t
  misc_feature (1101)..(1102): n is a, c, g, or t
  misc_feature (1105)..(1105): n is a, c, g, or t
  misc_feature (1129)..(1129): n is a, c, g, or t
  misc_feature (1135)..(1136): n is a, c, g, or t
  misc_feature (1139)..(1139): n is a, c, g, or t
ggtaggcttttacgcaaaaaaaaagaagtagactttcaatttcagccactttttgacttttgttttcctgtttttcgctttggtccgtaaaaatttttcatttcctttttggtgataaaatattaattaaattttagttcattttaaattagtttttggttttcatgaaaaatataaatattgtacataaaaattcataacttggctcaaattcaacaaaaataatattaatggtatcattcaatagcatttttttaaacatacttaatatgatttcattattttcacaaaagtataaaaaaaaagttctcgtcaaaaaattccaataaattttgggtcagaattttttagcaattttttaaatttaagtgctaaacgggttttcaagttcttaaaaatattaatttatgcatattttattgtcaaaattaatgattttcattcaatagcccaaagaattctttgttaaaatttcaaagaacattcaaataagttgtggccaaactaattctgattcaaatttttgatatattattacaataaattaaattggattttttgatagagaacactaaaatttgttaaatgataccatgaaatattttattttgattgttttttgagcaaatctaatgaatttatatattttttcctaaaccttggcggaattaaggttaatctcctaaacacctcacaaatcagtgctttttacttattgatgttgaagccgctcaatgcattatgcattcggtttgtatcataaacaatgggcgtttgcatcagataaaaacttaacattttataaatttatttaaaatatgcatgatttaatgagaaaattatgtttaaaaaaattacatcagttcccaaaagtcgccagtgaactctctatgcagcatagcaatcatctctttctcaaatatctttttatatacttcactcaatttttggcgctgaaattttttttttttttttttgaaaaaattttattctataggaatcaatttttatttaaaaggttcattttttaaataccntaaaataaataaanacttttttccatttntttccattttatatcatcattattanatnnatatnnttnccaaattaaaaggttcaaaacaancttttnnccnacaaaaaatcagcttgtgggcaaacagcagcatttggaacaatttgaaaatttga

SEQ ID NO: 14243 - DNA, 2859 bp, Heterodera glycines
cgtaccctcctccaagttcccaaaaagtttttgaaaaaatcgcgctgtaaaaaacgtgtaaatagtcactccttttcccaaaaatgttctaaaataatgaaaaatgacaaaaaaagattttgataaaataattgaataattttttcaagcgaatatactaaaaacatttgtgaaataccttttacttggttaagaattaaaaaatttagcctattaaaatatttagaaatttttttattatattttatattttttgaaaaatttccgatttccgacgtttttggggtcggaattccgatttccgacttccgaaaatttttggggcctcggaatgccatccctgatagggactgccggaccccctgtccctagttttttgaaaaattgcaccgcaaaaaagtggttttgaaaagaaaaaaatagtcaaatttatgaaccgttaataatttgatttccgatcaactttttaccgtcggatccaatcgaaaaatcttagtcgacccatcagccccttttaatgcatcccgccagcccctaaaaatttatttttcagcattttttgatttttggaaatttattgaatttaattgaaattttttcgaattttccaaaatcccgcaatcccgcacgggatcccgcaaattttaaatgcgggatttgcgggattaatcccgcgggatcccgtcccgcaaaaaattttgagttccagtcccgcagcgggattcgcaaatttgaaatttgcggtctctagtaattaagcttataattatactttagagtcgtttgtctctttttcattaattataattatgataaatgcttaaaagattgagcaacaatcagagtcgtgggttcgacacccaccaggggttgtcaaattaaaaccacatttatttaaggttcagcccgctgctgaaagcagcagcggtagctcaagcagtggtagctacgacacacaggaggttggacattttgataatttaataaattcttttcaattaattacttcgctaattaagactcaaccgagcggcagcgatagcagcagcggtgcgtgcagtggagcttcttgcggagaagcggtaaaaaaacaaattctaaatttatttattacttttttggtaaaatgatttttgaaattattgttttttttttgcttttaagaatttagtaagtaatttttataaaaaagtttttttctaattctcaggctcagcctggcgccagcagcagctcctcatgcagtggtgcatcatgcggacaagcggtaacaatttgtataattttttgaaatatattttaaatatttatttttattatttgaaatttgtaaatttctttttttatatattatattagaaaatttaaaatatataattttcacttaaaattttataattttgtgttttttaattaaaaattaagaaagttgtttattttttaggctcagcctgccgccagcagcagctcctcatgcagcggcggcgcatgtggacagcaagtgagaaatttggaattttcaattttcatttttaaatttaaattttttttctatactagacttcttcatcttcctcctccacatcgtcatgttccacttgcggtctgaccagctacaacaacaattggtccagcaaaagcagttacaccacaagcaggtgggtgtttgatttagtggtgtttcgggaatacaaaatatacgggtcgaaaatttggtaaaaaattggcgaattttgtctaacccgaaccccctcgtgggatgaataaatgtatgacaagaatctaaaaaaaaaataatttgttagaatattaaattaattgcacttttttatattgtgtttttctctcaattagtcttcgagaacgagcgatgcttcttcaatcatatacgaagctgccgccaatttcccgactctagaaaggagtcctaagagatttttcacaaaatattcttaaaaaatatatataccgtttaccgtatttttttaaaatatgccctcgggggctctgggttcaaccccactcaaaagagggctctaatttagggggagggctgtattttagagaaaacgttattttatttagtaaaaatgaatttttctaggctaattattgtgaaaatgtcaatccgtgttttttttctgggttcagcgccgattcaaaaaatggtatccccgcgcgttcgggacaggaacaaataatgacattaaagcagagagatccgtaaccaaaatgttttccccatttaaagctccagcggcagtgccgcggcacccgcccccgtccccgcagccgcgccagccgcgggtggctacagtggcggtagctcagccggtggacactcctcctcctcttcctgctacgtgtgcggacgacacggcctcacctcctacccgcaaacgtcgtacacaacgcggacctacggtggcggaagcggatgcggaagcggcggctgtcgcagtctcggctgtccggtgtgcggcaagagatgaagcggcgcggacagccagcggcggcacacttttgatggaaatggaaacaaacaaaaaatgattttgttgagaaccttagtcaaccccgtggtgttttttctttgttaggagaaataaatttattgcattcattcgacagggcaataaaatttaaaaaataaataacaattaagcaatttctcatttcaaaaatttcagtcatggtcttgacgtttgagtatcggccgttgtctagtctcgatctcgaacatttggaacattttcggtcatgctaatgagtgtggactttaatcagtaaaattgtcatgaactacatatttataaagtgaattaatccaattatcattctgttggttcttttctttta

SEQ ID NO: 14244 - DNA, 3665 bp, Heterodera glycines
  misc_feature (3607)..(3607): n is a, c, g, or t
  misc_feature (3613)..(3613): n is a, c, g, or t
  misc_feature (3654)..(3654): n is a, c, g, or t
tgctatttttgtttcacacaacttgtgaatccaacctttcatcctgtcattgcggcaatgctggcaggaggcctgtccctaagcctcttgtgcttcatcttcaccatgtgttccatggtgggatacgccatggcaggactgagaatccttttttggattttctcagtcttgttcgcgcgcttattcaagccgcgaaaagagacatgggtattgagtgaggaggaggaaaacctcctctatcctcaccgacgaatacgccggcccaggccagcaacaagaaactgggccagtggccgagttagccaaatgacaatacttgtcatggcatctcttccgtttgtacacgggggaattgagacagtggccataatggccaaatcagagagctgtctcaacaacggcacaacgaaaatgtgccaagtcaagggaagcgtaacccttgcgcttctcccggcaggacaaccgaatgtcctgtcaatgaagaccgatgatggtctcattttgggaacccttcaagtgatcttgaaggggctctctctcgaatgccaagtatacaccaaggcttggaaacgatcatacgagatcgcttccgtggccagcaaacgatgtccgtcggctggctcatgtgtcggtgacttttgcacaaaagtccgaccctccacagccatccgagagctgagggagaccgaaacgttccccgggaacagtttctgcatcgacagcacggctttttggggaaaccaatgtctcctagcagccagttcatgtctcttctacaagtggtttgccaaaccacgctcatcagccatttacgaagtcatcggatgcaactcttgggagtttggcatccatattcaatttcgcctcgattctacaactggaagaagtaccacagtcgaaactgtgcttcttccaggccgtgtgctcaaatggcacaacatcagcatttcaacaataggggtgagccaagcaccgactcccctattgaacgctgacttcctgattgaaggacgaaatgtcgcccttgtccgtgaaagaatcacggactctctccattgtacagatttgaaagccgcccaagcttttaactgtactctgggaatcgacgcatgcacgggctgtcttcccgatcacacagacgggacagtctcgtgccattgtcgcgtcgccaatctcgagggactaatggaagaccttcagcggagacttccgctctcattccgccattacgagttgcggaatatcggaaggcggatattcgccataacctgatacagtccggtccaattgaacattcaaatggacagtctaagaatgtccatggaaatacaccagaatttgtgcaccataacaccaaagaacatctctgtttgttataaatgtgcgacgggagctcagttctcttagcacgtcgtgccatgtcatgtgcttggctgggagaaccaaattctccttgatgggacaactccactacatcccactccgacagcagtcagaatttggagctcgagtctctgaaagcctcgaagaggccagcaactcaggctgggctgactttagtttcgactggaagtccacttttcatgctctgtttggccttaaaacaggcctaattttcttcattgtcttgatgatcggcattgtgatcatcattttccgtggctgccattctctttttggcggccggaggatccttcggatgggaacctcgaaaaggggattctttccccgtttcatgcggggaattaagaatccccgaccccgaattttcattcagggaagcggaggggaatacagtacccctccatcaaaaaatcgattaccgtaatcgatcgccaaaattctatataaaagaaggaaatttgaagccattttcattccttcactatcatcaagccccaaacaacactcaacacctcagcaaactcatgccgattccgttccgagaacggccaccctttttctcggcaccaacaatcagccgaccaacaaacgaagtggtcattaatgatcgcctcgtcatcgacgtcatcggccaatacgaagcagagaaccagcagagagcaaacaatgctcctctgcccggggctgatgatgctcctccacccggggctgaagaccaaagaggcccctggtggtttgaccaggattgggggccccagctcccaatggtccctgaaaacagaggccaaaatcgccaaattggcgaacaacgaggcgattggggagccatgctcctcctcgacgggaaccatcgccccgtgaacacacggagcgactcaactcgtgggttgagcgacaccacggcgaacaatggtacgagacggctaccattcgccgtgacgcggaggaacacctccgccgagaactgcgcaccggtgccacgctttttgcggcacacctcggtccattcgcgaatgtccatttcgacgggttttcgcgctttggaccggctaacacgcaaatgtttccgggacggactgtccgggaacatttccggcggcgcgggttccaagtggacccgaatttgccatgcctccaagagtatgtaggcttcagcaatagccaacaaggaatccatgtcgattacttcccaatcgacatggtcaatgtacgatcccattcacgagaagatcaaaggaaggctgagccgcctcgtcctccccgaataagagcctatttggcagtggaggaggctcccaatgacgaccaagaggggcccaacaggggacccccggctcggcgtttcttcgaggccattggcctccgaagaggcaatgcgaatgttggtgaaagggcggaaaacaatggccgccaagcgcctctccaacgcggagagcgagccatggactatggccgcccaaattcaccggacggtagctttgagaatcgcctacgaagggcggtccccaaccgtccaatgcgccgttggcagaacggccttttcattgtggccgtggcgttgtgcctcgtcaatttggcggagggaaaagaattcccttcgccaaagacttgccatcagccgcttgaagcggcggacatggcacgtgaaaatcaatgggaattttcaccaatacttttcccattgccattttcccacgatcagacagcaaatctgatcaagggaccccgccccttaaacggcagtcaaccctatataaaggcagggattttccatgtccccacatcattccacaccccaaccatgcccaaacccatcaaatgccctctccaagcccagcacacccaagcagcgcccggccctctaccaaccactggactcatcagcacccccacatctcgccaaattcctacccctcccattggggcgccatcgaaagcgtacaggcaggaacaggatgtggaacgggcggagaaaggaattaaaaaatgaacaaacaactggagggaaaaagagccgtcacaccattcccctttcgccctttttgcattattttaatgctaaaatcaaattttgattttcgagtttcgacagcactaatggaacaagtttgtcttctctctgtttctctttaagagaattgaggctttatcagtgtgctagaaatggtttgtcaacttggggagacatcatcctcacattctngtatgngtcattcttgattcatacgaaactgattggaagcgaagttngtccctctccc

SEQ ID NO: 14245 - DNA, 2597 bp, Heterodera glycines
gattttgagcagcgaagaataatttttcggcttgtccgcttggctcaatgtccgttccgccgttggcaatgggacggccgaggaaaaagagggaattgagagaattcgggagcaaagaggtggagaagccgcgcagggacacttccgaaggccaatcggcacaattggggagtcgcgggacgaaaagaatggtcggaaaagctgaagagagagagaggggaaattgaaatgagagggggatttggggggattaaaaaaatgagaagatttatttgtaattcggtggcatacatccgtcttctgttgcgtcttctccgacaatggcacaacgagcggagcccaacaccacgcgcagaatgcgcgagatgcttcccgtgccatactgacgatgggtgggacccgcccaaagtgccgtccttcgcgaatggtcaatctgaagggcaaacaaacgaaggcaatgagcggacaaaacacagattaactgacagattggcactttcgctgttttattgaaaagtacaaccattttcacttttttgattttgtgccttttaatgaaatatttgctgggacgaagtccgaatagttaaataaacaatttatttaaataaaataatatttctatgaaatgttaatttttcatttttatattaaaacattcggctggcaaaaataagaatgatattatagtatttttaatttaaaaaattgatataatttctaagaattcattgaagaaaaatgcatttttgactttttaatttaaaaatatttttattaatgatttttttttgttaatgcgtaaatgtgttttaatgttaaggttgaaggaaatatttatcacctaatttttcaataattttttttaaataatacataaattctgtatagtgaaacaatgggaattttaggcacaaaaaatcgcaaaataggcacaacaataggcattataaaattgatcctagaagcttcaaatcaagctaatttcattttttgtgcttatctcatgcataattcggacttcgtcatagcgcggatcattccgtccatgcctttttaaatgaccgttttgatcactcgcctgaatcattcgttgcgatacatatccccctcctcctcctcctcctcctccccctcctcctcctcctcctccccctcctcctccgcctcctctttctctttctccttctcctctcctccctccttctgctccttcccctctttcgccttcgctttgtgtctgcgctttaaaatccaacaaaatcatctgttgcgtctcttgtcgccctccgtcctctccgttctctttgtcctccgtttttttctcattattcgtccaataaatggccaacggttggccaatgaaggaaaagccgatcagcggaaaaaggacagagcgattggagagcaaatcggtgcagcggagagagtggagacattccttaaacggaaggggaaggggagtggatttgatgatgataagcatgagggaagggggacaaaacgaacagtgccgaaaggctggtggacaaattgccaaagttgacggccgttgtcggaaaggacggagagggggagagagggaggggagaaacacatggaacagagaaaaagggggggagagaatggaagggagggatgaaaaggaagagggagaattggccaaaagaaacaaaaagagaagaaaaggaagtggataatgaaatgagaggaatttgctggagagagagagatgaggaaaaggaaaatgaaaaggggggaggcaatcgatgggggcgggggaagcgaagtctgttttaagttaaagtgcaatggcccagacagaccaatgagtcacgtgacagactggtgggacaaaaaaaggcggaaaggggaaaaaggaaacttttaaaaaaggaaaaaggaaagagaagagaagaaggaaaaggaaggagaagagaagaggaaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaggagaagagaagaaggaaaaggaaagagaagagaagaaggaaaaggaaagagaagagaagaaggaaaaggaaagagaagagaagaaggaaaaggaaggagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggaaagagaagagaagaaggaaaaggtaaagagaagagaagaaggaaaaggaaagagaagagaagaaggaa

SEQ ID NO: 14246 - DNA, 2233 bp, Heterodera glycines
caaaacaatcattaatttttactaaatttaacctagaaatagacaattttcaatgaaagtctgtttaaaatggtcaaaagttctaatttttctcccggcagcgccaatcgcaccgcccaaccccaaaaaataacgcacaatttttcttaacaaattgacccaaaatcgcaaaaattttgtctttttttggtgaaaatctgttaacaaatcacaatcaaattttcaaaattttccggcggcgcctatcggcaccgccggcccccgccccccttgtaccccaaaaagtttttttttgaaaaaccgccgcaaaaaaatggttttgaaaaacaaaaaactctattcttttgatttgcaagttgacaacctgttgttgaggatgtttttgaaaaaatgcataaattgcttaactgaaataataaatatttggataaaatcattccggggaaaaatagaattgtggaaaattttctttttattttttttgtttaaatttttatgtgtacttggatttcacaaatttcccccgttatgcacttggaaattggcatgcctgtacttggaaagtgacttggtacgatccgagccctgccataaatcattaattaattttggcatttattaaaaaaacaattaaagccaaaaattgtattaaaaattaattcacaaaaaaaaggtttattcaccccaatgaatggaggacacaaaatgaattttaaatttaaaaattaaattaaatttgtcttttaggagcctgttattgctgaagcatttggccgccaaaatttccccccgctgaaacaaattatgcgcaatgtttccctgctgtttacaaattcaaatcaagtcggacaaaaacataatgccaaaaattgtcggaaaattaattttttagttctttgaaatgccgagaccaatttcgaacaaaattataaacattggaggaatcgtggaaatgaaagtgaaagaattggaaccggtaaaaattatgggataaaataatttttaaaacatggaaatcaattctttagggaattaaagcgatcgtggataattccagggatggcacagtgatcgtttccttcggcacttttgccgatattaactcaatgaaaagggaaatgacaatggcatttttggaagcatttgcccattttccgaactatgaatttatatggaaagttgaattgtccgataaagatgccaaagtgtttgccaagtacaaaaatgtacaccccgtgaaatggatggaccaaaaatcgttgctcagtgagttaaaatggaaaaagattaaattaggctctgttccaattggcgcgtctaattagtgaccgtttttagtttattgggctacaacttttttttactttgcctaaattctcggctaaatgcaacagacaaaaaattattcttgaatttactataaaattctgaattccgcatttctcattgctattttctatgtcaagattttgatgttttcttgagtttctaaattccagagactgagaaatcgtttgataccaagaatcaacaatataggcattgaaaatattgtggcccaagaaactaaaacgatagttactgattggacgaataaactgaatagagccgaaaattctgttaacatttgatcaattaatacatatcaaatgcactacagttaattacccttaattgcctaataaatttccttttctaatttgaaatttcatttcaaagtgcatcccaaaatgcgggcctttgtctcccactgcggtttgaacagtgtcagtgaggcagtccaatttggagtgccaattttggccattccgttgcttggagaccaactgtacaatgccattatggcacgtgtgaaaggcattgctgtccaattggacgttggccaactcaacggggacggggccgaacagctgctggtcgatggacttgacaaggctaattagcaccagctaattatgtctttaataagttaattgcttttgcaggtgctaaatgacccctcttatagccaaaatgtcaaattgttgaaacaaaagtttgcttcaaccccttttggggccaaggaaaagctgatcagatgggtggaatttgctgccgaatttcccgacctaaacgagttgaatttgccgtgggaagaagagctcggcacattggcctattattctgtggacatcatttttttgattgttgcaatgttggcaatatttgcatggattcttttcaaattggcaaa

SEQ ID NO: 14247 - DNA, 1024 bp, Heterodera glycines
aaataaatataagaaaagtctattaaattacttagcacgtatttatttgtattggtttatttttcagaatatcacagatccgttggatgccatcgagagattttactttggtattacggatccatccggcaatcgttctgaatataaacaagaattcatttctcgctgtaaaggatattcatctcataggtctccgcatggtgttctgattgtgagtaatcggggttaattcggagtttgttgcggttgggaatgtgggatcggggatatccccaaaaaatgaccaaattgtcgggggccgggtgtgaaatatttgttacggcacaaaacaatgttttacagaaaatgaaacgtaacctattgctcaattgccgtttgccattaggcaacgagacggaaagttatgctgatgttcttgggctttttcacaagattgaaaagcaccttcataacatgtccatttcctcggaagaatacgaatttttaaaaaactgtaaatatttaaaattttatgatttaaaatagaaggcaaggatcgggatcgcgaccggcatttgttccagtttccttttttgggtctcggtccctttctcgtttttaaaacgcaaatcccgatcccggtaggcacggacttacgacaattaaaattcaatgttttgaatgtaaattttgggtcacttgtaagcccgattaatcttaatcacgatcccgacttatcaaaaaagcaaagcgcgttccagattcacaatgtcaatcccaaacccgctcccagctttcaaggcttttaaggtcctggttaaaattaataccgatcccgtacaaatctaattaaaaattaaaattttatttcatgtatattttcagcacttttggctaaatcaacgtgggtgcaagataaattaaaatcaagtagttcaaataatctaatgtttaagacgctactattctttattgaataaatactgctaaatatatttattaaaaaactttttaattaactcattttaaagattactttcgtttt

SEQ ID NO: 14248 - DNA, 3242 bp, Heterodera glycines
ctaattaattaattaccttcccttaggccactcttttgcccccgtcgttgcgcgtcctcaacccccagtcaaatgcggcccaattggtgatgaatgcgtcccattacattgcccagttgaccgccacggtgttcgcccgtgtcagcaacggcacattgcccgaaggcatgttaattacttgattaattattaattaattaattgtcactattttatttttatgttaccccattttttactcctatttgttaatcatttgtctttctttttcagttgcacttggtcaaattctgtccgtcgcttctcttcccgggccaatggctcagcccacgccccgtccccgtgccattcgccgcttttcgtgggtgccttcgcgaaggaagtcaatcaaaaaaagccgaaacctttgaatttatgagcaaattctaacgatttcataaatttattatgtactataatttaattttataaaatatatttttttcaaatgatctgcaaattaataagcacaatttttaatttgtcattcaaaaaatagaaaattataagaaaaggcattttatctgcaaatgggctagacattttctgctgctaattactctccgctattcctccttctttcgatcactccgctctctcacatttctccactatttcttttccttccaatcacttcgctctctctgttttctccgctatttcttttcctacaatcactccactctctcacttttctccactattttgtcttcttcagttgtgatttctttgatttcttcttcttctttcccgtcgtcatgactcatcataagcattggagggaatacgaactcgttgttgtttctgtcttggtctgtcggcacaaacaaaggttgacccctggcagtgtttgggcaacgcatcggacagaaattcgccgcctgtccaatttcaccgggcggcgcttgcggccccggcacaccgtacggacccggcttaaattccaaagttcaaatgatttaattaataattttgacaacctctcccggcattcccgtcggaccacgtagcccctgccttccgggctgaccggccatctttgatggacgacctgcgaggccggcaaagcccggagggcctttggcgcccggctgaccgggcgcccctttcacgccaatgccacctgaaaatggttccaatcaaaatgtgatcagttcaaaaagaaaacactgatcaagaacagaccgacgacattctctcccgctgcccccgctttgcccggcacgcccaattgaccccttttgcccagtgggcctctttttccaaagcctccgtctttgcccgatttgccgggcggtccgcctttgcctcggggccctgccgccccgggcaatccgcgctcgccttgcgttcctcgcagtccggggtaaccttaattagaacaaatatcgaaaattcgaatggaaccaccagaccagcggggcacacaatacacggcatgtctggcaacggattttcctgaatgtcagtgccatccacgccgggcactccgagccgtcccactgtgccggggatgccatcatcgcccggctggccgggcagaccagttggaccaactgggcaattcatacgtgcgcactctgtgaatggggcattaagcgatgtttcagtctctccgtctcgagaatgactctcgactttcggttggcattcctttgtttttttcttcaattgactattttagtcactttttactttggcatcctttcagtgcttgaaattcggcgccttttccaaatgctttcattgtttctttcgcttctgtgttccttctgctgaccaaatgacggagtgccgaagatgggtcaccactttttgtgacttttggaaatgccaaaaaaagaattttcggccaaattctttccgaatttgtcttaatggcatttcattatttattgaattttaaagtcattttaaaggaatgtgcttgccctaaaagctgccgcgttctgttcaatttccgcttggatctgctcaatttcccacaaaatgctatgcgtcgaccaaaggagggcacacaacgccaaacagctggcaccaatgccaattttggcgatcacttcggctggttggagcgcgttgaaatgtccactcattctgggaagaatgaaatgaataataataattaggtcggaatgatcagaatgaatgaccaacgagcggaatggcgactgatgaccagcaaatttggggcactgatcacaccaaaagggtaaacactgccccagcaaagtccgatcaaattcaaaagcgcaaaacaaaagaataatcaaagcataatttttcccctatgaagccacttcactccgaattggacaaatcacttttcactcatttaaacatttgcaatcgaattttttattttttgcaaaatattaaatgcaaaattatcaattccaacacattgatcaattaattgtcaatgcgcatgtgatatgcctttctttgtttccacatttggcccaggggtgctgttcactgatggcaaatgcttaacccccccccccccctccagcataccatttttcaaaattaaattgcattttggtccagtgccaacacaattggcacaactccaacgtctctttctctctgcttgccagtattttcctacattttctttggctttaccttttctcaaatgattctttccacccattttcgtcatttaaaagccgcactaattgcttatttgttagcccattttctgaattcattcccccgcccctttactccgtgccgggcccgttaatttttctcttttttttattcgcctatttttggtgaattttcaatttcttaaaatttttaccttaagagaaaatgtgcaaattttcctttaaatttgcttctatgggctttgtttttgttgtctgtttggtcaatcgtttgtttggcgttccgccaaaagggtccaaaagtgccggcccaagcagctcaagtgggaggaagaatttggtagtgattacggacatggagccggacgatcgaattgcgctggagatgattcactcgcaattggccgaacgcattttagccattggcacgacggtacttaacgcggaacgaaaggcggcattggtacggaacgcattggaggggacccaattggaaggtgtgaaagtgtttgtgggaagcggagggggagagaacgaatatccgctgatcagatcaacgaaagcagcattaacttatggggacaa

SEQ ID NO: 14249 - DNA, 2606 bp, Heterodera glycines
attttatgattttttacagatttttccggggaaaacggataccactttcaagcaaccgttttttcatgctctatcgattggtgtcattttcagaaaaatttttaaaattttttttggaaagaaaatttttggttggtaggcctcaatttcagttctgtggctataacttgtcaggagttgattttatcaaaaaatcgtctaagagcttttttgtagagaattttaagcccaatctaatgtgctttatctcatgtttttatcttgaatttaaaaaaagttatgaaattatattttattttaaaattcaaaaccatatgggggaccctttggttttacatttcatgaaaatattttttgctcttaaattatccaaaaaacatttttctggcctattttaatgtgctgatcttgaatatgcactttattttgggttgcagactttttggaaggtggttaaaaaatttttgaaaaattgtcaatttttgggcctccaaaaatcaagcggaatttcgaaaattcataactcacttcacttttggtcaattttaatgtaataaagctttaaaaatatagaaaaatcgggagaattttatgagatttatttgggatttctatcttccaaatattaaaagttattccagaaattctgaaaattttcgatttttcagaaaaaaattcagaactcggttctcaaaaaatattttataaaaataatatactcaaaaaatccgcaattttttgctctattttataaattttaattcctcttattatcacttttttgaaaaaagttatagaaataaaagtgattttgtaattcgggaccaaaggggtgtgaccatggtttttgagtggaaaaattttttcacccaaaatcttccaaaaatatgtctttaggggttatttgggccgttgatcatgaatacgtaatcagtttttacttttgacatcgttaagacctcagaatccctgtgtgattggggattctggggcttcattttgaggggggggggggggaagttcggagccgggtggtgtacattaattttctaccattttttttcgtgtttttcaatttttattcatttaaatgttttagttatttttttcgggttttgatttattttagtaggaaaaatttttttgtattttgattaaaaatttcgaaaaaaatttaaaatcttttattttagcttagaattatatcgagctatgtaaatcggccttttttgcttttcaaaaccctttaacggcgcatttaagttttaggctgtttcgctggtgaaatttagctcggtcaaattgatcgggcccggggccgggcttagccatttgaccgggaccgggccgcccggtcaaatcccgggcccggtttatccagaattctgtgttccggtcgtattttttgcttcccacaaaatttggattattgcttcccgttttttgccaatagattcgtgatgcctatatgtgttaactaacggtaaacgaactcaatatttcataaaatttgcataatgccatcatcattttcaggttttaaatttggcataaaaaactaattaattctttgaaattttcttatttaaataccagtaattcgataggtttattcattatatggcaatataaaatcaaataaactaaaatgaatttatatcattaatttggtaataaagttggcaaattaataaattatttatgttttttacatattctatcatattataattttaaaatagtataattcattttaaatcatatgaatataaatttaatttcttttttaatttataatttcttaatattttagaattgtttaattttttctcatttttactgaatttttaaagaccgcctggcccccgggcccgtccggtctttaataatcaatgcatgattttcattaattcaattattttatggtaattttcttttgctaaatttattttttgtaatttttgctttattttgagtgcatttatttatgttaataaaagtatttatttttctaaattatttatatctaattcaaaattttttaaatgcttacaacagaaatttaaatttgtaaatttattgaccgaagatgagtttgcatttttattattaattcatttaaaaattggttcataatttcggttaacaacaatacataattacgcggtgttattttgtcatttttctttctctggacattttgccacaaagcgaaagtcggacgattcgtcaccaatgccaccacagtgtcctcattctatgactgctaccccagacaaatggaagaaaagacggtgttttagagaaaaaaaatagtaaaggaatttctgttattgtttacttaaaaatattttgaaatatttctttgcaaagaattgttgttcagaaatttgattcagatagagtttaagaaggattgttttttctgcgacttaagatttttttctcttttttactaaatttagagatggatatttttgatcaaattttagaaaatttaaataaaacttacatgccaaaaaaaattccaaaaaagaataggacgggaggcggtgccaatgccaatgcaaatgtggcgggcggtggtgccaatgcaaatgtggcgg

SEQ ID NO: 14250 - DNA, 1617 bp, Heterodera glycines
gaaaatttttggggcctcgaaattccgacttccgaaatttttgatgaaaagtcggaatttttcggaattttttttgagttttttttttcaaaaaattagcaatttttgtacaatttatgttaataaattgcatagaaattttcaattttttttccgacggcacctatcggcaccgccggacccaaaaaaacttaattttcttgaaaatttgctcaaaatcgcaaaattttccattttttggacaaaatttgttaacaatttacattataaattacaaaatttttcccggcggcgcatatcggcaccgccggacctctccccctattacccaaattttctttggataaagcgcgccgcaaaaaaagggtgtaactttcccaaaaaaaatccaaaataatgtaaaattacttaaaatattttgatctttttaaaaaatatagaaataaactaaaaacagtttgaaattaccttttacatggttaaaaatttagcctattaaatatttttttaaaatttattattttttttgaaaaattccgacttccgagttccgacttccgacatttttggggtcggaattccgacttccgaaaatttttggggcatcggaattccgacttccgacttccgaaaatttttagtgcctcggaactccatccctggtgctggtggcggacgcggtggtggtggtggtggtgccgggcgcggaggtgatggcggtgaaggacgaaccaaaagaaaaaatgccgctggagttaagaagggttggaaaaaaaattgtgccggtggccgcggcagttgtgatcgtggggaccatggggggcaaggccgtggaggcggcggagggggagggagtcgtagcgtcacaatcaatttttattgaattgttaaatttttttgaaagttattaaacttttgttgaatttttggcactacttaaggtcaatctcaggaaaatttttaaactggaaatagaataaatattttattaataaaatatgtatttttgagttattttcaatgttttaattaatttaaaataattttgttttattaataataaataaatgttcaaatttaaattaaattattttttgatgaataaatattttgcattaaaaattgattatttacttattttttgaattaaacaatttataatcactgttgtacctcttctaaacaccgttttacctttctgatttcggttgcataagcgcattgatgctgtaagtttttacttttttcaattgatttcaaaatgttatttgccctaaaaattttgattgagcttttaatagaattttaaaattatggcaaacgcgaatttttcaaattttggcaagctgagttctttagggtttggaaaatcaatgatcagtagggatggcggtttttgtttattgattttttccttttttaacctcttttaaaaagcgttggcaccactaaaaaaagttttcgtgcctcctttttttgagcctattcctacttaaattgaaaagggttttatttaataattaataaataatttactttttttttaaataaaatttaatttttttttaaaaaaaaaaaatttcttttaactttttttgaagcaaaaattaaacaatt

SEQ ID NO: 14251 - DNA, 1618 bp, Heterodera glycines
  misc_feature (1487)..(1487): n is a, c, g, or t
  misc_feature (1515)..(1515): n is a, c, g, or t
attagtctaaatcttattaggtagtttcatggcacaaagatttctaagaattttgtccaaaaaatcagaataaaaattactgtctgcgtatttttctttcgatgcctatcggcaccacacgacccaaaacccattattttcttataaattaacaaaatatggacagttttgtgtataaattctgttgacaaattatatttcaaattttcaaaattttcccgacggcgcctatcggcaccgccggcctcccctccttgttcccaaaaattaaaaaaaaatgcactgcggaaaaattcttaaaaatctgatttttatgattccgatgcactttacgatttgctaatttacctcaaattgttaaaaatgatcatagaaggcgaaaatacaaaaataatattaattgattaattgtaaaaaaaactatttaagctatgttgttaaatgggtacttacttacctgttttgaaggcacataaatattctaagatttaaatgtttattaaatttttttgctcacctaatttttttcttgaaaattgttaaaaaaataaatgaaaaacttttataaatatctacttttcatttttaaacattgttgtaatataacctttgaataataatagcaaaatttgttttctaaaaagtatattttagtattattttttaaattgccataacatggacctaattcaaattaattaaaaatcttataaaaaaaaaatttttttcaaagtaaaattaaaaaaagttaatttaaagtagcctgtcatttaaaaattttattatcggaccaaattattaatgtgcattttcatttgatttattgaattaaaggaaattaaataattgaatgtactactgtataaaatttatttaaattgggaactgatacaccaattacgtgagatagagaaaagtagatgctcattaaaattaattcctaaaaataaaaaacattaattttaattaaaacttttttgaaaggaaatcaacgtctttttaaatatgaaaatcgatatatgaataaaaaattttcttttaagaaataattgaatttttatgactttttgcataaaattttttatttacaattgattttaaaaagaaaaaacttttctaaaatgaatcataatataataaaactcattaccttttaaaaaagattcattagaataacatagagttgagcttcggtaattgtaaaaaaaccggtaccgaccggtactgcaaaaaccggtaccggtaccaactttttcaaccggtaccggtaccggtaaaacccggtaattttccaacattaaaaattatttgccagaatttttcaaatacaatattacttttaacaaaaatcatcatcatttatttccaaataatcaatttataattctttttcttctgcatcgggctcagtagatggtgccaaaaacaactgatccatattcgccttgataagtaaaatttttgtgtcatttctccactcaggctanaaaattggccgaatttgaataagaatgnaaagaaattaccaaaacaagttgctttttcggcatactcaattgctcttggtgtcgctccatacattttttaattttggggtttcggcattctttagtccact

SEQ ID NO: 14252 - DNA, 1651 bp, Heterodera glycines
  misc_feature (47)..(47): n is a, c, g, or t
  misc_feature (99)..(99): n is a, c, g, or t
gaaattatttccatctcggcccatcgaggttttttgggtgcagacanaattccgggcatttcttggtctcttcaaaattgcattgccagcaaaactttnttctgctctttgaaagatgccaacattcggtaggtcgaattccatctcgtcggaactgacttaaaattggctcttttgccttccagataatttcagaaaggcattgatttttgatcgcatcttgaataaccaaatttaaaaaatggcaacaacactggaaacttaaaagggaacacggaaccattcaaaaataaatgataaaaattgcctgtccttatccaattggcgtgtggccgactgcatattacgagcgtcatcatgcacacatcacgcaattttatccaatgaaatccattttctgtcagacaatttgctattccttcagcaatcacttctccagaatggaaaaattcgtccataggaaaggcaccgagaacggcatcatttctgcagaaattatcatcaatccagtgaatggtcaggctaaaacggaaaaatttttctggctaaaggaaaaattatgaagattcacctttgtaattgaggtgaatgcgtgggtttagaccagccgtcgctcgtaattgcaaaatgtccatcaccaattcccgttctaattgcatggcgaatttgatcagccattcgagggatcactttacgtcgaaagtgatcgcggcctccaaattcctaaaataatgaaaactgaaaaccaaaaatgacaaaaaaataccaaattaggaaatgccttctttgtcaaattcctcaaatccgggtcctcaacaaataaaaacgagttgttttggcgaatcataattcgcacaatactctcttccgcttcttccagttcatttttctttggaaccacataattgtcaattcggcgctgtttctaaaatagtaaatcaaaaaatttaaaaagcttattggttaaccttttgttcttgcttttcaagcaaattccaggatttcaactcagtaaattgttgtttgtgtcttgcctccaagtgtttccacatgcccattgttgatccatcatttctgacaatttttttcccgcatacattacataatgctttatcattcgatgatttgtcgaaatatttccaaatgtcagacatttattggatttggattaccaaaactaaaatcatgattctcttgtacaatggattaatcagggataagaaattttaaaaccaaatattattaatcttcaatgaattaatatgacgaaataaaataagattgtttttaaaatgataaaatttggcgaaatgttctatttttataaaatttttcgtttccctaaattttgcatcattcattttgtgctaaactcctatttttaacagtgcaaatttttaccggcggttaccggtactggggggggggaattccccgaaatgaaaatttttaaaaattttcaagcaattaaaaattttcagatcacatccctgcctgcctaacagagttttcgatgcgccgaatgttatctaattgataaattctgacttaagctgaaagcttccgctactgttcaaaaatcattcaaaatattataatatttttttataaatgtagaaatttatcttttctgctgtgcttacttaactaa

SEQ ID NO: 14253 - DNA, 973 bp, Heterodera glycines
ctaatgcaattaaattcgaatacaagaaaaggtgggaaaaacggtcacaaataattaaacataatgccaaacaaatataaaaaataaaataaaggtcaaaaagtccaacagaaagaaattattataatattaatatttcacaaattaacgaaaaaaaataattttaaaaaccaattacgaataataatctttttaataatagactgatttaaaaatgaaaataaagttttaaaaattttatttaaatgaaaaggctattttaataattaaaatttaaaaaagaataagctaaaaaagaacattatgataggttcacaaagattgatttgataaaaaaaattgatcagatattccaaaatcaaaaaaaaaaaaaaattatttttaatattaaacaagagcaccaagaaaaagaaaaatcaacagatggtctgctcgagatgataaaatatttaaatgtcttacgcattggaattatttatttgtatttccaggtaagattttcattcattataatatatgctataaataactactgataaacaataatacaagtatattaattaatgcaggattctgaaataaataatatgttaattaaataataagaatgtgcaaagcaaaaccataattcattttttaattaatgcttaaaatataatgaaattatttaaaaacaattataaagtgtcgacaatcagaaacatcgaatcagcagcacgattgaaattaattcttataataaattcagcgagtacaattaaaattaaacaaataataataaaaaaattatattaaaattcaatttatataattgtttatgatggtgcttgcgcgttacgccaccagtcgcgttttataaatccgccacctaacaattcgcgttttataaatccgccacctaacaattcacgttttataaatccgccacctaacaattcgcgttttataaatccgccagtagcgttttataaat

SEQ ID NO: 14254 - DNA, 3173 bp, Heterodera glycines
tttctgttcctcttccactttctcttccactttctgttcctcttccagtttctcttcaactttctgttcctcttccactttctcttccactttctgttcctcttccagtttctcttcaactttctgttcctcttccactttctcttccactttctgttcgtcttccacttcctcttccactttctcttcactttctgttcctcttccactttctcttccactttctgttcctcttccactttctcttccactttctgttcctcttccactttctgttcctcttccactttgtcttccactttatgttcctcttccactttctgtctctcttccacgttctgttcctcttcctctttccttcctcttcttctttttcttcctctttctcgttctcttcctatttctcgttctcttcctcttcctctttccttcctctttctgttcctcttccactttctcttccactttctgttcctcttccactttatcttccactttctgttcctcttccactttatcttccactttctcttccgctttctgttcctcttccactttctgttcctcttccactttctgttcgacttccactttctgttcctcttcctctttctcttcctcttccactttctgttcctcttccactttctgttcctcttccactttctcttcctcttacaatttctgttcctcttccactttctcttccactttctgttcctcttcctctttctgttcctcttcctctttctgttcctcttccactttccttcctcttctttttcttcctctttctcgttctcttcctatttctcgttctcttcctctttccttcctcttccactttctggtcctcttccactttttcttccactttttgttcctcttccacttactgttcctcttccactttctgttcctcttccactttctcttcctcccgtacccggtttaaaaacttggacccggacccggcttttctggacccggaaatatccggacccggttttgcccaaatacccggattcgtctaaccctaaaattaactcattttgagatttataaattatttaaatatttattaatatttgtttatttttaatttttattcgattaattttaatatttaatttagactttattattctattaattataaatatttattattttattaattcaaaaaacattatcattaatttaaaataccataaagttaattaattaaaaaaataaatttaaaaaaacataatttcaatataatatttgctttaaaatatcagaagaaatgggactctaacccatggcaagccagcaccaaaggaaggcacactaactacttgaccaccggatcgcttgcctccttttaatttccttttcactttccttcttttttggcataaaatatttataattttatgtttaggtaacttattaatttgtctccatttttaaatgattttgcacaaaaaaggtcaaacaatagatttttgggctaaattagaaagaaagaattattatttttaatatttaaaataaattatttttaataaacttaattaattaaaaaaaataaaatcattcaaaaaatttaataaaataatggatgaaaacacccagaataggtgggacccgaaccgtcgaccaccaccaccaatggcaaaaactaaaaatgtatgctattaaaacagcaataatttagttggaaatatatattgaataaaagtaggagcagtaaaaaactgatgtaaatggaaacaattgataatgaactggggaaagaaaaggaggagacattttttgctgattgaaaaggcgaggttaaagaccactggcgagtgtgcattacatataaaaaaaggaaagaaaagaaagtaatcaatttttatccaaaagtactttgctccatatttttttattatgcctttctttctcttttaattgagcatcgtcgaacctgcaaaacgcaaaaataaatctttgtttaattaatccaatttaaaaaataattataaccaagccaagctgggcataatttttaagtctaacaagggaatcaccggtactagtgcagttgatacgccacaaaagttttttttaaagtcgtataaaaatgtttccagggttttcgaggacgctgttttctgaatccgacctccatttcgaccaattcagtatcccggactcaaactcaaagatttggtcgaaaagtcaaaaattctcaaaaaaatttaccaaataaatatgatcaacaatatgtcaaaaattagagcaatttatttttgaatggacaattttttttcgtcaagttgcttatctaaaaagttaaagcacagctattccactgaaatgggccacttaaataatttcattgcttaaaaacttcatgaaaaagttttttgacttttcgaccaaatgttcgggtttgaatctgtgactctgaattggtcgaaatggatgacttttcgaccaaatgttcgggtttgaatctgggactctgaattggtcgaaatggaggtcagatgcaccgaacaaagtcaccctaaagataagaaaccgaaaagatgacctcggcattttgttgctgtacgcaattagacagcaaagtcggctggaactttttgaatgtccttgacggatttctgttcccgttggcccttgggaaaggcactttaaataaaaattggaaaaaggtctactgtagttaaaaaatgtattgtggtttgtctattgtgttgtggttagtatgggctcaaaattctgcgcctcctcgcggtgagtctggaaacagagttaatttttaaaatattaattaattttttttgcaatggaattaactctggctaaagcagacgtaattttgtctaattttgtggcttagaattaaatttttaaatttttttttgttttattgaaatccccaaatgtcgggtccctaaatgtcgggttgccaaatgtccgtggttttcttaactgtcttttgctcaaatgtcgttcggtccccaaatgtcgggtccccaaatgtcgggatcccaaaaagtcgggtccccaaatgtcgggatccccaaatgtcgggatccctaagtgtcggatccccaaaagtcgggtcccaaatgtcgggatccccaaatgtcgggtccccaagttgcaaatccccaaaagtcgccacacgg

SEQ ID NO: 14255 - DNA, 3072 bp, Heterodera glycines
  misc_feature (65)..(66): n is a, c, g, or t
  misc_feature (201)..(201): n is a, c, g, or t
  misc_feature (2799)..(2799): n is a, c, g, or t
  misc_feature (2801)..(2801): n is a, c, g, or t
  misc_feature (2809)..(2809): n is a, c, g, or t
  misc_feature (2811)..(2811): n is a, c, g, or t
  misc_feature (2813)..(2814): n is a, c, g, or t
  misc_feature (2817)..(2817): n is a, c, g, or t
  misc_feature (2819)..(2819): n is a, c, g, or t
  misc_feature (2830)..(2830): n is a, c, g, or t
  misc_feature (2838)..(2838): n is a, c, g, or t
  misc_feature (2840)..(2840): n is a, c, g, or t
  misc_feature (2846)..(2846): n is a, c, g, or t
  misc_feature (2850)..(2850): n is a, c, g, or t
  misc_feature (2864)..(2864): n is a, c, g, or t
  misc_feature (2892)..(2892): n is a, c, g, or t
  misc_feature (2898)..(2898): n is a, c, g, or t
  misc_feature (2900)..(2900): n is a, c, g, or t
  misc_feature (2914)..(2914): n is a, c, g, or t
  misc_feature (2924)..(2924): n is a, c, g, or t
  misc_feature (2930)..(2933): n is a, c, g, or t
  misc_feature (2937)..(2938): n is a, c, g, or t
  misc_feature (2940)..(2940): n is a, c, g, or t
  misc_feature (2943)..(2944): n is a, c, g, or t
  misc_feature (2946)..(2946): n is a, c, g, or t
  misc_feature (2956)..(2956): n is a, c, g, or t
  misc_feature (2964)..(2964): n is a, c, g, or t
  misc_feature (2977)..(2977): n is a, c, g, or t
  misc_feature (2998)..(2998): n is a, c, g, or t
  misc_feature (3003)..(3005): n is a, c, g, or t
  misc_feature (3016)..(3016): n is a, c, g, or t
agaggcgaacaattaattaattaattattggattagcaccaatttgttagtttgaatcaggcccnnccacccatatccacaaaaaaagagagagcacatgaccatcaaatcatttttaaaagcttcatttgctattttatagtggaatgttttttaagtgtcatttgtcagtaaatttaaccaaaaattttctatttaacnccagaaaagtgtacataattcttccgttggcaaatgcctgtcccattttcgactgattatgaatgcatttctgcgcctaatttttacctaaaatgaacgaccgaccgccccggcatagacgaaagtcaacacatcttcgaaatgcgaccaatcatgcaacaaaaaagcatttcgaatatcccattttcagttgccaattgaaacgcgtggccccacttacaccgacccaatcgctttgtttggcatgtgtttggaggactacgcctactttttggtccgttttgaacatttataaattcttgaaaattaaaaaccgttatttaccctttccatggcattaaaaggtcttaaaatttttcattttcaggttgaccattacgcggacacgcggctggaggaggcggaggaatacataaaagaagcgctaaaggtcggcctcttttttgtttttaaggggggactcggatttttgcctattttcgtcaactccaaccaccaattcccccatttttaggtgtcttttcaaatttttggtctcagtgcgacccattcgctgaatttgttgtgcacttttgggtcaaaatgcattttgcagaataagtgagccctttatttatttaataaatttagccaaatctttaaaaaataaacattttttcaaaggtttgaaacggcgcgcaattttctcgaacttggcgtcaaaagggtgacgctgctgcccgaaaccgagtgagtaaaaagtttttagaaattttatcattttctaaatttttcccctcccccaaaaaaggccgaccattttgctgtccttttactgctgctacgctgaggcgctgttccacaccggcgacatcgaacgtgcgcttgactacgccaagcgggcgcaaaaactgtcgcaagggagtgacattgatgcggctgtgcgggcgtacgtgcgcgacttctcacggcaaatcgaacgcgacacactgcggtgagcagagagagtggcagagaaatggagaaaaagtcaaggggcgaaaagacaatgggcaacagttaggggaggaatcagagaaatagagaaaaacgaaagagtggattaggctaggtctaaactttcggctaggcataaggtttaggattaggcctaacaaaagcttatttaaaatttcatcggcaagattttggggtgctcccgcgaggcgcagggaaaattagcgggaattcctttttaatttttcaatttgtttctgtttttccctttatggcttttgccctttctgttcagggcatctgttcggtcaaacaacgaaaggacggcttcttcttcttcttcttcttcttcttcttcaacttcactttctgcagagggcgcagaaggcacagaaaagggaatttcgaattggctgtggcccttcaaataatttaaaaaattgttttgcctaattttgcatcgttttttataaacaaatttgttttggcaaaagtgaagaattcattcccatccattcgtctcttcttatccatcggttgggcttataatagccgaatcaactgaacattcattcattcatttggatggcataaaccttcacttttgcatttgcaaacattcttttttttgtttgatagatgcgtgtaaaatcaatgccttcgttgataaaacaataataaattgtacaatttgctgctacctcctattaaattaaatcaaaaatacattaataaattattattttttaaattgttattttatttagaaattttaagaaacaaaaaattttttcttgttaataaaattgattagggttgggcccccgaccccgccccgaccccgaaccccgacttttttgcccatttttcggggttagaccccgaccccgacgctcccaaccccgaccccgacccttaaccccgactcggggtcggggttaaatatacacccctaggaatggcatttttgtgggagaaaaagcaaaaaatatatacaaattttgaatttattaaccattttgccaaatttttataaaataaagtaatttgcttttatcaattcaaatgcagtagtggcgtagtggttagtgtgttaacactaacacaacttttgtcgtgagttcgatcctggttgactgcctctttttaaattattttttttgtaattaatagggttttttaaaataaaaatacccataaaaattggtcatcattggcataatttattgacaaattaaacccaattttcctttcgttgaaattaaaaaaatttaattttccttgactaaatcatgaaaagtttatattttacaaaatataaagagaaattcataattttttggtgaaaactgtttgaaaaaagagcttaaaatttaaaattcgcccggcgttgcctatcggcatcgccgacccctcaaaaacctgaaaattttgctcaaaatcaaaaaaatttataattttttggacaaaatctgttacagatccatccaaatttcaaaatttttccccggcggcgcctatcggcaccgccggacccctttctcctaaaagtctttaaaaacgcgccgcaaaaaaaaatgattttaaaaacaaaaaacttttcggggaacaaggggccggcantntctataancncnnccncnaaaaatttttnaaaattananaattanaatncaatttattaactnatttcaccaaaaataaccaattttttcnactttnanccaaatttttttanaaaaaatttntttttnnnncccnncnccnnancaaaaatttnaaattttnactatttttacanattttcactaaaaaaggttcnttttnnnatcccttatcntttttaataacttttgaaggaaaataattatgaataaaaagaaataaaaaaataca

SEQ ID NO: 14256 - DNA, 3277 bp, Heterodera glycines
  misc_feature (896)..(896): n is a, c, g, or t
  misc_feature (931)..(931): n is a, c, g, or t
  misc_feature (936)..(936): n is a, c, g, or t
  misc_feature (945)..(945): n is a, c, g, or t
aattcaaatttttgaattaaataagaattttataaacaaattattagtaagagtcagatattgcaacttaagcgattcagggagtaggctgccatgcttctaacaacataaaatacaatatttaaaatattaactattcagcaattaatcgcgacatataaaagaaagtttaaattatatgcttaaaataataaaaatactaaaatactacaaaaatccgcaatacccgcggtgggacttgaacccacgaccccagcaatccgtgccgtgctctaaccaactgagctacgcaggcatccactccttcactctcatttccccctatctttggggcgaaatcactctctttatcccacactgccacataggcacaagggggaagagtgccgcatttatcacattatcacttttttgagaattgttataaaaataaaaatgacttttggattcgggaccaaagaggtgtgaccaggatttttgagtggaaaattttttttcacaaaatctaccaaaaatatgtctttaggggttataaaatacgcccctataatcatattataaattaagattatattatattttagaaaaagaaaatataaataaattttctgaatttattctaaaaatttatattttcctattattgttaataattattaattttaaattaattattagtaattagagaataaaaaaattatattataatgtgggatcttgaagaatgcaaaaactatgaacgagcacatgaaattaaaaaaaatagttcatgttgcaatttcatgattaatattgatatatataaatttaaaaattaaaaggaaatattaaataaaaactaataattgtggattattaaaaagtttatttaaataataaattcttttattatattntaccataataataataattagtaatcttaaaaatntcatntattaaatntaaatgaaatataataatattaaatgaattttaaaataaaaaataaaataatttgattttagtttttgtaaattgttgtaaattttttgataaattatttaatgttaattatttcaaattcctatttattcgcatatattttagtgacaaagtttgaataaaaatattttgtaaaaaaagctaaaattgtaaaaatggcataagaacattaataaataatgaatgatgatagataaaaagattattattaaaaatcaataaacattatttaacaagatatgaacaaaacacaatcaatgatttgataaaatcgacgaaatacaatgatataaaattgcttttttatttttagtatttaatatacatacatttttatttccaattgaattactctatttgaatattttagtcaatttttaaatcatattcaatagtcagaaaaagaaaaaatatttctaaaaaaattataaattagaagaaaatatcaaaaaaaaaaatttgtccacgaactgttgagtgatttttcgtactttgtaaattgccattgatttgtcttctcgtagtttgtaataatatttttccttgagaattgataggctatgttcagggttcgcagatgaaattatcaaaagcctcatttggcaggcaaaaaagcctcattttgggtcaaaagcctcattttcacaaattattcaaaacacgtttaaaatgttcaaatgttatattttctattgtccatgatcaattgcaattttttcttagaactaagcattttgtgaaattatgagcatgaaaaatcgaagttgatttttgcggcgctttttccaattttttgggggaacaggggggtccggtttaataatttgtgttatacatattatttaaataattcaattttttactgacgatatcccggtcccggttttacaaaaaaaaaaaattaattttttaaaaatgtttctaaccagcacgagcaacacttgcagcagtggcaacagctaaaaaatatacagatttttttaattgaattttttcggaacttttaaggtttaaataccccgatgaaaaaccattaagggctgggggccttttaattttaattttttataatattttttcattttcaaggtcatgaccgaaactcaagactccctaatatagttttttttatcgggataattaaactgtaattaagtgccttttttgcaaacttaccaacagccggcttcactttcgcgcacagttgcaaccacaaagacaagcacagccagcgatatgctcgtgatcaaagacatttttatttaattttttgttttagaaatcaaatttaaaatattattttttttaatgatttttaattgagtaattaatttttgagtaattaattgtgtgatgctctgttgagtgatcggcgcgattaaatacctatacacaaaacacctcctgtcccaaagcccacccacataatgggccattgtcaaattttcaacacattgttttggcccgatcggctcgatcattctcattcattcatgctttatatttagtcattattgtttcaattacttaggtatattagcatgtttttgtacaaataaagccaaggacgatgattacagaatagattaatcatcatttttgggtcctctgtttgatcagtgatcgctgctaccaaacaaatttatttatggtcaaaaagcaattcgtcgtcgcccggggggacgagcaaaagcgaatcgggaggagagaaactttctcctttcctgcccattcatttgttgaatgtatgtacaaaaatccacaataatagatgtacaaacatcataatgatgaattgaagatgacggcgattaatgaagcaattagtagacactttgtcacttttcgagtaatttcattcattcatttagatggacggcaaccataagaacagttaaaaaaataattaaaattttgatgtggaaattttaaaaatttgctgaaaattaaaaatgtgaattaaacaattgaattttacaaatataaacaggataagagagaaaatagaaaaaattttagtaataaattgacaaaactttttaaaaaatttttccacttaaccaatttgttaaaattcaataaaaatctccaatggtataatctttaaggcattaattttagccatttcataattataaattaaattcgataattctaattagctctaaaattgattttaaatgcatgaaaacactgaaatccaacaaaaaaattccctatataaaatgccaatcacggatcaaaattattgaaaaattgaaaaaatccgtgagccgtgatcacggccagccct

SEQ ID NO: 14257 - DNA, 2838 bp, Heterodera glycines
  misc_feature (64)..(64): n is a, c, g, or t
  misc_feature (73)..(73): n is a, c, g, or t
aaaataatgattagtttttaaaatgttttttttccattaattcacattttattaaaatggtccnccatgaaanaatattataaaataaaagaaaaaaataagtaaaaaggaagaaaatactcaagaaaagaatggaataaaattgaagaaaaaataacgaataattttatactgcgtatagcaaattgtttcttccatttctcaattattctttgactaactccaattttcttacaaatttcggcataattttgtttccattctttggtcgaatattttcttttctctttaagctcatttgccatttcaatgaatttttgtacaatttctaacttttcttcatccgtttttgatttatagcttttctttatttgtttttgaagccccaattctttaatccattcataaatatttttgcgatatgtccccatttttttcgcaatttttctttcaattttattccattcttttcttgggtattttcttcctttttgctttattttctcttttattttataaaattttgcaattatttctctttttttgagttcatttcgcctttcttcttccttttcttcccatttttctccaaaaatttcgtcaaatgacttttgtttcaattttttcttctctgctccaaattggtcaattttgataattaaaattacaattaaaaagaatagtggtaataatttcatttctttaaaaatattctcaaattggatatttttttaaaaagaatgatttttattattgatgggtatttatttatgcaaaaattttctgtttaaacaaactacaaaacattaaaataatcttagagctctgaaaaatatttttaaaaataaaaaattgtgatttatattatttattttttattctaatgcagggcttccatcgaaaaaatttcaaaataagaacatacaggccataaaataagattttagggtcaaaaataagaacatttaacaaaaaatacttaaatcgcttgtataacactttatacaattaatatattatcaacttttgtatttttcgcctccaattatcatttttaacgattttgggaagtaaattagcaaattcagtgcatttttaatctaaaaaaacaaattttttgcggcgcatttttccaaggaattttggagaacgggggatgggagtgggtccggcggtgccgataggcgccgcctgaaaaatttttgtaatttctttgcggataatcgaatggatgagaacgccttccaggaatggcttttatctgctccatctccgcttaaactccgcctaacgagagcaattaaacttctcaggcgccgcaaaaatgaaataatctcgctgacgaaagtgcggcggcacgtgatcacgtgaatattcttatggcgtgagaaacgaaagaaaaatgaatgaagtgaactttggaactctgaaaattgtaactcatacggtaaacaaaataatagggcataattttcatttttcaattggttctctattttcagccagttaaaatcgcacccctttgattggttatcagcccgggcctttttgctttaccgcaatttatttctcctttttttgtctcactttttctctctctttttttgtttttggcctctttctctcttgtttctggcctctcattcgttcaaaaagtttttaaattggtcagttattcggctgctactaggcctttttttggttatttttggcttctttaattcctctcttttctctcatccttacaaatacgcccctttagcgtttagaaagactgggcacatttttgtgtacctctttctcttcgtttttcagtgtccctttagttttcaactagcccggacagattttctcaattcttttctttaaaagtccctttagtcttcgactagcccggacaactttaaatctcagacttctttacttgcgtgtacacgtctttgtttctagccctcaggccaggcagatctcccacaaacttctgccggcttacccaattctcagcttcgtcgtcaatgatgggtcgtttctcaaaatgggaaccatccggtgctaccagtgagggatgcgcactgtgccctaagaccaactatgcaccgtttatcccggatggaatttgggagggaatgaggaaaagccaaggcgcctttgaccaagccccgaacccccaaacgactcattgactgttaaagatgtgtttattcattcgttgttggatttacagaagcgagaaattggaataataatttaagtctgttccataaataactgactaactgatcactggggaaggagaaaatgcgaagagaatgggcggagaaacattacaatgagaaaaggaaaaacgtgtgaaatggataaatgtgattgaattgataatggccaataggaaataatgaaatgagggaaatgcgtcgaataatccttacaaaaataaaagaaaaaataaaggaaagaggaagaaaatattcaaaataaaaaatggaataaatttattcaaaaatagcgaaaaaattgggaacaaaccaaaagaaaatttatcaattgacaaaataaagcgaagatttataaattttggcgaaaaatgagagataaaaaaatcggaaattttccatttttgacttatttctgcataaattaccaattttttataaatttattttcctattatatttttcgagaaaaaacacctaaaaaaatatgatgtaacgacaatgatttggattttatttttaagactttgattgagtcttaaaattatttacaatattaaaatttttaatactttattattgcgtcatttgaataaaaaaaataccaaataacaaaatacaattt

SEQ ID NO: 14258 - DNA, 4583 bp, Heterodera glycines
taaaaatgttctactttgtttgaagcttctaacatacatttttgtgactttttttgacttttttatactttttgggattttatgacttttttgcgtttttgtgactttttttcgtgactttttacactttttaatgcaaaaaattgagttttattgataaaatttcgaaaaataagtctatattcgagatggtactcaaatttcttataccattagtaaaaatgtcgatactgaaaaataaaattaaatctggcgattgtaatatgaatagagcccggatttttaggtgctaaaaatcccaaaataggtactaaaataggtgctaaaaaatgtgcaaaataggtgctaaaaacccgcaaaaaggccaaaataggtgcgaaaataggtgttaaaaattggaaaaatccagtgtctttatgtacaaaaattccaaaagtgactaattttttatcaatttcgcccacacaattgcaattggtcaagaaaataaataataaatattgtggacgaatttttgggaaaattttttgtttcttaggggatattttatgaaattttgatcaatctttaggggtatatttaaaaaaaaattttggacaggttcttagggggtgtgtttttcaattttattgcatttttgctatgaaatttctggaaaaaggccaaaataggtgctaaaactcgaaaaatgccaaaataggtgctattgaccgaaaatccagttttaggtaattttaggtgctaaaaagtcgctctaaatcgaaaattgttcggagaaaatgctatttttgggcttctctcatcataacaaagccgcaaaaaaaataggtaaaaacctaaaaatcccagctctatttatgaattttaattttattcaaaaaatttaaaaatatttttcgaattaaaaaaccaaaattataaaaatattcgaacccaaaaaagtatcagtgatagtaatatttaaattgcatcattaaaaaagatcccaacttagttaacctaagtaaactttaaaaattttaaattttttcaaaaagtttgtaggaattattgaatgttgctttttcgaattttttttttagatacaactaatatttgctagaatttaaaaagatagagagaaaagctatcactccataccgagattgtaaatctaaataattaatttaaatattactttcatttataacttttttaggttctccccattttagattttttttgattcagttcgacctagcaccttccccaacattcccttacgtaattgaacggcctttgccgtctgttgcgtggcaatttcggccgaggcgatcagcagcaacgaatttaagacgaagaagacgagcattttcatcaacattctttgattttgatttatgtgatgacgaatacaaaatgttgggccaaagatgatgatgatgatgatggcggcggaggagaattttcaaaatttggtccgccgctttttatacgccgccgtttccgatcagaaaattccgcccaccgcccaattccgatcactttccaaatggccttgggccccttttcccaatcactccgatcgctcccttccctttctcgccaaagtggtcgaagaacaaattttttacagcaacaaaaactattccatttaatctcgcgcatattcaatcattttggtgcataatttgggaaagaaagagaaaacccaaagatttggaaattaaaaaaatgagtcaaaaaaggctatatgatgacattgatttccttcaaccgttttgagtttttgtacgaaaattgttttgttaatgaaaggaaacatttatttcatttagaaaaaatattacaaataaatttgttttttaatatatgaacacctaatcgactttaaattaaacaaaactaaaatttttgtaaattaaataaaaattatctataaagaaaagcattgtatgtactaaaaacaccgacttgaaaaataatattctttaaaaagcatgactaaaaacgaatgaaaaagcctctaaatattttttgaaaaataatattctttaaaaagcatgactaaaaacgaatgaaaaagcctttaaatattttttgtcacaaaaaatccaagcaaattcgaagttagaaccaaaaattttgtaattttgcttctaattagggggttcagaaactaaaaattccgtctccctaatcagagagtaagaagttattcgaaaataaataacaattcgaatataaaaatttctcaataatacgaaaaaaaaatgttttaccttgacctaaaaataggatgaatgtacaaatatttttttgtaaaaaagtaaattttctccataaattgtgccacccagcagcaaaaaaaagcaattaggtaattagcaaaaaattcggttgaatttggtacattaaacggagtcccacacttattttttgtcaaggttaaattattgaacaattagtttttttgtttagccccaattttttacaatattttttaaacaaaatcatttttaattatgttttttttaaacagtttaaaagaattgtggtgatatcatcgtttattttttttaatttgaatgtgtattttaattaagtttatccatttattgaaacaacaacaacaaataaaatccaaaagtcaataataaaggaattaaaataggcaataaaataaattaatagtaataaataaaaatagcgaaaaggaggaaaatatgagaatatgtagaaaaatcgtaaagtgagagaatttcaggtaaaaatgctgtagaatgggaatatgcatttgcgtctaaacaggaaaaagttgtgcctttggactggacataaatgggcgcaatttctgatcaaattcaagcggtgccgatcgccgccgggaaaattttgaatttatttctcaaataaaaattctcaaatacttagtaaataaatataggcagctggaagcagtgcttttgttgccaaattagaaagcattttgtgactcacaaaatttgatcaaaaattacgatcagattgcgcaaaaaacggatataaaaattgaaggattacggaaggtcaccacgaagtcaaaaagcccaagtcaatgcaaatgctaaaaaaaatccgtcgaaggcaaattctgctccatataaggcgcatctaaaaatgccaataaaattggaaagtgaaatagaacaagcctttagtaggaagccgagatggaacccaaaaaaatctcataaatcggaatttcgactcaaaaaatttcggaaagcataattccgtacaatccctggtatatttatccactgaaaaaagcccaaaggttcacaaaaccaacaaaaaaaaacaaaattttttttggcgacagacagaatgccaaattcactcatttccactcactttttatgagtttgtctcgtccagaaaggtttgacgagccgacatttgcacggtgggcttgaatttcatctggccatacttggagggccaatagttgcccaaattttcgtcaatttggttgcaggcccagcacacgtgccatgccacctgaaaactcttagcatttttttttgtatgtaagaaggggccttgtccttggaaactttttcattttaacgaaaaaataataaggccacgaagatggttttatttcctctataattaaaacaaaaaaaaaaaaaaaacaaattcttcatttcggcgtaaatctcttaacaatttcaaaaaaaaaaatttcctcgacaccgcagggaataaataaaattccgtttgattttgtttgaaatacattttccattttggacaaaagtctttaaaaaatttatttaaaaaagtttctcaatttccagtcatagaattttcaggcctgccggcattgttatcataaagggccccaaaaaatgggagaccccccttcaaggtgagtggaggaaaatttttaaaactcgaacaaatttttttaaacaaaacttcattaaaacatggctaaaatttccctttttccaatggctcaaaaaatcaaggaacatcaaaaaatttttatgtgcctaaagagcaaaaaaaattaaaaataaataaataaaaaattgaaattttcgactcctcttcacctcgggcgtcggcaacagtgcgtacacaaacaacgaattgtgcgagccgttgtatggcattatgctgtttcgaccaaagcgacaaatgcggaaggcctggccagcggacacggagaaagtgatgaagcagctgatcagtgctgaaaatttggcagaaaatgatcgggggaacattttgcggcaatgtttcgcacaaaaaattaacatgtttttgagggttattgtatcgatttataaattttcaaaaaagccaaaataggtaggctttaggctttaaaacccgaaaataggcaagggcgtagccagaggggggggggggggggggcaccatcatcattcattagtcggcccacccaccctttgagcgtagtccgctccgaatgcgcagccactccttgaactcctgctggaagaacatgttgctgatccacgtcaacggcaggccgaccagcttgtgggtactgagctcgccggcgccaaacatgggcagtgtcaggt

SEQ ID NO: 14259 - DNA, 2766 bp, Heterodera glycines
  misc_feature (39)..(39): n is a, c, g, or t
tgtgtcatttttggtcaattttactttcgcttaaatatnttggcaaaacgatgccaatgccaaccaaagaacaatttaatgcaaaaaaaaaacaatttattcatttttcaaaaaagaggagccaattcgctctgtgttctcccaattcggcaccatcaaagaaattcgtctgtttgcttcacaaaactttggtttcgttgtgttcgcggacaaatcgtcggccgcgcgggcgatttttgagatgaatgggagggaattggacttgggagtggtagcggggaaatgcacagttcgggtgaagtggggaagacaaccgcagcagcaaaacggaagcggaagcggaggggggacaggcggaagggcgggagacgcatggccaaccgctggcaccgccaacaacggcaccgtacagacgaacggggccaatacggtaagcaatgacgaatggcattaggtggcataattaatccccaaaattgacccaaactgttgcagattcccgccactttgatggagttcggccaacaaaatgcgctctccgacaccgccgtccgaatggtccaacagcagcaacagcaaatggccgttctgtccgcgttggctgtccatcagcagttgcagcaccaacaccaaatgctccgttttggcgggtggggcaacgaatgaacggagaaaagacgaacaaattggagcaataaatatctacgagaaattgttttaattgaatcttatacaaaaatcgaattgacaaatttggaatatgccaaaggcgaagaaattggggggtgggagggtaacacaacaggccaaggtggagaactccgttttccccttttttaatgttcgacaaaagtcacacataaatcgttttccaataattgtttcccaaattaattggattttaaaaataaatttaatgaaaataaattagttaaataatgaatcgaagaggaaaaccaacaacagaaaaaagaattaaatgatacgtcacattaaagaaaatgagtgccatttgggagattggcaagaaatttgggataaaatgaattaaagcggcatgagagaataaaaaggcattggagagatgtgaaattggagcaaaaatttggcaatgagagaaaagtgctcatatgaaatggacgaatgatcaattggaattggacaatccatccgatgatctgatcggcttggttcgtcgtttcaagcttttgatcagaagtgatcagtgcgagtaaaaactgtgctcgagcacggcgctgccggcacttccctttcgggtcattttgaacagtgcgactgtgatgatgatcagcagcacgaagagaatggcaccggcactaattagtgccgtcggggaaaagcacactccacggccggaagaagctgccctcttcccgctttcccagtcgacaaaggacggcatttcttggacggaactgcgctgagaagagcctttttgggccgcggccgccggctcttaatgggggaaaaggaaaagtcacaccccactaggcgaaatgctcgcgatttcgagaccgtaatcgtccaagatcatcagttctggcgattggatgtcgaagtccacctcagccatcctgcgtcggcttccgcccgcccttccgcccgccgcgggcgtgtcccgctgagtgcgtcccgccgccgccatttgtggcttcgcttttccctcttccgtcggcgccgttccctccaatttgcccttcttgaagacttgcactggcttcgtcaccccaccgaactcctcctcctcccctcccggcactttcttcttccctttgcccttctcctcgccctcctccgatgccgaaattgtccaacttccctcctccgccctttccattctctccatgcgctttttgtccccttccgccgttttggcatgatcattttgaagcaacaattggggccgagggaaatcctccgtcatttcttctctgctctttttgtagtgaattgttgtgccgtcagtaattggcgaagtttctgttgtttgtgccgtgatcggcgatgacgctgacgaggacgatggttgtgcagcagcttctgctgcggatgatagcgatgatgctttcggttgaatgccttcgctgctctccccacttgccgccctttccacgctgctcagcagttgttcctccgtaaccgtcttcgtcgtcatcgttgtactgcttgctgtcgtactcgttgctgttgttgatgaggttgttcccgttgtcgtgttcgtgctttgtgtcggttctgttgttgtttcggttgtttgtgctgttgctgtcgttctctcggttgaggttgtcgttgctgttggtgctgtactgcttgctgtcgttgcccctgtcgttcgttcggtcggtcgttccgtcgttggtcccgagtcgtccgtctgtgccgttccctccgccacctctccactcacttccgttctgctccctctgccgccgttttgctttttgccctttcctctcatcgtctgctgttcctcctcttttcccgttgtccctccaccgtttctgcccccaatggccgctgtccccgtgcccacctccgcccccgcgttgtccacattgaaattgccattcgcggcactctttgctcgcttcccgttgcaacttggtggcttaatttgcgagtgattggttaataagcaaagtgccactgccaaaggcattctttggtcggtcaccgtcaaagtgttgcattcgtcttctttcaacatgcaaagtttgattttgcaagtgaacagcatcatgt

SEQ ID NO: 14260 - DNA, 854 bp, Heterodera glycines
gaagggatccgcagcgacgcatgggcgacccgaagagccgaaggtgcgaaacgaagagaagacggggaggaaggacgtgcagacgcggaacacccatgagcagccgcggacgaggcgcaagcggacggggagcaggcgcacggagcagccgacctggcgaaagagaccgcaacgatgaagaactcgtccagccgctggacaagtgggaccacgggtggatctcgtgagagcatcaaggttattacattagtggaagagtagagcacgtaaagaaaggcgtagagctaccaaagggaacgaaggaagtgaaaaggggagcaaaaaagggggaaaaaggagcaaagggaggggagggaagagcaaagggaggggagggaagagcaaagggaggggagggaagagcacatcaattcaggacgaatgggaagaatgaaggggaagatgcaaataattggcttaatattcttctactgctgaatttttgggtcaacttttgggagtctccgccccgcccatcccaaaaaaagccagacgaatgtcaaggtaaacaaaattacgcgaatttgaagacgaccaactcaagttttgacatgcattgaatggcacagaatgcacaggtaattttggcgattgtgcggtcgaagaaccgtcgcaaattaactttgaatacacaaagtcggacggaagggaggggggggggcggagttcaaggtttaagaggaagaagaaaagggggaggaagatgaggaggaggaggaaggaataattaatattccaagggtttggctggagaggtgctgggcggatgaaggccacacgcggccgcagggggtggcgggggggggggggcgggg

SEQ ID NO: 14261 - DNA, 988 bp, Heterodera glycines
gttataatatatttgattattttaggtttcctcctagtagagagaacagaataaaaatgattctgcgcatctttcgtcataccatcattagcttctcccgtgccgtcccatcccgtggacaattgttgccattgtcgaatgaatcatccatcgcagggctcacaagcggagtgccaccggcaccgctcttttgcggaaacagctgcgaaagaagcatccgttcgtttgagaaattgccattcctgctgccaaaatggcattggcacgataacttcgtattgagagaattgcccaattgggtttcctgtcgcttgcattcatcgtcattgtcattgatagagcaaccccaaaacagcagaaagtgttcatctgcgagaaatgtcaagacaaaagcttatgttgggcaattgatgaccatttcgaattgaattaacttttatattttttgcaaatgtttaatgatactcaaatagagtttatcagttaaagtgaatttgttccaaaaagtggtaaatattttcgaaaaatgtacgtatgtttttcctaagcctggcctaatctaagcaattgtacgagttgtcatggcaccgaaaactcaatttaaaatcactttaaaacaaatgaagaaaatattaatttttttgtgaatatctgttagaaaattgaggttaaatttcaaaattcgtccagcaccgccggccccccaaaaaacctacttttcttaaaaaattattccaaaacacctgattttggtaattttttagacaatatctgtgaaatttatgcgaaaaggaattgaatcgaggcgatacatcgactaaaggaacaaacacatcattcataaaaattaatatttttttgtgattttttggaactaattaaaaccaaacccccgcccccgtccccggtggcgagactgctggaaataggcgctttggccatcgatttttgatgccacataacttttttattttcatctcacaccgct

SEQ ID NO: 14262 - DNA, 1761 bp, Heterodera glycines
cgccataatggcacatacacgtgacattctttgaaccggtggtcagctgcaaaccctctgcagcagaactggcacagtattgcgtatctttttcagtgtcgcatttccaaaaataatcggtaagtttggcgcctcttctgaaatcttagagatcattcaaaaactccaccttttagaaggtacaactaatttaggcatttcaatcataaggaaaatccaattttcgatctttctaaatatctctttagctttttctggtctattttcaatgtgtttatttgaattattatttgcatatttaccgatcgtgcagattgccgccagacaatattgcgcgccctccttatccaagcattctccgttttcggtttcaatttcaccgccatgccgagcttcgaatccctgcttgcacttgagtccttttaaaacacagataaaaaagaacaaacaaatgttaatgttttttgtgatcccatcagtttatcggggaaaagggtgcaagtgaaaagcagaagaggaagcaatggcttcatcagagaaaacattcccttagtttaattaattaaaaaagaaaaatatttttaaagcaaatcgttcagaaaataattaatattgaataattttaattaaaaatttacacaatttgttcatataatttcagcaaaaaatgattatgtacattttcatacgaagcaattcgatggaaagatttttattaacgcaaaaatgatcatcaatttttcacatcctttcgctgattaatttatcggttgaatatctaaattcttgatattttttaaaaatattttctcgaaaaaaatcgatggaaaaatttcgttttttttttgatttttttcggtttgattattccatattttcttgaaaaatacaatcgaagcatttctacatgaaatatattattaagtaactaaagatcactaattagataaattcattttaattttgtcatcgctttgttcctcctctctcagaatgtttaaattttcaattgccaaatttgcaaaaatgtccaaatcactttttattgcttgaataattattatggcattcagtgccttgtttttgctctgttgtgaattttcttgatttctgacaatctcttcgagactttctcgaatgtgcttaatgatgccattctcgacaatgccttctgagcaaatttcaaaaaattttgcatccgaaaatggaataatttgatcaaattgcatctcgggcagcaaactttttaatttttcggtgatgttatgtaaacgatcattgagttggtcgatcgcatgttccgcttgtaattttttaaaatcatttccatcatttccctgtccatttgcaatgcgaaacaattcagaaattggattcataacaaatttgaggacaaatcggaggaagtgcaaaataatgaaaaggaaataattgactaaatcagggataattaatccgaaatttgtaaaattaaattggtttatttgttttaaacataaattaactcatccatcatttatcattttaaattggataaaatttgccaattacaacaaatttaccaaccaaaacacgattgggttgctgattacacaaagggcatcggagtctgtcaagcaatgaaaacctaaaaatgcataattattcatttttacggaatatctttcacattcaattgaccatttgttgatgcaattgcggtggaaaatgtgctaaaaagtatttaaattatttaataaatctatcataaaccattttggc

SEQ ID NO: 14263 - DNA, 2030 bp, Heterodera glycines
  misc_feature (5)..(5): n is a, c, g, or t
  misc_feature (12)..(12): n is a, c, g, or t
tcctnttgttantttcgtctaaacaaattgaacagtccttttctgcttcatctccaaccctgctgcttttcattttgtccttaattactttttatttacaataataatcaaagttaatcaacctcttcatactgataaatgtcaatgtcgagaaaccaaattttgtgtttgaaaaagcgattcaaattgaccgggattgatagtttgtattctgtgaacttaaaatatcaaattattaatattatttatttggcatttattttttgcctttggcatttgctgtccatttgcattttccaatttttcgagtggggcaaatcccaaaagtattctctcgtcctctaactcaaatccgcgtcggtttttctgtacaaaagcgtacacaaatgcgtggtaattgcccgcgtcgttttccgcttccacaaaaactcttcggttccaattgagccgtcccggggggtcggcactgcccaaattgaccacgtacagccgcgagaagttcggcctgaacagctcgactttgacggtccggtgcagggaccggatgtcgtccatttgcacaaattgatcttcgtatggctgatcatccgccgggttttcgtcattttcatccggcaaaaattcattatttatgggatttaccgacacatgaaattgcaaaatataattgtcaatttctctttcatctttttcattaattttgatttcgaaattttctccaatttggacatccgaatatattttaaatattccaccatttaattcataaaacagttccaacacaattttaacttctcgtgaatgttcacagataacgcacaaacggagcttttttgacgcggagctttgtgaaggataaaagagaaaaattgtgaaaaataaaaaataatttattatttccattaaaaaaatatattaaaatgaaataaatttatgtaaaaagtcatataaaaatattaatcaatattaaagggtagtttttcgcactatgttttattatgcatatttaataaataacggatgccgaaaaaaaatcgatgctcattgtaagttaaaggcaaacctataaaatatttttattttataatttaaatttacataaattgagaatttggaaaggaaatttaaaaattaattagaaacattcctaaaaaagcaccattaaatttttcttttccctttatttttttgcctaaaatatttcgctgtcattcactgcgctcaattaaccattttcagtcaaataaattcgattagttgctgctaattgtcaattaaaagaattttttttgtttttttaactttttattttcttcattttcaatttaaaaataaatacaaaacaaaaggcaaaaagaaatttaatctctcaacaaacaaatggctttctttttatgctttgagaattgaagttttcacaaagggattaaaccggctttagaatgatttttaatgtgaaggttcatcccttttttttcattttttaatttctccatttccaatcgttgatttttctaaaccgttttaattttaaatttcgaatgatgaatcatccctaccaatgcgttgataaattggggaccgttttgcgttaattggcccttcttgttgcattggaatggccaattttggcgttgtgtcgtccttcgtcggcggttgttgacaacgaaaatcggtgaaggagcacgggaataattggaaaatgaaagtaggcaggtatttactttacacttccaattattgagaaaccgcacgaaaagtcagccggccaaacatagcaaaaactcaccgccgactttcaatcatttggcggttgccttatgacactcattaattcattctttcattcttccgccccctcacccacaaattattgtccctcaattaggcccaaagcactcaaaaatattattgcgaaaatatgaaaataaggcattttattaacatgatatatataacacagagatatattaattaattaagtaacaaatgacttataattaataaaagaaaattcagattttatagaa

SEQ ID NO: 14264 - DNA, 1063 bp, Heterodera glycines
  misc_feature (9)..(9): n is a, c, g, or t
tctaaaatnttccgaaacaaaaaataagcatcatattcgctttcagcacctcaaaataccccacaaaataatttttcacccactttttcaacccaaaaaaaaatttcgaaaatttctagggggcctagctcgaaaatttttgaaaatttcctaacatgaagtacaccattcgatagcatttaaaattctctacaaaaatgttctaagacaatttttcgctaaaaccaactcctgacgagttatgggcccgggactcaaatgtcccgctcaggccaaaaattttttctatttccgggaaaaaatcgaaatttttccgaaaaaaataccagtcgatagagctcgaaaaactatgttttggaagtggtcttcgtttttctgggaaaattcgttaaaaattcttaaaatgcaaaaaccaaaaaaacgttttttaggcctagctcgaaaatttttgaaaattttcgaaattttaaaatttggaaaaatcgagctcaccgagctctacaataagtctgctggccaccctgcgctcaggtcaaaccctaatgagttattcaacggggactgaactggaaaaaattggtactgaaaagttgccaatttctgcagctcttccaagtataggtagaggcctggaattttttttgaaaattagaaaacacttcaacttagtttcctaccagcaagcattttttgatcagagttttagaaaaaaagttacgggccttcaaacgcaagcaaaagtgagaaattagccgccgggactcagttggccaccggagcagaaaacctatagttttcctgaatgcgcctcaaaaagttgtaagacccttccaccactttcagacccctcccgacagcagttcgactcaaattagtttttaagacgaaaccccctttttctctatggtaatataaactagcgtgtgggaattgacgggggtccggtgcaggcagtttgcttttggatgaagagaaaatggacatgcacatttgttattttaaacagacaaaatattaagtgtattaatgtgctgttttaaagcgctatcgcgctatgggacgc

SEQ ID NO: 14265 - DNA, 1055 bp, Heterodera glycines
ttttgggggcctaaaattgccgattttcaaaaaatttttaacccccttccaaaaagtttggaacgcaaaataagcgtatatacgtattcagcacctcaaattatgccataaaaatgcattttggctaatttaggagcaaaaaaattttcatgaaatgcaaaaccatggggtcccccctatggttttgagtttcaaaatcacaattaattttataactttttttaaactcatggtataaacatgagataaagcacattagattgggcttaaaattctctacaaaaaagctcttagacgattttttgataaaatcaactcctgacaagttatagccacagaactgaaattgaggcctagtaaccaaaaattttctatttccaaaaaatttttgaaaattttttttgaaaatgccaccaatcgatagagcatgaaaaacggttgcttgaaagtggtctccgttttccccggaaaaatctgtaaaaaataataaaattaaaaaacggaaaattttcgagggggcctagctcgaaaatttctgaaaatttcagaaatccaaaaacatggttggatagagctcgtcgagctgtacaaaaaagccgcttacaccgacctcctccctccaaaccccgacgagttattccgccggcgctgaaatggccaaaaaagtatgcaatttttgcgcagtttttcggaaaaactggtaggccctacgaggtcggtgaagagcaaaaagttgtgccaaacctcccaacttgatttcctatcgaggccgatttttcatttaggactttaaaaaatttttgaatcccaaaaacagcaaaaaaaaatttaaaaaagccgtttcagcgccgctggcgctcagttggccctcggaccggaatgcctatagttttcctggatgcgccgtcaaaagttgcccccaaggtcgaaatcccgagtccctcccgccagcggttcccgagatttttgttttagcaatgagttcatctgtttctttagttatatataaactagcgtgtggcgcagtaattgctcggtgtagacagtatactttg

SEQ ID NO: 14266 - DNA, 805 bp, Heterodera glycines
gacgggcgcttcgcgtccgttttttagcttgttaggccacttcgcggcctcagtcgggcgcttcgcgtccggtttttcaatttttgttggccttggacgggcgcttcgcgcccgttttttaaattcgcggcctcagacggcgattcgcgcccgttttttagcttgttaggccgcttcgcagccttagtcggtcgcttcgcgcccgtttttcaatttgtgttggccttgtacgggcgcttagcgcccgttatttaaactttgtttacctcaaacgggcgcttcgcgcccgttttttagcttgttaggctgcttcggagccttagtcgggcgcttcgcgcccgtttttcaatttttttggccttggacgggcgcttagcacccgttatttaaactttttttacctcaaacggccgcttcgcgcccgttttttagcttgttatgcgttcgcggcccagtcgggcgcttcgcgcccgtttttcaaaatttgttgaccttatagggattataagaggtacaataaatggtagaagaggtaaaatagtgattagaagaggtacaacagtgatcagaagaggtacaactgtgattaaaaaggtacaaaagtgattagaagaggtacaacaacggggaagaggtacaaccacgggggaagaggtacaaccacgggggaagaggtacaacaacgggggaagaggtacaacaacgggggaagaggtacaacattattgaaacaggacaacattattcaaaattacataaaataaggaaatgtatttattaaaaaataaggttaaaaaccgaatgc

SEQ ID NO: 14267 - DNA, 4768 bp, Heterodera glycines
aataatgggttcggaagtgaattctgtccgttttactctggcactgtaatatcacagaaaatgaatttttacgcgttaaataaagtgagatttgggccagaaaaattcgggtcgctcgtcgtcgtttgttggttggtgatgtgctctctgcatttccatgtcctaattgctgtcctccctaattagggctaattaaattatcctttttccggtgcccttaaagccgtaagcgaccgcgccgacaacgcattggacagcggtgcaaatgaacacaacgccccagtgattgttggtcatctgcgaacccgggaagaggggaaaatgcataagagtcaaaaataaaaacaaaatttgaaaatgaaaatttagtaattcaaaaatttttttgaaattttccgaaaagatgcgaggaaatgggccattgtttttgaaatttagttgccacgtttttataatattattgataacagcaaaaacatttttaaaagttgccgaattctctgtcaaaaaaatattttcaatttcggtgggggaattattttaaaatattattttacataacaattattttgccacacctgcaaaatccaacccgcaacataaacgccgataaagccggtgatggcggcgaaagcgttgaacacaccgaacaccgaccctgtgtgatttggcgcgaaatcagtcggattgactgcgacaccgccttaaagatgaaagaattgaaaagtctttgacaataaaaataaaatatttggtgaaaatttttaaaaaatttaacgaaattttcataaaaagaaagtaattctcacaaaaaagttagttttcatgagttttttctgcaaagattgagaattttttcaaagaaattttttatttttaatgcattcaaatcaaaaactgaccatggtgaaagccccggacggccattgccaaagtgaaaagggcaagcgaagcggagaaagagtcgggcaaaagggagacggacagaaagcacaaagccatgccgagaagggagcagcactgggcggagagggggggggagggaaaccatggctttttagcgtttttagaaattcaggtctgtagtcaggggacacaccctcaaaaactgaaaaaatacccctaaaatcgaatttttgaattcagcccacctccgaaaccaagggtttggctacgcccttgatatccaccacaaatacaaaacaataaacaccgtacctccatgcagcggcgtgcaaaagtcaccgaccgccccttggccatcattcggctggcgaccagcggcgacagcagcgaagtgaccacaatggccatgctcggcaccacgttgtaaatgtacggcttggcgtgtgggaagttgtccgagaaataggagggcaaccagctgaacatggtgaagtaggcattggcaccgcaatactgcgcactcgaggcggccctggggagacgagagaacaatattagggcaaaaatttaagaggaaaaaaatcaatgctattgttacaattcagaatggatttttataatttttttccttttaagtaccctcgagaatttttaataaaattattaatttaaatcaaaaaaatttaaattgagtgcagactacagtgatttagttttctttgaatttggcattctgattttatgcccattttttcactgtaagacttgccaaaatgaggggtgcctgaacagtttgccccatggcacggcagcgctttcgtttcccgccgctgacacagtgccgccatttgtcgcggtggtcgccggcgatggagtcatcggcggactgtccgttttcttcgcctcactattcggattggcaacctgaaaagtgtacaaaataaaaatggaattttttaaaattccaaataaattttttttaataaaattaaatcaaattctttttattcccaggttttttgacaaattgctaatttggatattttttgtttttcggagtgggaaatcccgagagttaagatttaaaaaaacgaaaaatcctcgattttggagggtcgattatcataacaacccccgcccccgcggcgcctttcctctgactttggcggatgagtcgaaaatgcgccggcgctgccgcacggacagtgcgtctttgctcaaaaaattgaacatcaaacaccacaggatgctcaaaatgcctaaatacaattaaacacaaccacaacaaacggagtgaaaaaagccaaaactaaaattatccgaaaccccaacaaaagaaacatggaattattaccaacaaaatggaacaaactccgccagccgaaccattcgagcatcacggagccgaccccgccggcgaccaccgagcccaaagtggagccggccaagcaaaatgccgaacacgcggcccttctccgaggcggtcaaatgccgactgatcatgctggccatggatggcagatgaaagcctggcaaaagagagaaaggagaaatgatggcaccttttgctaacaaatgaccccctaaaaatgaggaaacgaagtgtaaaattccagaatttcagtatttatactggttgtgaacctgacaaacccacattttacccgatacactgtcgatttttgtttgattttgcattttaaaaaatttaaaaaaatgtaaattccctgcaactattcccacaaaaaaactgctaaaactgttgcccaccttggccaacgccggtggacacgcgtacaaagaggaggacgagcagcggagagtttgtccaataggcaatgtcaaacagttgtggcgtgcacagagtgagtaatgaccagacgagggtggagacgggaaggatacgctcaccgcccagcaaatctaacggacaaattagggataaattgagcgactttgcacaattttaacaaaaaataaaatcgcgactaggctttttgttggaattcaggttggtattcgagtttctcaaaattaaatggaatgtgtgtgggtcgaaaatggaaccagcggttaggtaccccatgagagtggatgaatatttaacgattttacggtcccaaaaaagtagacagaccggcgcaacttccggcgatgagttgagtgaaggcgtaaccccaaaaaaagcaggacagcatagtacccttaaaaggggattagactcgggatttaattttgcgaaagaattccgaattggacttgccgagtccgttttgttccacccgtactcctgggccatcgccaccgcacagattggcagcgcaacacgtgaagcgtacaacacacacgtgccgaggaaaaagttggccgtccaaagttttgattctgacctgaaaaattaaggaatgctcagcgtgagaaattcccgagacttggccctctgaaacaaaaccctaaaatgtcaaattcgaaattttaaactcccttcctccaaaaaagtatattggatttgtattggctcttccaatctctctcaaatctcagtaatttcgttgatttgttgtttttttaaaagccaattctgtaaacatttcattaaatttgagcaccaccttgaccatactcttctggaactgaatgagtggtcaaggcgtcgaaacaaagggattttctgcagttggtccggcctcagaaaaatgctcatgattcaactgctgtccacaaatcgcagatgcttctcattgcggcgactgttgcattttatgcaatttattagtgatgctaaaataaaatattgaaaattcgaatactttatgcctcttttgtgaatttgtgctgatttaattgattggaattgggaaaatgggtcatttctgagaagaaatgaacatttagttgcgtccgcaacaaattcgcttttctggcggagattttatcaaaaaccatatttgttgaccaggaagtgtccgtcttcaagaaatgcgtcttgctcatctcaagatttgacttaaaacggcataaatgtagggaaaaacaaattatgggccgagattctaaaagtatgattaagattaccgtaatcaattcttttttagaaaatgagccctccaccccatcccttataaaattgcctccttttttgattggaagataaaactgagctcccagtaccgtatttcaatataggtacattaagataagtgcttaagcagagtttacacagcttaggtaattcccgaaaaaattaggaaatcagaaaaagccatttaaatttaaaaacattttgccaaaaaggtaatcatttaaatttttttattttgtaatcaaaaagcaaggagtgctgtcggttttttttttactttgttttgtattttcttcctttttttgccttacattttcatagtctctaaacgacaacttttatgcattaatttacaaaatctaagagaactgtttgctaattaatggaggtggacaaacatgaaaaatctgaagcggtgccaaccgaagcaaaaaatgagtcagaactgatcaaatcaactaaattggaggacgaagaggaattcgaggagtttcctgtttacaacaaaggcgaaggaatcgacacggtcgaagcacaggcggcgattaatgtttgggaggtttgtcggctcaaaacagtcgcattgggaatgttacagcaaatgagacacattggaatagagtaaatcttaaacagctcaggatatgaaccggagtccaatccagcaccggagccctagttttacgaacaaaaataatgtttctaaaatttgaggacaattgggacgacgaaacgcaagagacggacttccatattcaattgcaggaggagctgaagaag

SEQ ID NO: 14268 - DNA, 665 bp, Heterodera glycines
ttttcgcgattttttgctgctttccgttgaagaattttccccaaaattaggagtgcatataagaacaagcagaaatgcaattttcaagggaaacattttggtggtttttgaatttggtggggaattgcaagcttttctcgggtatttaaacgaaattttttcatcaatttttcattaaattcttgaatttcatccatttctggctttttgtgttcccaggccgttcctctgcggctttaaatattttgtattgaatttcttgtcggtcttcagcctctttttctttccaaattccatggccatatgctttttaaaaatttaatgtttgttttcccacccatttttagcattttttttcgccgcattttttcgtatcttattacggaactcaaacaatgacgtatttctaatggaagccaaaatttatgcaaaaaatttaacaaaatattaaaattattcactgtaatttgacattatttaaaaataatttaaatttaataattttaattgaataataattattttaattaattattatcattgatactattttaggaacgccccattgatactattttaggatcgcccacattgatactattttaggaacgccccattgatactattttaggatcgcccacattgatactattttaggatcgccc

SEQ ID NO: 14269 - DNA, 1976 bp, Heterodera glycines
atgcctgataatattgtgatttaaaatatgtttggtgttttgttgttttattttgtgttattttgtttgtgattttgtgcgatagttagttcagttagtttatgctgtcgtcagtattattgattgtcctcgcctattttatttggaattaaacgataattattcttcggcattgtgttttgtgtttgctctgggctgttgtgctttgccgtgtgctgtgcaacaacaacatttattaaagcccctgacgacaatgtccccacttcctttttacgacttggcgctcctggccttggtgaatcagcagtggacaaaaacaatttggacgtagccttgaattgaaaagagggaaaagtaaatccctcgacaagtgtggaaaaatcggaaaaaagggaaaacaacttcccagcaacagacgaaccgaatcaactgtggacagcgaaattttgtaaagcccacgaagagacgagctctagcggttgaattaagttgaaaacgggagacaaatccctcaaatttcaacggactgtcaacggaaaaccaaaaggggtgaacaaaacccagaacgaatcgaggagcagacgaaaaagtggaattttttcgaaaacgggaaaagcaaatcccttctcacttcaaaatcgcagcatcggaaaaggaaattgtgaaacaaatcacaaaatttgtcagttcggtaaaatccgtcgacaaaaactgattcgcaaacgggaaaagtaaatcccaattcaacatggagcagtgtcgacaaaacaaaatgtcgggcaatgaaaattgtatggaacagccgctaaaacaaggacagcaaattggcgcgttggaatttgttctcgcaatggaacgactccccgagctgaatggaacggaggacccagccaaatacggaaatttttcaaaaatttttcgtcagcaaccgaaggttggccggaaagtcgccgcatttcagcgttggaaagcaaaataagtggaaaagcagaacgtgcctttggcgccgccatgaagcataggccgaacaaattcaacgaaatttgtcgcagaatggaggaaattttgagcgaatgggactgcaccgaaatgcaggccttcaatgaattgtgggctggcgtgaagcgacaaccggacgaatctttggaccaattcgccgaacgacttcatggagttgttgaatgtgcttatccaggtttgcccccaaatttcgtcgatgaatttgcagtaaagcacctaattcgtgctatggaaaatccggaaatttcggtgggattggaaatagctcgccgtccaggcatgagcttctacagtttcgtcgctctcgcagtacgcgcagaggcagtgcaaaaagccactaaatcggctggatttggaaaagagcaccggccaaattttcagcaaaaatcgacagttccgccacaaaaaattttcccgccaaagacaaaccgaattgtgtgctacaactgcaacaaaacgggacacatttctcgccattgtaggttgcccttcgcgcggaagcaatccaactgtgcacgaaaaccgccacaacaaaattttgcgacgaaaagtgccgattttcgaaaaaattcagaagctgagaagaaattgattgatttgcagttgtcgaaccaaccaccggcacaaccaacgaacgtggaagctggaccaaaacggaaagcgtccaaccgacagcgcaattcgtcgtcaagttgcagcgtaaaagcaacaaaaatggaggaaaaatcggcggaaattccaaaatggtttttgaatgctattttcgctgcgttggttgtgttcgccggcgtattttcgaaggaaaagtcaaagtgtggacaaatttggaaaagtaaaggctcaatgagtcgcaccgacgaagtgaaaggcggaaagcattcggaaaattggggacaattttttcgccgaaggccggggaggaattggcggatgtcgcagccgccaatctgaaaatt

SEQ ID NO: 14270 - DNA, 2177 bp, Heterodera glycines
caaaaataatcaaaattgaaacgtaaatgataattaaaacaaaaaattcaagcactggtaagaatgggggtctgagtgaaaaaatagtgatgaaaattggagttaaaggaaaaaataaaaattaatatattgtttaaaagtagcaggcttttcgtctttattctctacttctttcccatggttcagttcctctagagaaatttaaatattttgaattttctttttgtatactcaggggtttcctatcgacaaaataagatttatttacatattttatcattttttaaatgaaaatccgtacaaattgttgaacctattaatcccaaaaaccagccttttttgttgaaaatctgttaacaaattgcactcaaaatttcaaaatttcccccggcggcgcctatcggcaccgccggacccttttcttcccaaaaagttttttggaaaaagcgcgccgaaaaaaagttatgtgaaaagcaaacctgaatttctaataatactcgatcatttagtccaaaatgattaattgtttgaaataattgaagaaaatttgttttgaaaattttcattgatttaatttagctttaacttttggagtttattcaataaaaaacaaagtaaaaatttaattttgtattattttcagttgaaaaaaaattaaaatttgaattttttaaaaattttttgaatttttaaaaattcccggttggttccggttcccggtcccgaaaaaaaatcgaggtcccggtcccggcttctcaggtcccggtcccggttttgcccaaaattcccggtcccgctcaactctgttagaaatattcccattttgtgccgcgctagcgacgacctttttttcttttcgcccgtgaccggcacttgattaattattttttctaatcaggaaaattttaaaaagtttaaaaaaatttatgtttaaaaacttggaaatttttggggttttaaatgcgcgattcccagcaaatttttttgtgcgatccgcgattctcgaccgcggcttccgaggccaagctgagaaggcgcaagaaaagcgaacacttcgagccaacaatcggcggagatgaagctgaaaaaaaggaatttaaattttatatatttttttcgttttttacatttcttttttgttggggcgtcgtcgttttttgacgttgtcccaaaagaaccgaagaatggtgccacagccgaccaaatttctgtgatttttctcaaaattccgcaaaatcgtgcgccgcctttcttttagctgtttctgatgagtgccaccattgccgtcagcttcatcatttggttgcattcctttgaacatgatgctgcgaatgggggccaatttgagctggtgaattcgtgcactcgtgaacggttgacaggccgaagaattgggaaggacgaccaatttttgattgaacggtgtccaatcgttggcaaaagtgcggaccaacgggacgaaagtggccgagaagaagcatggaagacggagggcgaaggaagaagcattgattgttggaaactgctaacttttggcactcctttctttgaatggaacactttttcgtagcacatttcaatgttgtatgtgccaaaattggacgcagaaatggttggcaagaaacaataagcattaaaaaagttgttttttcataaattttcgtaaatatttaaaaatcacacacagtccaaggggtgcgtagagggccgggggaggcagggtgaaaaacgaaaatttgttttctcggcggacacctctcacctctttccccgttgaaaagttagaattttttggacaaaatcactactacatcgtcggacccactttccaatgcttttttttcttgaattcattgttgcgtgctgagaatgagttaaaaattggaaaacattggcaacaactcatgacaactcatacaaaagacaatttaattttaaaaaattaaaaagaaaatctttcctattaaaaaatattgtaaaatgttaaaatgaaagatgaaactagtctattctttgataggtcccttgttgtacgagttgtcatgtcaaaattggatagtcctaagaatcctctattagcatgcaaaatttcaaaaaattccgtctggtttcaaaaaatttatagccaaaaatagtgtagaaaaccaactttttaaaattttctggcccataacctt

SEQ ID NO: 14271 - DNA, 1740 bp, Heterodera glycines
atacgcatcggcagcaacacagaaagcttttcctatttttttgtcttcttcaatgaatgcacacacacaaattgtattttcattgtttattgcttacaattagccccataattaatctgattagacaaaataatttttgtggatttgttcgcaatttaaaaatgttttaaataacccaccccctagcgatgacctttttttatttttttgctcttcggccacatttttttttcacccgctaccctttttaaaaagggttaggaggacactggcgctgccaataatggtgctgatcgagacttgaaaatttaccgagactcgctccgaaactcaaagccgaaattcgaaaaccccgagattttctcgagcctagcctttttcaaaaattttctttacacttaaaaattagttaaaatttaaatttaaaaatgaattttctgagggtttttctgtatataacatttaaatattaattaaagcataaatttccaaattttcctgcgattgagctcaatttaccataaaatttctctcatcaattttcatggttgaaggatggatgattcaattccttcctcaacaatcccaaaaatcctttgttccacatcgttgcatcatcatccatcccaaatggcatgcaaatgggtggtcattttggtttgagaattgcttcaaattaaaaaaaaatcatccagcaatgtgccaatgcccgaataaaatttagcataatttttcttaattttttttttatattaatttcttttaattaatacttaaatttctaaaacaattcttgacgggcatttttaataattttctatagaatatttactacggttttaaaatgattttaaatgaattgttttctatattggctcagtttcaaccatttataaatttatttaattaaatttttaaaatatttctgttggacaggttttttaaaatttttatagaatatttatttcaattttaaatgatttttaattatatgtatatgatgattatggttggctcagtttcaaccatttatcatggaactgttagctttccaaaaaagggcattgggcggatgggggggggcgggagcgcttttgggtcgtccgtccctccaacccctcctcatccccccccccccgcaaaagcccatcctttagttctggaaaaagtatgtcggattatcatatgcaaaaaggactatattttgttatacattaaaatccactttgacgaaattagtaaaattttcattttaattgggaaatccaaattgttgtaatataaaagctacacaacccattagagcaaattattaattttttttcgttttctaatacgacgtcttctcaggatctcacggaattgtgaatttttttcttttttaatgcggcattttctcagggtctcacggactcggaatttcagtatttctttcaaaaaaaaaaaatttttttttaaagcggtttgaatgttgaaataaaataactgaaataaattagtaactcgtccgtcagttctgtccgtttccgaaaaatgtcaaaccctagggatctttatctcaatagttctcctcttcccctccccctccatcgctgacgattttttttctcattaatttctgccgcctttgattacgaagtccccctcccccccccccgctcgattacgtgattgtcgccgcgtaaaaaacaatgaattttggttgtaagtgataaaatttctttcatttctctccccttg

SEQ ID NO: 14272 - DNA, 2440 bp, Heterodera glycines
  misc_feature (140)..(140): n is a, c, g, or t
aaaaaaaaaaataaatttgaaaaaatgaccgaattaaagaataaacttagcgtcaattttttttaacaattttcaaaaaataatttatgaactgttggattttacgtacattttttggttatatgtcaattattttttcngcctctgatttctgtcgctgacccaaatttttgcgccgctggcgtgaagaaacaaacgcattgaacaatgaatgaattgcaaagcacatttgtaccacatttgtgctgcattaaactttttgttgcttacaacattacacaatgacaaaaaaaaagaattggattacgcaaatttaattgttctttttttttgctcgacaaaatagcagcccgacaaaactcaaaaaaataataataataaaactttgtaggggctaatgaggatgatcgcatttcttaattgattttgattaaaaaatcaattttgcggggattttgcactgaatttaaaaatattagtgtaggtatgcgtcagaagaaaattattgaaattatggccccatttgttaattgattttgaccaaaaaggccaattttctgaggttttgagatgaattaaaaatatattaagaaatttttgggttgttgataagaattttaatgcaattttttagatgaaaatagtttcccattgttcattagttttttcagctctttggcatttggctttcactacactctccgacacaatttttttttctatcatgagactttttgcttaggtgtgcccttctcggacccgtcgtctccgtctgtgtcctccttcacctcaaatgttgctgctaatgacggttcatcatcatcatcgaataacaacaaccacctgctacaccatcatcaacagcagcttaatcaccatggttctgctgctgctgctgctactgctcacacaacaagtctcaacaatgacgcggacacaagcaaatgggtgatcaacgggtacacaacggtgtacggcacttacattggcccaatgcgatcgtcaatggtcggcacgacgacaatggcacaatcagcagcgaacaataacattggccacttttttgcggtcaatgaaagtgttgtgcaatgtgtgaactgcacctttgctggtgatattgcaggtgcagtttttgactttttttttggtcatattggtttaaactggatacaacaataaaattggccatatttcatcaatcaggcccgagaatattgagccttactttcatagtggtacggaccaaaacaattttatgcttaaagagtttctctataattaaggaaaatttgaaaaaatttcgtttatttttttaaaaaataaaacaatatggcctaaaatgttcggaaaaaaatttttttgagtttttttcgtcataaccttttgaaacttaatgaaatttttacctgaattatactggataggatttctttttaaaattaaatttatttttttaatgttaattattatttttttcttgttcgtatacatagaagaaattaattttgttttcttttgttaaaataattttgtggacatatgtattcttctaacttgtgtctattgtgtctcaaatttgcgcacccaatttgctcaggtcaaattattgaccttaattgtattgtgaattgttgtatagagatagatccttgaccttggggcagaaccgaaaaatttttgttaacatttttaaatacacatatttctaaattaacaattccaaaattaaattattatttattaacttctttaattaccaaattttaattattcaatttttattttattttcatcccaaaaccttcaattccacttccccattcatttttcttcgtcctttgttcatcccaacacaaaattggggtagaaaaagaattatcccccaaaatgtgctagtgtggtgggggggggggggtgatcgttattgtttggttgggttaagaaaaactatgaatagtgttgaaggaaatgaaaaaaaaacatctgctctcttttcgatttatttcaattttgtttatttttaatttggttcatgataaaattttaaataaatggacaattaattatattattaaatttttacaccaaatttaatttaaatttttgaaaggaaaaatgataataaattcccattagagccccgattcttttttagcatttttaataaatataaatcgagggctttcccgtttccttcattttaggcaaatggcaaatcaatctttatgaatgatgaattacattttgtgatgctgtcactgtttaatctcatagaagatagataaccatctggcaaaaagaaccacaattaagacataaaattcataagaataaattttttgcattttcttattaaagcttttttaattttaatttttaaagaagtttttaattttcaagtaataatatatcaattaattaattagagaatttgtattat

SEQ ID NO: 14273 - DNA, 1382 bp, Heterodera glycines
tagaagatttttttcccgccatttttccttcaattattttacaaataaaaaatgattcttattttgtgcccaccctttcaaaattgtttttcgagttatatagatggtggcatttttttttcttttttttacaaaattttaattattttctggaaattgagcaattttagctgttgagagcggccagttcagtgttgtccagtgtagggtcgacaactcgtcgttccatcggtgctgttagttttcgacagtggtgatctcgacagtaaagtttgtttttaaaaacttgttctatatggtaaagtttcgataaattttgaaaaattaaaatgattaggacaggctctttacattgcagcggggtttgcgattttcgaattctgctataagaaagagcttgtagatatttgcatcttggcactcaacgccagcatttgttagcatattttcccacacgattcgagaatcgtatataagattttttaataaaaataatcatacgcatctttattattaccacttactcaattctaaattttgtatatgcaaattgtatattaatagtaattcatatgtacaataaatcaagtagaaaatcttctcaagattttcggcagagaagctcactgttgacccactcgcgcacccattcaaatttggattaattttaggcataatcaaatttttttcctaagagatattcgaatcggaaaatatttgacgaaaaatggcaaaatatgcaaaaaatcggaaaatatttgacgaaaaatggcaaaatatgcaaaaaatcggaaaatatttgacgaaaaatggcaaaatatgcaaaaaatcggaaaatatttgacgaaaaatggcaaaatatgcatgaaatatgcagaaaaagcctaaatatgcaaataaaagtcccgacttttatacgcaaacacaaaaaaaaagtgttttttatgcatttgcatattttttgcagccctgttaatgaccaaaaacaaaagtcacataaaatataattttccgaattttcgagaatttcaacaatttctttgtcctcttttttggctttccatttccaaaagttcttcgccgaagtgttggtcattttggcaatttctgttcacttatttttggagtttctctttttatttgccaaaaattttcatttttgccattttttctttttccgttattctcttaagactaatgccaaactgttttttccatgttgtaattgctctataattaactccaattttcttaccaatttcggcataattttgttgccattctttgcttgaatattttcctttttgtttaaattcatttgccatttcattaaatttttgtacaatttcaaatttttcttcatccgtttttgatttatgaca

SEQ ID NO: 14274 - DNA, 1140 bp, Heterodera glycines
  misc_feature (1119)..(1119): n is a, c, g, or t
ctttttaaacaggccaaaatgtttaggcttaactttttagtgaaatttcaatcactcatttttcgagtagtgctcagaagcgtaccaggttttgcaggggcctaaaaaggtcaaggaaaggcgtctctgcgttgatttagcagtagtacctatgaatttaaaattttctaagaatttttaaagtttcactatttatttatttttgcaaaattaattcatgaatattttttcagaaagtgctctgaaacgcacctaattttatttacatgttaataaggctctctgatgctttttctatcaaaaaggaagatgaattaaatttttaattcctttttaaacaggccaaaatgtttaggcttaactttttagtgaaaattcaatcactcatttttcgagtagtgctcagaagcgtaccaggttttgcaggggcctaaaaaggtcaaggaaaggcgtctctgcgttgatttagcagtagtacctatgaatttaaattttctaagaatttttaaagtttcactatttatttatttttgcaaaattaattcataattatttttttcagaaaatgctctgaaacgcacctaattttatttacatgttaataaggctctctgatgctttttctatcaaaaaggaagatgaattaaatttttaattcctttttaaacaggccaaaatgtttaggcttaactttttagtgaaaattcaatcactcatttttcgagtagtgctcagaagcgtaccaggttttgcaggggcctaaaaaggtcaaggaaaggcgtctctgcgttgatttagcagtagtacctatgaatttaaattttctaagaatttttaaagtttcactatttatttatttttgcaaaattaattcatgaatattttttcagaaagtgctctgaaacgcacctaattttatttacatgttaataaggctatctgatgctttttctatcaaaaaggaagatgaattaaatttttaattcctttttaaacaggccaaaaagttgcgggggcttaactttttagtggggggggatcactcatttttcgagtagtgctcagaagcgtaccaggttttgcaggggcctaaaaaggtcaaggaaaggcgtctctgcngtgatttagcagtagtaccta

SEQ ID NO: 14275 - DNA, 829 bp, Heterodera glycines
acggtgaagttggagtaaggggagatcagttggctaacgcaaaaagaattgggtcgataggtgcagaattcgcaatgtgcgggccacatttgcaaagagccccccccatttttttatatatagataactaggcgtcccggtagatggctgcgctttatagaaagccgagcctatcccgtcgaggtgtagatgcgtaaggtgtgcaccgtcgcggttgttagtgcagtagcagctcaggcgcagatgcgtgtctggatgttcgtgcagtagcagctaccggtaacagcctagcctagccgttcacccccaccccaccctacgcggcatgcaaaagaattgatcaggttcgtattgactcggtacactcgctcgtcgctccgcttcgctccgctcctcgctcgcgcacctcgagggtcagggcgcttcgcgcccgccccttgtcatgagcagcatcggttggcgcttgctcggcgtactcgctcgtcgctccgcttcgctccgctcctcgctcacacgcctcgaggggcagggcgcttcgcgcccgccccttgtcgataatgagcagggaaatgaaatggaaatggaaaagggaaaagaaaagtaaaaagaaaatggaatggaaaagtaaaagaaaaaggaaacgaagaaaaagaaaggaaaaggaaaaaggaaagggaaaggaaaaggaaaagggaaaaggaaaagggaaaagggaaaaggaaaaaggaaaggaaacaggaaaggaaaagggaaaacgaaaagggaaaagggaagagaaaagggaaaacgaaaagggaaaagggaaggtaaaaggaaaacgaaaagggaa

SEQ ID NO: 14276 - DNA, 266 bp, Heterodera glycines
attttctgaggtttatattttggttgggatcgaaaaagttgggccgctaatgtcttttatggctggtggccgcaaaagtcggaccacaaatgtccgaggcgcaaatgtcgtttttggctgtgggccgcaaatgtaagggcaccgtttactataaccgcactttttgctgccaaaaatcagaagtttcacattttttgctattttttggccgctcaacgataaatcccccccccccccccccctccatatattgtggactgtttgca

SEQ ID NO: 14277 - DNA, 1834 bp, Heterodera glycines
gggggggggggggggggggttaaagggggccgggccaaaatattcgcccccgaaataaaaaaattttttcaaacctagaaatttttcataaacaattcttagggaatttcttagtaagaaaatttcaagaaaaaaatttttgaaaaacatttcagcgattcgaaattttatgaaaattgctaagttttttagaaaaatttgaatttttcaatggtttttcaggaaattttcttttaaaaaatttcttaagaattttttcttgaaaatttctaagtttgaaaaatttctttttaaatttctgcggcgatatttttaggatgcacccggtataatggggagcaatcagttcgtccccctcccccccggatctgtccccccccgcattgtaactccctcgagaatttttttttaaattttactgatctagaaatttttgcaagaaaaatttaaaaataagttttaaggggttttagggtcgttgatcacgaatccgggctcagatcagcgctaccgttcactacatgagctgtacagggacaaagaattgataggtttcctgtaccaataataccctcattggcaaggtgcccatgaggatttcgaattttattcttcctgtaccaaggttaccctcatgggcaagatgccaatgaggatatcatccatacaaattttctatttttatttttgttcgagtccgggtcagaggttcgaaattggcaaaaatgggtgctgtattcgtgatcagcgacctcaaaacccccataaaactaggcatctgaaaatgtatgtgaaatctgccccttaaactagataagtaccgggtataccaacacgaaaaacccataaattttcaacaaaaaaattattgttttcaaattattaatttccagttggaagactgcgaagatttggacaacgaaattgacgaggcgctgtccgagttcgaggcgaataatccggagcgcaatttgctgcacacaatttgcttctattgaccccccaccccccaaaaaaataaaatggaaaaaaagttttctctcattgtttgtaattttataattctctctggttcccctaaaatcaaaattttgcatgttattgttatattgtatacaatttaattttgtcccattttatttgccaccaaatttgctgctcaaagattttctcgacttttggaaaagtcttcgcttttcacgtaacggatgggaaatttccaagagtaggaattggtcggaatggacgtcaaattcgagacccagaacaccctttgcaacatgttttaatgatttaaaaaaaaatgttttttaaagttggggtgccaagggcagtattatccaaataaatatcaccgtcttggagcattctcgttttgagtccaatcattcagtcgatcgctgttagacacaaaatgtcgaaaatattctcgggtttacaaaaatattgttcaaaatttatgcatgcaaatgtataaaaagaaaagagataaacagaatcgataagaaaaaaaaaatggataaacccgaaaatggaataaaaaaacaattaaaaaggtaaattggttaaaatggtgtaccccgtaagtgtcctcaaaaatcacttaaaacccgaagaaaatgccgtcgctggcccacatcacttgctgaatggccccaattggtcaatgttctgctccgactcctcctccgacggttcgtcgttgttgtactgctccaactcctcctccgacggttcgtcgttgctgtactgctccaactccgtccccgatttgtcgttacagtactgctccaactccgtccccgatttgtcgttcctggaaaggtccaactcc

SEQ ID NO: 14278 - DNA, 3477 bp, Heterodera glycines
  misc_feature (2075)..(2077): n is a, c, g, or t
  misc_feature (2115)..(2115): n is a, c, g, or t
  misc_feature (2145)..(2146): n is a, c, g, or t
  misc_feature (2192)..(2193): n is a, c, g, or t
  misc_feature (2199)..(2199): n is a, c, g, or t
  misc_feature (2201)..(2201): n is a, c, g, or t
  misc_feature (2217)..(2219): n is a, c, g, or t
tctagagtctcaaaaataaaacaataaatattagcgcatatactctgatatttttgggatggcttttccgatcaatcaataattgctctctttctctctccgtctacactttggtcgtttcctcttcgctctctcgctgtctctcgccttgcctcggttttttacccgtgaaaaccgtctgtctgtttctctggctgtccatcttcaccgttcccatctcttgcgagtttcgactcgttgccgaactgctcgaactctttcgtctcgttttgctgacgaatgttttgccatgttcagctgctgctgtctgttcaacgctcgtcatcgctaattcattagcatcgaataattttggcattgtgtcggcttttcgaagccttaaaacatttaaaattaaaattcattcgagcaaaaagaacgtttcttggcaaattcacaaattttgaaagaaaaagtgccgaataaatttaccaattgctgggcaaagaaggcacatcatcgtccaattcagcattgaccacaaaactgtgggaggtattcggcgttggcatttccgacctttggtcttcttcgtcctccaattcggcatttactaccaaattgtgtttcagctcagaattcggccgtgccatgtcaataggacgagcggaataagccgtcaccatccgccgactttcgttgtcacgctcagacaatgggcgatcatctgctgttgatttgccatagtgatcagaagcctgaacccgttctgacgaccaatgctgatcagtcgaatcgaccagttccgtttgtttcccatattgatcgcttcctctgatcaattctgttggtgttgtcccttgctgataattgctgcttccaactcgctgctgctgttctgttgctctgatcacttcgtctccctcctcatcctcttctttgactactacgatttgtgtgatcattggtgtcattccgtcgtccttctcatcgtccgctgacggcggttgctcaatgactaatgattcaatggtactccgccgagttgaagtcggttgatgatgcttatggtgccgatattgatgagaatggtgttgggactgatggagtcgagaagagtttggcaccgccggaggagggggcaaaattggccgaatctgaaattcaaagctctcaattatattccgtggtaaagcattggaattcatttttgacaaatcccaatccgaagttccgcccgtcatttgtgtgagtttggatgaccttttgttggcttttggcgttgccacctcccaatgtcgtggtggtggtcatattggacgaagtcggcgaaaaatgagtcattgaagaaactgcggcaccttcgccatcgtcgttatcagagttgaggacgatcgggttaagaatttgctgatcggaactgtgacccgttgaagaatttgccgaggaaagtgcaggatggacccgggaaagagagtggcgacgagagcgatggatggagtgggaatcatgatgaagggcaaactgacttaaagggcagaaaccattaaccaagggattcaatctgaccaaccaatgattggtcaaccaatcaattatttaatcaatcaatcaatccacccaatcgatggatcattgaactgactgacaatgatgggatgcgcaagtgttcgatgttcttgaacatcgtgcccttggcgatcagttctccaaagccactgcagtgggagaaggcgtagcccgagcggagactgcgttttgccaggcccgtctttgtgatcggcgccgtttgtttcatcgcttccgccgtcggcgctttgtccgatggttccatgcaaaagcgatgacggacccgaaggcgatcagaataggagggatgggtgtcgaaccaaaagaagcgattggcgatcaccggcaccagcagaatgacacagattaacacttagaggggaaattggcacggtaaaatggcaaaatgaaggcaaattgatctaatattgccgacagggacaaactcacagagtgaaagccaaaactcgggaatgcgaactgctcgagccgcgacgccaaaattgtaagtgccggtgatcaattgnnngaaagggtactgtaaaagggggaagagtttggtattanaaagcaatcaatggttttgctattacctgnntacagacgaaaaccgtaagcacgtaaaagggcagagacccgccganncacagncnattaatcccatgtcannntagcgtgtcaaacgcgatttgaccagtgaccacaagcaccgaaaatggaatttgggggagaaaaattaaaattgggaaaataattaacgaataatgaaagactaattaaaaattaactaatattgattaatgaaagacaaataataaaataattaaatgaactgaacattcgtttgttcccccattttctacgcaatttttgtctcatttttggtccgcttttcctttcgctgcctcaccagtgccgtgtaagcggtgaatgcgaacagcgaataatcgtagaggccgcgtccgttttcactgacagcgcggaacaaagcgccgaaagggacgaagaaaaggacaagcgaactgaagcgataaaaggtcacaaccttcgcttcaactgctgctttttgttttgcttataatagaatgcttttcattcaattcgatcgccaagtgattttcgccatcggtgaaactgatcagaattcgatgggatggccaagggatttgtggcattggccaacccaattgcttattgatttttgccattggccaatccgttcaaatttcgatggcattgctaatcggttgttttgtacgactgatccgttgcgattggcttcgttcttccgctgcgtttcctcccccacctgatcatcccgtgaatgatggagtggatgaaaatgcgcatgttgaagaacagattgaactgtcccggaatgtaaagacggggaaagcgcgtgctgtactcctcgtccacgtcctggtcaaaaattgccatcgccagcacgggcaaagcggtgaaacacaaattgtacatggaaatgagcacggggtcgtacacagtctgcaacaaattagcaaacaattcaaaatcgactgtccaatagccaaacagtggcgaccgcaattcaattaattaaccaattaaaatgggaataaaatccctatcaaaacattggcgtgctattttttattggactatcagtgcgccatcagtgcgacttcattcagcattaaactgatcagaccgccctagtcgcattctctcatcatcggcaggactgatagtccaaagtcgtatagaagtgggagactggagggagagaagagtaaaaaatgggcaatgtgtgatggggagaaaaagagtagagaaagataaacaaattaatgcactttctctctgcccgctcttttctctgccgctctcttacaacccacgctcttttgcctcttatatttatttatttttttaaatatatttaatttt

SEQ ID NO: 14279 - DNA, 1071 bp, Heterodera glycines
  misc_feature (1015)..(1015): n is a, c, g, or t
  misc_feature (1022)..(1022): n is a, c, g, or t
cattgtaacgacggttctctgcaaaatgttttttcttttcaattgattaattaatttattatttttatgtatttttaatcattatcatttagtccaaattttgctttccattttttaatcgttctcttatgaattgccaattcttttgaaattttttcccccactttttgcgcactatttgcttctccgtttaccagcgatgcctttttttagtttcatatatttgtttacaattttgcgtctgttttcatcagtgttctttttctggtttaaaataaattaatttgcgttttatctttctttagtttaattaattacattttttaaatacaaattttcttactggtcaagcccaattgggctttccatctgtaaattgatgtaagggaagtgccaatcttttcggcaattttcatccattccctcgttgaatgggcccattttatttgtggctgaccaaatttttgcgacatttcttcatctttttcttccatttttatctttttcctgttattttcctgaatattttcacttttcgtctcttttttgacaaaatttccaatgtttttgccaattattttttgttcaatttttaattttgcttcttccccatattcagtgggattcttttcctacatttttggttcacggaaaaagaagcaaatttgtataatttttaaaccactaaaatattcatttattcattcattaatttttgattatatcacaatttattcaaatatttgttatgcaattatttcttatttcaatgtaatcatttccaaataaacctttatacgaaatgtgaaagaaaatcccataaatattttgaaagatatcaaataaattttgggaaatataaaatgagaaaatttccacaaaaataaatcacatataaaaacacaaacattcttaaaaaaatgcgtttttattattcttgcatttttgtggttgttcttttgatggcattcgtcgacaaaggaaattttggaaaaagttttaaattaaagaatanatattanaaaataaaaaaaataaaaaaaacattatatttgcgataaataaatttta

SEQ ID NO: 14280 - DNA, 2211 bp, Heterodera glycines
attcttaagaaaattattggtgactttgaggaaactgcttttaatgttaacaaaaatattttccaagtcctgtaaatcagattctgaaattaaaaaaaatgttttgaattttcaaaaagagtaatttaccctttaagaacaaaaaaaacaaaattgagaatttgccgaactttgtcccttgtttttaaatttttatttacttattttcaacgcatttactaattgatgataacaattgtcgtcattacgggatgaatattatgcaatttgttgggacagtgtcacttcaatggtccctcttttcgcttcattttgttgccaatgaattgaaaatggacgggaatacattgatgaattggaagaaagcaatgaaaatttttaaaaaataaacaatcataaattggggaggagctgataataacatttttcaatgtaaaatttaatacaaacaaaataaatgtagcaaattaatggacaattatttaactcgccttaattcaaaatgttattatttttaattgtctttaattaacccaatttatttatatgatttcacaagagatcaacaattactttatagatttattaataaggatttaaattgaaaatttttatgtttttggataccaaaagtttccggtgattggtgaatgttatttttagttttgctgcttgacttattgccccaaaaaaaagatacccacgaacaaatttatgatcagcaagtgactaaaatattatgatcaaaatattaaaaaaatataaagaaacatacccataattaaaaatgctaattaaaattaattaaaaattgtattgaaaagagaattaaatgttatggaaaaaattaatattatgttttatgtgtataattcgaatatgcatcaaaaaacaaattttcgtgattttttgattatttttgctaccactaattaatcgtttaattaattggtcttacatcttttcgcattgctaattttcattttaatttcaaaatttgtgatttcccattcaaattatgctcccctcccttcctttttccgcttttccttcccccgtctctcccaatttcgctgctcctcccccgcccattttgcccaattggtcccggcgttcgtccccatggtccataaatatgctatggctctccgtttctcgaactccgccgcgagataagaatcgtggtaatacgactgataagtgcacatgacggcagacgcggcccacccgtcggttgccaaagtcccgcgactctttgcgctgcgctcgccgccatataaaaaaggcagcggaagaaagcattagtcagtccgggacgagaagagaccattttgggacgatcgttctcactcaaacccatttgaaaacaggaaactgttttttagcagaccaaaagtaataaccaacgaaattccgccggaaattttcatgaatttaatcccaaaaaggcgttaacagtccatttcttgatcatactcatagttttatttgacaaaattatattcgagaaaatgtaattcataattttaataaattaaaaaaagaattctcctttctttttccatttctctttcataaaagtgtgaattgcgtttgttcaaaggatcatcaaacattcaattaatgttattgatcgttcactaagattaaatgatcagatggtttttaatttctgaacttttcatggccaagggaaaaaataatatacttaaaattggacgaacatttttcgtccgccattcgcagacaaaagcgaataattcaatgttggagagcagggggagttttcagagtgggcatgtcgagaagtgggtaccgaaaaatttggagaattttcgggattttttttttaattttccaagatttaccctattaaattgactaattgatacgcttttcgggttgtttcttatcagaataatcgtttgaaacgaagatttggcgaattagcctttatcttttttctttttctcgcattttcataaaattgtggggggggggaaatcggagttttttttttgctgttttttttattcatttttgtgcacatcgtcacaaagtcatgaatggccaaatgttatcacttatcattatcagttcagtagaactgaaatttcttttttcttttttttcattacgcattcaatggagagggaaaaaattgtaattggggcgtttcagttattcatgaattagaaggtaaatgagaaa

SEQ ID NO: 14281 - DNA, 3518 bp, Heterodera glycines
ccaaaaatatgaggcataccttggcattttgtattttttgaaaaagaattggcaatgcaaaaatatccttgaaaattttgatgaatttgaatggaaaaaatgccaaaaatatcgcaaatatttggtcattttgtacgaatatttgctcagagagtacgccggaattccagcagtgaaggcaaaatccgtgaataaaatatggtcaattgaaattgaagggctaattttttatgttctttattcccttaccaaaatttcgtagttttattttaatccgattaaatattataaatatcaatttaaaaaatggtaccatcataatgttgaaccaaaattattgaatgagaataaattgagaaatgaaattaaatcggaaaacggaccaaaaaagtaaattaatgaaatgattttacaattggcaattgacacagccaaagaaagcccaaatgaaagtgttgatgaaataataaaacaaaattttgatcgaaatttatacgaaatgttatttagcaaaacatttggaaatgaaaatgaaagcccaaatttcaaattattttttcatgttttataatgggatgccaattctcagtccgaaggatttcttccaattccctgaccaaatttgggacaattttttttgtatatctgtgagaaaatacattaattaatttcgaacaaatttaattaattagtgaattttataatttcataccattgtgaaggtttaattttaattctgtcattacgatgaaataaactaaattttctccaacactttcgctaatttctttatttgttctaaatttttgaacacattagatttgctgagaccggaattttttgggtaaaaccgacacatgccgggcctagaaaagccggggcctggatttccatatgaagcagcaagttggaaaatttcaaaattttgggaattctaattatttttttcagttgtaatcggatttaatttgtatgccttattacacgaattttcaaatacgttggcataagcgcgacttcatgcaaaatttcaatttgtttcatataataaaaaaaattcgccatttttgaaaaacttggacttgaaatttttttacttttagaaaacttcaaaatttttgagcgattaaaaatcatgaattttgcaggttgttttagactttctgttaacgtattgtcgtgcaaacttttcaactcatttgaaaactattatttgaatgaagccatactattcgagcacactctccttgcactcgcattttcccaaaattcactgcccttttttcaaaaattcagtgaataaagcatcatcacacttaatttggcataattaaaaataatatttaagttaaatttaattgaatgctcacccatatgtttgaatcatcaaattttgacccgataattatcaaatgcttatcatcaaaagcatccaatgatgatgaactgccatttttttcttgtgtcatttttgccgcttttttaaacatttcgtataaatttcgatcaaaattttgttttattatttcatcaacactttcatttgggctttctttggctgtgtcaattgccaattgtaaaatcatttcattaatttacttttttggtccgttttccgatttaatttcatttctcaatttattctcattcaataattttggttcaacattatgatggtaccattttttaaattgatatttataatatttaatcggattaaaataaaactacgaaattttggtaagggaataaagaacataaaaaccttcaatttcaattgaccacattttattcacgtattttgccttcactgctggaattccggcgtactctctgagcaaatattcgtacaaaatgaccaaatatttgcgatatttttggcattttttccattcaaattcatcaaaattttcaaggatatttttgcattgccaattctttttcaaaaaatacaaaatgccaaggtatgcctcatatttttggattgcatatttactgatttgaagatttttttgttggcctttcataaaagcaattagcatatcatcttaaatctaatgaaaatggatttaaataaacaattaaaatgaaaactcaccgatgaattggcatttgaaaaggtaaatgaaaatggagacaaataatggtaaaagaaaaagccaaagcggggttaaacatttaatgccaagaaacaagaaatcccttacttgtcaagatcttagaagttacactagccccattttctgggctgtttcggtctcttcgggatccattttcgttttttcaaatcatgtaccaaacctgacctaggcgcctgggcacctaggttttctgaatttttgatcagaatatgcaaaattaagtcagacactaaaacactaaatccagaaaacccacttccaaaggctttttttttttttttgcaaaatcgcattcaaaaatctcatatttctttttctttccatttttcctccctctattcggttttttgtttgtttgtttgtctccccttaagcttcttgctgcttctctgttgacaaatgcgtgagcttttcctctttcctccgctccatttaatcatcattcttctcattcattgtcaaaagattaagcaaaagaaagagaccacagggggaggaggagggaagagaaaaaaaaggaagaaaattgatcgtttcaaatcagtgtcgctggggagccactcgttccctacccccccccccccccccggattagctccctcacccgtatcctttccatccctatttttcaaaaattaaaaaaatattttcaaagaaaattcgaaaattcctgtttgacttttatttttttaggtggggagcgggggggggcgacatggtgagtggaaactgatatgggcaggcaacggcgcggagggtccgccggagagaacgtacccactaaacaaacacaaacatttttggtgggggcacacaaaatcggagaggctaagagtgctcttctgctgctgctggtggactacacacatattattcgataattgcccgccaccatcggtcggatgagtccaaagaacgccgctgctctgagtcagatgatgacaatgatgatgatgatgaggaggatgaggaggaggatgagtagcatcgctgctgccgccacttttgcccctctccgttcctccgccgcctccaacgccatgtcaacaaacaaaagcattctttttggtcggtcgatggttgacaataataatgttgataataattttgggtgtgtctgtgatgctatcacaccaccctcagccgttgttatctctcggttttgttgatatgtaattaaaaaattttttgctttaacattccatttttttggtttgaaaatctgatcaaatccaacgaagcgggccgtttgagtctggcgcactttgaagctttgtaacttttgattgaaacgactaaatacaacattcttggcgtcattcgatagccctaaatgttctctatttagctgcaaattctcaaaaaaaacttttttga

SEQ ID NO: 14282 - DNA, 2110 bp, Heterodera glycines
cctaatctgttttatgcaaatcctaattgagttttccatcggaaaattgtgctgttactaacacccaattttcgcgcaattatttttaaaaacgcggaaatgggcagctagtcgaatgagtatcttttatagcaaagagaacggcggcggtgctagcttaggaaggtggattgggcgccgggcttttcgacagtggatttttcgacagaaggacttttcgacagcaaaggacatttcgacagaaatattataaaattcaggaggggacttttcgacagtagatttttcgacagtaaaaagtaattaaatttcacatttagttgtgtaaaagcgtaaaattttttccaaaaatcaacaattaagccaaatcagtatttgagatacataatatttaaactcaaaaatttttaacaaaaaaataaataaataatttttggtgatgatttttagaaaattttttaattcttagtgatgtatttttgaaaattttaaggatcgattcttaggagtttaatttttgtttttattacatttttattcataaattttgagcaaaacacaaaaggtcaaaataggttttgttaaacttcttagggttcaaagaaaataaaaacgataaaataagtgctaataactcgaagagttgcttaacaatcaccaaaaaacatattttccatgctttagggccactgcaagttcaggaaaaataagtaaaatctaaaaaacttatttctatgtagtaatattatttagcaatacacattaatatgttaattaaaaagaaatttagtaaaactgacaaacaataacttgtttttatgattactgtcgaaaagtccattttatttttctgtcgaaaaatccttcactgtcgaaatgtcctttgctgtcgaaaagtccttctgtcgaaaagtccgggagccgaaaaatccactgtcgaaaagtccgggaagccctaaagcgacaaaaaaaacaatttttttaagtcttaggaataaattttatttcacgtaagaaaacattttttctaaaacacggcaaaattattaagaaaatggaaaaatcaaaaattcggagaaaaaattttgggtcaatttctctgaggtgcttttaagccattcaaagagatgacttctgttaaaattaaagaaacaaaaagtaattttttttaaaccaagctcaaaaagaaattcaaggggaaaagacaaaaagataaaagaactaaacaattcataaaatgagcaaacttttaaaatataaaatttaaaatagtaacaaatggaaatagattaaagggatttaaactcaaaataaattcaaaataaaagggctttaaaaattaaaaaaatcaaagtatgggattcggcagaacctatggatgctgccggagaaaattttttgaaactttaccggtttccaaggacaatcctggaaagaacgccgctttcaaatttttcatgaagaaaagtacattttcgaagttttagaaaaagcaataattcacaatagaagtcgaccctgctctatccaatggtatatcgtttataggcattttctgactgacagctcgtaatgttccctgttagcgataagacaattaccaaaaaagttataacatgaaataacaaaaaacccaaaattttggaagttttttcttaataacttttttattgaatttcgaattcgaacagcattttagagaaatacgaggggatactttttggagatttcagctcatttgagcagccctaaatggtgtatttaatgtcgaaagtgaacgaaataaaaaaaattttcgtcgaaaaaagaatcatcaaaattaacaatggcctaaagaaatgccaaaatgttttttatctcgaaaatcttaaattttaatcgaatttgtctctgcccgaatttgaacaaaaacaaaatattctaaaaaatttttataattacatattttaaattttacgcaaattctgctcaccatatgcaattgacaccgctcaaattaatgctgacattgttcaaattgttgatcgaattttcgtccgtccattgtgccgtcgtcgtgtcccctaatttggcatcgtttaattatccatcggtcgtatgctgctttggt

SEQ ID NO: 14283 - DNA, 1565 bp, Heterodera glycines
  misc_feature (68)..(68): n is a, c, g, or t
  misc_feature (1357)..(1357): n is a, c, g, or t
  misc_feature (1410)..(1410): n is a, c, g, or t
ctctagagtccatgctcactctctctctatctctttctgttcttttccctttatggttagggccatgnccgcgccgcgccgcgccggtccttcaccaggcaaccaattataaagtgccgtccccccacccagcgcctcgggcatgaagcattagcaattccccgaccacaaacacatggagagggcgacaattcagacaattcaatggtggcacggcacacacagtgccgccttaagcttctcttctctgatggcaatgccaagagagacaaaaagcagcaggacggcgcgggagggcaattgaaaattgcaaaagactcactgagggcaaaggggggggggggaagaagcaaaacaacaaattcacaaaacatagtaacgaatgaatgaatggtgccgagaaaaatagtgccgaaaattagcccggaggggggggggggattttatgtgaaattttggtgtaaacttttaattttatggcaatttgtgccaatatgaaaagagttaatttaaataattttaaatcaatttggaaaataaataaacgaaaaggtgaacggaagaacaaaaatgatgaagcattttgaatgttaaagtgattttgtccggaatttttgtgtttaagagttagttaaataattttttttttcattttaatgaatggtgccgagaattaacggtgggcggggggatttgtgtgaaaattttgctgtaaatttttaattttatcgcaatttgtgccaatgtaataaaaaaaaagaaaagaaatttttttgatgtgttaacatgattaaagtgaaaacacagaatgcagaaaaaaaaattttcggaattttttaaagggatttttctgtctattatttatttttgttcattttacttttcaatttatattattcgcaaatttgtaagctaaattatgccaaaaatctatgaaaaaattattattgaattgttgtgattttacatttatttattgattgtttattttgagtgtttttattttttagttaaatttttgctaatattttttttgaataaataagttccttttaaaaaattacgtgaattttttatactctataggccaaggtggacagaaccaaaaatgctaaagcattatgaattttaaattgattttgtccgggatttttgtgttcaagagacaaacaattgttgttgttctttttcattttaaatgaggaaaggagaatattttatttaaaaattgcttttaagttttaagaatttttttttaaaaagccggtctcgagcctcgctcggctcaagaaaattctcagggtttttcagtctgggagtttgtctcgggtctcagctcaagaaaactctcgttttnttttgttggggtttttgctgtataagtagtcaatctcgaatctcgactctacnaaaactctcggggtttttgcatttttcggaggtaagtctcgagagtcggctcaaaaaaactttcacggaatttttgcagtccgggaggcaagaagctgatatgataccgtaatttctatgaagaaggcacttgcctgacttaccatgattatttg

SEQ ID NO: 14284 - DNA, 2087 bp, Heterodera glycines
  misc_feature (53)..(53): n is a, c, g, or t
gcagttttgttactgtaagagacacaccgtgatcctgtagtatatatttgcgncacgaacggtcttaataaaaaatgattgatcatcatctgattgagtttttctttactattttaaaactcataaattaaaacttaaaatttattacaatttaaattattttaggatcattatttaaatacccaatttttgatacatttgtaaggctgtgtgatttgtcatatttctcatttggatttaattttttattaaagaaagatatatttataatgttttattccgtttcaaccattctcctttttattactgctattatacatctttatttaattcatatttcatgtgcaattccatcggtgagttaattaatccgagtaattaattttacgggtctattttaattagtttgatgacaatattctaattgcatttatgaaaggccatcattggaaatgtgacaaaatagcagagaaatttgaagaatatgaacgcaccgaatgccaaaaatatcgcaaatttttggacattttgtacgaatatttgttcagagaatacatcggtattcacacagtgaagccaaaatttgtgtttaaagaccaaattgaaattaatgggccaataatttatgtggtgcattgtctagcgaaaatttcgcaattttattttaaattatcttggaataaaaattatgaatataaattaaaatctctgttcaaatggcttgacaatatttttgaaccaaagttgttgaatgagcacagattgaattatgacgaaacaaaattgccaattaatgaaattattttacaattggcaattgaaaaagcgaatgaatggcaaataaataaaagcttagacggaataattgtacaaaaatttagcaataaatttgaagaaaatttggaggaaatgtttaaaaaagcggaagaaagggcaaaaaacaataaatggaaagcaaatctaataaatgatgacaagcatttaatacttgtggacccgaagtacgaagataaatggacatgggtgagacttaaaattcaatgaaattatataaattcaaaacttagactgatgatgcgctattttctgaatttgtcaaaggattagcgacaaattttgagaaattttttaaaatggctaaagaatattcaaattatttaaatcgaatgaaagagaaaggagggaggaatttaaagaaaaatgccaaaaacatcgaaaacatttgcatattttatatgaatatttattccgattatatgctgaaggtttgttggaattttagtttattttgatttttacatttattaaagtaatataataataataatttaataagctaataagctaaaagtccgaaattgtcgaaacaattgcccccattggtgaagccaatttttattgttggagggaatcttcctgacagtttaattggtcttgtcgaaaaaatgaatgaaatttcgaaatgtttttggggaaaaaaggaaaaaactcttgatgaaataaaattagtaaatgagtaggaattaaattttgaaattaaagagcagaaaaattagtcccataaaattaaacaaaagagaaaacaaattttaaaaggacaaacggacactgaatgaattcggcaagaatttgaacaaaaaatggaaaaaatatatgaaaatacgaaagaaaatgccaaagaagaaaaggcaaaattggaaaaagcaattgaaaatgcgacaaatagtgaagaaaaggaagttctgggagaagaatacaatgacaaatttggcactttcaattcatcgccatttattgacgaaatttgacaaatttggcactttcatttcgtcgctctttcataaatcgttccttctttcccatcagatccatggcatttctgatgatgggtactattttttcttggaactttcattcaaatattatttttaggggttgattactggtttatttctctaaacttttggcttaaaacggggaaatttactatttccccgggaggggaaaaaaaaaagggtcaataaattggttattttcttaaaataatttaaatcccattgttttttccgaatatttcctttcttttt

SEQ ID NO: 14285 - DNA, 4205 bp, Heterodera glycines
tgtgaatttgcgtacttgaatcacactaaactttcccatcatgtacttagttaacctaaatatataaataatcattttaatttagcgacagatggctttgatccgcttgtccgattctgcgtttaaacaccgctatgtgccggctgagcgccaaacttattcagagcaacaaccgtatgaacgcacgagtgccaatggggacgaaacgatttcaaccgagaaaaaatgggacacaaaagcgatgaattggccgaaaatgttgcttgatgaagaagggaagagatgaatgaatgaatattgggaaaatcaaacaatttcatgatgaatttatgcacttatgatggatgcccttgattatgccatttaaaaaagaattttacatttttcgctttaaaattcaaaatcttttttttgtgagatggaatcccgagggataatcctgctaaaaccccagttaaattttatgggatcacgggtgattgcggaatttttgcatgttcgaaaattctaactttaataaaaatcttcaaaaaacaagaaaccaaaccaatttgcccctttcataaattcagggagtaagggtggggccggtggtgccgataagcgccgctggttaattaaaaaatctggccccaatttcccagtgaaatttttcaagagttaatcgggcttgtgggccgacggaactgatttacggcgccgagaaatttttttaaaaataaattttagatagaatttgcgatgaaaatgtttacaaatttttgtaaaaatgttcataaaattctggcattatatactttgaaattaaaaaatatatttacttttctgagaattttaagagtagtttttttagtgacttgaaaatgtttcaaaaattaaaggattatgactaggggtgagattatttggctctaaaaactgccaaaataggtaggctctaaaaaactcaaaaatagtatctaaaaaatggaaaataggcactaaaaaccctcatttttagggaaaaaagtaaaaaaaaattaggccaaatcagtattgagataaataatttttaaataacattcctgtcaagaaaataaataaataaattttggagatgaatttttgaaaaatttcatttcttaggggtgtatttttcgtttttattgcactattattaacaaattttgggcaaaacgccaaaataggcaaaaatagttctttaaaaattttttaggcgctaaaaataaaagcctagaaaataggcactaataactcgaaaagtagcttaacaacagccccaaaaaaacatgtttttcttgcatttcaggccacggggagctcaggaaaaaaataggcttttgcctaaaaatcccatccctaattatgactttaaaaaattgttattatttttaaatttataaattaaattaaaaattttatgctattgcattgaaacacatttttcaaaaatcttaatagtcgcgccccataccccacctttattaagacccccacctgaagcaaaagtcttaatttactcatgaaaaatagttgtcaaaaaattaattttgaagtttaattaatttaaaaaataaatatcataaattcaattggaaaaatccttacaaaacctgacattattaatttttattcaaactttcgaaaacatttatttaactttgaaatattattaaatcgtttagttggactttaattcaatctgattattccacttaattaaatatttagacaaagaaaacaaaatgattttttctgctccattaatttcttttgttatttttgctttccatttctcatttccaatttcaaatgcaaatccattgatgggttaaattttggaaaattctattttaatccattaattaggtgacagacaattggctaattgcatttattaaagagcataaaaaccactatttgtcaatattcaacgcaagaatatgaggcttaccttggaattgtgcatttaatgagaaagaattggcaatgtgacaaaattggggagaaatttgcagaatatgacggatagaatgccaaaaatatcgaaaatatttggacattttgtacgaatatttgtttagagtgtatgttggtatgtccataatggacccaaaaactttgcaattggcaattgacacagcgaagaaggttcagcatggagagccaatgaaatattcgaggaaagcatttgataattttgtatttagaattccaaaattcagacatttgggtaatattttttttgattaaaataaattcaaaattagactgatgatgcgttgttttcagaatttatgaaaggccaagcgacaaattttaagaaattccataagctgtttaatgaaaatgaattaatgatttttgcaaagcaaaagaacatttgaaatatgaagtgcatctcggctttgtatttgatgcgacaaaattggcaagtgccaaaattggagagaaatttaatgaatatgaacgagaaatatgccaaaaatatgacaaatatttgcgtattttgtacgaatatttatttaggctttatgttgaaggtttgctcaatttccattaattcaaaataattttttgattttaaataataattttaaaggaaaaaacgctgaattggccaataaattttcggcaatgaagccaaaatgatcggtcaaaaaaaattacaaaaaaatggaaaagaaatttcaaacgaactgtcggacattgagcttgttcagaacgaatttgaaaaaaacatggaaaaaatccatgtaaatgtaagagcaaaagccattgaagaaaaggcgaaattttgtccaataatcagaataaaaattgttgtcaacgcatttttccttcggtgcaaatcggacatcaccagacccaataacccattattttcttataaattagttcaaaatcacaaaaacagtttttgtataaattctgttaacaaattacatttcaaattttcaaagttttcccggcggcgcctatcggcaccgccgacctccccccccccggttctctaaagtttttgaaaaaatttgcagcaaaaaaaatcttaaaaatctgattttttgattccgtttctcaaataatcatctgagacgaaaatacaaaaattgatattaattgattaaattgtaaaaaaattatttaaggctatgttgttaaatgctctcatttttgaaaatctgattttttgggcatgatattccaattttgaaaaatttctataaaaatctgatataattattgatcaattataaatattagataaacatttgaacaaaacatggcacaaaatgtaaaaaaaaaaaaattgggtttgagcaaatcccgataatcccgcgggatcacgaaaaaaaccaatttagtgcttcactttttcatttgtaaattatttagcggctttcctcccaatgattgcccaattttgatattcaatttagctttatcttttccgctgacccacaaattgtccaagccacgaattgtccaagccacgaattgtccaagccacgaattgtccaagccacgttttgtccaagccacgaattgtccaagccacgaattgtccaaaagagtaaaaacccacgaattgtccaaagtctaaaaagctcataaaaagccggaaaatgggtctattttagggttttcggggtcgctgaataccaatacgacatttatatagccccttgcctaaccctagacccaaatataaagattaaatagcaaaaaaatattcaaagctcttacaaagagtgctgatcaaaattcgaacaagtttagggctcctatgtgatccgaattccctctatagacccaccctcagcttcacacattgaaaaaaataattttattaaacattcaataaaattcattacgggacatggacaattgaatcatcaaaattttcaaatccttcaattttcctgcatatccctcaatttgagagtgccggcggaattggaaaatgtggtgcccgaacgatttcgtcctcccatgctgtaaatgaatctttttattgagtttaaaacggtttaattgattaaaagaattctgcctgaaggcgctatcgaagtcgatagcggactcaacaaatattgaacaagctgctcacgtggactcacagtggttggccatgtaagagttgatggtgccggtgagccggtgccgaactctaggggtagccgcatggcttgttccgagttgat

SEQ ID NO: 14286 - DNA, 3173 bp, Heterodera glycines
  misc_feature (3073)..(3073): n is a, c, g, or t
tcttaaatttaaatcaatttaattcaataaatcaatttattttgtattgtaccgtattgcgtgacataatttggcaaaaatggccatggataagtgacaatgtgaaatgccataaggagaaacaacgagaaaagacacgtcagacgttcattgatcctaattaagtaatctttttttttacaatttcatgattaaattccgtgctcacttaccgctgtcccaaatccgtaaagatgtacatggcgtacaccagcaaagtgagaagaccacgggcggagtgggcgaaggattcgtaagtgaccacttcggtggaactccacccgaacatcatcatggcgaaggaggtgccaatgctgcagaaacaacaacagtttgaagcattaaaagactgttcgaaattacgtctccaaattcgtgaagatcaaatactgcgtgaatcgcatcgcacagcaaatggccaatgcccagcggtcgtagggcggcaatttttgaatggccgactcgacttcggacgaatttgcctaagcaaacaatttttgaaaaattttatttgctcttccaattttcaccttgctttttggactgtctaaaatgccgacggaactttcgcgaaagaaaaattggagcaaaaaatgaatcaacacattggtgcaaatcgcaaaaagtgccgtggcagtgaacatatttatcgaaatccatcggttgagccgccacccggggtaaccaatgtaagtgaaaaaccattggaaggctaaaattaaattggatttgcttgcatgagttttctcctcactcgggccaagagtaatgccaatcgctgtgccaaaggtcgtccacgccgttgcgcggtagcgatctttgtccacactggcaatggtcgaaaaagcaaccagcagactgatttgggctgttgaattggtttgctcaaaaaccaaattcgaatgagaaattaccgggcccaattccggccacgagcctggacagcaacatcacatgcttcatccattcgacagggaaccactcgatgacgaagtacaacatattgccgatcaacatcatggcgttgcacaccaacaacggcacacgcagctgaccaatgcggtcggcccaaatgcccatcaaaggtgagaaaatcatttgcatcagcgagaaacagccgacgatgatgccgaagaagccctcagaaacggtggggtcaagctgaacggaaggcattgaacgaatttaacattttttaattatttgtcgcattttttttggtttaatcgccttattttttatattctgtagtcaaaaatagaaagcataaacataaagagcactgaaaattgaaaattcagcagaaaaatgataagaaaagagagaacagaaaaggggggaaatgatggtcaaattttacagaaaatgaatacatattctgctaaaatgataataattttaaatgagtattttcataatattcaaaaataaatatttatttatttttttaattttaccgttttcataaaggcgaattgcgagttgaggaaaatgctgaactgaacttggccaaaaaagcacaccaaagcggccaaataaattgagcgccagtccgtttttcgatcctctgctgagaatgaatcttcggttgcgccgctggcggttgattccgtgccattggaggggacgcatttctgactttttgggaatattttgtagtccgacggtttgagtgtcgtcgacattttacagaaaaacacctaaaaaatataaataagccaaaaaagtaaaatattattcttttaatagcctcttaatttttcctgaatttgttcttttttcttatcggaacagaacaacatgggtcatgggattggttggttgtggtcattgcaatgattaatgttaatgagtgtgtgcacacacaaaaaccaaatttatttgaaatgacaaataaaatatgaaaataaaagaaaaataattaaaatactaaaaactctaaaattccaattttttatgttattggaactttcgacaacagaataatgcaactttattgcagcaatggccttctccatttggtgctctgcttcaaacaaaatgttaaaaatagcggcgtttgtgtgtaataatatggtaataattgtggattaatcattatgcaaaatattttttcatttttatattaaagaaaatataaaaaaataaatcaattagggaaaagaagagaatttttatgttaaagtgcctatgaaaaaaagttttaatttaaatgcaaatattgtgtttcccgttgaattgatggatgaattaaagacaattatgaaataagaaacaatgttttttttcattaaatgatagtgaaatgaagagactcccaaattttatagcctcagatgtaattgatgcaatttggccggttgatccacctacacttcgaatggctttatcacgggatgaaactgacaaatgaacacattggggagaagaaacattgacgaactgataaaagacaaacgaatggaagagataagagataagcagcaaagctaaaacagaaatttgatcaaattaacaaatgttttgaaatatcaacaaaatgaaatgagtacatttgtacgcagcgattgggggaaacatagggacaaatgataggagaaagggcgaaaagaaagaagcacgaacagaaacatctgaccacaacttacgggaaggcctgtgctaattgaacgttacaaaaaaatgttgaaaggattaattacactatttggagtggaataaataaattaaattgtcaaaattatgagacttatgtcaacctttttttaattttttctttattatttggtccaaatttcttcaaaagtatttatcataattagggaacggaatttttaacaattaataaatttctaaaaacttattcaaactgaaaatttgagaaattactgaaagtcgtaacatttgaaattttaacatttttgttgtaattaaaggcttctgaccaagtttaaattctttttcatgtcttttgatcgttaaaccattaactagtttaaattaagcaaatgcttccgatccaatcatttaccanataatttttgattttctttttattttatattttatttgttttttacattttgtattcttttaatgttattttttgatcatttattgtttagttttcgtat

SEQ ID NO: 14287 - DNA, 1374 bp, Heterodera glycines
  misc_feature (41)..(41): n is a, c, g, or t
tttgatgcgttagtagcaggtacaaccaatatttcttcccnccccagggagtgaaattatattcaaagggagcggggggggggggcaacacgaaccagcaacagcaacagaacagtttgcttcggtggtgtccttgcttcagaggtgagttctatgctttcaaaatctaatagcaacagcagaaaaagccaattgttttggtgggtggcagagggtggcatttgaaattggtcgtcacatttcccccgggccaattgtctcctcaatttggcctcaaaagaaagcagcaaatgtatatgtgtgcgtatgtgctggcgggcgagaaaattgatcaattgggtgcctccgatcattttggacccgccaaaagctgatcaatcggcgccagcctcgccccgcttcctctgcccctccgaccgcttcgggaaacgattgggtgctggccaaccgaccgtttattggacgacaaaaggcacgtattcggattttccgctactgctggtgctgctgaaggatttacgacggacggatgcatttgcggagaatgaaaggaacagcggcggcactttggcagagagttccccctccccccagggcctatcccttcccaatgttcgcatttccggccaaatgcccaaaggcccacccatccccaagctgaggcttggagggaatcatcatctgaagccgcttgctgattagtgataattaacgatgcatttttccacgatttcccagggacatttattatacatatgtactatagcagtaggaaattaatataaaactttttattggataaatttatttcctaatttattgctgaaatgtttaaataattaaatattttgcattttttttttgcgttttcactgttctgccattttttgattattcatcttttttatatgacaaaggttatcgcaccctttcaaatagcagtgctcaagtttttaaaaggtctgtcggctgtccgttttcctaaatgcgcaaatgtccctctttttttgacagtgtttagggaatgtcccccccccccccttattcgtctgttttgcattttaaaattgccattttggccaaaggtccatccgtcgagcacttttttcaaaattacaaaaaaaaaaaataacaaatttgaccgaccaaaaatgtctttctatggtaaaatgaacagagagggaaacacggaaagaaggttttgtgttctgtttcaaaggccttgcccgaaactgaactcattcattcattcattcatttcattttgttccatctccttctcctgctgttgctgctgaaccctataaaaagccgtgtcccccccccccctccactccatccgttccccctcagtttccccctttcccctcctcg

SEQ ID NO: 14288 - DNA, 2121 bp, Heterodera glycines
atcgatttggtttttgatttcttcaaagtcaaaaaatggcccatatgtaggcggaaatggaattaaaaagcgtgaagttaaagaacaaaagttaaatttataattaatattaaaatattttattaaaaaaaattcatccatttgcattgagttggatatttttatggaaaatatgtttatggattataactccatcctagaggcttcaaaccaagatatgtgcagaatttattcattgaatgtttttcatatgtggacccacaaaagttggcattgtttttttttggtatttcaattcattttgcttaagttttgctttttcgaggatcaagcagaaatatttggaattggatgtatttattaataaaaaaaaatcaaattaaaattaaaatttaagggcaagggttgttttcaatcttacaaattctttgaaagtcgaaggatggcaatacgtcaaatatttcagtttgggcatcaactttgtatgaatgtgacggcattcaaaaatgaattctttgggtaagtatttgaaaaagtaaataatattattattaatatacaatatatatacaaataaataattaaatttttttattaaaattaatatataataattttaatcttttcagaaatgatcagtcacacaaattttgtgtgcacacccgcaggggagattttgttaaaagaggttgggactcgaagaaggaacctacggagaaaggaattgatttgggatttgaatatttaaaggtgattcaaatgatgaattatcctttttaatttttaattaaaaatttaggaaaaatatgacaacatttccatttctgttgttttgcttggagaagacaaacaatttttggcgaatttatcattcaatcagcaggcaaataaattaacacattttattgctataattaattaaaataaattccctttctttttttgtcttttgccaatgtttacgtgccgaaaccaatgccaagggctaatgatttggcttttgccgtgttgggatgcgattctttgtttatctcggctcagacatcgacattttcttggtggattgcttatttgatgccggacgatgcgaccattttttacaattccgattttcttccgggtcctttttaactttttgcatttacaaaaaattgctaaattcgccggtgataatttaaaatttttttttccaatgatgactaatttatatttgctcttatttaggccataatacccaggaacattttttgcctgaatggattccgataaaatcgaccaatggcacagagtctctcgattaaacaagcaaagtgaatggaaacgattttgaaaaatgttttttttcttctctattttatgatgataaatttaacaataaaaaactgcttcttcagcggttggcttagtttgagcggcggcgttttctgctcgggtcacacactgatgtatttggttggagtggcgctgtcaggtacagtagggttggcaccagcggcgcggtacggtgaccgggttgaaatcctctgatttttcgtctccatttttctctcccgggaacagggaccaccgcacctatccccgccgaggatgggcataataactagtgctgttcgagactctcggtctcgactcgagaaaagtctcaagtttttttttgtctcggtctcgattttcgagactcgagattgagacttttttacacccctaatggttggctttttgtaaatttaaaattaatgtatttttggttaactttttgcatggtctggtgggttgtgtcttggtcatgttattcagttttgcgttgggtcagttcccctccaagtagttttttttcttctcattttacgaaattaatgtttattcgatagggatttaatcacaattttaacaattaaaatcgtaaaatatttcatttttggactttttttgttcacaaagtgcactataaaaacccgtgctgggacgtttcgtaaaatccgccactttgggcgtttcgtaaaatccgccacttttcccattttttcgacaaaacatggtataactttgcttaatatcaaccaaatttacattcttggtaccattcgatagccaagtttatctctattagcctgctaaatt

SEQ ID NO: 14289 - DNA, 1776 bp, Heterodera glycines
  misc_feature (33)..(33): n is a, c, g, or t
gtaaggacatgttccatgacaaccttaaaaatntggttggcattctccactatcctttggcaaggggttaagcaatcgaaaattgacaatttcgtgcaatgtaccgaaattgtgccgcagaaatttgcgccgcgacctttgcgccccgacactagcgccgcccagtaaaaactgacattttcgccgcgaaacttgcgccgcaccacaaacccattttcactatttattctaaaaataaattaaaaaaatcatttcacagtcgtttgagaaaattttctgaaaattgcaataatatttttaaaatatatttttgactcagcgacgcaaatgtccattttataaaaaattagaaagaggattttttttttttaaaattccaataagattacacaaattgatcctaaaaactcacctaaaaattcagaattgtttattttgtcatctaaggacagaatactgaatacttgctgcaccagtaaataattttttatacattttctaaaaaaaggattttaaaaatccaaatttcctttatttaatatttcctttttttgcattttcatcattggattttcttggtaattttttctcatttgaatcctggacatttgcggcacgtttcttaagatccattaacggacattttcggcccagtttttttttggtgcggcctaagccaaaatcggacttttgcggcccgcgacatttgcgtcccggacattggcggaccgtttcttaagggcaattttcgtaccttgtcgacccaatttttttttaaattttgagtcccaagccaaaatcggacatttgcggcccaacatttacggcccgacattggtgtcccggacatttgcggcccatttcttaagatacattttcggaacattttaggccatttttttttttgaattttgcgtcccaagccaaaatcggacatttgcggcccaacatttacggcccgacattggtgtcccggacatttgcggcccatttcttaagatacattatcggaacattttaggcccaattttttttattgaattttgcgtcctaagccaaaatcggacatttgcggcccgatatttacggcttcacccaaatttcaccatcggtagcggcataaattacttagcatgggcacataagggagtaaatttatgagacttttcggtaaaatgttaactcctatctgtgcggatcctttttgcgtgaggactgcaaaatgcccaaattgttacttttttatacctcccaaatagttgaagcgctatttttggatattctgtgggcttttcattgaggttttaaaactcacatgtgactgccccaaaccgtaaggtacctactttgcttcatcatttaaacgcatatagtatcgctttattttttgaacattcatgcttatttttcttgatttaattaatatttctttgattttttcatttcatttgaaatttaaataactgcactaattatatgtgtttttgttgaaatggaatcatttaaccctgatacaaaaattagctttaaaattgaacaaaattgaaccattttctacattttcccaacaacgaactggtactaaaaaacggtgtcccaacactttgaataatgggcaatttgaaataaaatgccaccattatttcgtcgacatccacgacgaagcggatggtgcgctttcaccgataagaattcggaaggcattccgaattctcttggaatgtcagggaaaagtaaattaattttatttgccacaaattaatatttgcataatta

SEQ ID NO: 14290 - DNA, 2690 bp, Heterodera glycines
aaaaatgcaagcgcctcctataacttctaccttttttgattttttagaccgattaaaattgcaaatttgctggttttagggataaaatctgttagcaaggttaacaaattgcactcaaattttcaattttacctccggcggcgcctatcggcaccgccgggccccaaaaacttattatttcataaaattggctcaaattcgcaaaatttggtcatttttagacaaaatctgtgcatatataagatatttaattttaaaaatgttaagtgatttttttataaaatgtaaattttgttaaaaatggaatttgacattttttgttcgaatccgggttcggggtttgaattgggtcaaaacagatgcaagaattggtttttccgcccccgaaaacctataataagtttattctcaaaaaaaaatattttttttttaatctggacacagataatacataagcagggttgccagatgaaaattttaaaaagcctcattttgggtcaaaaagcctcatttttacaaaatttattcaaaacacgtatgaaatgttcaaatgttatatttttgattgtccatgatcgatttgagtaattttttttgttcgaaatgagcattttgtgagattctgagcatgaaaaatcgaagttgatttttttgcggcgctttttccaaaaaacttggggaattgaggggccggcggtgccgataaaaattgagaagtttgaccatatttttagcagattttcatttaaaaaaattcataattttgtggatttccgaaaaaaattgtaatttttctgaggattttccccaaaagcctcaaaaatcctcaaaatttctcaaaaagccacaaaaatcctcattgacctatcaaaaagccacaaaatgaggataaatcctcagatctggcaaccctgtacataagttacccgcgcccgttgaactgttcaacaattgctcttatgttgttatcttgtcgaatacatttttcttttcgactttgatttctccctgggcaaattggcggacgccttggagatctccaatactcaaagcttccgttcaaaggaatataatcaaaatttcggaacaagcttcgtccacgatttattttggtctcataaaacggaaaaattttctctggcaaaacgcaagtgaccaatccatttcatcatttgcaacttcaagtcaagataacacaatattaaaaaaagataacgagaagaacggcagaatgcaaataatatacataatttaacgattcttgcaaataatatacaaacaattctcgtttatctaatatttatgggaaaaattatcacattatcaacctttgaatagtttttttttcgaatttgaatccgaggcagggctgcacgcaagtggatttacaattacggaaatccgcaatccgcaattgcggcgattttctcagttgcggaaatccgcaatccgcaattacgggtgtccaaaaaccccgcaatttccgtaatccgcaatccgcaattagaaaaaaaattttttaaataatttaaattttattttaaaaaatcctataaatcttttaaagcaatttaaaagcatattaaaaagcaaatttataaaagcaaaatcattcaattgagaaaccggttaaaagcaaattgtgatgaagaaacaaaagctttgccagattctccgcctgtaaactctttctcaagtcatctgaaatcaggccggccgttgagaaaagcctctcactttctgaacttgttgcaggcggagaaagaaatttccgtacaacggcaccaatcattggccatttttgtgaattaacttcccagtataatgatggatcggccctggatttgattttttggtcccgtaaatattcagctttacatttagcagttgctttgccttgacgctcaaaataataccaccaattaccagttaagtttgacatttttaaattgctaaagaaataagaatttaaacaaatgtacatattttctttaaataaaaatagaaaaaaaattcattttataaaaaataatcttacaagaaatcgtctcgttaaaaaatccaatagtcaaattacggatcaaaattgcggataaatcccaaaaatccgcaacccgcaatccgcaattacgggggtccaaaaaccccgcaatttccgtaatccgcaatccgcaattgcgtccagccctgatcgttaatcaaattaaaagtgttttttaaattgcagtttaatcatgggtttaatttaataaaattatcgatgaacagtctattatatttttttagctttatggttttttgattttaaattatactttacacttaaatattaattttcagttttacccttgtttaaaatgatgattgaatataatcattaaaactcattccataaattaaaaaaaacaattttttgaatatttctttgacaattttttgcttttttttaattagacttcgtcaaaaaattacaatatttgcgatattgaatctattttattaaatatgaaaaataatacaagtttccagaaattttttgttttaaaatcaaatatgcaaaaaagacaatctctgtaaaattaaaattttaattggaaatattttaacggaattattacaataaattcgtattgaattttaacagagaaaagagaaatagttctaaaaatatatagaattatgactctaga

SEQ ID NO: 14291 - DNA, 1004 bp, Heterodera glycines
cacccccccccctgcctacgcccttggaactgtgggaaaataaggagctggacgaggggaaatccaggatcagctgcaggggaccttggaaaaatcttgtacatatcctgaattgcccgggctctatttttttttaaatttaaacaataatttatgtatgtaaaaactttctcacagaatcttccattctttttcactacgtctttctttctcatcctcctcccctcccctctctctctctcctcacttttcccacgcgtcgctgtactgtctcaaccttttcatgccttctttcttcgttattcgttcgccctccttcccctctccctcccactttcttagtgtccctctctcatccatccgtcaggcaaaaatgggacacgggggcaccttcccagtgtctctcccccccccctacctccctctccccgtctaatagcagactttttactcctcaccccctcccctttttttccaatttcatcgttgtcttgggacttgggggtgactatcctttctttcgttcttctcatgccttatatttgccatccttagacggcggaagattggatgatgcaaattgctaagtggaggttggaggttgaaaattgttgaaaggacatgaagccatgacaaatgaggagggcacggcacactttggcccctctcctccgtttccttttgcctttctttcactttctcaagtgccaattttcttttttttttcttttatcatttcgcaaattaggcattctcagtctgttctgctaataagctaattccatttattcatttgattgtgtctgcgagctttttaatgagctaaaattagcatgaattaagcatgcaaaaaagagccattgctcgttgtcatggacatttgtgcatacatcatttaaaacatcacctaattgaaagagagaaaagagacagagagagaaaagagacagagagagagagtgagagagagagagcgatttaattttctcgaaaagagagtccac

SEQ ID NO: 14292 - DNA, 2780 bp, Heterodera glycines
ggcgcgcggacaaaatcccgccccgacaaaatcccgcctcagctaaaaacgacaaaatcccgcctccacctaaaaacgacaaaatcccgcccgaaaaaatcccgcccagacaaaatcccgcctcagccataaaacgacaaaatcccgtcccgacaaaatcccgtctcagccaaaaacgaaaaatcccgcctccacctaaaagcgacaaaacccgtcttcttaagaacaccgaacatttagaattttttattctaacataatgaattggcaaaaagtgagttgaaaaagataatttgacaaaagaaaatgcgataaacaaaaaaaaatggtggacaaatcttcaaattgtcaatcgtcttccgaatcgatatcgctttcattgttcctcacatggagaccaccaacgaacccctgcatcaccaagcccaaaaggttgcacacttccatcagttcttcattcgttccgaaccttgctgtttccaaaatttcgaccattcgttgctctttgataacgtatttgggccgacgatctctgattttgcgtaagcgtatcgatcgcgcaatgtctatctgtttgtcgatgtccttgacgaacgcggccaagaaagcagctctgaagtatgatgttccaagtcacgctgaagccatttgtcttaaaatcactatttgttaaaaaactaactgcgaattgtccatgcgccgactccatcgcattgtttgtgcgttacattgccgcctgtgctctgtcgtagacgttccaaaagtcgacattgtattttggaggccgggtgattggaagattccatcggtgcccacgtccgatttcgtcgtctatggatgccatcgtgggtgttgaaggtcctggggaaggacgcccaaactgaacaaattcatgttcctttcaagctgttcacgacgactcattttaacaaaaaaaaatggctcgttgctaaattcatgaaataaatgttcggtgaatgatttttataaaacaaaactaaggaaatttttgtacacgttggatttgcgatttgttatcgttttgtaacattcggtgtttttagtcgggattttgtcgtttttaggtggaggcgggattttgtcgttttatggctgaggcgggattttgtctgggcgggattttgtcggggcgggattttgtcgtttttaggtggaggcgggattttgtcgtttttggctgaggcgggattttgtcggggcgggattttggtttttaggtggaggcgggattttgtcgtttttggctgaggcgggattttgtcgggcgggattttgtcggggcgggattttgtcggcacacggcggcgcgcatgtcggtgcatatcgattcagtgccgacgattcagtgccgacgattcagtgacgacgattcagtgttaagacgattcagtgacgacgattcagtgacgacaattcagtgtacgttgaaaaattgacaattcagtgccagaaaatttggcaaaaaaaaaattccaaaaaaccctaaaaattgcaaattttattaattggaaaacataaataacaaatcatgggttcatctcataattgtgggatattccctgaagaaattcaatcacatagttaaaatttgggccgggatttgcaaagtattggtgatcgtaatgaatgggcactaacggattttggactcccatttcttgggcgtatcgttcaacaagagtaagaattcggcgatcggcgtctctgtactgcttccgcttctttgaaggttgttcgcctataaagtcagctttaaaaatttttgatttatttttgaattacccatcgaaaattttgcaaaatcggcgtcgataattttctgacactttcggagtctgtcgataaccaaattgacggatggtcacagccaaatgcgcgttgaagtgatcggtgtgcggcttctgcgtaattattcgtcctgtctcgtttttggatggttcgcagatgaacactccagatcaccggatcaaacagtgcagggtttcgagttccgtcaaaacgcggtcggccagtgtaattgttgatgaacctgtatttaacatttaagcaactttcaaaattgaatttttaccagtcaaaaactggctgaagttcgagaggaagttctctttcaagtgccatgattccaagcgtcaaatgttcaattggtaaaaaagccaatgatgtaatcattttggcattcatttgaaagaccgggtcagaattgtagcgctaaaattggaatggaaattaaaagtgacacagcgttgaaggaaaaacctcaacaaggtgttcagtagcaagacgctttttgaaattacggacaagatgaaaaaagcatcctgacagttcacaatcctaaaacacttcttttacagcaccgatgattcctgcttcaaagtcaaccgaaattgagtcaggacgaaaattaggccagaaagacacaaccatccgaaaaaagcgggcataggtctcctttgtttttgtagtaagtagcccgtacaaaactggtaaaacccattgttcacgcctaaaatcattaaaaaataattgtttacaaattaaaatgtacctcgcaagaactgcgaacacctgataaaaaagcggtggtgcgattgcaaaagtgccatcaacgtacacagttcgcatttgctgtgcccaactgccatttgactcttttccgaaaattagaattctaaatttttaaattataaacggataatgggttttgtttccttaccgttcagttgtctgtcgtcctgcttctctgtaaatccctg

SEQ ID NO: 14293 - DNA, 2705 bp, Heterodera glycines
  misc_feature (2642)..(2642): n is a, c, g, or t
ggtggttcagctactgcttcgtcttctcgcttccgtcatcgtcttctttgtcgtcacttttccttcccttcgtctgtccctcttcaatttgtcggccagcgggcgatggcggaggctttggcggcaattttggtggcgtcaatggactgtctggtccgccgcccattctttcgcgccgcggcggcaccaccggaggcgacgacggcgtcggccgaacgcgaagcggcagcggagatggtggcaatcccatgtcattgcccatgtgacatggcgatgaagtgcttgaatgtattatgtaagctagccactaattaccagcagtcactgccaaagtatcaatttccacgccgtttctccacgaaaaattttaaaaatttaatcaacccaaggtttttcagtaagaaaaaagcaaaaaaaaatgtgcagattttcaagaattttttggttttaggtctttataagaattgttcatttttgcttatgcaggtcttatttctttgattttttaaaaattttttgggctggggaaatgaagtgcgcccatcacaagcggccataaattaccgacttcggattggcacagtgtgccgttgccggtgacgatgctgcaaccgttgggtcagaaacgtactcagcggatacaaaatggtcattagctgaatgtccaaggagtaccccatgaaaaatcaccattgaccagcatactttctcgtatttatttggttttactggctaaatccggcaaaatttcaccagttgaggaggatgtcggaggggtgtcgtccacacagtgctgctgctcatcatccaccgtcgggcttgtcaccgttgccatggtcggctgaatgcgactgcgattgagccgtgccggtttcggtctctgtttggccaaatgggtcagcagtttgccgttgttgctgccgttgtctctctctcgccctggttggttggcgtcgctcacatgcgtaaagtcgccgatgacgctgcgagacattagcaacagcgaggccatcgcatccgctgcggttgtacgaactgagaacgaataaattaaggagggatggtacggtaatcatgcacggaatactgtattcttttcttaaagcaggatttacaggataactgggcttttgtgctccggataaacgagaaatgtcaaggaaatagtgattgactccacaaattctacgcttcaagagtgtttttaccgtagaaaaggattggttgccctaccgtcttcggttggcacaattgcggactcgggccggtgctgactttggtgggtggcggcgttctgttgcgattggttgttgccccggaagatcacttcccttttccgtgtacgtgtcgaggacgacgaagaagacgggtcggaattcgcctgctgctgaaccatgaacatttcctgcgcatcctccgcaagaaggcactggtgaacattggcgaaaaggtgcgaccacgtgaattccctgcggcggattaaaatgcgggtcattaaaagagagcagaagctcgtttcccgcccagtcccacgccgatcccactctccgtttaaaaatttttaaatcttagatattttttatggaagaaaaaaaataagaatttttgcttttctgaattttttgaaaatgttttatttgaaattaaaaaaataatatttactgtatatttactttaggtatcaaactcccgaatgatctgtcgggttttaatttcaaaagacctcggttacaaatttgcagagctttgtttagccaaaaaatttgccatcatattcaatgacctcaatttatttaatggtccaattacagtactcgcgatgacacattttgtaccgtactttttgtatttgtccaaaagtgccgccaaatcgtcgcgcagtgcgacgcccaatcgtttgtttgtctcgcacttttgttggtcaatttctgcttgtctgtgctctggttgcatttggacatcctccagatcggccagacggaaaataaattgttgaacaaagcgctgaataaatttattttataatgggcttgatcagattgatcagttattgatgcctatccctaaaatgtttttaaaattggctgaattttacaggtcttttcatcgggagcagcttgtcccccccccccccggaaaattttatataacaattttttccaaacctagacactttttgcaagaaaaaaagtttttgaaaattttttttagcgattttcttgaaaaaacttagtaattcactataattttttttgtaattttcttattaaaaactttctaagcttttttcttaaaatttcaaagttggtaatttctcttaggtttccagaaattagtctcaaacttacgaaaaaatgttaagcctagtaaatatacgcggtaccggaacgggaaaacgttcaaacgaccccgaacccatcgagattaaaattgtcgggagtatggaaagagccaaaaaagaatcgggtaatggaccggaccacaaacacacctcactgtgcagatcagtaaaccgttcaattcgttcagcgagctgatcagccaaagtctcgagaatgccacggccactgtcggcatgtcgtccaccaacattgctcttggcaccactgttgttttcgtcgtcgcagtcggcattgtttggnagtgcaaaattgtgccccttcttgtgatcattttgccatttttgtgaaagcgatcttcttcag

SEQ ID NO: 14294 - DNA, 2073 bp, Heterodera glycines
  misc_feature (112)..(112): n is a, c, g, or t
  misc_feature (1350)..(1350): n is a, c, g, or t
ctgtcacacatcatttcctcacggaaaattttgttttactttttcttagagatttttcctaaaaaactactaaactttcaaaagatttcttactaaaaaattctagggtttntaaaagaaaaaagctccaaagaaagaaaaaacctctaactaaaaaaattctttttaaattttccagtgggggggggggaggaggggaatggaggggaatgaaatttgcctcatttacgacagtgattaattttgataaaattctcggcataaatcatcaatatttaatattaaaaataattttcaatgaataattcactttaatttctccatttccccactcactgctaattaagtcttaaatagttttcaaatgatagaattcgagaaaaaaagacaaattcccgaaaattctgttggattgtcctactcgggagaagcccggcatccacccccacgcacattattcaatttgtgcatggtcctctgaacgaaatggcacacggccaccggcggttcaaccgacgaagaaaatgtgtgaagttggcgattgcgttccaggcactgctcaatctcttccatctgtgtgtacaaaaagtggccaattactttaaaaacatcataatttcatgcaccaatcagaaaacggcaactaattaaagcgaaaaactctgtatttgtggattttcggaaaaattttgcaaaattttttgggaaatttggtgaggtaggtcttggaaggggtataaaaaagaaaactgaatggaaaatttggcaaatgcctaatttgcgaatttcatttgccggacgcattttttgccaataatttgcgtggcaaaggaccaaggcttggagaaggcttattaattagcattggcttcttgcctgaagctgaaaacgcgctcgttcggccggcacgcgtgccatagccaccacacactcggccgcgtcgctgaacggcatttgcaggccgtcgagcgcgaggttgacgcgcaatgcacgtgccaactctgcgaagccgtccggcccaatttggttgcggtccagcgccagccaacgcagcgcgtggttcaactgcagcgacttgcacagcagacgcgcaccggcagggccaagctaaaaccattgggaaattggggtgggaattggtaaatttacagtgccaacccttcacaccacaccgcgtcattttatctcaaaatttttttaatcttcaaagtttgaaaaagtatttaaaaattcgaaaaaaaagtttcaggttaattcttttaatgacattttttcgaaaaagatagaagaccgaaaaaattgttaatttattataaaataataattaaaatttagttttatgaattattntaagaaaatttttctattctcggaggaatttttattttaatgttagaattggttgattcaaatccctaaagagaaaagcaaaaataaaaaattctccccctcataaaaatatttttaagttctgttgtcagtcacttcttatggaatggacaaataattgaaaacaaagtttgcctccaaaaaacacaggatcaaaagcaacaaaaatataattaatttctgatcagggtgatggaattgttttgagcgacaaggcggtctgatcagatcaaatgggggcggataattagtcatttctgctgatgatgattgatcgatgatcaacattagcaacaaacagcacctcattgttggacaaatcgagccgcttcaaccgcccacaaaggcccaacgcgttcagaaaaacgctcagatggggcccaagccgtgcgtcggcaagcgacagctccgcaatgaacttgaaaatgttgacaaaacgattcattttctaaatgagttttgggccaacttttacctaccggtccaccgccctcctccgccgcctcgccttgtccctcccgctcaatgccgttgatcaacttgactaactcggccaaaatgccggccaacaccggcgcgtgctttttggccgctcggagcgcgaagaaattggcaccgccaatgtccaacacgcgcagatggcaggcgcggccaagcgcggacagcaaacggaatgcctatgaa

SEQ ID NO: 14295 - DNA, 1045 bp, Heterodera glycines
  misc_feature (27)..(27): n is a, c, g, or t
agggggcgatcccggggagcagccacngggaaatagcttcccgtacaaacatttacgccaaaattaattttttttttaaacatacctgcgtgaagtctttgccttcgtaatgctcaggcggagggtaaatttggggaaatgcctcggggaaaatggcgttcaactgttgctgcgccttataaatgccgtcgttcagcaccatcggtggaccggtgccgttcagcaccaaatgccgacatttggggccaaaagaacgcatccaaacacggtagtcgccggagttgaacagccgctcgcgcgtgaagtgcacaatgtaactcatctgatcacggcgaccatcgcccatgaaatcctgtcaagaaaaattgaacataaaagcggaattggcttaattaatgaatttattgggatattttagaacgaaaagtccgaccggcaaattcagaaacatttagtataaaaattgctaaaaaaaatcgacaaacttttagcaatgggttggcgtggatacgtctgagtttttcgcctgaaacaatctccacgaacagcaaattgggatgcaatattttggcggcgtccgagtacacgtcgctgggttggatttcgcgtccgtcctcgagagtgatcggatttcccgccttcagcctcgcaatgtgaggccccttcgaattttcagcttcaacaatttgatcgggtcatgcttggcggcgttttctgaacaattaatgatttagactaatgagtgaaaaaaggtcataaaatttgggaaattttcacgccgaatcaaaaattctctttcacacagaaggtaaactcttattaagtcgggtgtacttcttccccacccgatatgaattactttttcaaaataattccaaaaatttatactttttttgaaaattgttttttttgggggggggggggggggaagcggcggggcgaaggggaaacaaactgtttcggccatgccttggtcattcaccttgactttgatcaagtatgccacgtcaacgttgcccctgccgtaattgccttgctcttgtgt

SEQ ID NO: 14296 - DNA, 2796 bp, Heterodera glycines
  misc_feature (32)..(32): n is a, c, g, or t
acagaaccagtcgagtgaattttgaaaattantgaagaattaacattggtacaaaatttaaaatgtaaaattattgagctaacaattatcaatccattgcttcgtttttacggggaggagctcgtttccaccgtatcagtttgccgtcggaaaaatttattaaaaattttttaaatttttcaagaatttatggaaagtatttgggaaaaacttaataattcatcataaaataggaaaattcgctaaaaaaataaaaattttaaataatttttccgggtggtgaggggggaacaaacaatacgtggggtggggaaacgatggggtggaaaagtagtgcacccgtttatacggacctttgcgcgtccaaaaagtgtttgatacggtgcgggccgtgtaaccgcaaagtttcgtcagtgttttctttgttcaaaagcactgacgcaattccgcccgtgttgtcccaattggctgaaaatgcagcaacaaattaaaagggaaaggacgaaaattgttattttattgatgattgaagcagcacccttggtgaagaacatgtcgttgatggcatttgtcctcagccgaaaggtgggcaaaaagcggcaaatgccctcggggcagttgaacaagtaggcattcaacggcgtacggagcaccaccgacgggcgcaggtgggtggtcccgttgctgatcacctatgtaagtagagaaaaagtgtgtttttataggaaaatgggtcatcatcaggcccataatcagataaaatttcgggagggacacccaagaatttttttttgatcttccggcccacattttttgcccagtgagattttgctagatttttgcgctgtgggaaaatgggaaatttttagccagtcattttcgcaaaattttggccattttgagaccaattttggccaaaatataagaaattgggacccggcgatacctttagacactgctagggaaaattgcgtaaattttgggtcaaattcgtaggaattactctttctgaaaattttttttcattttttgggaggggggaatcgccctcacttgccccctcccccaggttacgggtctggtcatcacttttaaccctttttttaatacgtgcctccagtgtgacttgagttggcgccaaaacaaggttagcaatgctcattttgtccctttcagtatgcaaaaattcgtatttggagttttcgattttgatgatttctaaaaatggttgacgtaaaaaaggactgattgaaaataatatttagcaaataaaaaaagaatttctcgccttcctgcaattggttaagctgttctttggtcgccgtatattccttcgttcccggcctttgcttcctccactcttccttacgcttatcgagcttttcgcaaagttcgttgtgcaaaagcgaagcgcaaaatacgtccgactttccgtcggttgagaatttggctgaaagtgaaaaaaaggaaacggaatttgctaaatgaaaaattctaacacaaattgggtttaaatgataaagcacccgaagattcagagaaaacatgattctttaggttaaaattgtccattttcttttacccgccgaagttgccggaaggggacagtgcaaggctagaaaatttctgttgattaattgctgcaaaaatgagggaaaaattctgggcgagaatctcattagccctttcgcatcacaaaaatttttttctgaaaaatttgttagaaaggaatgggaagtggaaaaaccgatagaatggccaaatgccaaggcaatggtcaaaaaccatgtcgaaaagtgattggaacgggagttaaatagtttattaaagagttcaaaatgtttatgccaataaaattcatcaaataaaacacaaatgaacaaacaaatcaatatgaaatggttggttatgttgtttttggcattggaatgatctgctgggattatgttcaattggtcatcattatttttggtacaccgaatttatcattttcaatattttatttgtatttgattgtagcattcctcgtacggttattgagcttccaatttcatggcaagcaacaaatccattcgaatttttcgaaactaaatttttaaaaatttgaaaagcaaaaactggtcatgagttgaaattaaataacatttaccaaccaatttgatgatgtgaagaagtccaaacatgtaattttcatccatttttgtctccgtcttttgaatgaaaaatacatgtgaaaagtcaatcatagacaaactgacggatggcattaagttggaatggcctgtaaatgattaaattttttcttgagttggcttccataaaaggacggatgaaattctttagttgattattaatttggtttaataaatagcaattagaaaacttcgccacaccttcgtaaacaaaaagtagagaagaggcgtaaaaatgagcaattttctgctgttgaaaccaacaaagcacttggtcgagttgcttaacaaattctgtaaagggaacaaagggtttcgacaaaaacaagtcaattaccatcgacaattttgaacgaatcggctgttgaacgcagcgaagtgagatattcgacgaatgctgaaagcagggacggtcccaggggggtggggggggggggtacgcggggtcggagtaggacaaaacgtcgtcggccgaaacgtcgtcgaacgaatttttcgaccgtaacttttttctttctcaaccgaattaaacgattcttggtattattcgaaagcgttcgaaaggatactattagcctgcaaattttcaaaaatttttatttat

SEQ ID NO: 14297 - DNA, 1769 bp, Heterodera glycines
  misc_feature (1665)..(1665): n is a, c, g, or t
ctctatttttctcattttctcagccttacctcatattttttctattcttctgttctctctcgtcaatttctctgtctcgctttgctctctttctttctctgttttctttctctaatttctctgtcttattttccggtacttttcggttttgaggccaagatttaaatttaaaaaaaacaaaggaagcacataattgcaaaaactccgtgccagaattatattgggggcatatatgtcacaatttgagctaaaatttcttcaaatggcactgcgccactttttttttggcatctttgcgccagaggaactcgcacaaataggagtccaccatttgggagtgcgtgccgtgttgcttttttgttgaatgtttttgccgagcgccaagtgcgctcaatcgttgtgttgggccccgaaaaatgtcctttcgttagtttatgcaatgtgaatgaatatttttgcatttctgcgcgtctttttttaaattcaaatctaggccccaaaaccgaaaagtaccaattttcctttaaatttattgtttcttttcctcccttctctctatttctctgcattgcttgtctctttttttctctcttctctttctctatatttctttgtctttctcgtcaatttctctgtcttgctttgctctcgttcttttctttgttttctttctctgagtttctctgtcttattttcctttaaaaatttctttgtttcttttcctctgttctctttcgtctatttctctgtcttgctttgctctctttcttttctctattttctttctctgaatttctctgtcttcttcttgtcaatttctctatcttgcattgctctcttttttttctctgagtttctctgtcttattttccttaaaatttctttgtttcttttcttctgttctctctttcttgtctatttctctgctttgtttctttttcttttccctcttctctttctcctacgccattttataaaatgtgctttggttggtgttttgttgtgaataaaacaaatatcaaactgaaaaagcagtagcagcagaagaactgacagacacatgcacaaaccctttcttttttgacaccgatttttattattttaaaaatatttatttatttttattattatccataaatacactaacccaaagaagtcttgcctcaaacatataaaattgttcaatgcttaatactagggctataattagatagaaatgctattttgagcccctttcttcatagcatatgcgcagaaaaatatgcaaaagcatagaatttatagtcctaattattacataataaaagtcagaattatcgttgtaaatattttagatgtctttttcaaatacccaaaagaagaattcccatattttttttaatgactgagttttggattccgaattgaatgatttgtaaaaagttacgcgcaaaaagtctttcgcaaaattaaaataattcatgcttactttctgtattatatgtatttttttttttgtcattttagcacaattttgtttaacaataaattttttgaaaaaatggacaaagacattgtgccaaaagaaggaaatcgctttaaaaagcacttcgacccattgactaccaaagaaggtgggctttgcataaaatgacatcattatttaattttatcctaatttgttanaaatttaagcaaagtcttccgtcacttttcgatccaccgaaattactggtgattattttgttctaccataacgatcaaaatgggctttggataatttttgaaaa

SEQ ID NO: 14298 - DNA, 2522 bp, Heterodera glycines
gttggttaaaatgggtttttgggctatgggttcacatcctgttgcctgtaaaaattgtgttttaattattttggggtttttgggccgctgatcacgaatttgatattaatttctccctgtaccgaacccctgacccaaactcgaacattttaagaatttaaatgagaataaaaaaattttttggtaaaaataaatcggagtcttcaatgctattaaaaaaggaagaatcgtaccgaaacaattgtgggaaacaccaaaaaatgcaaattaggtatgcgagtgggatctagaccccgatttaaatgaacattttaattttgttaaactccccgaaaaaaccgcctctcgtattcaacctttagatcgttttttcaacaaacaatttaaataatttattcgcacaattcatgaaaaggtacgccgatcttactcaaactataatttgtctaatcgcaaatttatcggtcgcatattaaatgaaattcatttccaactttctgcgccaatttttgtcaattttattcgttattcatggaaaatttcggggtatttgggcattgtcacaattccaccatttgaaaccccaccccaattttgtttccgaaatttggatgtttatctctcatgccaaaattgtaatgtgcctgaaatctgtccgcaaatttggacactgacctcccctccgcccattatgcacccctaagaaatgaaaatttctcaaaaattcacctccaaaatttatttattttattttcttgacgataatttttgattttgaaaattatttatatccttaatgacttggcaaaatatttttgctttttgatgaaaattttcaattttacacccctaaatttggaactttttggcacctattttccaatttttggcacctattttgggctttttttagggcctaaaacctacctatttcggcattttttagcacctataaatattagccctagtcagtaatgaacaaaatttatttttaatttcaaaatatgtgctaatattgagattttcaaatgtattttggcatttttaagcaaagtcttccgtcacttttcgatccaccgaaattactggtgattattttgttctatcataacgatcaaaatgggctttggataatttttgaaaattttttaccgaaaaaaaattaaattttctattttattttgctttaaaaatatatgtcataatgtgcgaccaaattttaacaatggatttcttacaaattatggtcctaaaagttcagaattttatcattttttcaaaatctttcaaagaattcctaatttttagcccatgaatatttggatttttcattgtttcgtttggtgccaccgcatttggtggaccctggcacaattgtggtgaaaactgtgcgacagccaaatgttcttgaagagcacaattatcacaagcggccaattatgtacattatcaatcaattaattataaaatcaatcaatcatctcacacaagggataaagccaaatgccttatttttgacataaaaaattcaaaataattaaatttgtgtagcgatcgatcgctgccatcggtgccaaatttgcctctctttcagcaaaaccctggtcagaaaacggttgtattggctgcgttctccctccccaacttttgctgattctgatcactcgcaaaacaatgaatcgtcgatagaatcagcggagaatttgcatgagaatacggcgacggaggggagaccgcgcgcagaaagttaggcaaaattttcttttggaaattttcgtgttttcctttaaatttaaaaatttaggggaagaattgatgttttgtaatccattgataactttcaaaatttaaagatttaatatattaatgggcggggaaaacattcaaaaagaagcgaataaaattttaataactcaatagtataatacagtaaatcatcagagttttacatatattaattattagagccctgacttttaggcacgaaaattttttaattaggcaagaaaaatgtgaaaaaaggcaccaaaaagttcaagcaaaccaatttaaaaactcgttttttgtgcgtattaggccatagcaagttaacaaaaaaaggcatcaaaatccgggctctattaattattgaataatattctcaatttaaattctactcatttttggcacatcacaaaatattggcgccgatgccaccgcgtgtatgacgacgcgtccctctgacgataacgagtcgtatttggatgaacaggtggcccaataaagcaattacgggttcccatcgtcctaatggggcggggtcattcgccgtggccaactcacagcaccttattttaagagttaattgccaccacatttttgtcatacacacggagcgaaatatttaatttgttttaatcccttctttagggcctccgttggcatcggcttttcgccgtgcccgacaatgatttgtcgacactcctgcgcatttgcattgaatttagcggtggcacggcacagaattggtcaaatgcaacaaa

SEQ ID NO: 14299 - DNA, 3184 bp, Heterodera glycines
cagcaaccaaagcaaatgaacttttcggtacactttttgaattattaaatatttaggcacttttattttgcaattctcagacacgaatggcactttcccaactgaaggggaaggagaaaaaactgctggatgagaagacaaaattggaaaaattgtccgaaattgcgcggccgtcccatcgtttgatgccaattttgttgcataggcaaccagagatagatgtaaagaaagaagcggaagagacagtgttggacggaggagagagtgagaaagatgtgaaacgagagactgttgagaatgaagagagcgagaaagaagcggcagagaaacagccaaaggaagagacagaaaagggacgagaaacgcaagcagaagcagaaacatcagcaacacaacacacagtcagggaaaaagaaaatgacgacaaagggaagagagtggacgaaagaaggcaaagcattgaccagaaataattaacagaacagacactgtgtaatatttagcaacgaagcagcaccatccattccatcccccaaaacggcggaagaacgtttttacgcgccggccctccccccgaaacgcaacgaaatggccgaggcaattgtgccaaagtttggcatgctcaccaaagaggaaatggcacggatgaaaatgctgcaacagcaaatggagcggaaacccgaactcgctgctgctgtgaagagagctcggctcgagcaggaacataaaacattgaagacggacgaggaggtaatcaaccggatgggcgggcggggtaaagttgggttggaatttttcctaataaaattaatcaggaataaaaatatacataaattcgaatggctattgaatgtctgctggagaatcatgttttcatttttaaagattttgaatacagtgttccaaaattaaaggaaaagcaacaagtgcaggacgttcgtgagaaatatacgacatggcttcctcccgaagaccaatcgggcgacggttcgacacgtttaaatcgaaaatttgcaggaaaatattaaagacatatattttcttgttctttcgagtttatgcttttataaagcccagaaattgctttttaaatagaaatctgaaaaaacattcaaaatcattgcttcacagggttcgactacactaaacttaacagtccctggtcaggaaaatacaaagtagcataagaataattctaaaataaaatttgcataagaataattcaaaaataaaaatatgtacatcgaatgattaaataaagtagtttcctttcgtcattcaaacacttggtatgccatcccgcgaatgtattgccttttctggtggacaatgtaagcaccagcaacgaaaaaggcgccggaaatgaaacaaaaaattgcaacgatagctaaagttgagccggaaaagccgacaaattgtggaggcggcgatgggcccggcggcgggcatggatgaggtaaaggagaggaccgtttgccaaactgagtgccagagaacacctggggataaaggcaacagtttttcttgcgtcgctctaatgtcgtaataattccaaataactaaaaaacctggaacatttttctctatttgttcaaaatgtaattgagtcaaacccaaaactaaaatagtaatctcgtatttatatgcaaagcactaccaattctgtgttcgtctcggcttctgtcgcaagtggaattcgaacggcaaattttcctgacacgacggaagtgttcagcaactgtactgcctctgctactgttatttctttctaaaatgagtcatttttattttttgaaaaaataataaagtcaccaaaaggtagatcgtctgcgcctgaatggctccgcttggcgcaccaatggcaaaaaaagcgtacaatgtgccgtcgttcaattcgtctaactaaaggagaaaataacaaaaataaatgaatgatgattggaacacaaaaatctaattttacaaaaaagttccatacatttaagtcgacaattcgtatcagtgaaatattggccgcttctgccaatgcttggcaatcgccgcttttgcccattccatgccgatctgtgcgttcaattcgctaagcgtaactaaacccaatttggacaattctcagttgcctttgccgtgttttttgtctcaccgtttcccatccgtacgaaatatccccaggccgagtcggccgtcgtccttctgacgcatcccctcagtttccccgccagcgtttgccatgcattcagctgctgcacccgattgactatgaactcggcattcgtccgtccgcttttagtgtaatggaccaccgatcgaatggcatcactgggcatatttccaatcgttagatttgccaaaagaacttcgacaacaacgacggcactctcatttttggtcacggcaccatcgacaaactgatgagtgatgcgagaaacgtatgaatcgagcagctcatcgccaatttgaacctgaaaaacaaatatacctggggatccagacctgtatttttcctaaaccatgcaagatcaatgacaaccgaaagaacacatttttttatttaaaaaacttgaatagcgaaaaaattgtggttttattctgaaactaaagaatgaaattggcttgttggtcacttgtatttttcctctatttttagatcgaaaaaacagataaaggtcaattggggaatatagatacaggaattatttcaatggcaagttttgaatctgagttcagcaaattccgaactttaaagatgttagaattcaggtttgtagtccgaaactatgcaccgactgggggagtgggtgctctctttaatgaataaccattttcacctttcctgcatggtaaaattgcggctttgtgctgccatcattgagtttgcccatccaaatgatcaaatcttccgcagatcgcaaatacatcgtcccgttggcattgcgcccgacatcggccaattcagcactgattggcccaatttggccacattttccatggtgtacaaagtccagatgatattgaaggccttttggggaatacacattttataccacaacaaattgtatttaaaataccataggtgaaatcgtggacgacaatttggtcaggatttgaagttaaaatgccagtaattgtggacctcccatcgtaaacaacctgcgaaatggtttaaaaatatctcatttattgc

SEQ ID NO: 14300 - DNA, 1616 bp, Heterodera glycines
atattggattgggtgtgaccgtgtttggcaactacaaccttttccgcttgaagatgatccggaattgggtgcttatggacgagtggacgcatggattcgaaatcgaattcaaaacaatggattacaggggaggtctgcaagtttcccacaggaaatgtggaatatgagtgaaaggtgaaagtggaaatagaattttaagaaacaaaaatttagagttgagcaaaatttaatgaggacaaataacagcatcgaggggtggcatcgctctttcaatagccaattccgcttccttcatccgccattaagttattttgtcaaaaaaatgaaagaagaagacagacactggaatttgattgtgcaagattacaacaataacccacaaaatggaatgcgtggcaggggaatggcaaggaaaaacatttacgtacagcaggaccaagcaattcgcgccattttcttggatcgtcataacagaccttttttggcctatctacgtgcaatcgcttatcgaatgccggaaccaaattgatttgattgagatatttttaggaaataatccgttctaatgacttgaaaatattttttaaaatagaaatttactgtcggattgtccactgtcggattgtccacttctgtcggattgtcctcactgtcggattgtccaactgtcggattgtccactgtcggattgtccactgtcggattgtccagtcacgtatccaaaagttattaaatttaatgatgagaaataagtaaactaaaaatagttcttcggttagaaatcttggtcaagcagtaaatacagctaatcaaaaagcttaagcaaaacagtgatttatatgattcgaacccggatttatttggcttttcattttttacatgatttttttgatgtttctaaactggttttttctcatttccatatttctgattttgtctatatttccatattgtacattcatattacggcatttttacaaatctcaaagacaccactcaatattttttgtttttgtaaaatacgaccttaaaatagaaaaattttggaaaaccatcataaatgtaggaaacgaaaagaattgcagaaataaatcattgtagagaaatgattagaaaacaatggcagctttggcaataaaatgtgatactgagaaaacatctgaactgagagatactaaaaaaagtgatgaaaagaatccaacagaacctattaataacatagactgcagggctgggacgcgaccgcgatccgcgatgcgcgatccgcgaccacggcaaattgaatccgcgatgcgcgatccgcgaccgcgggatttttctgtgcgcgccccacccctgatagactgtccttctagttctggaataggtttaagatgtactgatactattgcatgggcaatggttaaaccagaaagcgatgaataccaaataagacaaaaaaaggataaaaacagagatgatcagctaaggatgattatttttcagagaatggataattatgcattggctgttcaggtggataggaggacaaatggccatattttgcccctagttcatccaaatttaaaaatgaatccatatccaccccttaggcaataaaattttcagtaccaaaa

SEQ ID NO: 14301 - DNA, 1237 bp, Heterodera glycines
  misc_feature (38)..(39): n is a, c, g, or t
  misc_feature (55)..(55): n is a, c, g, or t
  misc_feature (65)..(65): n is a, c, g, or t
  misc_feature (79)..(80): n is a, c, g, or t
  misc_feature (191)..(191): n is a, c, g, or t
tcatccaaatttaaaactgaatcagttttcacgctagnncagtataattcagtancaaaagtggnaaagctgaaatatnntagttcttcgaattatgagttatactcacaaaatccaaaagaggaaagtgggactatttataatattataaaaagtgtaagaaatgagataaaagcaattgatgtcgattntaatgtatatgatgatgagagtaatgatagcataaaccagcgattctttccgcatcaaattggataacaaacaattctatgtggggatcagcattttttcggcaaccaggattaataacaggcgctacagagacattgtagaggtgcgatcagcgtctggtctgtcggctactgtggcatttgtagacgcgatggacattgggcgagaaactgccccaacagaaatagacaagaaagagttaccaatcgtgaaagaggaggacaccaaagataaaatgtcaatggttatctgccagaaaatttaaaaaaaaatgcggaattgtagacatgaccggcccccgcacttgttgaccaacaattttcaaactgctgcggcaatccaaattgtagttaaattgaaatttccaataattgattaatttagggtataattaattcgagttagtgatggagcataagtaaaattttttttcaaaagaatttaaatgagaaaagttgctttagctatgaaaaacactgactattggatttttgctttcataaaaaattggcgcacaacgcagaagagcagttcgagcagtacgtcaacatttgtgtcaaaagaagaacggaagaagacgcaaaacggacaaatgcaaggcaaatgagacgtcaactgagttctcgtggcgacggctgttttgtttgtggacctttggactaggacaagagtacgtgaccaacaacaaagaaggacaaagaaatgaattgacataaattaaatttgaaggaaggcaaaagaaaaacttaatgcttcggcaaactaaattagaataagctaaaaaggatcagggacgaccctctatgggatgggaatgataggctaggttttaaacttattttattaattctcaataacacatttttgaatttaaatttagcaaatttttcgaacaaatttttcaaagtaattaaaaaagggaattgccaattgataccaaatttgagaccagggacggtctaaaacagggtatgaggtgtaagagataaataaattaacattaaat

SEQ ID NO: 14302 - DNA, 3582 bp, Heterodera glycines
  misc_feature (3390)..(3391): n is a, c, g, or t
  misc_feature (3438)..(3438): n is a, c, g, or t
  misc_feature (3554)..(3554): n is a, c, g, or t
caccggcttccatgtcctccttggcgtgcttcagccgcttcgcaattgtctcttcagtttcgcttccgcgctgacgaagtcgttgttcctgaattttcgattctgtttgaaaatccagtacggtttcttatggcccgcttattataaacccaattttttccccgaatattttggtaaacttccctaaaaatgaggccagattttacctgggaaaaatatttaaacgttttctagcgccgaggaaaaaatatattttttagcccttttcgccaaaaacaaaatgttgtgtggtcagtttcaaaatatggtaaatgtgagtccacgatgattaaatgtgtgccggaggggtaaattttggaatttaatttctctttaaaaaaatttggggagcaagtaacccactcctggataagaaattgtttaaatttccctatttttctaggaaaacaaaatattttttaggggtggggcatgggggttggaattcctcccccccccccttggcttggtcccatagatcctaaagtcagaggcgccgttcacttttttctaaaagttgctgttttttttctcccttttttgagtaacggaccaacacttcgatggacgggggtcggacgagcacaaatttggcgtcaaattgcagcgctttgaagttgcgcacgccgttcagctccacgtccaaaacgcaaattttgccgctgctttgcacgtcgtccaccgcctttttgctcgtcccgtacaaattgccgccaaattcggcgtgttcaaggaattgtccggcatcaatcatttgttccatttcgcgtcggtccacaaaataatagtgctggaaaattataaatggaattgtggggacacacacaatttttgagttttttcggttgggagggccaccgaattttacccttattgtaacagaaatttgagaattttgcaagaatttgggaccattttttcaaaaaaaaaaagcaaattaaagggtcctctcctcatttcggtttttatgaaaatcggcccgttaaaagcgtaaaagtgccagaaaatactcggcatcaacaatgtaagtccaacatttgatattttcaacaacctgctggtccaattcgccatcccgcggctttcgcgtggtatctaaaaaaccaaaacaatttttttttaattgacacaaaaaattgctttaaaattttgattttaaaattttttaaagttaattttccacaaataaatggagaaatttaggccagtaaccaggaaaagtcctattaacttccttgtcaaaatcgctaaattttcattattttccacaataaataatttttttccaaaacttgcctaaaaattatctaaaatttagcatttttgccagataattaacggtctaaaataaatttccatttcaaacccgaattattgctggttacgagcctaaattaaacgcatttcttgctctgtcaaaaatatgaaaaaaaattgccacgaaaaagcgtacgagaaatgctaaaagcaaatgcttcgggatattctttcattgcgcgggccaaaattgtgctcttcccacaaccggaaggaccagaaatgatgatgggcctaaccttgaaaaagggggaaaaatgaaaatttggaattttttttttgaattttttaaaaccatggcttgctggaagaggcttccgttcaacaatgttccgaaaatatgtctttgcaaatgctgtcgaatggtgttagtcaatgttcctaaagaatgcattttgctaattttcccgtcacattaaaaaagttttctattggctttttactcacttttatgtttttaaaaattaaggtaggccgatgttgtgttaatttttcaactttaaaattttagacctcattgtcgacttttcgtactcttgagcgattattgaaaattgtacgatattaaggaatttgaaattcaaagacattaaggaaagaccaaattgaataggatattttttgaattttaattttttgtgtattaaatttggttttatttcagtcccgttcgttaatttataaattggataatttttagagatcgacctggacctgaatccaggcctggatttttcctggatccaggtccaggtccaggccatttttcggcatcctggatttttcctggacctggattttcctggatttttgtccaggaaatcaaggtccaggtcaaatgtgaaaaaaaatccaggtccaggtccaggcaaaacaggaaaaaacctggattttcctggacaaaattttagaatttattttttcaagtgaccgatgttttttcaagttttcgaaaacagattaaataaatttaaaaacacattattattattaattagatatttttagatgcttctaagcaaataattaattttttcaaacatttttttgatttttaaaataaatttaaaaaaatccagtccaggcctggatccaggtctcgaggagcctggatttttcctggacctggattttcctggatttttgtccaggaaatcaaggtccaggtccaacatggaatccaggtccaggtccaggcttttttcaaaatgtcgatctctacttaaaaccaaacccgaaaattttgctcatccagaccgaatgccgacttttttcccacctcgtcccctgctgttgttgtgccaaatgctgcaaattgcgtagtcgtggtgttggcaacaaatccctgttggttgttgttggtgccaaaatccaccgccacattgtgatgccgtggcacaccaaatcccagcggcgcaaccggcggtgatgccattggatttgttgtgccatcgctgccgctgttgtggccatttcttcccatcgctgccaactggcgatgatccgccgccgatggcatgaatccgtcgctgttgccgttgttgtgccgatgcaattccacctcgttggccaacagcgaggcaaggtgttccgtgttgtaattgctttgcgcgtcggcgacggaggcggcggcggcactgtcaaaaggccgcccttcaaccattaatgagcccagctgatgatgattatgatgaaagttctcttaatggataggtaattaggaaataattagtttcattaacatttgagatcgtgaatctcgagacctattctcgatctcaggcctccctcggtatcgagtttccgttctcgacttgcgtcagcccctcccccgctattttcatggcttcaagcgcctcgcccccatttttagtctgagagcatcgctaattacattaattaattaattaccctgctggtcgtcccgcaacacttccatcaggtcgtccatctcctgactgtggcacatggacattgtagcctcgggcgctggtgacctatttgcagtgcaagtgccattgctgctgcatgccnngtagtggtggtggcactgtgaggagaattgttggtggctaaacattngccggaagcggttgctgatggtgccattgcgcgaaaaaattattgttgttacaagtgccagtgccatcatcaacgtattggccacacatgggaatgttgtgcaccaacacagtttnggaggaatggtcaacatggtcgataaat

SEQ ID NO: 14303 - DNA, 1502 bp, Heterodera glycines
tcttttgattataccaaccattaaattatttaatttattttatgcctataattcttaaaaaaaatattaaaaaatattaaaaaaccgtttttgatgaaaattctcaaaacaaaattgtttatttacaaaatatagaacaaacaacttaatgaataattacatttattaacacttcaatattaaaatatcaattattaatttaactatccaaattatttcaacagataatcagcaattcatcttaaaaaatatatacaatttgtgaagctttctaggaaaaccaatttagccaataattcaaaataattgtcataattattcaaaaaatttatttctttttaaaatattaatattcaagaataccaaaattgatatttaatgatagaaagattatagattttactgactaattaaataaataatattcctttgatagtcatttttagatttaaattatttacgcttttcgtcattaattttttagattaattttttgtaccgtgtttgttattcagctgataaatattatttgtaatttactttcgtaataaactttttaataaattatataaaatataattaattttattaaaagttagaatgatctgtttcaataagaatatatttacaattatttttattttcttgtattttttaaattaatgtaaaataataaatatcacacatcctttttaaatatttttatttatttaagtaaaaataaaattattttatcattttaataaatctttcttgcttcttgccttagattttgacacgttttgatgttgacactacttctttatttcttaatagattgctttaatatacatacaaaaaatattatatttgacaattaggttgtgtttttttattattaatcatatcaaaggtacgaaatgctttaagtttgttaagttaatttcacccaaaataagcatttttggtcattttttaataggtgatgtgacatttgcgccgcagacacttgcgccgcgacagttgcgccgcagacacttgcgccgcgacagttgcgccgcagacacttgcgccgcgacacttgcgccgcagacacttgcgccgctgccatttgcgccgccgacacttgcgccgcgacagttgcgccgcccccccccccaattttgattatttaaagcataattttctcaatcaattttaatgtttaaagttaatgtagcattcggaattaaaacttccattccaattacattttaaataaaattcaacattaggtaattatcaacaaattttactaaaactataaattaaacgcaaatgacaactaattaaaaaaacacaacaataaatcactaatcacaaaggtaaacacttaattttttgtctttggtcaacgcatacagtaagagcaatgacaagtttttttcttcttcactgccgagagtagcaagaaataaaattatttttttaatgaactcaatttcaatttttccgccttttaaacacaattttgaatgttctga

SEQ ID NO: 14304 - DNA, 1664 bp, Heterodera glycines
  misc_feature (1616)..(1616): n is a, c, g, or t
gcgcgaaaacggcggcgcgaaaacggcagcgcgaaaacggcggcgcgaaaacgaccctgaccgatatttcgatgctcattcatgcattttacccattggacggttcagtcccaatggcatttggccatttcagtcccgggtctgtaacccttcagggattggttgcccaacaaatttttttcggattcttccattacagaccgagagacttcgatggtatatatttcgtccattttgactctggactatatgaacgatattttccgatcattttgctgtaaaatctttttctttaaatttaattccattctttccgattttaagcgtaaattcaaacattttacatcaaaacaataaaagcaaaatgtatttaaaaagatggaaattttaaatttcatgtcctttttataaactgacaatttgaaacaaataacaatacttttctgcactttttagcatatattttattatacatttcagaattttacacataaaaatcccatctgtatttataatatatcaattcatttgggtctgctgcctttggtcatccgaaccgatctccatctgtaaaactttataaaaagttgactccacgataattgctcaattattacggaattttcccatttttggattttttaacttatttccgcttctttttttaatttattaaaaataaatttataatcattaaataatgttttcaattgatataaacaaaatcaattaaatagttgatgattagccagccaactaacaaaggctaaacaaatatttttcagtttaagagaagagcgagtaaaagtttaaaatttagtttagtaatgttcttttgttataatatatcatatcatttttatttaaagcatgcgccaaattgaaatgtgaagggcgtaagatcgttttgatttcgttgaaaataaaaaaagttataacccaatgggaatgggctggcgcgaaaacgaccaagtccactttgaacacccaaaaagtgaaagtaaagcttttaaaataattttagcaaagataaaacataatgcaattaattgaaaaagaaaaagtatagctctatgaatttggaaaaaattaatgtataataaaagaattatttaagctcaaaaaaccgtttatttaaaaataaaaaattttaaaaaataaaaatataaagagcaagacaacaacacagagatatggcaagtaataaaaaaacaataaagagtattcaataaagtaaaaaattaacaaaataaaatttaggttgaagaataatattattaattagtcaaaaatcttaatttttaatcaaaagaagcacaaaaattcgttctaatcctaatttacaatctcttatatatacacaataaaaagttgtaaaaattatatatatgtaataagtaataataaaataaatattacattttgtttaatttaaatttatttcaattatttcttttattctcatcttttaatgaattatattttgattatctatagagaatacaactatataatcatctttggttataattttaagcgagtttttgaaaaatagagctcctacgatgatgagacttcttttataaaatattttctctattttagcatttatgctnaatgaacaataaaaatgataatgtcctcgaagaattctgtctataaat

SEQ ID NO: 14305 - DNA, 1465 bp, Heterodera glycines
  misc_feature (51)..(51): n is a, c, g, or t
  misc_feature (77)..(77): n is a, c, g, or t
  misc_feature (118)..(118): n is a, c, g, or t
  misc_feature (1407)..(1407): n is a, c, g, or t
  misc_feature (1449)..(1449): n is a, c, g, or t
ttttagagaaatgtcataataaatattattttttcaaatttttctttatanttttcccaatagatgaaaataattanacgtataataattgccctgctcatttgctttgaaaatagcntaaaacatatacaaaaaaaagcaattagaaaaatataaattatttattaaatttcacagaaaaactaattgttttggaaattttttaaacatacttttatttcaatatgaaatagcaaattataaataataaatatactacgaataggaaatattttatatacaaaggataaattcaatttgagaaaaattaatgataatagctgcgcttccaatatgaggtgctgttaattcgacaagattttaatgtattaaaaataaaaaaataatttcatttaattggaattttcattttttactaaaccttttttaaattatataaacattataaataaataattttctattttattttcattgggtcctaaaataagaaaaaaaatgaaaaatttggtcttgaaaaaatttagaaatttttcagttttaatcagtttattctgtaaacataatggtacaaattttttgaataatttataatttaactttcaattataaaacaaaaaaaaacagagctgtgacttttgtagctcttttttaattttcataacaaatcaaatttcgaagtatgtaaatttaaaaattaattagttaaattaatttcatcctggaaacgtttattaatgagaatattgaaaaacagaaatttttaaaattacttattacatactttataatcaaaatattaatgtttacttaaaccagtaaagcggataagattggtaaataaactatctaataaaaaaatagaaattatgcgaaaaattactaaataaatttatcatattaatgataaattaaactgtaaacaaaaaaataaagtaaactattaatttagtcaatatattttaagaataatgattacctaataagttcattcaattttattttttattatataaattttgcgctgtaaattaaccgatgaaaaataatatcaaaaagattatcgaatttaaaataaaatttttagcaaatttatttaataaagcctttaaataaataatatacagttaaaataaaaaaactattaacattgcttcattatttattatttcctttgttctaataacaatggtaattcaattaaaatataattctttttatatttatttttattaaatttatatgtcttatttatttatttattatctagaataatttatttttatcaatttcctttaaactattaaaatataataaaaacaaacaaaatgccatcttaagaatatcttttaaaagaagttgaataaaaatcataaatgcactcacgaatttatcgaagttcaccanaaattttataaaataaataattaaatagatatgggaaaccgnaagaaatttcgtgcaa

SEQ ID NO: 14306 - DNA, 2882 bp, Heterodera glycines
  misc_feature (2868)..(2869): n is a, c, g, or t
attttctttttatttgactgaaatttcaaaaaaaaaaatttcagtgcctcttctttttttttttgatggtgacacaaatttaaagacatggcaaaagaaattattgaaattcaatttttttgattaaataaaaatcgtgaacggaaaatgggtcagtggaaaatgcgtcagtgaatcagtatttctttaaattgagatacggtagtaatattaccgaaatcacaacttgttttttagggatttgggaaagtttcaattaggtattttgacttttaaaaacttaattgataaaattcagaacaaaattattagacaattttgtccttttgtaataatacaatacttaatgctacagtaactttatttaaaaaatactgtattattgacaccttttccactgacgcatttgccaggagccaaaattattattatttttaaaaattaattttcatttaaattatggcacaaaaatttccagcaaacgccaagtgtatgtggtggaggagccccgtgacacatttgttgtgccgttgaactcgcagcatgccaacgaaaaggaaaatgccacttttgaatgcgaagtgaacgacaaggacatcgatgtgaaatggttccatgacggtgccgagatcgggatggacgggcggcactttaaggtgggaaggagggggcaaatctcttgctaatcaaagaatacattcatatttttgtgttatgattaatttcaaaaattgagtaggagtttaaattacctattttgggattcctttaatcccaaaaatccctaagtatggatatttccaaaattcaaaccaaaactagctcaaattcttcaattcaaatgcctatcagaaatttaaaaaatatattagaaaagtcagaaacaaaaccatttttttaacaatattttttttaattttatatttttttacattatctaaaatttatttttatttttttgccaaatttcattttgtttttctattgtgtattttatagatgcttcttgttttacaggaacgggctggatgccgtcgtcgcctgctgatcatcaatgtactcattgaagaccacggggagtacaaatgcacagccaaagacgacgaaacaatggcccaactcattgtgcaccccaaattcgtcaaaaaagcggagcgcaagccggtgacctgctggttggacgatgagttgtattaaaattttttgtttttcactgttcctgttttatttgtgcccatctcttttttaaactctgtgaattgaagataaaattttattttcctttaattgtcctaattttatggtatatcccaaccagggctggccgtgattgaatttccaatcacggaaatccgtgagccgtgatcacggggctttaaaaaaaatccgtgatccgagatcacggcaccccaaaaactccgtgatccttgattaaaaaatttttttctaatgatttttttaatttaaatttatttagaaaaacggaatttaatcgctggaaaaattcctaaaagatattttaaagaaaccaaaacacaatccgctttttttgctgcgtaccttttccaaaaaatgactaagtttaccattttgagcaaattttttgatgaaaattaggcctttttgtagaaatctccaaggaaaaattttattttttaacaaagtttattaagaaaatttttcaaatttttcttaaatttatatttaactgtcccataatgtttctttaaaaattttagacattgcaattttgcgtacttttccaattttttgcaaaattaattcatgaatattttttcagaaagtgctctgaaacgcatctaattttatttacatgttaacaaggtcctcttaggcttatattatgaataaggctaaagaataaaaaaattttaaaatgtttccttatattttggttatttcgttcaactttcggtggggtgcttggaacagtggaatcatgcgcacccgtccgatatggtccaccagcgggacgtggttgctcataacaaacattcttgtccaggacaaaatttatgccaaaattggcgattttgatccgtaccatttcatttattcggtgatgtcaatcaaatggttttcacaaactgtttaaaaacactaaattattaacgacttgaaaatacgacgtgtgattagaatttgggattgggacgaattgttgctgttgttctgatcacttctgattattgagaaatgagcaaaaaaattaattattttactaatgtgacacttaaaaattgtataattttattttatattatgtgattgtctttacccttcaggcataattcccatgacaatctaaattacagttgtagccaaagtaaaaataaccacgatttaggtcggatgagattatcttggtcaaaaaactgtacagtatgccagagaatttgctaaaaaacggtgtgtttgacgaataaaatgaatgaatcgttttatggaataaaatgaatttttaattccacattttttgtgtacaattgcacgcaaaagggaaatattattgtaattccacattttctagtgtacaattgcacgtaaaaaggaaatatgaattgtaatttcacgtttacaactgcacgcaaaaggaaaatattattgtaattccaggaaatatgaatttttaattccacgttttcttgtgtacaattgcacgcaaaagggaaatattattgtgattccacattttctagtgtacaattgcacgtaaaagggaaatatgaattgtaatttcacgtttacaactgcacacaaaaggaaaatattattgtaattccgaggaagatatgaatttttaattccacataattcgttgtgtactaattgcacgcaaaagggaannatattattgtaat

SEQ ID NO: 14307 - DNA, 848 bp, Heterodera glycines
tttaaattttttatagatttttaatatttggattttttttttcttaccaaaacttcatcgaacctggttctttctattctctttcaaatcgccccaaattttttttacagccacgaggccgcgaagcggccgagtgagtaccttgggcgcaggaaaattattaatgaggagggttcattatttatttatttttgcaaaattaattcataattttttttcagaaactgctctgaaacgcaccaaaatttatttacaagttgaatgagcccctgatcaattacaaattatcaaaaagggagatgaataaatattttaaatttttgaaatttttttaagtgcaaaagtggtgggtgtctgcaaaaaattttcaccgggtttaataaatctaggaaaataagtaagcttttgtagtgttccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaattagtaagcttttgtagtgctccgatacgtatctctgcaaaatttggtgagccgctgatcaattacaaattatttatggacgatcaaattttttgaaatttttttaagtgaaaaagtggggggtgtttgcaaaaaattttcaccgggtttaataaatctaggaaaattagtaagcttttgtagggttccgatacgtatctctgcaaaatttggtgagcccctgatcaattacaaattatttatggacgatcaaattttttgaaattttttaaggggaaaagggggggg

SEQ ID NO: 14308 - DNA, 1029 bp, Heterodera glycines
aaatttttttacacttaactaggccaatttagcttattccagaaatctcgcatgaattctcatttttaattttttatagatttttaaatgtttggatttttttggcttaacaaaacttcatcgaacctggttctttctattctctttcaaatcgccccaaatttttttttacagcttaactaggcccaattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcccaattaagcttatttccagaaaatctcgcatgaattctcatttttaaattttttatagatttttaaatgtttggattttttttggcttaacaaaacttcatcgaacctggttctttctattctctttcaaatcgccccaaattttttttacagcttaactaggccctattaagcttatttccagaaaatctcgcatgaattctcatttttaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagccacgaggccgcgaagcggccgagtgagtaccttgggcgcaggaaaattattaaggaggagggttcattatttatttaccgaaaaagtttaggcttaactttttcagcgggtttaaaaaatctagaaaaattagtaagcatttgtagtgctccgatacgtatctctgcaaaatttggtgagccgctgatcaatta

SEQ ID NO: 14309 - DNA, 1987 bp, Heterodera glycines
ttcaatgagtaattttatagtaaatcagaaactattaccttattatcaaaaatataatttaggaaatgctacttaatatgatagatttattttatgaaaaaaaacttatggctgatgaaacggcataaaatcgcaaaaaaataaatagttgtttccatttcaaacaatgctttaagaaaaatataaattagaccaaccaaataaaccgtaaatcagtttttcgattatggaaactaattcttcagaccatgattataagtaattgagaacgaatgtaaaaagtaaatattttcctagttaactaaaatttcaccgcacttaattaattaattttttattaaatagttttcaaccaatgtgcaaaattttaccttttgtgacagagcttgactttactttcgtaggttttttttatgatgtcgtacagtaacggatacattgccaggctttacagtagattttacccaattaattcgaagcaaaataaagaattgaaaatacaattaagatactgcataaaaaagctgtttttcattttttaattatctttaaatattcaaatgaccgtagattcaacctcttttttaattaaattaaaattttaattcgagtttcaaaacctaacggcaaaatgaaataaattatgttttgttaattattacaatgggccaacaaatttaagatggcattgctttaaaaaggagacttaaagccaaaagtgattctattgattctaattaaatttatttatttaaatttattaagatagcgatattaatatcgattcttatgaagcagaaacaagcgcaaaacggcaacactttatataatgtaaaaacaacccaggatttattggcaattttgtgtgttatcaaatgattaaattcagcaacagactgtggtaaaataacaaatggaaataatttatttgaaataaaatattataaaaaaacatactttttcgtgaacctactcttttcttgaaactttgagacaaaatgaacatttatttgggaaattccggaacaagtgaggcttattgggcaactcatttccctgtcggtgattttgtggcagaagtaacggagaacgcaattgtgttagaaagcgaacaaagcgtgttttattttgaaaaagaaaagggcgatgaaagagagggtattgttggcgtaccagacgaggcgtataaaatgtcaaatgacgttttcattctgatacacactccgagtccacaaaaagcgagaggaaaaagggaaacaaagcagaaaagtgaacctcagagaaaagagcgaccagcgaaacaggaagtgtttctgaaaatcaggccgggtcaaaattcaaaatttgaaaatttggacccagcgtccagacccaaaagcaattggacagggacaacttgggctccaaaaaggaacacaacggagctaataattttgagtaccccggttccccagtccacaagtacagtggggagtacgataaaagtgaccatgacaatttcgacaaatattacaagcacggttccaacgactataaggcctaagatagaagtcaaaaaaccaattttcaagaaaattcaaataaaaaatgagcaaaaactcagtcagtatacaaggcagttgggaaaaaggtggaaaaattggtagttacgacaactaaagctccttttacaacgaccaaaaagtcaaaaattgaaaacatactgaaaaaggtaacaccgaaaccaaaaattgcggttttaaagaacacaacgcaaaagattcttagtactgttagaccaagcactaagagagtggtcagtgagatctttccaaagtcagttacaactccgagtacaataatgatcttaaaaagcacaaataattccaaaaattttttaatgaatgtgactgagattccagcacttatgactccaattcctccaaccactcaaaaaattgtggaaaaggtggaattgccgaaaaagaaagtgaaaacaaatcagaca

SEQ ID NO: 14310 - DNA, 1392 bp, Heterodera glycines
  misc_feature (1301)..(1301): n is a, c, g, or t
caaaaactcagtcagtatacaaggcagttgggaaaaaggtggaacaattggtagctacgacaactaaagctccttttacaacgactaaaaaatcgaaaattgaaaacacactgaaaaaggcaacaccaaaaccaaaaattgtgggtttgaagagcagaacgcagaaggttcttagcacagttagaccaagcactaagaaagtggtcagtgagctttttccaaagtcagctacaactccgagtacaattttggtagtaaaaagcacaaataattccaaaaatttttctaagcatgtgctggttaaaaaacctgaggttgaattggaaaaggccacaacagcaagtctatttccaaagacaattaaacacacagaaccaacaatgaatgtgactgagattccagcacttatgactccaattcctccaaccactcaaaaaattgtggaaaaggtggaattgccgaaagagaaaggggaaaacaaatcagacagcattaaagctgaaaagaaaaatgaaaagttattaattccatccacggcaattacggttgtgaagaaaattaaggacgaaaaagtaagagacgtgtcggaaaagacagtaaagaataaaaagagtgaggaagaatacagtcaggaagttgaagctgaggtcattgagagcttagctaatgatggcaatgaaatggaagaattcgaaaattcattccaggatgaaagcgatgaggaagttagtgtggaattattcgatgagaatgaaatcttcgacatggatcgaagaaaaagaacgacagttacaacacctgacgcccggtggattaaaaaagtagagaaaagcaaagtgtgaaataaagcaggacaggaaaataagaatttgaatacgcgagtcaattatgcattgtatcgactaaatgaggagaaaagaaggcaatacgatcatatttataaacaagcgtgcgaaaatactaaatttcagctacaattggccaaagcggttttacaaattaatccaaatgagggagtcagaaaaatatttaatcgagacgatttagtggcacgatggaaaggagataatttggaagttggtttttgtgcgccggttacaccagaaaaaatattctgggacagaaaatggggaacgattgttacgaatggataccaattttcgcagaaaatacaacattttttattcggccgggtaccagagaattgagcattataggcaaaagaatggagtgtacagaaatggaaaaaaccaataatatgaacaatgcgacacaaaaggaaattgttcaaaaattaactngaaaattttgggaaacatttaaaccgaaatacagaaacatacaaaaatcctttggtccctgagagcgggaagccttttttgaatcggacag

SEQ ID NO: 14311 - DNA, 1224 bp, Heterodera glycines
cagtgacgggtaaattttgagaatgggaagcgacactgcttgtttcacccgacaagcactgtcctggaccagtattgcttggtttaccttttcttatggatttgaaaggagttattgcacttggggaaaagaaagttcgattgggtgaaatttgacaagcagagtatcagtgataggcacagaaccaccaaaaccaccgagagtaattttaccaaaaaatgacacgtttgaaccacggacggaaaatattcttaatgcgagagttgatgaaatttttccaactggacaaaatttcttggtaaggggtatacagcatcagtaccctgggattatcattggaaggacattggttgccccaggcgcgaccaaagaagtcataataagacttatgaatgcgggaaatgcaccaattaaaatttacgggaactcaaatttggcagatttggagccattacaaattaatgcattacctggcgatgatattgcggctaaagattttattccacctgaaactcggtggagtgaaaatttgcctaaattacccgtaaatgacatgaatcggcctccttcagaaagaatagatttggaaaagacaagactaagtgaaaaggcacagcattaaagcaaattgtggacaaatattccgatgcatttgtcggtgatgacggaaaaattggtcgttacaatggtccaattgttcacaaaatcgatttgacgcccggggcgttaccattccattttagaccttatcgttaccccccagagactcagaaggaaattgagaggcaaattagaatgatgcttgaccagaatattattcgtgagtcggaatctgagttcgcttctcctattgtgatggtcccgaaagcggacaaaaaatcatggagatttgcggttgattacagggcgttgaataaaatgaccaaaaagagagtttttcatcttccgaatattcaagagcttttggatttaatgggagccaaaaaatattacacttgtatggacatgatgcagggatttatgcaaatcccaatggcaaaggaggacattgaaaagacagcttttatttctcatttgggcatttatgaatttatcacaatgccttttggtttaacagcagcaccggacacatttcagagggtaatgaattcgttgagaagacgattgacagcagcaatgttaatttatttggatgatataattattgggagtgaaacggaggaa

SEQ ID NO: 14312 - DNA, 3885 bp, Heterodera glycines
cccaaacggacacttgaaaaaatcgattttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccagtagttagagactccattttcaccggattacggtagccccccataggtgtgggaggggtgcatggccaactgagcgccagccatttgagcgccgccaagtgagcgcgggccatttgagcgccagacttttcagtactgaagccaaaacctattgcgcgactttttttgcaaacccaaacctattgcgcgactttttcttgcaaacccaaacctattgcagggggtgcgcgactttttttggtgcgcgactttatgcaaattattttattaatttaaattaatttaaaattaaattttaaacatcttaaaagtcaaaacaacttaagacgttgaatttaaaatcatttaaaattcatcaaaaattccccgcaccgagcggatccgaaccccagagggggcggccagactgacgcactaaccactcggccacattggcaatggatgataaacattaatttgctctcataaagggaaaaattgacgtcaccagcggcgggaggggggcgagagcaggcggcgagaaggggggagggggtcaaataaacaaatcaattaaggaggggcgggggtgttgaaaaggtgccatataaacaaattaattaattggttgcgtactttgtgttgccgccctccttcccgcatgcccattatgtaatttgacaccttcagacaataaacaatttattaattgattttttgtccatttggtaattttcatttcatttaattcactttacggaaagaaaagccaatcaataatccattatcatttatttatgccttaattttttccttctttggcatttgtttacccatttacccattactttttgccatttattatttatgtgccagattggcattattatggtaccgttttttgtgccattttgccgcaattttttggcattgttttgcccccttatttcccaatttatttcttgccaatttttgcattgttttgcccaaatttttaaccctttattttgccaatttttacacatttttgtgccaaatttccctatttatttcttaccaaatttttgcacatttttgtgccaaatttccctatttatttatttcttgccaatttttggcattattttgccacaatttttaaccctatcttttgccaatttttacacatttttgtgccaaatttccctatttatttcttgccaaatttttgcacatttttgtgccaaatttccctatttatttatttcttgccaatttttggcattattttgccacaatttttaaccctatcttttgccaatttttacacatttttgtgccaaatttccctatttatttcttgccaaatttttgcacatttttgtgccaaatttccctatttatttcttgccaatttcttgcatttgttttccccattttctcatttaaaaaatatttaaattcttggcattcttttttttcaaaattaaattatggcgttctgttttttcaaatttaaaaattatttaaaatcttggtgttctgttttttaaatttaaaatcttggcgttctgttttttaaatttaaaaattatttaaattcttggcgttctgttttctcaaattaaaaaattattttcacatcttggcactctgtttttctcaaaattaaaaattatttaaaatcttggcgttctgttttcaaatttaaaatttatttcaattcttggcattctgtttttttcaaatttaaaatttatctaaattattggcgttctgttttctcaaattaaaaaattattttcacatcttggcattctgtttttctcaaatttaaaaattatttttattaattttccgcttttttcttccaagttttaattatttttgctttccctctttaaaatatttttattttccactctttttttccttttttattcattttccccttgttttttttcattttcattgatcgcaggtactttgtactgtcctttctcaccccatttttttcattttgttggtttactcggtactaaacccctttaggatatttgttaagccgtttcaaatatcctgggggccatccttaaaccgaggagtcctgccccggtactgggttacttcccagaggggtgggcacgggcgttcactgtccactgggcttattccgctggtatccagggctgcggcagtgactgaccgaaaccatgtttccgtcatagcccgccgggtgtcacagcgatgtttaagcccagccagatagtcggtctggtgtggacgggggcccttcactcgctggccttgagggtgaaggtgtgtctgttcctagcagcgggggtggcggttcctagccctaatgtgccctgcctacgggctgcattggtacagcgagagaataaccgggactggctggcccggaggaccgcgagtcactgagcagtgtcgaatgcgcagctgctcaaactcaacaccccggattaaaatccgcgttgacggaactcatatgtgctgtgggcgttggcgcaagtgccttatggagggagtaattacccaacatagggaggcctagaccaaaccttgcactttgggatggtagtgccacacactttgagttccatgagcggttccataatcgcttgctatgatagtcatagttggtgggcatgccctccattgtgatggcttgggcaggaaggttaaaaacacgtgtagggggtgacctatgcgcgtttttgactctccaaaaatggcccaaatcatcgctcaggagaggggtcatgcccgatttttttttgggtggcccttttctttgtcattttcgatcaaaattgttttactcttttcttaaaattgatcaaaatcaatttcagaaaaaaaaatgagccaataatccgacgattccctcccccctaccctcgatggaccgtattcccctgttggggatgatgatggagccgaattgatcgacgccgccccgccgctggaagaagtcatcatgcacttgccaaattccgtacgttttgcgaaaatgtttttaaattttttcatctaattttgcgaggtcttttcaggttgtgccgtctgaagtgaatgaacgaaaggcccgcaaggaaccatcaataactcgcgaattggacaccaagttgttcaaagtgatggctttatgtgtttgtccgccgcgcaggcggaagcggggcggttcaaaggtgtgttgtaatcacaactttttttaattttaaaatttctaactttaattaattattcgctttatgctatgaaaagtatattaaaaaaaaattttttttatttgtacattgtttaattgaggtattttaaatgatgtttagcgtttcgattcattggccaatttttgctgagcctaacgttcggcgctgtttttccggaggacattctgcgcaatttattcaccatgtgcctttcctacgcagtcgagggggccgaatcgatgaaaatatccgcggaccacttcattttccttctgacgtcaaaacaccttgactacgaagtggctgtacactttaaaaagttggacaactcggcaacagaaaaaatcctgacgcgttttga

SEQ ID NO: 14313 - DNA, 2337 bp, Heterodera glycines
ctcaatggcagcactgggcgctcggtcgggttcggtcaactccgtcccagccaagtttaagaagccataacttttttcattgttgaccaaccataacatccatgatatcattcgaaagctctggatgttttgaagatatttgtaagctattaataataaacacacagagctatcgaacaacaccaacaatgcttaatttgattgacaatgaacaaagttatggttcaaaaagtcttccgacgacgtttcggccgacgacgttttgtcctgcttcgtcttacccgccccccattgaaatattttaaaatttttacgattatttgataaaattaattgtgcaaaattaaactgctatttccacggatccatctatcaattaatgaaatttttcaacattttttgtaacaacttttttaaaattatttgaattttctcggaaaacctgtaaaaattggcaattttacgaaatgcccatagtgcggaacattgcggcggaagagccaaaaaaaaatttatttttttttttgaaaaagattgtcaaccacattttagaaaattttcgaacttttcaaaaaattagaaaaattcaagaattttgtcgcggaaagcgacaaatgatatattttgataataattaatattttttcctttcattaatttagtatttttctctattttttattttgtgtgttactggttctctccctctttctttctctctctctctatgcgcgtacgcatgcgcacgcgtctctagggctataaaagccgcaccattcgcctattggggcacttcttctcacttctatttaatatttatatttaatcgtcccttctccatttattcacacatttatttgtgactaataaaggaattgaaaaagggagtcaaaattcgaagagaaagctcttctcgcataagcatacaagggaaaggccaaagcctcttcctttgtccaacaaatcaattaacgttccaaaggggaacgttgaaagggatcgaaatccctttctcttttttgtccattccgcgacaaatttgctttttttaattttaaaacaaaaaatttgggatatattttattcatttcttctcatgggttttttcaattcaggacaactatgaaaaaccaggacacctgtgtgcatttttttacatgttaatatgtttgaacattcgtggcaaaatcaaataaaattaaaaataattatatttaggcatttttgcaattttatttctttatttttaacattataagaaattatagaaaaatgaaatttaaattattattattattcctattaatgatcctactatatacaattaagcagaccgtgcaagtgaaattaaaacaagaaaaaagctttgatgaaatatttgacaaagatgtgacgatggagcagaagaaattctctgccgaattgatcacataattcacggagaaattgctgatcagtaatcaaattcaacaaaatagtcgacaatttgatcaattttttgatgaaattttggaagtaaaaaaaaaagatagtgaagaaatgtccaataattgtgatgaattggaacaattaaaattgggatcaactcaaaagaaaatttatgaattgaaaaaagaatttggattgaccaaaaatagttattcaaaggaggaaaaacgcaaaataataaaacaatttgatcaattatatgacaaaataaaatataaattaaataaaaattgaagggaaaaagaaaaatatgtcaaaaaaataatagcaaaacatttgggcacaaatatcagaagcattttttattggaagaaagaattaaatgttgaaaattcgaaggagaatcaaaaaaatgatgatgcaaaacggaaattgttgaaaaatattttaaaataaaaaatgaatttatgaaaaatgggaaacattcacggaaggaatgggaagaatttagagcagaaattaaacaaatgtttggtgtgggttattggacgattgaaaaatgggcaataaattagaaattgaacaaaatgtttcaaaaagtaactttttgaaatataacattttttaaaaatattttgaaacaaattaatttgaatattcacagagcgcaaattttatacaattgctgataaattggaaaagatgaagcattattatcaaatgaaaaaacaaaatcccaaactcacggatagccaaattgcccaagttttgaatgtgtcaagagcatcaatgtacagaattaaagctgaattggagaagttttgaaaacagccgcttcatatataattagtagagaccgactaaaaaggcacgaaaaatcgcgaaaagaggacagcctataataggcac

SEQ ID NO: 14314 - DNA, 1183 bp, Heterodera glycines
atttttatgggagcaaaatacgtataacttaatcaaaaaacttaattttggtcatttaaatgatatcaaatattttataaagtttttttcgaataaggaaaaatttttaaacctaaaattttttatcaagaaaaaatgaaattttggtgatcaatttttgagaaaatttttcaattcttaggggtatattttctgaaattttttcaaatcctttttaggggtgtcttttcccgatattttggagaatttcttgaaaaaagcggaatgttttttcatccctttacaaaaatattttaatcattaaaagcgtctaatgaaaaattttttaatcaattaaattttaattaaatgtttatcttattttaatcttgcaaaaatgaaaaaatatggtaaaaaaaactttgaggtattccatgccaataaaaatattttaatttaatgaagtaatgccaaattggtaaaaataacattttaattattagcaaaaaatttcaaaaaaatcgtcattttttgttgttttatgaaaaaattagagttgcaaaataacctcccctgaaataaaagcccccgattagcggagttgaaaaataaaaagaaaattactttgagagtccttaatttaaaaattgaattggttgcgtattgtaagtgagctaagtataagaataaaatgattttcattagtgtcaaaacatatttaaaaacctcaagaaatgaaaataaaaaaaactttagaaaaataactcttttaacttaattaattaccttaagatttttttatttaattaaaataaagggttcaagaatagcgataaacaaaaaaaattaatccctatccaatatctctccccttttaaagcattatgtcctcatttatgattgcgtcctttcaatggtgtcgggcgaataaagaacaaccggatgccggtcacggactgaaccgagagttatcggacaactagcatttttcggcatatgtggaatcggttcggcagcttcagttggcaaatttcttcatgcataggttcttgctgttgtatctgatcagtctgaacttttcctgcttgacagggaacaaaagaccgaattagtttagatgagagtgatcgtaattctcaatgttgccttcaaaattaaaacgggcgagacttagaattttgcgttctaacctaatttggttttc

SEQ ID NO: 14315 - DNA, 2866 bp, Heterodera glycines
attgctcggcagttggagttccccgagctcagactcatcgaatacgattgtggtgggtgcttagaactggatttaggtacaaacccagttcaaatttgttttatataacactccccctgctcttgacaggtaaactccaaatgttggcccgtcttctcgagagtcttttctccaataagcaccgctgtctgattttcacacaaatgtctcgcatgttggacattctgcaggcctttctgtcctaccacaactacaaatactttcggttggacggctccactcacatcgatcagcgacaggcgatgatggagcggttcaattcggacagttcggtgttctgcttcattttgtcgactcggtcggggggcgttggcgtcaaccttaccggggcggacaccgtcattttctacgactcggattggaacccggtcggtattggcaaaaaatgcgaaatggggagaaaccgacgactgaaaaattgtcctctttagacaatggacgcacaagcacaggacagatgtcacagagtgagtttaatttaccacaacagggaacaatttgaggggaattcatttgctatttctttttcagattggacaaactcgaaatgtcaccatttatcggctcatcagtgaaaagacaatagaggaaaatattctgacgaaatccatgcaaaagcgacggcttggggagatggccattgaccagggcgaattcacgcccgacttcttcaaaaacaccggcaatctgcgggatttgttcagcaacgagacggccgttgccaaaataattgcgcccgttgtggacgaaccgaagaacatcaaagacgtcgaagcggtaaagaagggaatttttaaggttattttgcatatatttaggcaatgaatcgggtcgaggacacacaagatgcaattgctgcacagcttgccaaggaggaggacactgcagaagtggccgaatttgacgagacactgaacggcgcttctaccagctacgacctgagagacattgacagtccctccgagcagtacttggaattaatcagcggggtattacaaaaattagttgaaattttcggaaatcttgcatttgtagctgaaaccggtcgagcgatatgccgtcaatttcatggccgacgagtataaaccaatgctggacaaagaagtcgaggaggccgaggttggctcaatccttcaatcattcggaatgcgatcgtatttcacaggcaaaaataaaagcgaagcaaatggagttcatggaaaagcaacggaatgcggacgtcggactgttgtccgacacaatcgacgaaaatggcagcgccgtcgggggaaggaggcgacggaaagaggaggaactgctcgacatcgcctacaacgcctccacgggccccgccgctgtcgatgaggtagccaaaatggcgaaacgaaagttggccagcgccaagagggtgaggggggcgcagacgacgacaacgacggcactccgttgttgtggcagaagatgtcctccggggaaagtgtaggaaggacggccaaacaaaacaacatcgaacagcgcttattacgagtcacacagtccacaaattatatacctattcaccccacccttcgttttgttgctgaactgttatttcctcccccaaacgcacggcccaacgcatcgcaagactttgctctttttgtttgtaccatagaaaataaagaaaagaataaatgaagaagcactgaatctgctgctgtttttgcaaaacatattgtcgtcaacggactcaaagccttgctcttttttgtttgggcttaacgactaaaatcacaaaatttctctgagggacaaagctttgaggacaaaacggacaaaaagagcaagattttgacgggctgcgggcggggaagggcccaacattttgacttggggtgccacgttttggtagtgccacagtagggaaaaggaattaagttcaacattcaattttatgcaaattgtgccacggattaacctttttgctgccccctttcccaatgccgtcatccaaattctttccatttccatcacttttgttttgttagagcaaattttaagttcgatcgcttgtcccattcgccgcttcccttcacttgcgatgtgtcatccttcgacgacattccggtatttgcattgaaattgaaatccgcctttaattggcccatcctcccggggtttttttcgtttctttctgtactcgggtaccgtattccccccgtgtttttttcgtttctttctgtactcgggtaccgtattcccccccccatcccatccctccgttgtccccattctctgtgcccttcccatgctcagatatggatgcctccgtctccgcccaattccgaggccggtggcgtctgttccgtgccgtcctttgacatttactcgcccatcgacggggctttgctttaccaacccgggccaatggctgaggacgaattgcctccgctgcctccgcttttgccttctttggacgcctttccgcgcggcgtcagtcgttcgcctcgcaaaacggcggctgagtcgccgcttcggacggtggtgacgaaacaacggcggagaagaagcacatcgacgacgaaaaacgtactgacgacgaaggaggagagacagcagcaacaaatgccgaaggacgggcccatcgttggcattccgcccgaaattgcggcttccattcgcggcgaacaggcaatggctcgaacgacgacagttcaccgatgccgccgccgccttcgaacgaccgccctctccgcccgagtcggcgccgaacacttccgatggttatgacgccgctgaacagcgcgtcgacgaatgtgctgccgatgccccaactttttgccccgcc

SEQ ID NO: 14316 - DNA, 1005 bp, Heterodera glycines
gcccaaattggagcatgccgaggccgtcacggatttgtccactgctggttccactcctggtccatcctttgtccttcccccggccgtggcaatgccaacaatttcaactttggacggtaacgaaaggaaagggctgaacggtcggacaattggagcccaaatgggtaccatttgagaagccatcgaatcaacgctgcgcaaaagtcgcaaacgcgtgcaaagtccgtcaacatttgcgccgacagtgccgcgttatttgtcagtgaaatggccaaggggggagggactggggaaaaacaaatttgccatttccaactttcagaattcgtaatttgggcccatttcctcagcaacccttcgaaagggttggccccaacgcctcccgccacattttccgcttggtctgtcccgaatggcgtgccaattcgaacactctcccaatgcctggtcccattggaatggaattggttgattttgaagggattccctggagtgctgcggaagaccagcggctgctgaaggtgaagcggacattcgatgcacaatctcatggccattaattaattcgtccttcccttaggccatttcggataagcattgtctgacgaacgcggctgatcagcagctgctcactcggcccggcattcaattcaactgggaatttgtgtcgcaatatgtcaacgtccgatccaaccaatacaggtccgaccgacaccgaactgattgcactgtccttttctttctccgatcattttacatcaaaccccttaaaatgtcacagatcgcctcgtcagtgtgcgctgcgctaccaaaatttcgttttgcgttgtgacgaagcgtttgaggagaattcacttggccgcagaggtgatcagtgatcaccagtgggattttgaatttggaattgatccctttaaggcccgattcccgccgtccccctctctcgtcggtctcgcccttccgtcaatgctccgccgtcccattcggtgattttcgactgcaatt

SEQ ID NO: 14317 - DNA, 2719 bp, Heterodera glycines
tgcgaagatttgcttgctttgtcctcagacgattcgtacattggtaatttattcgttcaaattgcattttttaaatagtggtttgattggcgcgtaaaatcaatgatcatttcttttaaactttttgaatagttttgttttttagatgatacttctcattttcctctgtcccatgcaattcccaaagcggccatcagacgaatggctatcatcgacgtgtgcaatgttttgtacggctgtgcctttcacacaagcgcgggaaaggctttgaacgagtgaatatacgaaaggggggggggcatttgagaaaattcgcagggttttaggcgatgcgatgccacgggtcttattgtgatggcacggaatttgctcagggcgggcttcgatctcaaaatgttcgtgcccatttcttatacaaatgacaacaaaagggtgcacaacaaattcattatggaggtcagaaaggaaatgttatcatttgcatccaaaaattcaaaaggaactgcaaaaactcgattatcttacggttatcgacgatggctctcacgacgatttttttctgctcgaagtggcaaaatgcaacggaggctttgtgatatccaacgacaaattcagagaccaccgcgtgaggacggaagttccggacggacttcgccaaatcattgacaatcgcagcgtccccttctcttttcattatgtcccaattgacaaaatcggaaaaacaacgttggctgatcccgcaaaattgggctatttggaattggaattcactctcaaaccgccgaatatcagtgagtcatccaacaccaaaatccgataagaagggaaacaaacgcatattttgtattattttgcgaatttaaaaaatgcatgaaaatctatgagtccggatgaaaaaggatcagaaaatggagacatctaagaaaatttagtatcaaattaaattctatagtgaccgttaacttgggatagaaaaaacttgcaataaattgttcttgtgcatccaattaaatcaaataacgatcccaggattaacactttcccagttgatattcactgaaaataatttattatgacaaaaaaattttgaaaccctaaaggccaaactccctttggttattagcggcgggataacaactggaaaagtgtccgaagatttacccccattaccggatttatggcttggagtatctttttgaaaaaaacttaaattaaaaattataattttgctgggggaacaaaggtcgtggacatttgtccttttttcaggtgcaatgttttcactaagtccttccgacccctcttatggcatggtcttctcacaacgaattctcagaagtgagaaacgcgccctcgaaatgctggaaagattggatgtaatgtcggagtaccttttggtgagttatttgccaaaaaaccgcttaaatgtgagttttagcaattaatgtgcgaaaacctcggagtcaaacgctctctcaaacacttaaaaatgcccgaaatggaaagaatgccgatagagttcgaaagattttggcgtttttatgatttgcatcaaaaatgatttggtcattcatatttttaccaaaaatatctattgtttttgttttgttccggtgtattttacaaatagaaatataattgttttctctccctccttccactctcacacaactatttctccctctctctcatttctttgtcagttagcaaatcggacggtctcccgtgtctctgatttccactctgttcaaatgcacttccgcgtctccgaactgctcgcttttgtcgtgtactgccaccaatgaaaagtgtctcaattccgggtccaattggacgaccatccgctccatcctccattcttccaccttatcaaggagatcttcgatattgtggtgacgattggttgtctctcacttttggaccgattagcaatacataaaattcaataggcctcacctgaatcaactgcgctccattgatcaccgacatctatattgataaactcagcaaccgaactcgccgatgtttaattcgccgataaattattgaagaaaaccgaggaaaatattttctttattaattttaaaaaaataaccgaaaaatgttcattgaggaactaattggggtggccggaatctttataatacttttgtgatcattaagaccggatgggatattgtgagttatatttcacaatttgttaagatttttgggattttcacaaaaatgttcgagaaacaaaaactgcaataaactcactgaaggccaatgtttttcatttattctcaggaaattttttgcaaccaaaaattacattttttgttgcaaaacatgttaacaaatcgagccaaaattttatttcttccccggagacgccagccggcatagccaatctcaaatccttaattttaaaatgaaaattaggcataaaatatataaaattgtcatttttgtactctatataaaagtgccaaaagcggctttttggcaccggcaaaaatttacatatgtcagtttcattttcgattgttaatcccaaatatccatgataataataaatattctattaatgtaaagaaagtaaattctatagtttcaaaaaatatttagaaaaattatttaatattagaaaactatttaaaattttaaaagcacaaatcattaaaactaaattagcttcaaagtattctacaatgttaattcttgcagaaccgaaaca

SEQ ID NO: 14318 - DNA, 1906 bp, Heterodera glycines
  misc_feature (74)..(74): n is a, c, g, or t
aatagaaatataattgttttctctccctccttccactctcacacaactatttctccctctctctcatttcttgntcagttagcaattcggacggtctcccgtgtctctgatttccactctgttcaaatgcacttccgcgtctccgaactgctcgcttttgtcgtgtactgccaccaatgaaaagtgtctcaattcggggtccaattggacgaccatccgctccatcctccgttcttccaccttatcaaggagttcgtcgttttgtgtgtgccgtttgtttgtctctcacttttggtcccattagcaattcgcagtatccaaatgccctcagggggtccgtctccactccatttggccccgttttttccattgatagcctcgcgacggtcttttgctgctcatcagggcaaatgtaaagacgagagccgaaggtggacagactcgcttcaagatgcatttccaattgttcgttggagggaaggcgaaagtgacgcgatttgagaatcgcacgacgcattccgcgggagaaacgcgcaacaattccttgacataattagcaactaattaattgcccaccaaatctaaggcccgaaaaaccttcgccggacggaggcaccacaaacggaacatcgccggcagcgagaaaaagggttttgaatttgcacaatccctcggaaccgaaagcgcagttcaacgcctgacaggccaattcagctgcggatgacaaagagcagaagccagagcgagcagctgagaagagagtggaaaagagagtgaatgtgagagaacagagagagagagagagagagaaaactgggagaatagagagagtggggagggagagagagagaactgggaatagagagagtggggagggagagagagaaaattgagagaatagagagagaagggggatagagagaatggggagggagagagagaaacggggatggagagagtggacggagggagagagaacgaaggatggagagaaagaggagggacagagagagagaactgggaatagagagagtggggacggagagagagaaaattgagagaatagagagacaagggggatagagagaatggggagggagagagagaaacggggatggagagagtggacggagggagagagaacgaaggatggagagaaagaggagggacagagagagagaactgggaatagagagagtggggacggagagagagaaaattgagagaatagagagacaagggggatagagagaatggggagggagagagagaaacggggatggagagagtggacggagggagagagaacgaaggatggagagaaagaggagggacagagagagagaactgggaatagagagagtggggagggagagagagaaaattgggagaatagagagagaagggggatagagagaatggggagggagagagagaaacgaggaatagagagagtggggagagggagagagaacgaagaataaaaagaaagaggagagagagagaaagagagaaccggggatggagagagcggacggagggagagagaaagaaggatggagagaaaggagagagaaacggggaataaagagaatggggagagcgagagaaagagagaaccggggatggagagagcggacgggggagagaaaacggatgatggagccttttgactgcttgtttaccgatgcttttgatcagaatgaaaggctcgtggagatcattttggctgattggcatagaattgttgcgttcggcgacaattcgaatgcgaaaggaatgggcggagttaagcgcgacggaccttcaaaaatcagagggattccttctttatttgggataagtttttaaaatttttgaattgatgaatgtccaagtgccattgtaaatcaccccccccccatcc

SEQ ID NO: 14319 - DNA, 2586 bp, Heterodera glycines
ttgcttttcccgttttcattttatgctggtattctttcattattttcttaagagaagaggacatatttctcagcgtgatgccaatgagatgatggatgattgcgaaattaccaattaccaaaaaattcatcaattatttttccaagtttatcaataaagaaatgattaacgcacaaatattcaaatttttttcacatgatcccctttcagccttgatgaagatcaaaactaaatttaggagtgcttttccttcttttgaaaaattagggttacgtgacaaacgcatatgggccaagcttttccaacaacgttaattggattgttatgaggagagttgacgatccaccactaggatagagccaactgcaaatctctctgtgctcattacgaaaaattgtcaacgtgcaatcctgtctcatggtgaattcacgaagaaaaaacaaaattgcaatcacatcaagaccattttggagtttgtgtctcaacatcttcaacaataaaatgcatttttaatggatttttaaaagagtaaaggacacattaaatccttttttttgaagctcacaacaaaatgaatccgttatctctctctctctctctctctctcaatttttctttgtttttttggtagcaatctcatcaacgtcaccatcatcatcatctttttcttttggcacatcactgtcattttttccagggcacttcttgaacaaattgacaatccaatcaaatccagtgtaagtctgactgttcgcctatgttgtggtttgtcaaatatgtaataaattgcaaaaaaaacaaccttaatgttgactttcgcaattatcttcacagcaatcaaatcgtccaaatgtttcgcaaggctctccggctccttctccttggcgagcaattcagcagctttcattcccaaaaactcttcggcaacactcgaaaacatggtgacacgttgagcaatgtctgcttgttcaacatcctgtagcagaagacggacaaacaccgtgtggatgggggcaatggctttttggccgcaagcctcacacatgttatcatcggacaattttcggcgacaaatgagccccttggaacggaatgggcatgcctaaaaacagaaaaattaataataatttaattaattaattaatttggactttgtaaacacggtactgcatatttgtcacttttcccaaaacataaaaaacgccggccgaattgaagttgaccacatcgctgatgtttttcggttcaacggaatccaactcttcttgctggcgtgttccttgctccgggagttgaaagcgtttaagagaattcattgcaggaagatcggaaaaaacgaaggaggatgtaattttttaaaaaatggaacacgaatgatttttatttagaaaaattgtggttaaatagcaaaaaaaaatggaggcggaaaaaagaaactaaaaagccaaaaagcggagtcgtattcttagcaaagcaaaacaaaaacaaatgggcgtgaccaacaagaaaaggggcggagtattttttactttccatgatgacgtcattttttttacaatttaatgaattggattttgctttcccagtggcataaaatggccaattggttagcacagtaagttggtatgggttcgagcccagccggaagaaaagggtttttttgctaatttacttaaagcttcggatatgatatatgcaataggcttgggtttattgattatttgtgtacagtccttacaataggttttgcctttttttttgggggggggctcaaataaaattatcgattaataaattttaacggaattttcatcataaagtcaacaaatatcccatacctttcaactgcccctgtggccaagtggttaagctcctcgcttccactctcaacggttcgagaccgcgaccatgtttttgattttccacaatttatcggaaatagtcgcgcagctctcgctcgtttaaattaattaattaaaatttaaattaattaaattctcgcgcacaagtccatccaataggtttcggttgaagggatcaaagatcatccaataggtatgggggggtcaaataaaattatcgattaataaatttaaaaaaacaaattaaattaaagtcgatttcattagtcagagaaatcatagaatgtactctctctctctctcgaggagaccatccaataggtttgggtttgtggaaggggatgtcagagaaaaaaagtagacacactcaaattatcgatcgaaaatcaatcgataatttgattgggaatattatctactttagtttagcatttctaaaaaattaattaaaaaagagtgattgatctttttggtataaaatgtgggatcagtttaagcctaaagttaagcctagcctaagccattgtacgagttgccttttctacgtgtttcattagatctattttacctattgtataataataataataatgtacttgtaggttttgctaccccccccccataaaaatgtgatggtcctggcaaaggaaagtacttttctaatggagttttaggagctgatcgtgaatctgacgtcaaaactgcaaaaatcgatgatttcatc

SEQ ID NO: 14320 - DNA, 1377 bp, Heterodera glycines
tcagtccagcgatcaaagttatttcataggacacacacccaattgaagagctttcatttgtttttcagcaaatacgctttaattagtctttgcttttgaaatttacctgaagatcagtgaggtgttttttcggctggcttatgacgcgcgaaagatgcgcagaaaagggagaggcaatggaaaaacaattggaaaaggaaagattggtggacgaatgatggcactcggcaaaacaaaagcaggcggggcccacagcgaggaggacaaaaagcaattcgggtggaagtattcctagaatgaataagtacggatttgtggagaagagccccgacatttgcggcccagccaaaatcggtttttgcggccaacggaacgccaaattatcattttttcaatttaattaaatgaaacgatatttagcattctgctggccgcaaaaatcccattttaatttgggccacaaatatcggaaaatggccctgatgaaatgggccgcaaatgtagggacacgattttgggaggagttataccatcgaagccaaagacggtggaaagttcgtaaatttcgtgacaaggattattctggtcggattcagtgcacgacattgagccaaaggcaattccaacgctaccggcaaaagccttaaggggtggcacttccaactttttaatggcattgtccactgataactgaaaagtaaaaacaacaaaatttaagtttaggacagaacataaataccaaaaacgtgcatttttcttgaattcgtaaaccgagcgcaatatgaacaaaacgagcattttgacgaaaaattttttgaaaaaagaaatctttgaccgtcgaacgcaagccagaagaatgtagccgaaaaatactaaaaattcaaaattagtaaaactaaagcagagactatttcggaatgtcaaattaatcaccaaaacccgaaaaaaaacacattaatacaaaagaaatactttattcggagggagtcggtgtcgacgagttcggcagagattgtgacgagtttattgcccaacgaaagaatatgcaacggaaagaccgactaaagaaagcacatttaagccatttccaatgaccgacttgtgcggcttttcttctgccggtgcttacacttttgtcaattgttctgacccaacatgaaactgttacgcccgactcattgtaagaattgtccaatttgaaagtggcggctgtgcattccaatgagaaaagcgaatgatgggttggaagaacggcgactgattcgccaattgcgcattcggtggggtcggaagactcaaacggaaaacaaatgttttaattttggattcgccattttaaacaagaaaagagaagagcatacagtgattaatttatta

SEQ ID NO: 14321 - DNA, 3390 bp, Heterodera glycines
gagtcgaagagtcgacaattgtttgctgaacaaatacttcgataaatttgttaatttataattcatttaccgtcattagagcatccgacatggaaagtcgaaaaaactcgagcagaaattttggttgtgggtaaaagagaaccaattgttcggcaatgtccagcagtgccgttacggtaagttgggaagcattcaatggacgatgtaaagtcaaaattattgtgaaaacatttggaataagctgaataaaaagtttaatttaaaataaaattgaaacagcaaaaaataaaaaataaaccttttcaagacgaacggaggtaaaaaagttgaaaggcgtgaaacaggaggaaacggaacgaaggccaagttccaattggtcgttcagtgattccaacgaaaggcaaaaacatttgaggcgttcaattaaaaaaagctgaaattagagaaaccaattgccaatgattaaatgcgaatctctcttcatagaattagtgacagggctgccaactctgctgatttatcagcattttgctgctttcagtggatcaatgctggttttttgatatgctgattttttggaaaatccttaaaatagccatttttatgtaaaactgttaccaaatcagctggcagccctgataatgacattcaaacgaacgaaactgggcaattacaatacctgcaacactcctaaactgggaggtgtccgttgcgttgtattcgctgctttctctttattttgccccgatttgttcggtactttctcctcatttttcagagagtgttctcctccctcagcaacctcttcactgatgttttcctcattttcggcaatgttttgcactgtttcttcgttgtttttctgtgttccaaaatgggtttctacgatagcaaatgaatgactcacgggttgaaaagaagaggaaatttgggtggagcaggcgaagaacaaatccctcaaaagtaccaaatgcacattagggtcactgccagaactgagcattcgctggaagttttcgtggagaattcgaagttttatctaagaataaatgtaaaattgtttgaatccatttactatttttggctataaaacaaaccgcatttcctttgatcagaatgacgattagacaggagagcaattgggccactttattcacttctttcgcttggcgtgccattgtcgccgtttgcaaaaaatcaacacaaacaacgaccaaagaaacgcaatcggcaaaaacccttttagaatgtgcagaaaattctgaaaagaatttttgagccaaacactcgcacaaaccgaccgacaattgactgcaactctctaaacatgacgaaataactgtggagactgccaaaaacattgtctgcggattggcctaataacacccaaatgtcagtgagggctgagcgaaagattggcgaataattgtcaagcaaaagagccatcaattggtggaactaaaagccaatcagagaaatggagagaaattcaaaaacgaagagaataaacatttctatttgaagaatggacctggtcattgtcggaagcacgaagaagtaacagacaaaaattgaaaaagggaccctgcaaaacaatgttttggatgactgagctgatgttggacgaaattgttgcaaataatttgtcaaattggcttttgttgattggagaagtcaattggagtgttaattgctccaattctttgataaattcgtttacattcgtagtcgaaattactcccaattccatttgggaattaacagattatctgaaaaaaaaaccttatgaatacctaacagcactgcaaatatgcaaaaccgataaaaatcgaatgcgagagaaaaatgggaatttgcaccaattgaaaaaattgattaaaaacagaaaactgttattcattaaaatataatttattacacttctccgtttgaattaaatgttaatttgggattagggattaggcaaatgcctaaaatttctgcgcactttgaagcacgaaaacccagttttccgcttggtttgggttttctacgaaaaacttttattgacttatttttgcctatttcggaatttttgtgcttaatgcctaggcggcgcttcaaattcgggtccgggttcggaattgatcgaaatggatgtcatattcgtgatcagcgactccaaatacccttggaaaaactcttttatcattaaaaaccaaaaatttttatgtggcctaaactgcacaagtaccaaaatttatttatcttttcttacgtataagaatttttatttaaaaattagttactgaaattttcataatatttaaatgcatgtcccgatcactatcaaggagtgataggaccaagttcctacttttttgatcagcaccaaaagttagcttattaggaattttctcagaatttttaacttctctcccaagttttttgcaccagggatggcacggaattccgacttccgaaaatttttggggcctcggaattccgacttccgaaatttttcataaaaagttggaatttttcggaattttttttgagtttttttaaaaaaaattagcaatttttgtaaaatttctgttaataaattgtattgaaattttgaaaatttttcccggcggcgcctatcgacccggccccgcggacccctccccccccccccagttcccctaatcttctttggataaagcgcgccgcaaaaaaaatgggtgtaacggtcccaaaaaaaattccaaaataatgtaaaattacattaaaatattttgaaaatcattaaaaaattttcaaataaatatattaaaaacagtttgaaatcattaaaatttagcctactaaatatttaaaaaattttaattatattcttttattttttgaaaaattccgagttccgacttccgacatttttggggtcggaattccgacttccgaaaagtttttgggcctcggacttccgacttccgaaaaatttttggccctcggaattccgacttccgaaattttttggtgcctcggaattccatccctgttttgcaccactgaaaatgggggagggttgattggtgcaaaaaaatcataaaaatcccaaaaagtagaaaaaagtcaaataaaaatgcatgttagaagcttaaacaaagccgtatttttaaagccatttcaaagctattttgagtcagcagaaataacaaaatttaaaaaaaaccttttccctcatataaatgccattttcatgtggtgtttgttaatgagtcggatcggggttttcggtagtaaaaatttctcatcttgattttcataaaaattctcgcacatctttaccggttaggtgctatgacgaagcgaaaaaagaatggatgtgagggttctgaagggaagtgccgtttctcaattaaattt

SEQ ID NO: 14322 - DNA, 2817 bp, Heterodera glycines
aacatcaaaaggaatgtctgtccgaatgttctcgcttctttaacggtcaaattaataatggattttgtacaacgcgttttgcaactcttcactcttgcgcttaatgtgattgcccgacgggggaacaaaagtgcggcactgaaacgggaacaaaaatattagttaaaatttttcagtttaagcttttgaaaatccatttaaatgaaagattttcataatttaattgatgaccaaccttccgctgctgttcgaccacctgacggtcaatttctgtgcttggaaactgaacggccgaaatgggcgaaggcggcgtttggctgggcccgtagaaatggagcagcacttgcatttgccttccatagatttcgtacggcggactcgcatcccatgagaccctttcgatgcgctcgacagaacagagttccttaacctgcaaaaaaaaaggaaaatcagaaatggttaactagacaaattcacgcaaaaagtgccttttctcccacttcctaccaaattcactgggacatgcgaaatttgaagagaaagttggagaagagaaacaagtcttctattgcatgtacatacagaacccccaatcgatcctggccgggtgcgctaagcccactcctcctcctccccagcccaaaatatcgccgcagaaatttaaaaagaaaatttttcaaagttagaaattttcaagaaaaaaatcgtagaaaattttttataagaaaatttcgatgaaaaaatcattgatattttttttttggaaaatttttcgaaaaaatcgctgaagtttttcaaaaatttttaatttaacttttcttataaaaaaattttctaagaatttttcctttaaaaatttgtttgaaattttttttataaatttcggcggcgatattttgtttcgtcccccctcctcatccccgccccaaatttagaaaactaaaaaattcaggaaaatttgtccagaggggagaagcgaacggccccgatttttctttaaaaaattctaagttaacaaatataaaaaaattctcggggggggggaaagcaattgaatccggcgacacatttcggcaccgacagattcccccaccccgcctatccattttcaggaaaaaaaataacaaagaatttaccttgcaacgcacgtacagtccaatcgccaccttttcaaaatcccttgggccaagcagttgcaaatggatcaaatgccacgggttgaccatacagctgagaatgtcggcgccgaatgtctgcacaaatgacagagccggctgtaacgcgcagtttgccttgtttgcaatgcatttagtcctaaaagtatttcgcccactcatttccttttgcttactctactaaatgctgactatcacaatgccattcttcgaaattagccatttacctttccaatttaatttgttgggcttagccaacaaattatgtttcaatgcgttggcgaacgaagttggaaaattgggcgacaaatgaatttgcaagcagaaaatgccggcaataaatgccaatgatttaataatcgtattttcaattaaataagtctatgcaaaatgtattccaattaagcggtttaataattatttatttttgctaaattacaaatccaacaactaattgacggacaaataacaaaatgaactccaaaatgatctcattgactcattttcattgtttgtgtgagccggtcaatccgggcatagaaatcacactgtccgtgccaggcacatttcgttgggagtgatcaccttaagagatcgcataattaatgaattattgtctcttattagttttacccttggggccgtcatatggcactttggcaatgccaatgccaaactcggcacatttcgagtcaatttcactgatttgctgaccaaactgggcactcaatgcctgccattcgctgttgttgctggcatgggaagaagcggaggcggcaatgacgaacatggcacggtgtaaatgaaaacaattaattacgcggtgccgaaacgcaacattttttccttttaagaggaaattgttggatatttcactggtgtatttcctctgaattttaaataattgaaggctggaagctgttgaattttgcaatatatgcatagacttaaccaattttttccaaaatatttgactacaaatgccaacatcggatatgccattctatggatggcatttttccgactaaaaacgtatttaagcaaaacgaataagctaatcccatcaaccaatcagcatcattaatttattattgcttttaattagttaataattaatcaacaacagcgaatggcaggcattgtatttaaagctaaaataaggaagattttgtccaatttttttcatattacttagaaataagaaaaccaaagtctttcattcactcatttgttcggcactttcttctggcgaattcattttaaactcaaaattcagccgatcaaaaaatttgtgtataatcattttagtgatttcttctgtttcacgggtgccacacttggacacactcttccgcggactgatcttttgccaaaaagcatcattcatattagtagggctgccaaaaatatgtacaaaaatatgtaaataaatttttaaaatggttattttcttgaaaaaggcacaaaatgccataaaaattatctaattagcagggaacggatttatatgtgctaaaaaacgccaaatctgtacatatatatgcgccaaaaatccccaaaatatgtgctaaaactcaaaaaaggctaaaatatgtgccaaaaatgaaaaatatttaatgttaattatacaattcaaatcggt

SEQ ID NO: 14323 - DNA, 939 bp, Heterodera glycines
  misc_feature (24)..(24): n is a, c, g, or t
  misc_feature (72)..(72): n is a, c, g, or t
  misc_feature (81)..(81): n is a, c, g, or t
atttcactcattttttccatttcnattattcccatttctctcattttctccatttcaattatcaccatttcncttattttnccactcctcctcttcattttcttcatcagcctttcgcttccgcttttgttcactccaaacttccattttctctctccgctcttcgtacactttttctctgcgtttttcgaattcaccgaacatcgacaaaggttcatccttaaattctgtgaaaattgctgccattttgcagtttattactaattattcgcctttttcttcccaattcttacccatttagccatgtctttgatccaactttcgtaagtttcgtttgtcagttgggcgtcgtccaaatcgtcgacaaaataatgcaccgacgacgaatgcttgaacgaaatgcttttgtggttgagcaactcaatttcgtcaacgataacctaaaaaaaattaaattgaaagcgaaagtaaagccgttaatgaacagttctaagatttgtgcttttttgataattggaaagagaggtcgacgtccaattttgtgaagggatccggccactaaaccgatttttgttgttgtttttaaaactgctttttcggggatttgaatttttaatggaatttgttaacaattttgttcaaaaaatgtctaaatttcacaattcgagcaaattagcgacattcttttttacttttcacgccacttaaatttaaaatatgcacaatttccttagccgaatcaatacaaaattcaaaaatgggttcccgggcggcgcctatcggcaccgccggatcgccccgcccccttccccaagtcttttggaaaaaacgcgccgcaaaaaacggcgcatattcggatcatccccttgcacaattctttttttaagaaaacgccgcaaaaagtggcgtgaggaaaaagatcgtagatttattgtatat

SEQ ID NO: 14324 - DNA, 1595 bp, Heterodera glycines
gaaatccgatcacatccttcaccaatttgtacatggtcaacatttcagtaacatgaagaaaaatgcctaaaaattattttattaaatatttttattactaaatatttaatagaaattcaataaatttttctaaaaacattttttattctaagttaattaataataattctatgttaattgccctattaaaaaagttaaaaaagaataatacaatttttttaacaatttttagaaaagcattttataaaaacgaacaattttggctacaatttcaaaaaaaaaagtgtacatttctaaatttgtcatagtaaaaatcattgtaaaaaggaaatgattgggtgtgatttaaagccaatatttttgcctgaaggatcggacaattaaccaattgtttcattctcggggtcttctcaccaattatggaatgtttttaccggatttcgattgcccttcattgaccgagccttatttttggcatttttttttttgctaaaactcaaattatgtcttaaaaagtgcaaaaaaagttctaaaaatgccataaaagtagaaaaaagtaaaacattttaattaaacaaaacttttaaaaaacaaaaagtcaaacaaaaatgcatgttagaagcttcaaacaaagtgtttacattttaaggcattcaaaatcagcaaaacaaataaataaattcgtttgacttaaattcgtagcccttttaataagtcataaaaatgtcgattaattaaatcattaaaaatttaataattcatttatttttgctcatctataattcaaagattaacaaaataaaaaatcggaaaaattagaaaagaaaaattaaatttattttctcttttgaactattccaaatttgtaattactttatccgttttctattactaaaaccaattatcgcagctgttaactttgacgtacatattggcaaatgttaaaaaattatttctccctaaattaatatatattaaattataactgtaatacatgggcatatgttataatggcatgcatatttttaatagattgttatttaatttgcctattttggcattttgaaattagatgattttataaaccgaaaattattattttttttttaatataatacacaaattttatccattcgaagccaatgaatacaataaacaaattaatcaaaattaatatttttgtggtgtaattggcacagttctcatccaattcgcttcggttgcttcagtgctatgccggcaccaaccggcggcggagtgccattgtttgccggccatttcagcctcaaatgtgccataaactgatgccgaagaactttgctgaagacgagacgaagaattggcggagcaattgactgaagacaaaatctaaaaaataaaattaaaataaatttaaaataaaataaaataaagataaaattacattagcattacggacaaattcgaccatttgccttgcggtccaatgcctccattcataatgcaaagttgacctaaattaatttcattataagaggaatattaaacataaatttaaaaaaagattttttaaatcaataaaaattgaaccatttaaaaaaaatattatttcaaaa

SEQ ID NO: 14325 - DNA, 1495 bp, Heterodera glycines
caatagaatttgggcatagccaactctactatgtataatcaaaaaaataataaataaaatgatatttacccaaattcctttttattacccgatcggttttttaggtcgaaacgttaaaatcaaaggcatcgataaaattacaattttttggtcaatttcagcttaagaatgctttttggtctgatttttaataacaaatatatatatatatatatatgtgtcaaaaatctttgaaattttatctattcacctcatttatcacctttgaacccaaaaaatgaattgggctaataaaaacaaatctggtcaaaaacgaatcagggtaaaaaagaattggccaaatctcttgcattagccactaattaactcaattaatttttagatcaacatttatttctttttctatttaacacctcaggcttcgttgttgcagcgctactcgagcattttttggatgaagtccaacaacgtcgacagcaacagaaagcctttttggctcattagctcctttaccaacggtcgaaacaaattggccattatttttctgctgctgaccattggccatttggccatcatttgacgaactttttggcttcaaaattgctttgaaaaatcgcaatcggacctaattgatggtaattaaaaatttaataatattttcatggtaatttaccgcctttttcgtgaaaataatcacagctgtcgagatgtaaatgagcaaatatgccacaatggtcagcaaattcaacgtcacataataagtgcgggtgcctgatttggcatatgccgaccaatcacagctcattccgtatgttccgaccgtataccaaacggcaacaaacctaatatgttttgataaaattacttttttggtgctagattgtttgtaaaaaacagttaaatttgtaaattctaaattttttattcaattttttacattttgcaatctattagagaacacctaaggctaccatggcataaaatgattcatcacttcttagtcaccaactaatttttatccactaaatacatatgaatgtagatataaaattagagattaaatcagtccgttaaatggaacctattaatttaattttttgagttatcttccatttttttgtttaaaagtttttaattttctgatttcattatgagggtgaggtggggtctgttgtttccccactcattgtgcccttcctggaatggcactaatagatgatcagctataaaacttgtatgtgtgttttaattctgaccatgaagcactgtttgtggccaaagattgagccaatgctaccgcccatacggccattccgattagccaacaagtgaactggcgccggagcatgcgaaattggagcgggaacccacacaggcaaaccgtgtgatcgcgatcaacaggttcatgtaacaaccagcaaaccacacagtatcccgccaaatgtgcatactgtatttccatgccgtcaacgggaccagcaacaatgacacaaaa

SEQ ID NO: 14326 - DNA, 2848 bp, Heterodera glycines
  misc_feature (2829)..(2829): n is a, c, g, or t
aaaaggcctacaactagagccaggattcgggattcggtactgagtcgggtttttcgctctaaccaaaaaaaatcaatgaaaaagcttcaaaatttcccaaaaagtctttcctatttcagggcgttttccttcaaaataattgtaaggcggggtgcggaaaattcattttttttaaattattaacaaaaatttttccttgagtattttcgagttagtgcgaaaattgcgagtcaatatcaaatcccgattttccgggctctagcaataacatttgcaaatttcaacaaaagtgaaatacgaaataaacaaataataaaaactgagtattatttattatcattttaaatttgctattcatcagcgggattaaacacattaataaatgcgactataataataataatgaatgatagtgctgattcgatggtgatgacccagcacaaaacagataaagcacaactgaatcaattaaggaattttgcgtaattatgtaattaagagacagacatatgtaaaagtgataatattaataataattaagaataatgaggcggggaagggagggataaaaatgaatcgaactcattaacaatccatcaatctattaattaattagtctctctaattagtcctattattatcattgtcgcaattcgcgatgatgctcgcacataatgcggttcatccgtgaggcgaccgccgctgcaactgccgcgccacggccactgccgtcctcgctgagcaccaggacgaactgagggggaattggtgggggaaattaggggaaatattacggcaattgctgcaagcagcggaggttgaactccgctggtccaatttttcggtgctttgaatcctccaggatttggtaaaaaaaaattgaataattcaaacattgtcggcagcgcccacctttgcgcccaagaaatttttttttaatctttgtgttttaattctaagaaaaaaaatttcgaaaatttttttttttcttaaaatttcttattaaaaaacttactaaatttctttttaaaatttcagttagtaaatttaaaaaaaaatctggggagggggcaaaagtagagcacccgttcaaaacagtcgaatttttaccaaaaatgcttaaattttgcttcaaaagtattctcctacttaaatcaacaaaaaagggaggggctcttaaatattttaaattttaggacaaatgtggtttattggcatttaatagtcgaaaaatttaattcgccaaacgccggccaccaaatacggtatgctaccgtctctcaaaaatacagtaatctaccgtatcccctcacacgctcacttcatacttgccctccaccagctcgtcaattttgtggtccaacaggaatttgaaggtgggatggaaacggtagacggacccgtcgacgcccaccgttacggtgggccgtcccatgcgcttcagcagcgccgcaatgccacaggcgcagaagtgggcggcacgcgcgctgaccagcgaacacacgtaggccacgttggcacagtcggcgggcgtcgagttccaaatgcctgaaaaatttaaaaaatttaatttaagaaattcaagattttcaaaaaaaatttttttttaaatttttttttgtcaagttacccgaatgggagtggggtcaaaaaataaaccatggtaaacattggtagatgatcagaaatttttttttaaaaaacttatacgaaaaattaaaacaaatcgttttgtaaaatttccagcaatttttgggaataaattttccaaaactttttcttcttgaaattacactgtttgaaaatttaaaaaattcgggggaggggggggggcaaatttactaaatttttaaagaaaaaaaccagaaagtttttttataagaaaattctaagaaaaattttttttcatgaaattttcagattttttggaaaatttttgaaaaatcttaataattcaccaaagaaagtttcgaaattttttttatgattttcttataaaaaaactttgattttttccttaaaaaatttcgaagttagtaatttttttttaatttctcggggggggggggggaaacgatgcggggggaaacaacctgctcccattttctattagtctgcaaaaaattcccgtaatttcaaaaaatttaccaaaaaaaactgagttttttccccgaaaattttacggcacaacttttttgggatatttttttttcaattttatagactaattattaaacggccccattgaatgttatcaatttcaatggattaaaacaataaaatgtgcaccaatgtcctgcagcagctcctcaattttgtggaacgggttctcctcgtcgtcattttgcatttgcctgcagcaattagttaattattattattttttaaataattttatttaaaaaatacgtacaaaaatccaattacccctcaatgtcggacaccaatttggtcgggaagcagccgggctccgcaatttgtgaatggtcaccgctgaacaacaggccgcgcctcgtcaggtcctcgagcacaaggcggacaacttcaccctgggaaaaatggggtttttttgggctacgggccaaatttaatgctttttatggggaaaatcttaaaatgcattcattcgatgcagaaacattttctcaacaggtatgtaaaaatttgaagaaaatcttcgctccccccccccccctccgtatcgttcactctaccggattttttttaaatttttttttttttttgaaaaatttcagttttaaatttttcttttaaattttcgggtgtggggagacaacatagtgcaaccatttgttggttggttcccgnttttttgtgtgagaggagt

SEQ ID NO: 14327 - DNA, 721 bp, Heterodera glycines
gggggggggggggctgaaattttttaggttttcaaaatctctttgaaaattgcttacaaaaaattgagcaaaaataaagttttcattaaaaaaaaatttttatgggggggggggggaatttttaaaaatgaatttaattgaaataatttaaaaaataattcgtttaccggtgccaacaatgaccccaatgtagcagtacttttcgatgaatgagcaggccaacattgtgccggtggtgtcgttcagcaccgccaccacgtcaatgtccacgtcgccacggcgctggcacgcctcgagcaacagttgcacaacatcctcaccaaccacgccggaggccttggggggttgaaatttttaaatattttcaccaaatttccatactgcttgtggtggatgggttgcattactttcccgcaacccccggaaaaattttgctaaaaattttcaaacatttttttatcatcaaataaaaatttatgaaaaaacttgttaatttcatcataaaattttgaaaaaagcgctttaaaaatgtttaagtttgaaataaaaatatatataaaagttgtgttgtaccggttgtcaatgaatggtagcttttttgaattcaaaatttgggataaattgattgatcctctacaaatcggtatttttttgaaaattacactaaaaaaatacaaaagatatttttagtcaccaccaaacaagtttttgtaacttttaa

SEQ ID NO: 14328 - DNA, 3101 bp, Heterodera glycines
gggtgcatttttcgtttttattgcatttttgttaataatcaattttcaaattgcatcaaattttcaaaattttccacgcggaccccccccccattttctctgtccacgtcccacccctgtgaggtgtagatattcttcaattttaccaatcctagctctgtttatgaacagtctgtatctttgttaggttcattttttagttctacaatattgtcttaatgtggtggtttcacgaaattccaacaccaccgcccccgcaatttcttccaacccaacaaggccgactgaaaatgcgctaccaagggcacgattactacaaaaaatttgaaggagccaatgggcaggtgtactggaactgcgtccgttttccgcagaggttgggcgcgtgcaaaggcaaggcacaggtggtgaacggaattgtacggcaacgaatccgcacaaccatccgcctaacaatcatccgcctgccgaggaatgtaagtcggaagaatgagtaatagtaaactttggatataatttggccaatttttaggacccaaaatgtgacaacacacaagaaacggtggaccgtacgcaaccaaagaactgagcacggaatttccctaaaaatggcattgatcagtcatccccccaattgttatttgtgatcggataattgaaagcgcaaaataaactttaattcacccatccacttcgttgttagacataccaaagttgacccatccctttacatgaacagacatccttcgtaaaatttgtcgtcgaccccccccccctatttaaagtatgtactcggatgtgttcgcatacgaaggattgagttgacccttacctggttggtctacccctttccccaggttttttgaaaaagttcgccacacaaaaatgcggtggggatcgagttgaacaatttttggttaaaaataaatttgaattttcaacttcttgttcgaatttgggtccggggttcgaaatggatgcggatttgtgatcagcgattcccgaaaacccttggaagcatgcttcgtgaaatggaccgggacgggagtcccggcaaaatccggccgggatcccggttcgtccgggctctaataattattaccaagttttgcgctctagatacgaatgagccgaaaattttcagaatacctctaagaacgaaaaaaaatctcaaaaattttagtgcctcttcgaagatttttgtgtctatttaaattttaaaaccaattttgcgattttttgcctaagaaagggaattgaaagtgggacttggcgcccagatggcggcgctcgagtcgcgccggtccacgcttaaatgatgtgaaaagattcacatttactaacgtgaggatagaatttttgtgtacttgaatctcactaatttcccccgataagtacttggaaagtgacttgctatataatcgagagaaagccccgccttagaccgattttttttaattttaaacgttcttagaagctacaaatcgttctaaaaatactattaatttgatttttagaccgaaataagcgtgaatgaaccgaataacctaaacgggaaataccgtaattattaactttttacactggtagagccctttttgtcaatttgaccataatgaatgatctgctgaagatttgagtttactggagcataaaatagtatagattctgtgtgtaaaactgatcaatcaatacaaaagcaaaaaatgcgatcttttgatcactgggaatgattcaaatgttgcataacttcggggaacgtctgttggatgaacaaaattcccgcttgacaccgctgatggggctttgcaatttcgatggtagtggccagagtaatctgatttataatatttttgatggtaaaataaattatctttccggaaaaaaatatacataaaccgggccggacagtcacaaatgtagcaatttaaacaaaataataactaaaaaacaacttgccatggccttctcctctacagattcttgagactgttttcctttgatggcattctgcaaaaggaaaaatgagcaataaataaatttggtatcgaatggcactacgttcccatctcaaggtgagagtgggcacaaagtgaaaaattttgctaaaaatcgcaaaaattggtctttttggacaaaatctgctaaaaaccgcactcaaattcaaaaatttccctgtcggtgcctatcggtaccgcaaaacctccccactggagtacatttttcactgttttttcaagaaaaaatcttatattcccgcctttttcacctgcaaaattccgttgaaataattggcaaatgcatttgcgctgttcatctcgccaaggtcctcggcagggatcagattgatgaaatagctgaggaactgcttgatctggaagattctgtaggcggtcttggcctgcattcccggcacttggaagcagagtttgtagatggggtcgttgttgtacgcaacagtcaattggcccatcactgaaaaaatattttggggcttaaaattttcaaaaaattcaatctccatataaattatttttaattgtttgtcggggcaaatgacgtctgaaagtgtcccctaactcccaatagcaacaaaaagcccaaccttgcgtgaagtagccgatctctcccgaccgaaccgtctgctgttgttgcaccaaaaatgacaaattttttgcgacctgtgccgcctgctgttgtttctgaagctgcaacagttgcagttgtcgcagttgcaatgcgttggagaagtgcgccatgtcagtggccgtgccgaaaggcggctgctgagacgtgccaggaactgcggcagtgccatccatggtcaaaggggatggcattggcagcggcaaaagttgacggggcagtctttcgctctcgtactccttccacgcctcctctcgttcctcaaacaaaaaaacatttaatattatgaaaaaatataaggcaaagccttttcaaatttcattttcccgatttgtcactccattgtaacagtttgaataaacaaatacctctgaagtaagctgttcctcctcaataatcgtcaacagaaggtcatgcgtgtggtaactcgtctacgaagaattccaatacaaaaa

SEQ ID NO: 14329 - DNA, 584 bp, Heterodera glycines
aatgccaagagatccagcacgagttgagatcagcagcagacgttttctgaaaaagtattcacttaaataaattgaaaatttaaatgaactcaccgcaaattcaaagggtcgttaaattcccgttgaattctaaaacaacagaaaataattaaacggagagtgggtcgaacgaattctgtcgttttacctatctctgtctttggatgaaacagacccttcgatgacgtcatagtcatgtcctaaaatggtgaaatgtcatttttatgcaatttgagatattgtcgtctttgggcttggtgtctttgtgaaaagaagtgactgactcattttccacgaccaccgttcgccctgtcgcatcagtgcgtcgtgtccgtccacaaaccatttgccattgtcagcgtaaaaggcgagcattcggcgaatgagtgcaattgagttgagaaattgggagaacacgagcctagaataaaaaaagaagcttattttacattttaaaagtttaattttatatgggtttttgtgctcacagtttgtctccgatggcctcgcattttttgataatttccatcaacaaaatcagtttg

SEQ ID NO: 14330 - DNA, 1684 bp, Heterodera glycines
gaaaatgcgttttactgcaacgaagcagcaagagttacaaaaaattaaatcaaaataaaataaatatggtaatttttaatccattaaaatgaaaatgaattatctcactggaaatcaaatgaattattacatctttgtatgacttaagtaatttaaaaaaaattatgttcattagaaatattttaattaatatgtttattttaatcaattttatctttaaataaaaaataatactagaaaattccagtaatgtgttaataattttaatagcattcttcttatattccatcttttagccgttaatttgaatttgtataagaaaaaatgatgcaataaataaaaaatgaagcaatatctaaatatatttaaaaattccaacttttgaaaattttgaatctaattgatttattaatttatttcgtattggaaactcaaatttaaaaaataatatattctaataaacataaaaattaatttgaagtcaaaattaaatactttttaaaaagtctgattgtttattattaagtaatttgaaatatgaggccaaaataaacaaaataaaactaggagcaagttccttgatcaataaaataggtctacttttaaaaaataaaatcaatttttgacgattttccccgcaaattttgttttttgtttttgaactttgcttcaattacatattattaatccaacttttatgaaattaaaaaaaaaatatttcgttaataatgtatttcttaataatttattggattttttatgttattattttattagcggttcccactcaattcactaacgaataatttataacaaaatctcagtttaaattaaatacaatttttacaaaagtttgattgtttgtattaaatcaaaatagaaaaatattataagttgtgatgtgaaaattcttaaatcagacaaggaataataaaataaaaaataaaaatcattttttcatttttttaattgtattaaattgcttttctttattggacttttaactttttatttctatgttctgctgaagttttttattttaaaacaaaatacatctatcatcgatctactttatagttaaattatatcttattcaaattaaattttaaagaattgtatgcaatttatgaaataaaattatgttaattatataaaaagttgaaattttaaataattttattcatttattttacttaatattaaaaagtacaaattaaaccatatttgaatctaatttaattaaattattttttatgtcccaaaaatatctccaattttgcagcatttcatatactgtgaaaatttgtttgaaaatattaatacagcaataatattattatatcaaataaaatgtaagttttgtaaattagatattttataaagaaaagataaataaatcaatattttaaattttaatttttttaatatgttttagtttaccagaaattattattttccttatataatttttttttatttaatgtataaattttagagccccattttttcctaactgaaaaaaaactaaataaataattaaaattatacttatatgaaaaacagaggaaaaagctaccaaagattttaaatctctctgtattaacaaattaagaacaaaaaaaaagccaataatagcaataacaaaaaaaaaggatttgtaaataaaaactaattaaaaaccgac

SEQ ID NO: 14331 - DNA, 1819 bp, Heterodera glycines
tctatctgtttgtcgatgtccttgacgaacgcggccattaaagcagctctgtcgtagacgttccaagacgcccaaactggaccgcatacgagtggtctccggacagagttgagaaatcagtcgattccatcgaaagtgtgaggagtcgactacctaaaatattttgatttttttcattgctgcttggttaaaacatacgtattgtatttgaagacctgctcaagaaggaaatgtgttggggctcaaaagacacaaaaccgagcctttgttcagcttgcgtgagaccaatgaacgttttggctacgtacgacagccaagcctgcatacccagtggcgccatttctgttgttaaagcaaacgctctgcgcacgtgcatgggtggcagaagtgtcaatgtcaaaactttcctaaaaagaaaaaccaaccaaaattcgtgtgaaatttttaaaaggtacctgaaagtccggtggacattcttcctttcctcttccgcttcctcatcattcccattgaataggttgaaaatccctaacgatttcgcctttctaaacagacactgcgcccagtggaaattgcatccgctctgcaaagcctccggaaagacttcacgcgcggctctcatcatgctcctttcgaagtcgctgattactagataagggggggggggtgaggagtacaaaagaattaagcgtaaatttttgcgggagcagatgcgacggcgttcctgatggcactgagcgcttctcgatagaatcgactgtttttccctgggagtagcgcttgtgcacagaccaccatccgtttgtcaacgtacgctccaacgatgaagacttgcgtccattgtgtgggagctgaacgaaaagtcccgtccaaactccaacggcgattacgtctcaatacgtcgagaagctacaaacaaacaaaaataaataaagaaaattttaaacaaaaaacttttgaatggctgaacaccataacaacatcctcctcgtttactcgcgccgtccgactgtcgtatatcagtattgattcaccgtccttattcaataactctggcgcgaatcgaatttcgagcggatttgctcggtttacatttcagactagcttgtttttgactctaaagttacaaattattgaaattttccattggttgtatcaatgaccgaactttgaaccatcctgtctaacgcatcatttgtgcccaactggtcaaacgtctcatctgccgttcctgctctgacttgtgctcgcatttgagatggcctcaattgcggattcacctcgatggcttgcttgatctgtgcccttcccgcgtctgctgattgttgggtaaatacaacgcaatgattgtgttcctttgagcccaaacgaccagtcaaatgttgctcatcatcaaggcggacggtagcttgacatgtcttctgacaacagctgaaccaaatgcacttcttttgacaaatttgtaccctaaaattgggagtaaataagcgaatgctctaaattactgactgacctctctgccaaagatacagtgcccctttttgcgttgtccctcgttcaaatttcactggctcagtgttctcttcgtcgctgaatgcgctcgcatctgaatcggctgtggcagcggctcgcatttctgcctcccgcgcgtccgctatctcatcagctacaatgctatcgtcggttaatgccatgcgtggtttcttcaaattcatgttcctttcaagctgttcacgacgactcattttaacaaaaaaaaatggctcgttgctaaattcatgacataaatgttcggtgaatgatttttataaaacaaaac

SEQ ID NO: 14332 - DNA, 827 bp, Heterodera glycines
  misc_feature (694)..(694): n is a, c, g, or t
cgggattttgtcgggccgggattttgtcgggcgggattttgtcggggcgggattttgtcggcacacgtattttttttatttaataaggaatcaaaataaactagaaatttaataaaatttatattaaaatcatttaaaaaaataaagaaaatccgttaaataaaaaagtataatgagaaaaagtaataaccgaagctctacctaaaagtaaaagagagttaaaaaaggtaaaccaaaaggattaattttttctaaacataaaggagttgaaaaaaacctaaatccatattagttaccaaagctaaatcaaaaaaaaatcaaaaaaactaaaaaaaaaatataatttcactaaaaagaaaaagtaaaaaaccaaacttaaaactatcaatagaaaaaaaaagaatgaaaaccaactaaagcctcaataaaaaccagaaaaaatcatttaaaaaaataaaaaataattataaaaaaaaattaaatttaaaaaaaattaataaactagaaaagaaaaataataataataaactaaaaaaagggtataaatgaattagataaattaaatcaaaagctataaaaaaccagtaaaaaaactccgaaatatcaattcagtataattatattttaaaaataacaaaataatatgtgtttaactaaaaaatgaaagaaattaaggaaagatatctctctaaanctgattacaatagtaaattattcaaattaaatataaaataaatgtgctgttaaaggatattaaagttaataattaaaaaatgttgaactatgttgggggttcaaatttagtttaaaataattattttctgttt

SEQ ID NO: 14333 - DNA, 1545 bp, Heterodera glycines
  misc_feature (63)..(63): n is a, c, g, or t
  misc_feature (1478)..(1478): n is a, c, g, or t
  misc_feature (1526)..(1526): n is a, c, g, or t
ggtaatttctgaaaaattttggctaatttctatcaaaattcataaaaattcttaaaattttcnccgtcggcgtttatcggcaccgccggcccccaaaaaacctattattttcttaaaaaattacccaaaaatccctaaattttggttatttttagacaaaatctgtgtaaatttatgtcaaaataaatagaatctaggcgatcaacgaatatgcatttgccggatttatggacaatctttatcgagaatacaagaagaatggaaaaattggtgagtttattgcaaattcaaaaattattattatgtttaatatttattcttttaaaatatatcctaataaattgaaaacttaattttttaaattattttaattgtcagcatatagcaattaaatcttttataatcaaggcctggatttatatttattaaaaaatgctagttatatgtaaatatatatgtgcccaaaagtccaaacatttggcgaatttctggacgatctttttcgagaatacaagaagaatggaaaaatggatgagtttattacaaatccaaaaatatttattatgtttaatatttattgcctggatttatatttgttaaaaaatgctaaatatgggtaaatatcggactcgctcagttgggccggcacggttgggtcgcagcaatgcttttccttttccactatagcttttttctttgtaatccaaatccaacattgttggtatcattcgaaagctcttcacatgctctattagccttacaaaaagcgaaaagattttcaagcctggaaaacattttattaagaaaaaactttttcgcaattttcatgtataacttttttggaaattgtctaatcgcgaagcaatagcttagaaaaagcttttaaatatattaaggtttcgactcacagatttttcaatactatcctatatttcccaatttttcaaaaacatgaaatcgaaatttttctttgttctaatttttcccgcttttcctcggcttttccatttttgaagggatttcgtcatacaaatggactcatccaattcggccaaaaatgtaaaaaacgtttgcaaaatttatggacaatctttttcgagaatacaagaagaatggaaaaatggatgagtttattacaaatccaaaaatatttattatgtttaatatttattgcctggatttatatttgttaaaaaatgctaaatatgggtaaatatcggactcgctcagttgggccggcacggttgggtcgcagcaatgcttttccttttccactatagcttttttctttgtaatccaaatccaacattgttggtatcattcgaaagctcttcacatgctctattagccttacaaaaagcgaaaagattttcaagcctggaaaacattttattaagaaaaaactttttcgcaattttcatgtataacttttttggaaattgtctaatcgcgaagcaatagcttagaaaagcttttanatatattaaggtttcgactcacagatttttcaatactatcctatattntcccatttttcaaaaacat

SEQ ID NO: 14334 - DNA, 1123 bp, Heterodera glycines
cgatgccgaagaatccgtgaaaagtgaaggattgagtccctgtgatttgaatgcataaaaactgagtcccggtgattgaaatgttggtgtgttgagtcccaatgatcggaatgcataaaaactgagtccgggtgattggaatgatggagaattgagtcccagtgattggaatgctggtaagttgagttccaatgactggaatgctggtggattgagtcccagtgattggaatgcataaaaactgagtcccagtgattgaaaggcaggagatttgagtaccagtgattgaaatctggtgggttgagtcccgacgattggagaaaaagcaaaaaaaggatgcgaggccgcgaagcggccgagccagtcgattttatcaaacataatcttacaatacaatcgtattacctagcgggggatgcgccgaaggcgctgaccccgctagtttataaaataaatagcaaaataaaaaattagttttgtattattttcacttggaatttttttgaattttctctctctctctctcttgatctcttgccctctctctcttgctctctctctctcttttgatctcttgccctctctcttgctctctctctctcttgctctctctctctccgtttctccttctcatcctttctctctgacattctctctaactctcttttttccattctctttttctctgttttcccgtcttcctttctttcttcttttgccattttgccagcgcattatttcccatcaacatatgtgggtagaattgtttgtgtgttgggctgttttgcttgcatttattccctttttataaatgaaggatcaatcatatgtacatattcgccgttttattgcctttttatgtgtaatcagcacgactatccattaattgtttgaaaaaaaatcattaagaaaacccgggtattttatattaaaatctattaaaaatttaaatttatgaaggaagggctgccaactgaaagtttacaaaagcctcaattgggctcaaaaaaaaaaccagtaaaaaatcattcaaaatattttttggtaatactggggtttgttcccccccttttttggcaaaaatgtcaaatttttaaaagtcacgtaaaacattttttctggg

SEQ ID NO: 14335 - DNA, 1211 bp, Heterodera glycines
tctagagtcaaatttgcttaacactttgttaaacggcaaaatgcagccctattctgcgcctgtcaacaatgactgctccaacgaccccgacgcgtacttgcgaccgtcggccgactttaagccgtggtacccgagcttcaggaacactgtgtaaacaaaaaaatatttattttttagtctttttgaactttcctattgaatttcttctctttttccgaattattaccgggactttgatgactttgagcaaaaagacaattcgattaagcgactctttcgaatttcacccaaaaattctcattaaaaatggttttagcatcactaatgaacgtcgtccggggcgttacacgaagagagaaaagcggcaaatccgtgccagccttttgccggtgctgccgaatccggacgacgggtgagtggcggggcgatggctgggcaatggactcgttttcgatttttgggtcactttttacccatcagtagtggaacctttattttggcatttcctgaaataaaacaaattctggggtataactgcacaagagcctctggtgtcctgctccccaagccccaaaatgcctcaatccgggaactcgtcataatttttaaaacgcatttcattaaagcaaagactacgttttgggcggaaagtatgccaaaacgccggcgcaagtggacgccgaatttgcggagcagctgaagttagagaaggccatgcgggaagaggagaagtgccggatgggaggaatcgtcgacacttccgccgccgcttcgtcgagcgccgaagaaagttcctccgaagggaacggaggcggcggcgccggaaggggtcgcggcgctgcgccgggcgtgcgcctttcgtacggcggaatgcgtggcattgcccgagggcacagcggtttttcgagacaatggaaggcaccgacggagcggacggattgaagtcgagaagaaacaacgaacaattgatgaagaatgtcacttatgcaatttgttgccttgcttatgatccttttttgccattcatttgaattttatttgccgggggacggattcacacttataaaatgtcatagtattcagcttgatgaagtttaactcttttttacacattaaattcaatttaaaatctgcatcgattgatttagaaggttttttgtaaaaaataaggcaaagctcaataaaaagtaaaatgctgactaaaatacaaa

SEQ ID NO: 14336 - DNA, 1566 bp, Heterodera glycines
tcgcaaatttggttatttttttttactcagtctattaacatatcacaattaaatttccaaaattttgtacccctccttttctccaaaagtttttgaaaaattacaccacaaaaaagtggtgtgaaaggcaaaaaaaaaatttggtcatcgatttaggcaagtaaaaatgagactggagtcccttcgcactttttgggttacccccccccccctccctctttttaagcaccaccgaaccaaaaagacaagacattgattaatttgatctatcaaactgaatatgttaaaatgattttgcatgaattggttggtgttttttttaaatttttcacatgcctaagaccctaatgaatattcaaagaactaacatctctgctgggctaaagccaaccccacatttggcagcctttgttttgcgtaatttacccgctaaactttcacgggcactccgattaaaacgatccaaccgccgcaactttttaaacggtttttcttttatttgtacaattcaatttgtgaaccaaagatgaaattattgtacaaaatatcctctttttctttcactctcttctcactgtttattgctgtgccctttttaaacattgttttgcccgcgttgaaataaatgcgttttattgggtcaaacggacaaaaaaagaaggggcgactgatctgaacggacaaagtgtaatcgtaaagttgggcacaatttacgccaaaatttaattggaaacaaaaaaaatggaaaaataaatattcattttgttccaatttgaaatattttacatttttgtgacgttctgagaccatctcgggagcagtttcttcaaatagaaaaatgagcaaatgcgggggagggaggccatcaaaattgatcgacggacggacggacagtcaccggattttctcatgcacatccgtccgcccacatattaaacgcatgtccaaagatcatgatcggatcgccctctcttgggcaaaaacaaaaaaattccccgattggtcgaggtgaaaaccaatgtacaatttcctattttagccaattccatttttgtatatcaattagaaccgaaacaacaaacattgtaataattaatgattaattagttaatgagtgagtgagtgaagtccgtgtcaaacaggaaaatgtgatcagaacaacagaaaaaagcgaggagaaagcgggggaggagggagaaggattgaatggaggaaaaagaaatggacgaaatgaattattatggcgaaattgaggggaaaaaatgcggggaaaagggaggaggggagggaatgtctgctgaaatatgatgggtttttgagtggagcaaccaacagctgaagcagcaacaagcgaagaattgtgcggggggggggggggggagacgggagaccgggctggcccatcgccaagttggactcgggcacaaacgactgcctttgcttatttgttagctaattgtggttagggtgcggtggaatggagtgaaacaaacgcaatgttgttcatgaaaattctattgccttcattaacgggaaaatgccaggggggacatgccaacaatgcca

SEQ ID NO: 14337 - DNA, 2634 bp, Heterodera glycines
  misc_feature (8)..(9): n is a, c, g, or t
  misc_feature (21)..(21): n is a, c, g, or t
  misc_feature (39)..(40): n is a, c, g, or t
tgcaggtnnctgctgggcaanagtgagtggatgagtgtnngtgtgtcgagccttcaccatgtggcggccaaacattttttttaaaaatgctggccaattttcaatttttcattattttttttaatttgatccttaattagtgggtttgttaaatatatgtacctacacttgaatgctgctggatgcctttaaacccataatcagaacttttctatgacagccatacaataaaacacatttccctggggcttttcagggtttctgatcacggacatgacatcctctttcattcaattctgaatcccccggatacgaacaaatagtcgaagtctttttcccaaaattcacatttatattcatttctgtatagaatgaccattggtgtcaagcgattgaacaattcgccaaaaaactacagcttggaaaccacgaaaaactcagattttttaaatttttagtgagtggggcggcaactaatggattatctatcccctcttctttcttaaaaaaacactaataatccatgaaatttacactcgtttaaaattactccaaccaatgtgtttcaaaaaaaaacaggaactcccactccgcggccaccttctcgaggggtcggcgcccggtttcaatcgccgctggctgaagaaccgccggatgccacagtggcggcaaccactgatcacacgactactgtaccttcattaccagctactgtatcggagtccactgcagcattacaggtccattcattttacatttttaaactgaattttaatacaaaattttgaaattaatttccttttactcattttcaaccagttaaaagttttgtaatttcataatcatttttaacaaattttgattatttattttttataatttcatctaaaagagatttataattagcacaaattcgaatttaaaatatttcaaaaaatccatccaattttcaacaaaaggttcccgtgttggcctcgtcggtggtccgtcggcaacgcactcaaatggaagtgccgcgcgtggtggagcagcgcggggcgcccttcttcaccttctcgctgcggccacggctcatccagaagaacaatccgtgcaaactgttgtgcacagtgacgggaaatccgccgccaaaggcactgaaaatagggccagccacaaggaatggcataaataattattatgccgagagaaatttggccaacattttatttttatacgaatccaaaatttgagctaatgagattatttggacgagactcattctcggcacaatgaaattggcggattaatgaatgaatgaatggcctcactcgtaaactgatctgctcataaatctcagattgaatggttgaaagatgggcaaccggtggacgaagagcgcgtgcaaacattgtacaaaagtggcgtcgcctcattggaaatattcaacacgcggccacaagtccgtaaatgctttttcaatttggtcaacatggacaatcaaaatattcttctatcctgatttttataatagtattcaaattaatgctttaatcgtttatggctgatctttgttggcaaaaaccttaacaaaaaaaattttattagaaatttcaagaaataaaatttttgaaaactttttctagcgttttttttaaatttttataatgaataatcatttttttctttaaattttattttaaaaaaatttctaaaaaatatttgcttgtaatttctttttgaaaattttattatttttcggagtggcggggcggcatttaaatgacaaatcccaaaaattatacatttcaaaaacaatttgaacaggacgccggcgtatacacgtgtgtggccagcaacgagttgggccaagacgaaacgtccgcaccggtggcggtggagacgcgacagtccagcaccggctacctgcagcagtcgcatcagtccgctgcgcatgccatcctggccaggtcggcacgccgttcctgcacccgagcagcggcagcgacgacggcacgacgggcacaaacaccgggcgctgtgcccgagcgagacgtcggcatgccgaggcggagcagcgaaaagtgcgtaaacataattaaacaaattttttttccgccaagaaaattttttctaaagcctaaatagaggccatagatttaacccataaattaacaatctctgatttaaaaatcagtcagttttctttgataggctataattaatggacacaaaatttattaattatttccaaaataactgtcaaaaaaaccagaaaacttttgcctcttagcctttcaaaattttgatttcaaaaatttaattttcgctttgtttcatcattttatgtgtatgtgtttgtttggtggtgttgcaggtacgcctcgttgttcccggcttcgtccacatcagacattgccagtgcgctttcaagtgccgaccaaggacggcaaagctctgtcgacgaagattccagggaatggcgatcggcaagcgtcgccagtgacagcagcacatccaaatagtcgcctggttgttgatcagtctgatcagtgtcaagaaaaacgaaattcaagaagcaaaaaatgatcgcttttcagttaaaccatatatcaaaaaggtcattttaggaacaattcgcatttaatcacattt

SEQ ID NO: 14338 - DNA, 1079 bp, Heterodera glycines
tttttgcatttttaaatcaaacttttttgaaatgttaagtttttattaaaataaaaattcataagtgaaagtggtgaaaatagaaacacaataaacaaaaatgcgtgtgataataaacaagatggggacaaactttgggtgaaaaggcaaacaatcaacaaaatgagttgtccgtaaataaataagaaaacatcatggcacatcttgcggaacgcgcaaactttcatcagattcggcaacgaactgaaaagaattggggagaaatgaaataaaaaaaacaaaattagaattttctcttctttctcgcctgattgatcctcacacaactcggcgtcccagtggccagcagcagctgtgtgccacggcttctgcaatcggtggccaacttgtgcagaagggcaaagtttggctgcgcagaagcaccggcaatggagaaaggcctaaaaacatttggctaattgtttttgtttgcttattgtttcaattataaatttaaaatgttcccctactcaataatgagcacactgtagattggcttcgtactggcccgttcatcagggaagagttcataggcaaaacacgaatcattgaaactgaaaaaacaaaaatgaatttttttaatagattatttattttattgttaatccaaaataaccataacccaattttgcaaatttctggtgccaaatatagaaaaatattaataaaagtccatctgtttgccaataaaattagccattattatgtagtaaaaattgcaaattcatttggcttcatcactctctctctctcacctacgcgtcgttgtcgtcggttgtcgattgttttggcggcgtcgcttttgcagcagcgcttcacgtcgcagtgcgtacacgcgccagctgtccaagtagtgcaatgaacgcagcgatggccaccaccggggacgacagatgttccacggctcgttgtgctgtcggcggacatcgcgcagcaaaaattgttcattctacaaaatgagaagacgaaagtttgcatatatgtataatacatttttataggtccgtaaccagagaaaaatttcggggggggggaatccg

SEQ ID NO: 14339 - DNA, 1952 bp, Heterodera glycines
ctaatgcctatttttgtgattattttgttatttgttctttctgagtagaattttgaaaaaattccttaaaaaaaacgcacaaataatgaaaatatacccatagaacaaccccgaaaaaatttcaggaaatacaccttagaattgaaaattttctcaaaaatttattccctaacaatgagtttttttcttgtcaaaaaattaaaaattgtctatattcgaaaaaaggttcggaatattaaagtatttcgcttacaaatcaaatatgtttaaccaaaatttctccaaagtttcctaaaaaacattctttatataaatttaattaattcctgatatcatccgatagatctaagtgttctctattagactgcaaaatttaaaaaaattccgttacttttattaagttatggccagaggaactcataaaaaccagcttttcgaacatttttagtcataactttttgttaaagtatgtgggaaatggttttaattttggcaagataataaagaacatatagagctactgattgctatttaaaattaaaaatttggtaatttttagcaaagtttaagcaaaaatctttttattttatttgatgctttttacaggaggagggggcgggggcggcgctgaatttagttcaattttgggatgagttgaagtgttacgggtgaaatgatggcattggagagcaactacttccttttataggaccaccctttgccccgcggggaagcggcgccaattttcggtggttttgtgcgtttgaaggacaccggatttgggggaggggagagcaggagtggatattcggcgaattgtgcgcgaataaacggcggggagtgtgcacacccccaggggtgaggggggggggcgggtgggtgctgctccgattgggcattttgtgccctgtccgctgatcggagtacgtcatcaccggctggtgatcgctggctgatcagctgccgcggaacgtgtgatcagtacaaatgaaaggcgaacacatttaaatcagggattttttttgctcgtcgcatgaaaggggtggaaataatcaaaagtgatcaaacggtcacgggattaatcctccggtcttgcgccatgcattattaccaatgatggttcatcctaattttgaaaacgatgatgatgaatttatgttccctgtttttgcgatttgttggcgcagaggtaatttgcattcatttgcgcgacagttgatcagtcactattcggcgaatacaccaaccaaaacagcaaccccgaacaatcgctgcctctgaggtaactttttaattttataaattcaatttttagtcttttgttccatccgtctaccgcctcaaagtgattgatcggtttgtgatgatgtctttgatcagattcaatatcttcatcagtcccagttccgttcttttccgccccttctcctgccgcttttccaagtagcagttcggcacactgacgcgcaacgactcgcgagtgatctgaacatgaacagtgcagtgccattttataaggggagagcctaggccgttgattctaaagatcacaattgtttttaatttttcggtatatcctagggataaattctctgtcatgacaaaatgccgtctttcaccccagctaagggccatagatagataagggacagaatcattggtgcctggacacatttagaggaagcaaaaaaatgtatatttgtaattggtaatgatgctcaagatgacgaattttcccgagactcgagaccgacatcgcgactcgatcccgaaccaagactctcaagcataaattactaattgtcgcttgataaaccaataaaagacaggaagttaagtgtgggatttaaaacaaattttaataatttgcttctttttttaataaaaaaaacaaatttatttaagtaaaaaaattgttttgaataatcctactgggtgaaaaatcatttttt

SEQ ID NO: 14340 - DNA, 3321 bp, Heterodera glycines
tttgatgtcgtcaaacaccgtataacagccagttccgctagcacctgccatactgtagccaaaggatggcttcgtcgcggcgctatggccgatgtgctcgcgaaacaaatattcatacaaaacatccaaacatttatggaaatcgcgacgctcatttgcattttgaactttgtcattggcattggcactttgccattgcttcctcatgcggtgcaaaaggccaaggtgtgtgccataaatttgtgccaacatttccttgctttgtgcattagtgatttctttgtccgcacaaaatttttcaaatgcggcaggccctttcacaaaggcaaggaatgcattctcatcaacctggtaatagaggttaattagttttgttggtgtggataattagcttttaattattgccgtctctgcccgatcattaagttagaacaaatttgacacaacttttgcaaagaatttaaatataattaaacaaaaaaatttaaaaaaaaaatatcaattttccttgtcctaactaatttgaaaattgggcgatttttaaatttttggactaattctgaactcgaatgagaaaatctttttagtttaattatgttaattctaaagaaagtttcgactaattatttttctttttacaattttttcactttataaaattcgagtcactaaaaatttgccttctataaatacaatatgcttcttttaattatttattaatttaaatatataattaccgctgatgcaaaagcaaatgaactgggcaaaattgacgaacaaataaaaattagagcaaaaatattggaaataaaaacatttctttccatttctaggggaataaataataaatgaatatatattttttctatatcttacccatttaatagaactatttcttatgtaataaagcataaaaatattttatgtaatgatttgctaaaatcaataaaagaaattaaaaggaattttcttttttcattttacatcgcttcttctttataattgacgtgtattttataattattccaataaatcaattcatacataaatcataatttaaatgaaaaaataatttctttttttttgtcttttttcaatcaattaattttcgtaattctaacagataattattactttttaaaaatttgcaaaaaaaagcacatgggttttttttttgctataattaggaattttttaaaattttgcattcagccaaaaaatgaaccgagaatgtcaatgaccataacatcaatcgcccaagacaactttatatgaatagtatatttaaatctttgcaaattcccaagtcgcaacggtgtatgacgtcactcaaaaactaatgaataattttctgtcaaaaatttttattttgatgattctttgagcaacgatccggcacatcatttaaaaaaggaaaaaaaataattaaaaaaaaataattaaattttaaaaaactcaactgcgcaagttttccttgcttctgcctaggctctccttttcgttttgctttgtggtgtaaataatttagatggtagaatatgaaggtctgagtggagacaaaaagaatttatttttaattaatttttgtgggaaataattcaattgaaattttcggttttttttttcttgggaaaatactcggttggtcccatttgaaaacccagcagctctctgtactggatgtcttagtcccggttttgcccaaaattatcggtcccgttctatactaaattaaccaaaaagctttattatttttcgcttgccaaattttatacaattttatttatttacaaaaaaattaatttattcttcatttatgaattttcttttctctcgttattggaaagtcaataaatgcatttgatggacagcacaaatcacttacatatttagtcattccaagataataataaatgtgatgattcagaaatggatagcaaaatgtgtggggaaatcattcaatgaattaatttaatttcgttatttcgcattcacaattttgaaataacggataattactataaaatttgcttcttcaaatttagtcacaaatttcaaaataataccaaatttatttctaaaatgaaatcaatgtcagcatactgtatcatattgttcagtgctcttgtgttggcggtatatatttaatttaacacacaaaataactaattgttattttcctccagaaacgacgaaagccgaagagccgaagatgggtttgtgggatttgttgtacataaacacaatttaaattcaagttaggcacaaaatcctgtgtttcctggacaaaattttagaattaattatttcaagtaacaaatattccatttaaaattatcaaaaaatgatttaatagatttaaaaaatatatattttgctaattaatttagattttcctaagcaattaattgattttttcaaagatttatttgttttttaaaacaaaattcaaaaaatccatgtccaggcctgtatccaaggttatttataagtagggatacgatttttaggcaaaagcctattttttcctgagatccccgtggcctgaaacgcacgaaaaacatgattttttgggctgttgttaagctacttttcgacttattaatgcctattttctaggcttttatttttaaagcctaaaaagcaaaaaaaattttgaaagttttttctgactattttggcgtttttccaaaatttgttaaccaaaatgcaataaaaatgaaaaagcacccctaagaatcgacctaaattttttgaatcgacctgaaaatttttaaaaatacacccttaagaaatgaaaattttctcaaaattcatcccaaaataatttatttattttcttgacaagaattttgattttaaaaattatttagctcaataccgttttccctatatttttttttactttttaaaataaattttgtcattttataagcctaaatttgagacttttagggcctattttccattttttagagcttatttttggggtttttagagcctaaaaatatcatccttagtaataataaagtgaatttattaagaataagaaaatcagaaaaaaaagagaaaagaaaattgagaatgggaaaaagacaaaatcgccgataaaaattggcctttttcacttttttttgaattttttataaggagtattaattaatgttaaaaataattctaatttttaaaatgattcatgagtgattattagagtgctcaattttcagcacgaaaaatcaccgattaagcactgtaaactgcaccaaatttacccaaaataagcaggaaaaaagcacaaaaaggcaaaatcagcacaaaaaa

SEQ ID NO: 14341 - DNA, 1088 bp, Heterodera glycines
ttctgaaaaaattcctgctagtttgtaagctaactccttttggtgatcaaaaaagtttttacagcaacaagcacattaaaaatgctacaaaacggttaagatagttgggctataaaagagctaactaaaattttattaaaaattattattggaatcggaaaatattataaacatatgaccatgactgtactttaattacgggcagtggatgaaaaataataattatttgaattaaaattaattcttttttctctcccaaaaattaatattattggcagagaaatccgatcgaaatttccaaaaaaggaatcattggtcaaaaaagattttccattcactgctcatccgccgccctcttctcagcttcgtttctcaacttgcgcatttccgtcatcgattgtcccttccctttttcctttcgttggattttctccggacaaatttaaattcataataaatccaatcaatcggaggatttttgtccattatcacactttgtttgtttgtgttggattctccattaacagaagccctttctcattaatcgccaattcattaaatgtttttttgtcggagattttatcaacttaaaagggaaagaaggaaaagtgagagactaacgaccaaacgaaaaccatcgattcgatcgtaagaaagaaggaacgcatttctctctgttcttttgccgtcccttctccgatttttccctcctccccatttattcatttctcctcccaatttcttcctcaaaatgccctcctccgttggcccctcttcctcttccgatttgctcatccgtcttttcctcctcctcgactcggccgttcactttgccctcggcgctttcctcttcttctgtccgtccacctgtgcccatttccttttggttacccccttaaattccctcaaatcatttcttacaaattacaaactaaaaaaaaataaatcaaatattataccgatttatatatctatagtataacatagagaagattcattgaaattattttctaatattattatttagaattaatcaataaataatttcattacaaactacaggattaatgtctaaaactcaaaccaaa

SEQ ID NO: 14342 - DNA, 1738 bp, Heterodera glycines
ggtcggtttaaatcccttaatttctccatttattgcgcaataatggattaaattgactcctctcccttgccaggtgataagctttttgctgcgaaccgttggggcaatgtgctgtaccaaattgatacaatcgcttccattagcatcggaatggcgtgggtaatggccccgcaatggctgttgcacagacaagtcccccgattgccctttcaagtgctaatctcgtgccattgaaaaggtgcgcgtgcccatggaccaatcgcacgaattctgtggccatttgatgggcgttgtgttcatcgcctcccatgtaatcagttcacatgcggtcggttcaaaaagccaacgattcccttggagaatgaatgagctgttggctctttctctcttttgtacagctccattggccaactcagtcggaccgggcgatggccgctgagacgcgggcggtgctttgtgtgttcatcctttccgcccaaatttggtctcaaatagcctatggccaacattggtccgacaaagtgggccttttgccattgccctttttgtttgtcattcatcgcattatttagcattgggtgggcattagcctgttctcctcctggacactcatctcaatcatttaccgcacttacctatgggcgtcgggattggaccagccgaaatcggagaaagatgtcagctgtgccaacgacggaagtgggacgaaggcgaatgggacatatcagcagaagaaaatggcctagagaacggtttttgctgattgagacgagcttttgtttccaaatgatcataattttgaatttatctgtcaattggcgtaacgacagtctgcccgcgtcccactcaaatttcggaccaatgatattcgatccgcaaataaattgatcacacaaactcgcttgatccttccgttccttcccttcaaccgctctcgaccgctttttttgttttcctgaatcgattggttacgctttcccatggcatattgatcagcaaaagcatgggtctgaccagcggattcgccactttctctttcccttcgtcttttcttgcttctttttagctttcatctgacaaatgttttggcccaaatccattcactaagccgccagcattttatgatttcatctcggcatatttgataaatcattcgttttaatttttgataaattcctaaaatgtctgaagagcaatggagcggcgagtcgagcaacagcaacgaatcggagggagtgcaccacagagaggacccccattttgaacaggtcgaggaccaaatccgcgacattcaggcgagccgaccttcccctgtcccaatctctgctcgctcttaagacccaagctgaccgtttgctcttcggttcagtatttttgcggcggcccaaaggattggctgaaaatgccgtcggtaaaactttgagagtaatgagttaaaaaatgccgaattctttggacatttgttttacagtccccgaaacgccatcggaagtggcggatttggaggggacaacgcgccaaatcgcagagacaatcgaacgcatcgacgatttggaggagaagctgaaggaattgttggagcacaaagacaacgtgatgggagatgaagtggacagaaagtgggcaaccaatgcaatttaggcaatttacgaagaccaaattgacgaataccttcgtgaattggaggactcgcgaacgttaatgacggcactaaagcgggtgggaatggggggggggg

SEQ ID NO: 14343 - DNA, 2607 bp, Heterodera glycines
ggtgctatgacgttagtaaaaaaccatcagaatgggcgttagtcaaaaaaccatcaaatgaaaatattttttgatataacattgttcaagagcatctaaatttttaattcttgatatcattaaatagcactaagtgttttctattagcctacaaaattccaaaaagtttcgttaagtttcaagaaagttatgactaaaaatgttcaaaaaaacttggttttttgagcttctcaggtcataactttttttaaacgtaaagaatttttttaaaattttgcaggataatagaaagcacttaggctatcgaaaaatgtcaatattataaaatttgatccattttagacgaaattatgaataattttctgtcaaaaattattcatttgatggtttttgactaacgtcccagcatcaaaaaatcccctctactctaagaccaacaattagtttaatcgtgttcattaaatggaaggattcgcaattagtcatcaatttgagttatggcatttcccccaatttggccctctgatggtggcactcacaacatttattaaaacaaattaaaattattcattaaaatgggccaatttatgctttttctcgattagtgtgcttatgtaggaggtgggcctcctgttgtggggcaaaaaatgtgacacaaaaaaattcccatttttttctaaataaaaaagacattcaaagaatttgactcacagcaaattatggtgaatagtaattagccatattatgctgatatatgaattataatgcaaaaaaacaaaacaaaataatatttatgttttttataaaagtcacgttttgacatatgaaattccagggaggacgacaaataaataaatgctaacgaagtggcaatcaaaaaatgaaatgagtaatcggaaaataaaaacggagcacagaaaaacggaaattgacaaggattaaacataggcgggggaagcctcattaaaaaagtataaaatttaattttaaaaaggcacaaggattaactttaaaataaaaaaaatggaattgtattaattagacccctcggatcattgattgatcctttccaattttaagcgatttatgatttgattcttaaaagtttgaacattttctttgaaaactttaattgtttcttttatcatcgcaatgattggctcaaaataattgggttattttattatatttaaaaattttggttttaattggtccgtccgttcgaaatgtctgtttttaaaaacaaaataatatagaaaaaaaacagagaaaatctcgatacaaaaatgatgaaaaatgagatggattaaaatgggcaaccccaataaaaaaagtgtataaaattatttgtgtgaattcaaataaaaaacggaaaattttaattgccacaaacaattaaatttattgtatgattatcaatttttttttgttgttttagattggttcggctgaacaatcctccctaattatatggaatttaattggttctcattatttttccaattagtaggttaaaggttgtgcgatcattcgctttattcggttttttcatttttagtcatgtcactctgatcatgatcaaacagaaaatcgttctctgatgacattgaaaaattaattgaatagaaatacacatcattaaatgtataatttaaaaataatgatcggtttattttattcgattcagcttttcactgatcactccctattaaaggggcgttttctcaacaacgcatttaagatcagttcaaagttgatcagatccattctcatttgatcagtatacgtcattttttggcttctgatcaccctaattttagctcgaataacaattgtgaggtccgtccgcttaaattaagcagtttgatcactctgctgatcagcaaatgtctgcccttcccaatttctaagttggttcccgatcacttcatcaccgccgctacactatttttgtagcccattctgatcaaaaagcactctctcttttttttcctcgccaatcgttttccattatcaatttgttattattatggtttgtatattgttacatatttgttcaaattcactcatacccattgtcaatttcgtcgttatgttttgtcgtttttgtctaaaaaggctcctccaaacattgagtcgatcacccatttttactacaaatattcccccccccccccgccgacgccccactccgatcacttttattgtttcgccgttgctcgccgacatcgccgcgccgcgcacattttcgcgcgcgctcggcggtgcccatttttgtatgtttttgtatttaatcggccaaaatgaatcataaaatggggccgagggaattaataatgataatttaaccaaactatttatttgaaaattattgcaaaaatttaaagacaataataataataatggaattaatttaaatgatgattacccttattaaaattaagcaaaatataaaaggcattgaaaatgaatggccttttcaggtgtcttagactgaacaaaaaattttaataaaaaataattaattttaatgcgttaaaaatggagacgaagaacaaattttttttaaatataatcattcctaaaatattaaaaaaagactctaga

SEQ ID NO: 14344 - DNA, 1010 bp, Heterodera glycines
  misc_feature (14)..(14): n is a, c, g, or t
  misc_feature (17)..(17): n is a, c, g, or t
  misc_feature (1001)..(1001): n is a, c, g, or t
gtaattaaaaaatngantgataaaatgaaatttattattttaaataatgttgctgttttatggctggctggcctttttgtaagaaatcaaatggttttttgggaatttatttaagcaaggccacccgccggggggggggggggctatgcggggggggtaaaagcccgcgggtgtaggatgccagcaggagccggcatattggagccgcggaagccaaaatgccaatacaatgatcgataaacgtgtgtgtatatatacttagatataaaatgtactccaaaccggcttcttccgcgcttcaaagatttctcggaagattggcaaaaggttgaagaatgaagaatatacatagaagaaagaatggactatgtaaaaagaggaggtgggggggggggagatgctgcgttttgttgtgttgttgctgagattgtgctgctgctggctgatgatgcgcctcgccgccgccggcgacgggtttgctcatccattctcattaccactaatggctggtccgccaacaacgcttcaaaattggttgcttgcgcgcaacccgctcgccgcaaccaaccagtcccatccgcgcagcgcgcgtccgtcgcccagcagcagcagcagcccatcgaatcgacgaccatttctgatcgatcggacgaatatttggcgcagagaacacacacaaaaacgacaacgccaaaaatggagaaaagaaaatgattttggttgatggaaaaagggggacgaagagaaattgtgtaatagagaggtgaaaaagaaagaaagaaatgcctaattatataaattgagatatggcagttctgctgttagaacactgacgcggtaagccaaagttgccgggttcaaggccgtcccgcctcatcgttttcccacaaacgcttccccagttcataattatacaaatttctgctggggattaaaaaagattttatattctttatccaccggggagaaaattgtttggtgaatttcaaaagaaattaaantttaatttt

SEQ ID NO: 14345 - DNA, 1427 bp, Heterodera glycines
agaagtgaaaaatatttttccacaattcctgatcactttttggcaacgtttgaccaatgagatgatttatttgcatttgcatgttaaatatttacaaaatggagtccacccacacctttgaaaaatgtgatctgtgatagccatgtcgcgcaaatcacataactgtgaatgagaacaatttcagggaaaaacggcaacttctccaagaaaaatcttttttttggtccgatcacttttttactaacaagtgatcagcatgattcagcccaacttcattatggtatgactgaattacgaaattgcattaaaaagcaacatttcgaaaagatctcgccattttttcacacaaattgatcataaaaaggaaattaaaaaattgcgtgatgcataccaatgatgatgactttgcgagggtggaaaatcgtgaaataaatttctccaaaagaggaaggcttgatgggactgggttggcatttcaaaagtttatcaaactaaaagatagacaaatattgcaacgcaaaaatttgcaaaataatggcatagaccataaaatagcaaaatggcatttaaaaatgatatttttataaccaccccagggttcggtttatcaaggatcacttttcgctatttgaattcgtcattttcggtaaaggattgctgtaatcggacatgaaaattctggcaaactcggaaaagtgatgccgacaaaattctgctcaagaatcttgacggtcgcacgcacctgtttattagcactaattagttaccaaattagttttgtcactaatgaatgaacatatcatcgctcctaattgcccgttcgtttctgttcgccgtcccatcccccgggggtctgtttcgtccgtccgtttttcaaatggtacaaagtcgtcctcgtcctgctcaaaaatgttggcgttaataggtcgcgccgtgatcagttggttgtgctgacagcagagaaaccacgcacagcaaaatcaagtttaaagggtttgtggtcttctcgacaattaattcatgcaatcgcaatcattttttgaaggattttaatggctggtaattaattagttattataatttttgtaatttaaagggaatatgcaaaacggaatgtcgactaaattaaatgatgataggaggagaacgaaatgttaaatgtttttttttggatttggttttgatttttggcaaatattttcgccttttggagtttttcaataaatattttgctgtttttttggcaaaatattatagcaaataactaagtgatccaaatatgtacataaatatgtaagaaaaattccaaaatatgtacaaaaaaccccaaatatgtaaataaaatttttttttatggtattttttgggaaagaaattccccgtaaagtatgaaatagccacaaaatgacataaaaattacttttttt

SEQ ID NO: 14346 - DNA, 975 bp, Heterodera glycines
  misc_feature (663)..(663): n is a, c, g, or t
tggtcagtgtttttaaattaccatactctctgtttacccaccatcgtccgcctgtttcattttccaatgcaatatttttcttctttcggatgcttcggtggcatcgccgcaactttctccgccgtccgttccctctcctacacccatttcgtccctccctgctatttgtcgtcactttttgctgatgcaaaaaaacccaacgaaggcggacatgtaaattgttgcggacatttccaaaacatttcaatcgccgcctcaacgaacgaaaattgttcacctccgaatataaatttttatgaatgaacaacaaaatacccaaactttttaaaataaattttgtcatttgtttatttatggtacactgacccaaaaaagtctgaacaaccatacatgttttttctctgcgttcacaaacgctaattaaataaagcgtttcgggcaaatgtctctccatttacaattagtggttcattatgtcagcttcacattagcaacaaaaaaaaacccccgaaacaatatgaaatgaatgtggtatggtcaaccaagtgagaaatggtcaaaattcagacccaaaaagtcttgccccccccccccatttttcgaaaaaaatttttgttttcaaaagtgaaaatatatttttaatggttttcgggtttactgatncacgaatctgacatccatttcaatctattccaaaccccggatccgaattcgaacaaaaaatagaaattcaaaattttcgattttccatttttagtcaaaattagtttaaattgatcttttttgaagcagtgatgactttgccacttttttgactttaactttgtttccgtgaatttaaataaagttgtaatcaacaatttgaattcaaaaattttgaattttctactttttgttccaattcggacacggggttcggaatagttcgaaatggatgtcagattcgtgatcagcgaccctgaaaatcattgcaaa

SEQ ID NO: 14347 - DNA, 3065 bp, Heterodera glycines
ttagccaaagtgtgcagattttcgacatagattttgacaaaagttcttttcgagtgtcgactgatttgtctctcattgcacttcgttctgacctcacagaaattgttcttaatctcggagaccgtaataatttatattatcaacataaataaaataaacaaaacccccgctgtttttgtattctcaagaatcaaaaacctcttcccacccctgctgaagaaaagccataatctaaatctgtgtgtatagttaaacaaattttcagactgcattcttccaaatcagcccaattttaaaggagaaggacgcgtttcaattaatgacattgatgctaattatttgcgaagacaaacggtaaaaacaatgagcaaactttcataggtacctaatctaaacatttttcattttaggcattgaaagaaaccacggcacaaactattcctgctttgatggatgcgtggaatgatttgcttcgggctcgtcagggctgtttgattgtttatgtgccaaaagaatgtctttcccaaatccgtgaccaaattgtggtatcgctgcacattgatattattgtttgttcccccaaacaagtgagcttcgtattttatcgttttttaaagataatttagggaatcaaatttgtgtttacaagaaatcaagaaaatgacgatggacttccttccggcgctcatctgttcacttatcgctcaaacccacaaagttcgacgaaggaatggttgccatgttctgaagaacccctccaattgtgtgtttggcgttttgagataactgtgccaaagcaattgacggccgtgtgttgtggcgatttaattgttagaattttgctatagaattttgggtacttatgcagtttattacagattaccaaagattgttaataaacaaaatatttctgacaacttaaactgcataagtgcaccgcatcttgagctaattcagttcctttcttcacttaaacttatattttatgatacaattccaaactccgacgatgattcattgaagacgctttgttatcagctgctcgtgccaacttctgctgctaatatcggtttcgcaatcggtgattttcaaattcacgtgcagccagaaatgcccgaggcatttatttgtttccgtaacatttaaattcctaagcatttttcagattattaactttgtcgttccggagctcattccgctcttaaaacacacaatgaaatcgctgaatagaatttttgtctttttcgaagaacttttgtcatgccgatttccgtatagtacctattggcaaatttttgtggatcaggtccttgatggagtgtccactaaaataataataattttaattcaagactcccgatgaggtcacctctttcgccggacttacaattttttccattcgtctcctttatcataagaaaattttggacatggttcaaggcactcgaaaattgctcgccactgcaattgctcagcagttttttggctgttttatcgcccaaagaagcttcaacgaactttggctcctcagaggactctctgggtttttttctattcaataatttcgtgttttttttttttttgcagttttttgacaggtgtttttgttgaacgattttttggtgccactgaaagcaattaccaactgaacaaattgctgaaggattcgtgtgattacgaagctcgttttggtgctattgctcttcgtcccaatgccaatcacagccaatttttcttcgaccccaattgtcccgaaacgtgttctccattttatttggatgcgctcttccgcaaaggccatttggtcattcgaatgttggagaaaaggttacccaaggagcagttcgttaaggtcatttgtgtttctttccggttaaaaattcatttgaaggttttgcaacgaattctttccctgggggtacagtacagtcagaatttgtatcggcctgtcgaatggacgcacatgctaattaacacggcgatgtttttgcgggttatgactgatgttactgggaaggaattgccttcctttgtcgaacaatggatcgattttggtggatttgttaattttcaggtctgggatttaattgttgcttatgtaattgacataatgctttaaggtttcccacattttcaaccgcaaaagaaatatcattgaattggagttgcgtcagacagttccgcttcaaaaaggatgtcagaagtatgttttatttatttatttttgcacttttccatttattgctcttttaattttttcagttacaccggccctctcacaatcgttgttcaagagcttgaagtatcatacgttaattcttttctttcaaatagttcattttcagggtcattttgctcacactatccaaatagacgccgccgtttctcgccacgacatccaatgccattcaaaggggcgtaaactaaagaagaaacggataatgctcgggaccggagaagaggtcgacgtcgacctaaactcgatggacttcgattcgccagtgctttggattaggtttaatttaaaaaattcgatttaaatgctttcttacaattagagtcgatcccaatttattactttatcgtcaaatgtcaatcaaccaaccgttttatcaatgggaacttatgcttctccatgaaagggatgttctagctcaacaacaagccattgaaacactttgccgtttttccgaacacaaaacaaagatacttttggaagagacagtccgaaacgacaaattcttctaccggttggtggactttcatggcgggtgcaccccaaaatttcgccgccgaaatttcgccgggaaaaattacgccgccgaaatttcgccggacggaatttcgccaaaaatttttttgaaaaaatttggaaattttcaataaaaaattagaattttttatatggaaattccaatgaaaaatttttgaaaaatttttttagtgattttttggaaaatttttcgaaaaaacttactaatttatcataaatttcaaaaaaaatccttaaaattttttctaatttttttttgaaattttcttataagatattctatgattttttc

SEQ ID NO: 14348 - DNA, 2350 bp, Heterodera glycines
ttcaccaaaattcacgtttattgcattaaattattaattaaaatatatttattatctattctttctctctctctctctaggcaaatttactttttaactatttaaaaaacattaaggtaaccaatattcctgaggttacaaattttccgtacccccctccccgacttttttattttgccaattttgcccctattttgggacttttcgcccctaaacaccaccgggccctaattattcatatcattaatgctctttcgtttcgttccattcttttttttctatttttattttctctttttttgcaaaaacaaaggcccgattttgatggatttgcataatttttttgctttttgctctttgaagaaaaaagagatcgaaaatagcggcaacatgtgaagccaacttttgcatattaatgttttggcgtcgttgggatttggccaaattaaaattaattaatttattgtttctaaattttctatttttgctcatttggcccaattaattaattaaaaactgataaaaaaaaaagtaaccaaaactgctgaaatgtgcttaatgaaagtaagcaaacatttaacaaaaatactttgatgttccaaactttctgactagaataaatttggttgaactgataagattttttaaaatatttttgatgattttatgtaaataaaatggtcaaagattgatgcccaattgaatttgcttcgtgcggaaaaactgtgttaataaaagtgattagtgaaggtcacaaatcggaaacgcatgtgatcatttgcaaattatttgggtaattaaatggcatttgacttttatcggcccacaaattacggtaattgtgctaaaaggccaaagattccattcaaatgattgattgattatctgtgctgattaagcgaattttctccgtaaaaaagccctttaaaaggcatgccaaaaatggaaattcattcaaaataatttaattttctctgttttccgaattacaaaatgccttcttttctgccaatgcttttcctcctcctctccgtccaattgctctcctttttgccctgctccttctccgcttcgctttctgttgctcccgcttacaccaccaaagacacgtgcctttccgagtcgagtgccagcgattcgatcagtgcgcagctgaacaaaccgatcaccgggggccaattcactttttacggaatcggcggacaaggcgcgtgcgggttggacattgccacggtatggacgatgatcggacaaaattgtgaattgactgatcaaaaatagacaccgaaaagtgatcagagacaggcatttggggcaacaaatttgacaattattaccgtaattagcaaactttcgtgccttttagcttaattaatgcaattacatagaaacaattggtgcttataatttatttcttcaaaagtacatcaattttaacattgaaaggtcacaaatttgaattttccgcccaattttagcccacaaaatctgccgctggctccggcacacttttcaactccgacgccgcgtgggttgagtcgtgtttgccggacgcgcgttacttgctcaacgatttggtgtgcattaaccgatgcgtcaaaatcgaatacaaagggaacacgtaaacattgaaatttggggtttaattaattgttcaattgactcaatttggcttaattagtttgactgttccgatcaacaacaaatgttccgagtgcgcgaaagaccacgtggatttgtcggaggaggcgttcaattggttggagccgggcggcggatcggtgggagtggcgaaaagtgaaaaagcaaaaacaaaattggcattaattttcatcttaatcattttagatgctacaataacctatgtgaagtgttaaccatggggatatgattgatctatgaatgctcttaagtgatattcttctattttatttcacatttttttgttaaaataattattaaatttattcaacaattcttttgtttttaataatatgccattgacagaagaagacgcaatggcaaatgtctaaaaagaggagtccgtaatttcacaccgatccttttaaactgctaataacccatataaatgggtttaatatggcataatttccttgcaattttcataaaaacatcgtgaattaagccgaagcccccaaaaaaaccatatttgcgggtccatttcctagagttgaaattcgaaattcttgtccaatcaaatcccgcccccccccccaccttaaaaatgcaggattgtggatttggatcccgtaacatccggcatggatttgccagttccgcctatgaacgtctaacattgataattaattgttattaaattttttcattt

SEQ ID NO: 14349 - DNA, 2118 bp, Heterodera glycines
tttcgatttaatttttttttattcgataatttcctaaaacaaatgttaagcatcattcgtgctaatccaagcaattctaattctaatggtcaaaaaacgttcagcccatcgtcggaacgaaaacatggccgccttgaacgcagctgttggtggtaaggaagtggcgtcagccacaccgattattgagtttttggaagtggcgtcagccacagagcaaattgaattgattgagacggagactattccgcaaaatttggagtcatttgaagtagcgtcagctatacagaaaggagtgataatggaaacggcgttagccgtcgagaaagtaattgaaaccgataagactcgtggtatttccgcaggtcttgaagaagaatttgaacgaggcatggaattgggagaaggtcagctgtggaaagaaacacagaaaatattgaaatcgaaactattcaagacttcactgcgactcaattctccaatgtctcgtggtcagagccacgtgccatcgcttcgcctgtgccaatgtcttcaaatgaagaacattgcgcggaaggcggtgttttgaagtatttggtgtgtcaaaccgacgtgaaaagtgtcgtgggtaggaaaaagagtggacaaggtccattttttatgggaattcctgatattttggtaagtgccgagagacgccttcaaatgggagacacagttgtggtcagtaagtttgagtggaagtagggatttgaaagattgtcctatgacttaaacccggttgattcgttgcgctcgtggttcgtacaaggcaggatcaacgttcaagcggttgccataaaggtggaggtgataaaataggtcattggttcatttcaacctggttttgtaaccgacttaaaacgatacagaggtggggatttcagatcagccaccgtcatatctgcgcaaatgcttcgcccccaaaccatctatgcccggcaattaaccgaaatcagtccaggttgaattatgcttaaccaactcctttaccttaatttggccaaaatcacaagtccacaagcattggttccacttaattcttcgtgccattaatcttaattttaataatttttatttaatttaaaaaatatatttaccaaaatgcgttcacttcgcgcatttttataatttgttattatgaaattttttcatttcttattgcaatgcatatggaaattaagttaaaattaatgcgcttcataattcttcaagaaaagtaaatgtgtttaattttacaataatttatatttaaaaaaatattatattaaatttgtgaaagtattttttaggttttaaaatatttgcttgagttgaattggtttgaaaccctctacaatttattttattcaatttgaatttgtttgccattttgtttaaaattcataacacttatatttttggttttctatcgcattttatttcatttttcaatgatttgtttttgatatcaattttatttttaactagtttaatgtcagattttcagaaaatatcaatcatttaaatttggtagtttaattattttaagagatttttatgttaactaactcacttctttttttatttagataaaatttccattaaaattaatagagccaggaattttgaaaatgccgggcccgggctcgggcttcggcaattggccgggcccgggccgcccggtcaaaaaaagcccgttttaccgggcgttccgggcccggtccaaaattttggccgggcgcccgccgggcccgggcttttttcaaaatttttggaattttgattaataaagttaaaaatattttagcttagaattatattaatccatctaaattaacttttttgcttttttaaaaaactttttaatggcgcatttttttcaaaaaacattgaggtacaagaggggtctggcggtgccgacaggcgccgccggggaaaatttttgaaaatttgtgtgtgatttgttaacagatttacaccaaaaaatgaccaaattttgaaattttgagctaattttttgaaaacaaaataatcattttccagaatccgacgctgaggaaaaattttgacttataatgaaatttattaagaaaagtgttgattttttcataaaatttggaa

SEQ ID NO: 14350 - DNA, 1663 bp, Heterodera glycines
tttcctttgttgcgtatatggtgttggttctccccccccccccccatcctgctatttgccttttcgttttaattttgcgcagcaatcatttattgatttgatattttttggaaattttacccgttttaaatgcttacaaatattttatttaaaatgccgaaacaattaaaattttatttagaatatgttaaacaaaattaaaatagctccctataaaaatatttgttccgaacaaattcgcaatggagagaacgaagaagtcgaaaattttatgaacacaatttcggaccttgttgttggtgagaacatcacaattgattcggtaagaagcaggtcaactgcctgtttttatgaagggtcaattcgatttttttggcaaatttaaaaaaaagacgaattcttcaattttgaaaattttatagaaaataaagattttgggatggaaaaaatacaatttgttaatagatttttactaaaaataatttttttgtgatttttaattcaagcggtgattttaattacacggagaatgagccgatatttaatgaacaaatagggccacaagatgacaacttgtctgaattatccgtatgtgcggcggacaaaagaagccacgggagggcttctcggttagaactgctcggttctgacgtttaaatttattcttgagttaaagggcacgctcaaacagtagtgtcagtgtggcgtcaagcaaaagtcagcgaaaaagtgccaaccgagctgatcggaagaaatccggagggcgggtgaattaaatttaaaaaagcataattaaatgaaaatgttaaaggttttcgcaaatcggaaggccctaccgaacgaattggcacaaataattgaagcagaaagggacgcatttgaaatttcaaacgtttttgcggtttatacccatcagaacggggaaaaatggaaaaatgctattttgtacgatggttaggtacataaatgcggggtatttgttggttaccgaattaaggggaagtctctctctctttctctctctttcacctttctttctcatgaatcccgacccattggattatctgagttatcatatcttttttagatatgcagagctttggtaattcagtttttggggaaggattctcatcccgacccattggactatctgagttatcatatcttttggtatgcagagctttgacaatccagtttttggtgaaggatctctctctctatttctctcgctcgctctctctctctctctatcattctctctctcagtttatcataatgatttaatttttacaaattgaaattcaggatatgacgagtcgaaggatagttgggtgttatcccaggatacatatgcattggaatccgtggccaatttttcaattagtgtctcagcggagctcaccttgacagcattgctcggggggccagtacccgaaagttttaaaaagatactaatggcgaacgataaatttgcgcagggtaataccttttcggatacttttctaaaattttgtatgtgatttgctaacagattttgtacaaaaaagccaacctctttacacccccccccccccaaaaaaaaaatatgaaattttttatgcttttttaaatcttttttcgttttaaattaacgataccatgataaatgtaaaatttttatctc

SEQ ID NO: 14351 - DNA, 1458 bp, Heterodera glycines
catatatgttgtcagttgtttaatattactggtcacacactatacatctttgtaccttctacatgccaatttaaagtgattttggtagcaaaaattattaaaaatattcggttgcatttcgaacacacaattggttcagaattttctggtttacaaggaaaattgctccataaaattttcttttaacttaacaacattcatttcataccccatctaccacaacgctgacattttattacacaattaacagtatgttttattttttctcgaaacgtctgctcacaatatatacaataataatgtttaatgttgaagaattgttttacacttttcagacctagattataaaattaatttttcaagtgattaaatttaccatcccacagtgtccattttcaagaaaaacgcatataatgaattttttgatccatcccccttgtatattggttttaatgcccattcctgaattttaatttttttgtaaaaatcacttttcatttcaacctttgaaaaagcggctggtaagaatttccccggaaattctctgtcgaaatattttcggatttggttaatgtcgtcaattccataattctttttggttggatctattttggcgtttttaattaaatcatcagcaaaatttttttgtctttttccgttgctataaattttcctaaattgagattatgaaatttcagtccctattatttggtacaatttgctcaacattatactgtaaaaaaagacagtaattatcagaatttttgactaacaatctcccgctttcttttaatccaaacaaatgatttattgattgcgctaaaattaaaaatgatttatactcaattttttttaataccagatccttttggggctgcataagtagttatgatcaaagatatttcctcattcaataaatcaatttcatcaaaactttgctgaatatgatagaaggattccagcactacatctgcgttattttgtaccaaatccctaggcggaattattagctgatcactcagagcttcgcagtatagatcatacgaaattttttctattacccaacccttttcattttttcccattgctttatctgttaaatattcaataatttttttgaaattttcttttgaattttcttcggaatttttaaatataaatcttataacattttcttttatgccaaatttcttgttttctttttgcgtgtttgctatttccgtataaatcatttggaatattttttttattactgaaataattttttttatttctcaattgtcgtttttcttttggggtcttcaaaaaggattttccctccatttttaaagtaaaaataaattatctaaatgaaaacaaaaaataatttctttaaataaattaagatatttaaagattttccaattaaatactcactaaactcagaatataaaatgaaatattacaaacgtcagtgcc

SEQ ID NO: 14352 - DNA, 910 bp, Heterodera glycines
attttataaattttatttcacatttttataacttttttcttttatgttataaaaataaaagtgatttttggtttcgggaccaaagggggtggacaggatttttgtgttgaaaatttttttcaccaaaaatcttccaaaaatatgtcattagggctattttatgacgctgatcacgaatacgtgatcagattttacttttaacatcgataagacctcagaatccctgtgtgattggggattctgagcatcattttgaggggggagggggcaggttcggatccggacggtgtaaattattttcgttatatttatggttatttttaatgtttttaattcatttaaaagagtgtttgttttataataaaaaataaattttttaatttaaattaaattatttttttatgaaaaattttattaaaattaattatttttttaattaaataatttcatatatttttttttatttgagtttttcagaaattaatttaatttcaatctaaataaatttaaattattataagcttcaaagttttttttaataataaaaagaggcatttattttacaatttttaaaaattattaatgcattttttttgtcctcttctaatcactgttgttcctcttttaatcactgctgtacctcttttaatcactgctgtacctcttttaatcactgctgtacctcttttaatcactgttgtacttcttctaatcacttttattcctcttctaatcatcttccaatcatttttgtcctcttctaatcacttttgtacctcttttaatcaccgttgtacctcttttaatcactgttgaacctcttctaatcactcttctaatcgctgttgtacctcttctaatcactgttgtacctcttctaatcactcttctaatcgctgttgtacctctt

SEQ ID NO: 14353 - DNA, 2236 bp, Heterodera glycines
  misc_feature (1379)..(1379): n is a, c, g, or t
tccacacatcttccaacaatttttgtacctcgtctgagctcaacaacatttaaatacgggcgcgaagcgcccgtttggcctcaacaaaatttaaaaacgggcgcgaagcgcccgttcgaggccgcgaagcggcctaaaagtcccagataattttttaaaaattccaaatctccacaaccagagctaatattccatccccctattcactcgcaaggggacggatcccatccccctaatcactcgcaaggggacggatcccataccctaatccaaatctccacaaccagagctaatctaggtagcgaagctcccaaagcgcgaagcgctttatccctgtgccagatccgacggttcacgcacccgctagttacattttttatatcaacaatcgttttgttattttcattttgcttacactttataaatttttttttgaattgtttttcattgaaagcattttactaacatgctttttgactaaaaatcgattgacaataaagctatatttactagtgcttttcgagaccgaaaatttcccgatatttgacccgagactcgataccgagacccaaaaaaatcgactttttccagaaatttttcttacacttaaaaatcaatttgaggttttttctcacaattttttgctttttaccttatttaagctaccatccattttagtaaacaaaaaaagtccaaaaatgacatatttttacgattttaattgttaaaattatgattgaattcccatcgaaaaaaacattatattgaaaaattaaaagaaaaataactacttgcaggtgaactgatccaacgcaaaaatcaggaacgggtcacaaaaagttaataaaatattataaatttaagtttagcaaaagtcaaccattaggggtgtattttacaccttgaaaactcgattgttaggggtgcatttttcacgaaacttcgggtaaattacccgaagttcgaagcccaacaaatacgaagttttcgaagctcgaagtttcgcccacccctggttccaatcaacaaatttgggacaaaggcacggatttgagtctgcaggttattgctttgtcacacaacactaatgtccagccaatttgggatgttttgatccgacaaatttggcccgtttttgcgcaaaacattcgcaaattgcaatttagtttatacttagggcttagacttggcctcattagccagcataggaggctttcaaagtgtgatgattcctttcaattggcaaatctcttcgaataaaattaacaccaaattaattaagcaaaaattcaatgtgactgccgttgatttctcataaaacaataatgtgcaaaatttgaaattcgttaaaacaatgccaaactgccgagctgctcacncaaggcaattatggacattgttcaaatccttacaatttttgtaatccaaattaatggcccaataatttggcttcgcttcatttttcgtgcgttcattggttccccaattcaaatggcacaattaacacgtgtgtttttaattgaattttatagttggcggaagtggtggcacggagaaatatcaaacaatgaaaccgaaaatccaatgctaatcaatccaaatattttgcaaaacttttcggtttaccgctcggtcccatagcttgacgaatttggtgagaggtgaagctgatgaaaaaaagatttttcgcttttttcttaaatttaatactttatgtatcttcaacaatttaacccaatttatgtcagtcttaaaatttaaaaaaacacttggtaattagttaattgctcgcttatctccgcttgacagtatcatcaaataaaaatattgtatgccggaattttcttaaatatcaatttccgggtttccacgtaattttaaagttcggcttcagtcagcttttggccccatttgcaattttataattaagatacgaaacaaatattctgttgaaattaacgaaatttaacaagttttgtagtcaatcacataccgtatgccaagctagaattttttgctacggaaaacccaaattggagatgtgatgtaaattttgcgaattatcttcgttttttggattttggaaaatgaaaagttttaatggtaattttataaaaatttgcaattttacaaaaatattccataatgaaaatattcacaaccgtttaattaatattttttgcatatttttttaaattcactaaatacaccaaatgccctcagtcgaaatagtcat

SEQ ID NO: 14354 - DNA, 2135 bp, Heterodera glycines
gaactggcataggtgtgggaacagatttcattctcattcttcgaatggaagaccttgaaatgagcaaaatttagactgatcaaatttcggctctattaaaaatcaacaatcataattttgaacaagccgtgaaaaatgttctcgggcgcactaatcacgaaaatttgtattaattttgtttccatgactagacattgtcttaatttttttctgtcgaactaaagggtccccaatttggtttttaataaatcaaatcgtcccttttaaaatagcgtccgaatttctgctattacaataaatgaaaaatgaaattacagtgattatgtaaagaaacttttttaactttgctttttggtacaaatcggaagagcgtcctagaaagatagtaacccaatataaacgccaggaaacatcggtttttatgttagtttggagaaaaatgaacctgaagttttcgcgtgcttttcatcgacacaacacaggtcaatgaactgctgtacagcttctcaacaatgcatgcgcgttcaggcactgaaaacaaaaccaaaaataaataaataaattgaggatggggatgtgaatatcagaaggacctcgcgagtccgaaattttctccagtcgttccaatgagcgcaaattgtagaagctgtacccgtcgtcgtgtccgaccacaagaatggtgcagtcttggttgaatgagacataataaatctttttagatgaaggcgactgtttttgtgtgtccatgccgttctctgaggtggaaatgattttgaaaaggctgtaaaagatttcaaagttgttaacagatgacattattagttttcaaagcagccaatatgttaagatgaaagacggaaaatgaaaaatttaacaaaaaaacaaaacaaaatgaacataaaaaagacaagttgacatttatttacacttccttttttcctttccctgacctgctgtcggtgatagcaggtaattgtgcaccaaatattctgctcgttgtaccccggattcggcaatgttccaaagtgcacttgtgaacgcttggttagctatgaattcagtggcaccggaaaacatgggaacatctgacaagtgagaagtttgtgcaagttccgacaatgcgtttttgtgaaacttgggagggggcggggcaggtgagaaatgagaagaaaaaatactatttggtatagaaatgtttgatttatatttttaatttttatttattttttctaacattgagttacgcttgatttaaatgtatcaaaaccaattaaggtgctgtaattaagtttcttttcaagtttcaatgccggttttactgttgggtatttcaagccaaaaagcccgtaaaaatttaatgaaaaataattcgccaaaatttgaaaaaaatgaatttttgacatgaacatggttcaaattttttcatgtgtgtagcacggtgctgttagttttcgatagtagtgatctcgacagtgttggtttcgatagtaaactttgtttaaaaaagattttctcacacgattcgagaatcttatataagaaatttttgtttgtttttttgactacagtccagtagtagatatttgtatacaaaaagagaaagcgataaatcttgacaaacatacctaattatcagggctgtcaaaaatatgcacgaaaatggccaaaatatgcgcataaatatgctaataaaatcgtgaaatatgcacaaaaaccgcaaaatatgcaccaaaaaaacttgaaaattaggggtgcaaattaatttaaaaaattttattccccataaattttataggttgtttttgcaatttcaaattaaaaatttcacaagattttcgggtaatagtgcagtttatcccccccatttttcgaaaaaaataaaaaatttaaaaaaaagttgtgtaaaacgcttttccttggggttttctggggcgctgatccacgaatctgacaatttattttgactaattaccaaaatccccggacccgaatccgaacaaagtcgaaaattcaaaattttttaagtttacacttttgctctaaaattgattaaaacaagctaaaattagtcacaaaatcattaaaacaccagaaaatgtcattttgtacagattcgaaaaaaagtaaattttgaa

SEQ ID NO: 14355 - DNA, 830 bp, Heterodera glycines
atttgcatattttatgacagccctgcttataagttattaaagacaaagatttagcttatcactttttttcttgcacatataatgtacagcaaatatggcgatttccatacaattgactggcctcgagatttggcccgtgatcggatgcgacacaaatacataaaaggtattttgaaatgaattagaatctatttaatggaaaacaaccaaaataatgcatttgctttttccctaaaggctatcgcgaagactttcccttcggttccgcgtccgccgtttgggacgcgggcagcggttggatttgtgtgcttttggtcggcttggcagccggcgctattgccggagtcattgacattggcgcgcgatggatgagcgacctgaaggacggcatttgtgccgaccgattttggctggacagggagcactgctgctggtcagccaacgacagcgcatacaaaggttgttttgagagtttggtgttttaaaaaatatctggaactggatcctttggaacaaatccgggtcatgaaaaatccaggttgccaaaaatagcctcgattttgataattgccagattctatttcaagccatccccctttcatttacgcgtcatattgattggttttagaacaaatccgggtccagtaaaaatatttcttcactttgatattgtcatgattctattgcataaaaggcgcccccctcacttaatcggaaccttcgtgccatccttggtatacattaagggttaaattatataattttggtattttattggttttccacgtttgaccatttttcagacaacgaatgcagcagttggacacaca

SEQ ID NO: 14356 - DNA, 1846 bp, Heterodera glycines
ataataaaaatttgaatttttgaatgtttgtttctttgtttttttcctccaaaggattgagcggcgtccaattggtgcggggactgctcgcccttttcggggaagtcagatgtccaaaattggcaaattgattaggaaaagcagaaatttggaggcaattcccgagtggtatttggacacgaagcacttcaaagtcgacgtttgccccaattttgaaaatggaaaagttgtcgacacttaccgaggtttgtttatttatttattgaatgtcagcactttccaaggctaattcttttttttcatcaataataaattatttaattatttttgttttcttcagataccgatggaatcgaattggtcaaaatgtacgaaggttttctggaggacagcaaattgtttctgtcaatccatgcgaaaggcgtgagcaaagaatcgctttttggggaagaaacggtggaaattaaaaatgaaaatttgaaaattgtgaaaaaggcagccctttggctaattgacaatttcgttgatgaatttttagcctatttggacaatttttttgaatttggcggcaaccaaaaggaaaaagaccgaattttgaatgaaatttggcaaaaatgggtcgaaacgaatgcaaaaatgcaaacattcaaggaacaggggcaattgttttgccatatttacgttttttcaatgttttttctgagtacaatttggcaaagattgggagagaaggagcgaaagaaaatggcaaaagtaatggcggaaaagcgatgggatcaaattgtaagcgaaagtcactttggcacaatgttcggttttttgcagatatttgaggacaattttcggaaaaaaacattttgaaaagatttaaaacaatttatttttgtatttcttttgacattataagtcgtcaacaaaagaccaaagaacttaatttaatcaccaattaattttaaattgtaaaaataagctcgtgttgacgacttaataaaaaattaaaattattattttttttattaattttagaagtaaatttttctgtgtctacacaaaatataatcctttttaaagaaaattttatgttttccggaaattgtccgcaaatgtcccactgcgtttaaagtgatttaattaagtaaaactaattaatttataatattctttataaataattaatttttttacatagaccattttcgcgcttcgctggtacggcaaatcgtccttagaattcggccgttcgtccgcggcctttgcgacttgcgattattctcagtgggatgaactgcttcatcaccgcaacgcacaattagtgcacagtttgaccctttttcggctcatcaaacgcttcaaaggatttgcgcattttctgtgccaaatgattaaaaaagatacagtagaaacaaaggaccgtcttctgctgctgttccgatccgtggccgaatttgattggcttgagaagcaattcccaatgattttgcgcatcggtaattaattaattattcatttgaatgaccctaattatttaattaacaatccctttaatatgctaattaatgaaaaatttagaggaattaaactttcgttgtcgtttacatttctatgaacaaatgttcaaattcaaaagttcaagtgatttgcacagatacagcgaattccgaatggctttctccgttttgtttaaacaattgtccgttcgcttaactgctaaatcggccaaattggcccatccgatgctcacagaagtaatgtttgtagttcatgaagacattttccgagaaatggcacttgcgttggcattttgtcgctgatgcttctctttaaaggcattgagtgccgacaaaac

SEQ ID NO: 14357 - DNA, 1738 bp, Heterodera glycines
aggaagaaagcaacagagtgaaaaagatgaagaggaatcttctcagggaaaaggaaatgaaagggatggatgggaaagaggtggaagaagaggaaaaggtggaagaaaagagtaaaagagaggacgaggaagaaggtaaaaaggaaaaggaagaaggagaaaggaagaatggatggctgagagagaaggaagaaaggaggaaggaaaatatgagggaaaaagaggaaaaggatggaggaaaagggaaggatgagagggaggaaaatggcgaggaaggaacggaggagaaagtggaggcaatgaggaggaaggccgaagatggagagaatggaaaaaaacatagcgacattcccgtggcaaaatgccaattttttgggatgaatggcaaaattcaaaaagcgaatgaaagggtcaaaaaggaaaaaaatgatcaacggaaaggaggaaggccaataaatgcaaaaagtgcgaagaaatcagagacacatcaaacaaaagaaggaaaagcatcgaatgaggaggaaaaagaagcaaaaagcattgatttgctgatcgaaggttaattcgggaagatcttcttggccagtaattgccaatggttaacttcgctcttcagactagtggggtccgatactaaaaatcccgagactcgaaaccgagacgaagacccgagaatcgagacttgaactcgggactcgagacttaacccgagacttgagacttagacccgagactcgagaccgagacttaaccccacgattcgggagattttcagacattaccacggacgaattccttttggaaaagcaccgcaaaaatatgaatgccaacaatgatcacaatttggacaacgaattgttggccaatttgagtgtttacgcacacgaaattaagcaacagatggaaacgtacaaacaattgtcaaattatggcactgaatttcgaaattgggcgaaaaatgtggcgaatgaatggcaaaataaaatgagagagaaagtgccaaaggagagaaatgagcggattgaactaatgaacgaattgtgccgaattttgcacagaatggcaaattttggggagaaattttatgaccaaaattgggacaattgcacagaacaaatgcaaattatgtgctcagaagtgaaaggacagctgcataaaaggcatttgtcacggcaaatcaccgaaaatgaccaattagagaaggaatgggccgaattgactaaagagggacaaattaaggcaattgacacactttggggggagaaaaatgggaacagaaaagccaaagggaacagacggaaagaatttgtggcatttttggagcaatggaggaaaatgagggaccaaatggaattgggtgagggatttagttaatgattgggcaataaaaacaccaaatatttaaacatttaattaagatgaaaatttacgagaatatttcgccgaaaaaggatatttggagcaaaagcaaagcgaaaatggcaacaggacaaaccaagcggaatatttgcaggaaatagaatttgagaagtgccaacaaaagggggcaaaaacggaggaacaaatggtaaaagaaatggcaaaaaaagtggatgccctccgtgtaataatctgttgtcgtttagttggacgaacttttgtacgattatggcattttggaaacaaatgaaaagcgcaacgacaaaatcaaaacgaaaaagaagagatgcgacggattgtgaaggaatgggtgggtttg

SEQ ID NO: 14358 - DNA, 3392 bp, Heterodera glycines
gaaaacttttctacatgaaatattcatgtgccatttggctgtaaagccaagcctcgttcagaaatgatccaattggttaagacgttggcatttttatacatgcaaataccgagaaaaacacattgttttcgcttgcgttaatgcttcaacggtgtacacactttcatttttggactttaaaaactttaatcggcactttttaagtaacaggctcagcagaagccagacgttttttttgcccgattttttttttggaaaaaatgtcatatcaattaaactaaaagcatcgggcaaaatgcccttcatataatctcatacattttttggtactggatgatttttaatccttttttgcttaaacgtcatcgaccacttttcagggcggatgtccggcccctgggcacgtgacggcctatgtgcgcgttccgctgcgcgttgtcggtttggtggtcggtccgaaagggaacaccatcaaacgaattcaacaggtgctgatttggcgtgcgttagcattttgccaatggatggaacgccaaaatggcgccaaatttaaaattttgaaaatttgctctgtccggcatttacaaaagcaaatgacagtgtggagggacacgcattttgaggctcggatattgaaatttgttgtgtgatccaaatatagtggggaaaaaccggtgccaatttcacaatttaattactgtataccattattcaaaaattttaccgtatacccttcgagtttggtgttatcgtttactctccccctgcttctccaaggacacgcacacgtacatcatcacaccaagccgtgagcgtgagccgatcttcgaggtcaccggactgccccaaaatgtggaggcggcacggcgcgagattgagcagcacatctaccagcggacgggcaacatgccgatcaccgactcgagcgcgtccatcgccaactttgatctgcatgtgtgtcaggggtcatggtcatggagcccgaacggaaacgcagtaaatatgcctctctctcacacacaaacacggagattttttagaaattttgcttacctctttcatggaactaggccattacgaaatttgaaatgagacgcgcaattcttcaaaatttgtgccgaaattgtttttttttggaaatggccatggcacacccattttcggccaattcatttttattaaccaaactcatatactgtttttgaaacttgaaaatgggtgaaatttttgtttttaatcggttttaattgcgaaggatcataggagcaaagagctacttccccaggacttttgaattgtttttggaaattgaatctcaaaattcaccgcgttgacttcatttttcatgcacaaaagaaaaaaaaattagttggaaaaaagtttgcctagaaataagaagagttgtcattcaaaaattttggcacaaaatcccattcaaaattgcttttttcttaatgaaaataatgattgaaaaaatcacaccgcataaaaaacgtaaaatttttttgcataaattatgccgttttcccccgttcagaccgctgcactgcaggcgcagcacgcggcattgcacgcgaactcgacgaatcggccaaattatggtgcgcttgcggtcacgtccacgacgacggcacgccaatttcagcagcagccgcaacaccaccatcatcagcaagcagtacttatgccagcaatggcggcggcggcagctgctgcacaacagcaacaacaccatcaacagtttcagcagcaacagtcatccaatgcatgccatcaacaaatgcagcaacaacagcaaactcagtaccaacaacagagtcagcagcaacacaacgccaatcttggtaggtgttcatgtggacggatatgattgaaatcttgacaaaaacggagacggaaaaatcaaataagttgtcaattgtcccaatttttttgaaattttgcattttttagcccactctatttttggaaatttctaatcaaactaacctaggagaagaaaaaaaatcgggcttggttttcagatcgattcgactaaaattaagacaaactgtttgggtcgcaattttggttaacttaacggcaatctgacacgaaaccgccaacatagccaaattaaatgtaaaaatggtcatggcagattatccctaaatgaattgttgatcaatcaatcaatctctatgctctcgctgaagttgcttctcctttttgtaggactgagtttgggtgatttgaacggatgcttccgcagcaaccaaccacaacaacatcaacaacagtcacatcttttgcatcataatgactttgtgccgtcatcacatgacatgatgatcggtgctggcaccatcggcacgaagctgtacagcagcgcagccgcttcaccaccgccatcgtttggcccaattggtggcactgcaggcgctgtggcaccaccaacaacaaccagcacagcgacaacggcactgtcagcgctcggcacttccgtgtccagcaacaatttgcacgcaatgcttggcgcgttggagttggacaatggcgggacacctccgcagcagcagcagggccatgtaagtttaccaatttattttacattcaaaagccaatttttcagggttaaatgggatttttaaaatttaatttaaataggtaattattaatttgcaacgaatttatgtatgtatatacaatcattcctttttcgtcatttttagaaattttacggcattttttgaatgctaaaatttcattgttaaggacttacataaatttgttcaatgtaaatgcctgttttttttttaattttcatttaacttaacatttttattgcgcgttggcatcgatcgctaatggcttagttggttaactgtttgttttctctattgttttcatgccggttcggtccctcgccagtgctcatgattattacaatgttttggttgtctgtcaatgattatcaaaaagatcaagctcaacaggcttgaaccgaccctgtagacaaccactttaactctctctatgagacagacatttaaattttttcaaaattagaacctttttttcaaaaattgtttttggtaactccgtcactcactctctctgctctttcagttctcttctgccatcagcaccgatttcaagctgggcggcggctcctcctccttgcttctgttgcgctccacctccaatggctatggtgccggtgccggaagtgccgtcattcaacaacagaatgccgccaacaccaacaccacgagcgctttctcgccatggcgtatgccgtcgagcgctgtcgatgcaatgtcgcagaatgacttcctggacattctgtcatccaccagcccgtcaccttattgtcagcttccggtggtaatggtggtggtagtgcgggaaat

SEQ ID NO: 14359 - DNA, 1329 bp, Heterodera glycines
ctttaaatcttttaatgaaaaaaaaaatttttttttgcggagactggagtgcaccgcctgcagtgcaattagacgtcgcctggaattttacaaaaatatccttaataaataattgcactaaattttgcctaaattttgaaattccattttacaaaaattaaaattcgttttttaatttacaatcagtgaccaaacttcgtttaaaatggacgaacgcatggaacggtctttggttggtttcttcgagcacattcattcgctcatccaatcgaccgagtacagttcgcttagcaacttaatgatcctcatttacgtgcacactatcaccgaaaatggggtggatttggccgcgttgctttcgaatgttcttggaagaaaggtaaaacaaacaaaacaaggccttcaattagtcaatgttttcttggttattcttgccttcaattgtttgttttgggatggcgttcggttgcggagaatacgaaaaacttcttcatttttgtttgtattccgtccatttttttcatttctccgttccatttttcttttttttccttttaggtgcctaaaacgctgcacaaacagtcgctggttaaaagtctttacgttacccgggcactgctcgagaaggacgtggcggagaaggcggccagcatcagtgtgacgcgcgacctttgcgcacacagcagcggctatttgccggtccattgcattacccacctcctccattggcaatcgtttgccaaaaacggcacgcaaattcaggtgtttgccattgttttgagtcaattgtataaatatatttaaacattcaggaccttacccagaataaaattttggggaggcacagactgacaaaacgaagattttatttgtttttcgtccatacatggaaaaggggggggggtcaaccagaatttttgtgaactggtctggggggaggggggtcagtggccaattttgcaaaggggtccagccatgtaatttgacatttttttttgctgtgcgttttcaaaaaaaaatagaacaagagggccggcggtgccgataggcgccgtcggggaaaaatttttgaaaatttaagtgcaatttgttatttgattttgtctaaaaaatgaccaaattttgaaattttgggctttattttttaagaaaaaagaggttttttttgggggccggcggtgctgaaaggcgcctaaggggaaaattaagaaatagcaaaatttttcagaaacttcgctacgacctctccccacctcttttacagagaccctcctcgatgcgaaatggtcccacattttgggcttttgcgggcgaggcgaaggggggggg

SEQ ID NO: 14360 - DNA, 2429 bp, Heterodera glycines
  misc_feature (20)..(20): n is a, c, g, or t
  misc_feature (152)..(152): n is a, c, g, or t
agtcccgtctgtgcatgcgnttgatcgcgctcacttatctgctcgcatcactttacaaattggacacccaccagccccgggacccttctctaatcgctccgatcagtcgtgatcaacacactcatcgacttgcacctcccaagccgtactcnccgcagttgtggaaatgcatacccatccgttatctgttgatcatggccgaccaacgacacaacgacttccaacacatcagacctgtgcttttgcgttatgttgtgttgagcatgccccatcttttgccggaacaagaccatttcgacgcgttcagaaggtcgacaaaaagggcaagtggggatcactggatgttgatggtctcgtattttatttttgtctcatttttctcgatttttcatccattgttgttacccttccccttctttttcgtgcgggtctttttgttttttgcaatttgtgctttttgtccttttctttcatctcccattcattgtcagtgcccaccaaaagggtgcctttgcttcttcgccccgtcgtcctctgctcatttccatcgacgaatgctccgtcgctttggaggaggccagcatttcgcacaatttcagtcgcctttccaagtcactcgacattctcttgggccgtgcaactgtggagcagcaattctgctactacgagctgatcctcaaggcgatgagtctctctttggacggaaaatggccacgggcactcgtcgacaaattgcaattggcctgggaacgttttgacaggtgggccaaggcagtgtcgaggattttgtacaatttgcttcggcagcgttattccccgtcgtcttcacgaggattctgtccgtctttggttgtcctccgctaatgccgccaaaatcagtgggctcgaccagcgcgacaactcctttctcattgcccacacgccgttggttctgttccgcgttgactcacgcattttccgcagtcccccgcacttgcgttgcttttgtcgttcgttgtctttttatttggccgcttcacgcgacatgaacacgctgcagttggtccgttcttctctgaacagctccaaaaggtccctccctttcatttttcattttaaagtcatttttaaacagcgaaattgaggagaaagaagctctgctccgttcttttggtggcactcaacgattggccgttgttcaaacatacattgaactttgtgacgacgaggacggcaccgaaattgatgacattgaggagattcggcagattttatgctcacaaatccaccaattgtttattgcggacacccatcttccaaagctcgtccatttcaatgttcttttatcatcgcccgattgatttggcattttcctattttcagatgtatcccctcaggcttgtccctgtcattgtgcaacgtgtaccctcagcgcatgtgctgatcaattccatcaacgagctgatcactggcagcaatttggagaggcgtatttttgcgattgtgctaatcactgaactgcttgaacttgtcagttcccacagctttgtgtcaactttaaccttttatgttttcatttttcagtataaaattccgagcgccttcgctgctctgtcgctgatttctgacatgttagatgccatgttggtcagcttggtcaccgacgaatttattgtcctgatgctaaacgtcgtcccgtctttggctcgcctcgttctcctgtcaccattccatgccgaacagtttttgaccattttggaacgcacgcggaaactcgcattcagtcggatggccatttatagcagtttaagccaggcaagaaaatcgccagaacggaaactgtttgaaatggtcaacaggacaatggaagatctcccaaaattgacataattatgcataatttattttattttggcgaagttcgcattttacaaattcatattttccaattgttttgttttggttatagtttttttttattccgtttctaaacatgaactataataatttgcgctttcaaaatggacaatagcaaaaagaaaaatgggacaaaaattatgttttttcttgtggtgttaagggagggatgaaagtcatcgttgtcagccgatttgtgccgtctccgtcctgccgtcgctccttccgccactcatttcccttacgcttccgtaatcgttcgccctttgccctccgattggtcttttttgttgctctttcgttacgattgttttcggcactgttagtttttcgctgatcaatgcttccgatccgttcggcattccctcaatgtcttgccaaccatccgccgaactgagcatttgcgtgtccaagacggagtagcgattgggccgaaagttgtggaggacatttcggagctaaaagggggagggagggatacggtgataccatatgcaattaaaaatgtacgatgggcacaaacttttcgaggg

SEQ ID NO: 14361 - DNA, 1637 bp, Heterodera glycines
tgaagaaacaacagacactgtaagagtcagacactattaaaagttaatgaaaataaagtgaacaatgcaccaatgaaaaaacagacagctgaggttagacactatttgttttatcattgtttttaattaaattttgtatgcttctaacttagtctatagtaaaccaaaagattttttttttctgctcgttttgaaaggaaaattctaaagaatatttctaatttaatcaaaagttttaaaaaattgtttattagcaaaaaaatgaatatgtgttattttatatgttagagacatggaaatagtgcgtcaaaatgagagaaaaagaaaaaaactttgcccttggaaaaaattttttcctattggtaactttttttgaaattttgcataggcccatagtttgaccccctctatcgaatcacagtttatttttagctgtctagtttttaactcgagatcggctcttccttttttacaagggaaatcttgacaaattttttaaattaacggggttttttggcgtttcgtctgtgcgcacttttggtcaaattgatgatatatgcccctgcctcatttaccagcgccatgcaatgccgcaggtgtttgatgctaagctggcgaatgtccacgccgtccacacaaattgagccacctgaaggggatttttcgattcaaagactccgtccgtccgttcaccgattggatcgtaatgcctttccagcagttgtaccaccgtactcttcccacatccgctgggcccaaccacggcaattcgcttgcccaccgacgctgacaatgacagtccgtccaatgccaattgtttttgcccatttggataggcaaattggacggatttgagttcgagacggccttcgatgggctaaagttaaaaaccacaaaataaaaactttgaattaaaatgtgcatgccgttttgattcctttgtcggagagactgttaatgcgcggctttagccgtatcattgcgaacataagcctgaaagtgcgctatttcatgcccccttcccaaatgggcgcaccccgcagaaaagcgtgcccttaaatattcggggaaatacgctgccgcggccattatcatgaaggaggccatgttaagagcttcgacaacttggaacagtacaaaaggggtggtgtgaccggcacggatcagaagcattcccaggcaataggtgaagccgaagttgaagctgacgaaggaggaagtgagggcgaacgacagagaagtccaaaggcctaaaggcaattgcttctcaatgaatggccaaaagggagcccatcgaagtgagtgagtgcctcgggtgatggccattcggtggggctttcgcatcgcctcggagaatgtccggtacgcttttccctgtccattcaatgcttgcactgtccgcacatattacaaagattcggtgcccattttggaggcttcttcagccgcctgaatgcgttgggatcgattggtgaaagtgatcagtgcggtcggaattctctagcaagtcgagcatgccacgacgctttaagtaattggagacgaagctttggaggatggcgagaataatggaagtgccgactccaatcgggtcgtaaaggcaactaaaggcggacaagtgccacggtcgcacccat

SEQ ID NO: 14362 - DNA, 1673 bp, Heterodera glycines
agtcttattttttggctatttttctcgtccggcgacgttttgttggctggccaaatggccgactgaccacaccgaagaatacaaagggcatttcgggcccagcatatcgcaaaatgtccagcggagacgcaggtcgagctcccatctcgtgcagttcgtcgtccaatctgtcaaacaagaacaaagtgttctgtgctgtgctatgtttggtcattactcctccaatttcgcttcttcgtcccctccggcggtgctcgtcagcccaacggatttcactgaactaatcgaacggcgcattctctccgacatccgcgccattttgcgttccgatgcgttttcgctgattttgcactgagtttcgacgtctgtcaaagtcatggccaaatttcataatcttccaattattaccaaaagcggcttctcccgcctcggctccctttggcttttctttttcaatttgttgggccattacctaaaatgccatttaattggcccaattgaatttcgctctttctctgttcttttgtcccccccccccccactttaaccctttttcatttttattcggcaccatttgcttgtaaacggagttgggccttcccatcagtttctcgtggttgcccatttctacaattcggccatgctcaaaaacgactattctgtccgcatttcgcactgtcgaaaggcgatgggcaatggtaatggtcgtccgtcccgaggaagcattgtctgaagaagggaaaaaatgccaatttgagtggtgccattcgcatttatcaggtgcacattggcacaattcggaaatggcaaaatgccaaccgaccaatggcttcctgcacaatttgttcactttcggcatccaacgcggaagtggcctcgtccaacaacaaaatgcgcgggttgcgcagcaaaacacgcgcaatggccaagctaattgtaaaacatttacaaaatgggatgggcaatccatttgtgctcttcgctgaccgttgcttttgtcctccggacaattgaatgccgccttggcccaccagcgttttgaagccttggggcaatttgttgataaatccgatggcatttgccatccgacacgccgtctccatttcctccttcatttcccttttatgaaatgttttccccgcttttcgtcctccaccttggtcgcttcttctcttcccatgcgcaaattgtcctccaccgttgccgcgaacagaacgggttcctgctgcacaaggccaatggtttggcgcagccacggcacattcaaatcgctcaaaggaacgccgtcgagcgaaacgcagccctaaaagaacaaagagaaccttttagctttctaccgtatcgttcggaccgttactgtgtctaccgtaccctgcagcatcagcagcagattacctttgtggcttcgtagaatcgcatcagcagtgccactatcgttgactttccacttccactgtgtccgattaatgccaccgattcgcccgcatcgatgcgcaatgaaacgctcttcagcactttgagttgggggcgcgagggataggcaaagtgaacgtctttaaattcgatggcgccttttacggcactcggacgaattccggccgaatttgtggcgttgagggagggcttctgaagagaaaaaccaaatgaatggacgaatttggtctgattaaggg

SEQ ID NO: 14363 - DNA, 951 bp, Heterodera glycines
  misc_feature (916)..(916): n is a, c, g, or t
tcaattcgattccatgggaaaggattatcattctactttttgtacctcttattggcaaaagaaaaatgttcccattaatggcactgaaattcatagattttttcaaatatatttgtctcaattttctgtaaattcagagcggttctcgtcatgccgtggccatcaaaatggagccgccgtccaatgggccgttgttcaccgaaatgcacgtgtacatgcgcgtgctgaagcctgaacacttggacaaatggaagaaggacaaaggtggggttggccgcagatttttgaggaaaattaaggtatttttagatttgtggaattttttggtttcttaactaaaactttgacttgtctataatttttggacttgtatttgttaggcataggcttacggatccgtttgacgccttgcggaacttttgtatttaaaaagtgcggaatttggaaagaaatctcccaattttgggtagcattttacccccccccccatttttagggcttaaattcctcggcttgccccacttcatcagcaacggctccttcacttacgaaggccaacaaattcgctacttggtcatcccaaagttcgccctttccttggaatccgtccgcgcggcgcgcactccgtcggcggtgctcagttggaccgaagtgtccgccgtggccaaaacggtggtgcacgcgttggcgtacctccacgaccaggggagttgggctctgttgtaaaatggaaaaacaaattttttttaatgctatctctttgggcgcttttgcattttctttttaatttttttattatcattttttaaatgtctcatttcctcctccattttgaatttcatttcttcagaattatgtgcacggcgatgtgaaggcggcaatctgatgatggagtccaaaagtgatttttcccggntcgtgctcatcgacttcggcctgggcaggcgattg

SEQ ID NO: 14364 - DNA, 3211 bp, Heterodera glycines
agatttttgggaaaattaagtattttcccccccccgaaatgaaaatttttaaaaattttccagcaaataatggaatttttctcgaatttccccccaaacgaaaattaaaaagtttaataggcaaatttcgtaacaagtagcactcaaatttccaaaaaaattttccggcggcgcctatcggcaccgccggacctacattttccactatttttacaagtttttttccttaaaacggccaaaatttggtcatttttagtgaaaaaaaagtgcagttgttacccagcagtggaaaaaaagtaattggttaaatagcaaaaaaaaaagaaggtctccaggtcgtgtccccccccccccccgaaaaatgtttctagatacgcccctgttgggtagcattttacccccccccatttttagggctcaaattcctcggcttgccctacttcatcagcaacggctccttcacttacgaaggccaacaaattcgctacttggtcatcccaaagttcgccctttcattggagtccgtccgcgcggcgcgcactccgtcggcggtgctcagttggaccgaagtgtccgccgtggccaaaacggtggtgcactcgttggcgtacctccacgaccaggggagttgggctctgttgtaaaatggaaaaacaatttttttaatgctatctctttgggcgcttttgcattttctttttaatttttttattatcattttttaaatgtctcatttcctcctccattttgaatttcatttcttcagaattatgtgcacggcgatgtgaaggcggccaatctgatgatggagtccaaaagtgatttttcccgggtcgtgctcatcgacttcggcctggccaggcgattgcccgacgcactggtggagaaagagaacaaaaagcaaggcgaggagagcagttgccattgtgaatttccaattcgcctgaattggaaattcacaatggcattttatgccatttaaatgccggcattttcattttcgattttggcatttatttgtttcttttggctgttcagctcacaacggcactccgctgttcacttcctgcgacgcccaccgcggctgtctgccctctttccgtggcgatttggagattttggtgcacaacatgttctactggacgaccggcacattgccgtgggaagtgagcacaaaacgggcacaatttgaattttcctaaaaatattttgagtctttatacctcctttaaaaactttttaaactttttttgccggagaattcgattttaaattatgaaaattaaaaatttcaaattttgaaagaatttccgcggcggtggggcgggggaaggggaggcaaaatagaaagagcactaaaaatttaaaaaatcttaaattcttcattccaaattcacaatttaatctccattttccgcagtctgtcgagcaaaatttggacgccgtgtacgaggcgaagaagtcgctggtggcgaacgcgcgccgggaggtgccgcgactgatggccagcagcagcggcagcaccgagcagagccaaacgcagcaaaagcgacgggcgaccgccgccacggccattgcggcactgtacgcacactgtgccggcatggaattcggcgagaagatggagctggacacggtgctgcacgcgctggacggacgatgatttttgatggcatttttatggctggcagcggcggtcgacgggaaaaaccaatcattgaattttgatgattgattgcattgaaaaataccacaatttttattttatttattgtttaatttgttttatttatgtatgactctcttttttggtgtatctcaacatggaaggaaaggggcgacgctttctttcctcccctaacaatttgagcattgtttttttttcatttcctttatttttctttttgtttatctctgttgtgtatgataaatgacgtcatatcccctaaatttcaactaaatacagttaaaatacttaattttaatatctccaaaagattttgggggctaattatcatctttatagtgtttttattgttttggcattagtttttgatatatgtttataatttgccttcaattcattctcatttacaaccaacccaattttgccttttgcccttcccaacaaatccctcccccggggggtcaacttccttccgcccccccccaagggctgaaatttatgcgggagaaatggggcggcaatgaatggattggatgtgtggtgccggtgattaatggcatttatctttttgccgggagggcgcccttcccggcaaaatgtcggaagagtccggcacaaatatttgtgtgtttggtgcccgtttccctcccaccgcaggcggccgattatttggccctattcgaatttatgcggcggcggtggcccaaagacgccgccaaataaactgtgaaaatgacctcaagaagggcatcatcggaaaagccaattcgaagtcgaagggggtggtcaatttgggggacggcataattcggaaattatagaaatttgacagtctttggactacatacctaattgagctaataacggaatcctaaatcctgttcatggttgaattggatcaacggattgccgagatcagtccgagactctcggtcctggcacttttccataaaaaagtgccggaagttcgggtaaattcacagtcattggactgtttacctaattgagctaataatggactcataattctgctcctgcttgactggatcaacggaatgccgggaccagttcgagactctcgaccttggcacttttccattaaaaaaatgccggaagttccggcaaaatgccattgtgagtgtctgtatgccttctcctttgcccgggtccaccgttctctccgaattatataattacaatttatttctcatccaatttcaacatcaaaaatggtgttaaatttgctttttattccccccccctcaattggtccccattttcaattgttcttcaaaatgttcctctgtcgtcgtcgtcgtcaaatcaaattcctttcccctcaattaatttttcacttcccatttctcctgatcacattccgtccaatttgatttgattaaaaaaagttgtgtgaaactcaattttattccgtccgaacaaatcacagagcccaaagcccgcaaaaaaagagagagaagggaagtgaggagatagcgatatgaaccccaaaatgaaattcaaaat

SEQ ID NO: 14365 - DNA, 1313 bp, Heterodera glycines
  misc_feature (1219)..(1219): n is a, c, g, or t
  misc_feature (1259)..(1259): n is a, c, g, or t
  misc_feature (1289)..(1289): n is a, c, g, or t
tcgtctctaattgcgcattatttcttccctttccatctctttccgtctcttcaattgttccaatcacttttttctctctttctctctctttctctgtccacctctccaattcagctaatctttcccaactctttttccatctatccacgtgtctgttgttctatcctcctcaatttagcgttttgttcaaagggaaattgagcccattttcagtgtcccctcccccggccccgtctcgtgtcgtccgtttgttttttcgtccgtcgggtctattcctcatttaatttccgtccgtcgcccctccggcattggcaccaattaattgcctccagcgagtgccctcctcgacgacattaattcgcctcccctccctcggccctttcgtttgtcggccctcgaatttcatcgctcccaaaaagggcacgcataaagcagcacaggtaaagcattgaagatgggaacgatgtaagcctgaaaatacttcttcccccacccttaattggccattttctcatccccccccctttagggcatttcctccggacccctttcttttttttgtgcccacctttgctgcgcttttgctattagcataatttgtgcccttcggtcgacgccaaaccctcaaatccttcaaataaataataataattaccgccgccaccggcaaatctccgcggggcaaaaattggcgacatttttgccaaaagcaaatgaaacgaaacgacagcgaaatcgacattaattatcccattgttgtgctgttgtttgtgctgtgaatgactttttacgccgttggcacaataacaacagcagcaccagcaacagcgtcggcatcttcgcgcaatggcaccgccggcgccgaaaactcagactcaccgccgtcgttgttggcaccagcggatggcatgggccacatggtcagccgatgagtccatttttcagagctcatttattaatttaggcaaaaataattaaagtttcagttttaaataataatggatggatatttttttaattatcccccaccagcaccaattaattttcataattccactaattagttcctttaattgttgttgcttaatcatttgtttaattcccgccctcacatgacaggagaacaacccgtacgcgttggcattggcatttgtcccgctgatgaccattttcggaaatgcgttggtcatttttggcggtgtgccgcgacaaatccttngcgcacgtcaccaatttgctgattcagtgaaggtggtggntgatcaacactaattataaatttaaaattngaaatgatcagtccatttatctga

SEQ ID NO: 14366 - DNA, 3127 bp, Heterodera glycines
  misc_feature (3117)..(3118): n is a, c, g, or t
tgatgagttagctttttacagtattcctacagttacatcgccatttcccatccgttggcatactgtcaaatcggcaccaattcccgtgcctatgtgtccatcgctttggtttgggccgtgtccatctccgtggccattccgctcgccttcggtgggttggacaaatggctctaaatttgatcacaattctgataaattagcaaattttgttcaggtgccaatcacattgagagtgaacacgagtgcgcattcacaaacccaggcaaatgatgaagcccaaatcaagcatttaaaaacaatactatggacaatatgaaacatataatagtgatcaacccttctcgatcattctatcatcactcatccgatcagtttttgtaaataagaatcgaaaaattaattaattaattaatcgaacttaaagacacccaaagaatttaaaatttttgaaaaaaaatcgaacgaccctcactcatccatctgatcaatcctttcccgatcacctctcttccttatcaacatcgctcagtcactcttatttcgtcgctaactaatcgtatctgatctgttttccttgctgggtcaacatcctgtccaatcatccatattctccattttcactccgataattctcccaatcatctgatcagtctttgccagatcacttccatgccccaatttgtacagtgttcatgatcagctcctcggtgttgtccttctttttgccctgtttgaccatgattgcgctgtacgcggtggtgttcaggcgattgcgcgaacgcgaaagcgcacgcaccgcgcggaagcgacacgccgcactcagcgggactgagacggcactgatctccaacgcactgatgggcggcgcgaaaatggcaccatttttaattaaaaacaaatttatataaataatttatttaatttttaaggcacgccaaatcgcgcgcagccatctaaaggatcagctgctgttggagctgagcattcaggtgggacattggcattgccatgcttaattacttttttgaattgttggccataaataattaaatttaaaatcgtttaaatttaattactttcaatttcattggttatctccaaatttgctgcttcattggtgctaatttcccccttctgcttcttcagacttcctccttcccaaccgccagtcgttctgatgaggaggaagacgaggaggacgatgacgaggaggaggaggacgaagaagcggtggacgcgggcgaatccgtcgccggacgaacgcattggcaccgcaacgacaagcgcggtttggcggcacaagtggcgcaagagtgccacaaacagcaccagcgaaggcccaccttcggcctaatgatgaacggcggcgcaatgccattcgcgacggcaccgatgaatccactgcaggtacatacagccgagggaggaacagaaggatgaactgacacaatttgggaccgttcgggtattacaatcctcgagcattttagcacattgacatacagatagactaattaatatatatcaattagcgaatgtttcaagcttttcttccctgccgactcaattcattaatcaatgtttaattaactgtttgtttaatcttaattgcttctgaccagcagataatcagtcaaaaattttccttttaattaaaattggcattttaagcgctaaaagattcaggccaaggaatgttaggtgatcagcaagcaaatccaagccctattttgatcagctgtgatttaagccatgcttttgatgccctttcagttgccttccaccgctttgacggacgcggagcgtcgcgtgaaggggtggcagcgaaagcgaacgctgcgactgatgcgccgctgcaacactttgccctccaccgtaatgcagcgacagacgacgacgacggcgccgcatgggacgacacaaaaggcaacgaaaaggacgacaatggcacggggggaaagcgatgcaacccaggaacaacagacaaagtcggacacgacaaaatgccaacagcaaaggcatgagtcaccaaaacggcaaaaaagtccaatcggagacatacaaaacgcaagcggtgttagtgttgaacgggtactgctcgaaaatgatggtggccgggagcaattctgtaaagatgttgttgccacggcggatacaaagggccttaatgagtgggacggcgaggaacggtccccttcgcccacccttgtgcatttgtgcagcagtttcggcgatgagttgggggagtgcttcccattcatcgaccaaaatgagcaacaacaacaactacccgaggaccacaataacaacagcaacaaaaatgccgtgagtgtcaaactatacccaaccaattaattaattcactaattaccccattagttattgcttggtgacgagtcgactcccgacgacacgcgccgctgtgttggcttgtcaaatggaaaagcagcagaatcggatgacccatcgtcatttaatgccgcggcacttaaaatgcaacagcgaaatggcagcagcaaacgcggcacagtgaggcgaacggcgacgacgaaaaagctgcagaaaggcgcaacggaaaagacgtgccatcgaaacggtgatgggcagggcaatttcggcatgcgacgaacgcactcggaacggcatccagcggacaccaaaacgcagcaacggattaggcggttgtcagccgatggaagcgcgtgtgcttcttgcgcgggatgggttgtcattgtcgggaacgaagacgaaaatggtgccaaaaacaatggcaccgacaatgatcgactaaatggtgccgaatataataattatcgtaatgataatgacaatggcactaccgctgcgggatcgccaacgtttggcacaaacattgagcaacggaaaaagaaaagcaccgcgcgacaagtgacgaaaggtcggcaaagtggcctttcttccacttcaaagcacttttagacgctaaatacgggtcaaaatgcgccgctttttccacaggtgccactttggcacttcgcaacggcggcggatgcagcgcgacaccgccgctcctcctgcaacaacgacagctgcagcagaagcggcacaagcagtgcggcgcaaatgttggcacgaccnntgcaggcat

SEQ ID NO: 14367 - DNA, 1971 bp, Heterodera glycines
  misc_feature (1821)..(1821): n is a, c, g, or t
  misc_feature (1894)..(1894): n is a, c, g, or t
  misc_feature (1934)..(1934): n is a, c, g, or t
  misc_feature (1940)..(1940): n is a, c, g, or t
tgaaaattgatagaacaaacattttcaaaatgggaagaaacatttaggaaaagaagaaaaaataaaagatatttgaaaaatatgaaattcgattggagcaaaaaatgaaaaatttatgaggcaaaaaaaagagaagaccctaaaatgtatgatactgatattgcaaattgttgaaaaataaaaataaaatttttggaaaatcgatcctaatttgtaaatcataattattggcatatttaatgaccaccaaagctttataaatttttgtcatgttaaattttttggctttcctcacagatttttaattcagaatttaattcaaaaataaagaaaattaaagacgacacaccaaactttatccctgaaaccctaatcaatgagcccattgaatggtcagtctaacggtctttggaagacaacattaatcagcaaattgatcaggctgatcattgtctgacaattcgttttcttttaaacaccgttatctgacaagaatctatccagtcggtattaatggggtaaaatttgtcaaattaggaaatgcttggtcagtttatcaacaaaataataattgttcttgaaataagaaacgtttcaaaaaacatttcggtgactgaatggtttaattgactcctgtaattatccctctcgtcatttgtccaagttcattgacaacagttatctcttggctttgctggttataccccaaaatttttaaagttgcttgttgtccagtttgacttctaatggtcacttcaataggactagcataatgattcgttgaaataattgttgcacggccagggtttccgcgtgagttaattccactaattgtacggccaggttggacttggaaaattaattaatattaatttggcataggacaataatagatacgaaaagcaaaaaaaaaaaattaaacgattaaagatttcgaaatttaatatttgaacaaaatttaatataaaaaaattagttacgctaaaagctaattcattttataccaaaatttaaaataaaaattcaataaatatttatttatttcattacacaattacaacttacgcattcctcgtggtattggagtaggttgtgctgttccatcttaattctctgatttttttttatgtttcacaatctcagttcctatttatgggccagtaggtccaagcgaaagaaaagctttttcaaggccttattaagccaggcacgagtttttgaaatttgttttaaaaaataagtctaggaaaaatccagagaagcggttttcgggttgcggttcgagttaacccaagaaaaacagtgtctggctttacatggtccaggtcaagctctagaatttttctattttttataagcaattaaattaatgtttgctaaattattcggtattactgcttacgcattgcatatggtcgcattggaggaggttgtgctgtgccatcttaattttttctaattttatttcgattcccgtttgtggacctggaggtccacacgaaatccacgattttcaaggcctaaagccaggcatgggttttttgacatttattttagaaaaaggtaagcccaggaaaaatccatggaagaatccaggttaccaaaaaagatcgaaaccttaaatctgcttccaaggaaaatccaggccactacacctggtctggtagagctctattaatttactaatttttgcaaaataaaattaattaaattttatcctaaattattcgattatacaaatttagcttacacatttcatatggtcgcattagaggagaatgttctgtatcatctgaattttgtaattttttttaaatttanataaaatttttaagtaaagcaaaaaaatgtataacgcaaaatgattatttgaatgaatatttattgtctctgncaaattattacaattggagccaccaaacgcccaatttccnagattntgtagacctttgaccatgctactcattatgc

SEQ ID NO: 14368 - DNA, 2695 bp, Heterodera glycines
gatttcaaaattttgcaattagaatttcggtcaaaaattctgtgttctgcgatccattattggtataaaaatttcgtaaatactagtaaaagagcattggattttttttattaaattttattttaaataagtatttaatattttaattaatttagttttagtttttagggcaagaccgaaacagagagactcacaaatatttgttttaaattttaaccctaaaaacttcataatatgaatttcggccaaaattccggaatctatggccatcacttataagctttcataaacatggatttggtattatttttataagcttttataaacatggatttgttattatttttatttcaaattagtatttgaatttatattcataaatgggcattcaatttgattttaatatattttaataataattaatattattcattcaccataactatgttgaaagttatcgggaggaatgtgaacaggaaagtcatccattcctgactctgaaataaaataaaatattttttaacaattttgaattcaaaataagtaattactaacgataatgaggctgatggtatccatgtggtggtattcctcgcactggtgatatatgattatcagtcttaaaattatatatatataatactcaaaatttgtgagactatatgttttttcttaagaaacgataaaagtgcaaattggtaaagtctcatgtcatatttaattcatttttgagctttttataaacatcataaaatgatttaaatcatttaattcttagtatcatttgatagctttaagatattctctagaagaatttataatttccaaaaatttgttcttttcaaaaaaatacaattctaaaaaatcgaccctttgaattttggttttgtaacattttatttttgcaacatttcttgaaattatatattcggaataaaatatttataaattttttaaacaatatcaattttgaattgatctagccaaaacccggaatgctaccggctcaccaatattagtttttaaattattcaaataatagaaaaaaattacgcttgatgatcctcctgacgagtttcgtgcggatgacgtgccgccgccgcttcctcccccaccaacgctcgtgcgacagaccgggcaagatgggttttgagtaagcctaggtaattaggtaattggtgtcctgaacagtgggcaatctcgatcagtggacagtccgtccgtcagttaatttattttttggcaaagatccaagccaaaataataatttgattaataataatattaggctttttacaaaatttcatattttctaaaccttgactcattttttaactaatgttttacaaaaaatcatccgtcccgactttatatatcgagctctaattaataaaaccattattttatgtaatttaatattattctcaccatctatcaacgcatgcagtgtgaaatttgtgctaaaaattaagaaatgattttgatattgtgaaatttgtccataaaaaaataaattaaaagtacaatataaaaattaaataaatttatattttaaatttaatgcttaattaagccacttaaaatatttaatgatgttagggttgggacccaattggccggtacccattttgaccctttgctttattgtatttcccttttcccttggttatgtcacgcccctttttccgcccataaatacccgcgatgttgaccctccccgttcacttcattcatttgtgttatttttccttcttgttatttaaaaattcctccccatttattttgtgtctttttcccctctgctccaaataaatattgattatttgtttgccatcggccggcataacaattggcgacgcccttacgtattgcactgtgggcttatttattggaaatgtggaagcagttttggatttgttggtttgcttgaagcaaccaacaaactttttccaaactttggactcttaattggagggagaggtcaacagcaatcgaaagtcatcgctgctggactacatttgtttattatctaggcgataataaacaacatttttgttggacctgctaaagttaggtactgttagtagttgaaaatttgcgctgctgattttgtgtcttggcgacacttttcagttcatccacgcgcacccactctgttaacaagctaggcgctgttagcaatagagtggtgaacggcaaaaatgggagacgcatcaatccaacgattgacggatattttgcagcagttgttgactgcacaacagcaaaacgcgccaccggcacagaatgcctctcaattgccaacacttccggacgtggaatgttttgatgctagtcagcatagtggctgtgaaattgaggactggctcaagcgatttaagttcgctcttgactgtgccgcgccgaaccttcaggacgagttgaaggtgaagctgttgatgaccaaattgtttggtccgacgttcagcgaatattgtaagtccgtcttaccgagagaagtgaccgacttcaattttgtggagactgcagagaagctgaaggcattgttcagccgacctcaatccgtctggattgacaggtatgagtgtctctgcgtctccgctcggtgaaagacgacgacgaggattttggcaattttatcaaccgtcaaaagaagcttctgcgggatttcaactttaagaaattgaatgaggag

SEQ ID NO: 14369 - DNA, 1688 bp, Heterodera glycines
ctaaagttgcagcgagtagttcatcttaatttgctttacaatgaattaatgattttttcaaatttttaaattataaaatttaataaaaaaaattacggtaaagcatttgtatttgtatttgtatttctgttgctggtattccgtcgtccaactaaaaatggtagcagtgacattttgattaaaaatctgccaatttcttggtcataataattgttttcgataaatgttatgattttttttaaggaaagagtaaaattttttaaggcaggaattattttgggaagaagtcatgcgttttctaatattaatttttacaattagctacatttttaattttataaatttatatattatatgctataattattacaaataaaatgatttattgagaaattgtagaactagttgtaagcagcatgtcaaaaggattttcgaaaattaatgtgtgatttgttaaagttttcaacaaaaaaatctcttttaaaattcgcaattttaaatgatggctccgaaacaattttaaaaaagtcatttaaattgaaaatatttttattgttaatctctcttacgaataacaattaatgaatagtcggctatattcatgtttaggcgtccaatgattgaggccgctcacgggttctgaaggacacaacttttttcgtacttggccagtgccaacatttttcttaatgcatttttttcttttcttgtatttaaaaattcttaagaccttaagttttcgtattattctataagaatgtaggcattgaccaaataaaaaaagtatggcctaagacattgacaattgtcattggttgaacaaataaaatggaacaaagccgaagattcatttttattgaataaaatttatttttaattaaagcaaaatttaaatataaaaaattgataaatttaatggaattaacaaaacaggcatttaacaagcgatatccatgtaatttatttcgtttttatcccctcccccctttaaagttgctcgtcttaagtgctttttattactaaggaacgagttattacaaacactttttctagtgccttatttggcagaattaaaaaaaaattttaagaaaaattatgtgagaattattatttaaatttgaaaatttcgagattttgttacaaaatttggtattatcgaggaaaatattgaaataaaaaaaacatgttacataattttccccatcaaattgtggttcaccaatgttttaaaacaaaatctgattattccaaggaagagattttccaatgattgctgaaaacgaaattccttcgaaaaattttcagttttaactaaatttcctttttactcgaaatacaaattgccattttatgcaaaaaaaccatttccaataaaaattttagcatcaaattagcaaatctcccacaatcattatataggctaaattcgtaaaaaaaatgtctactgttgcaagtattggttttgatttggttgtagaacgcgcagtattcgtccagtattcaaatttccttcattgtcccgtacagtaatataattgttgtcggttccaaaccgttcaatgtatacagtttggatattgcgaaatctgtcagcaactgtcatataaggtgggttcatatgcaactgtacatctacaacttgtacagaatatcttcgacctcttatgtctatcgcatcaataattgag

SEQ ID NO: 14370 - DNA, 1315 bp, Heterodera glycines
  misc_feature (34)..(34): n is a, c, g, or t
ataaattaaatcaataaaaaattaacataaacantctttgaaaatataaaataaaatactgcagatcaacttcttctaagcattgcatatttaaatgcaattacacacaaaaaaaacataaacaaaaatgacaaaagttcaatgtattttctaacaaattttaaataaaaaactttcataaattttaaaactatttgtataaaattattccatcaaagaaaaatagtacgagagatggtgagcctctagaaaaacaactaaaaattatgataatacatttaatatataaaaaatatttgtatgtgaaagatataaatttaataaaatagcatttgagtcctagtaaaattttaaggaatctaatgatatttaaattataattactcttgtattaaacggtgctatgacgaagcgaaaaagtatgagtgtgggcgaagcgaaaaaagtatgagtgtggggtgatcggagggggcgggtcatttcagtacggaagagttgttctaatgatcaattaattatttaaatttttaatctattaattagatttattgaccataattataatttcgattattattttaatatttcccaaacaaattgcatttttgtgagagaaatacagtgccacaaaaaagtcttgactcaaacctgaaaaactatcttatagttcatttaaaaacttgaataattcatgcttgtataacttttggtgctgatcaaaaaaggctcttataccaacttgatcagatcactgcttcctagtgactgggataccccaaaatgcactgaaaatcgggaaaatttaaaattcctagggggttgggaaatcttttctagaaaaatgggcaagcccactgaaaaagcaccaatttgttatcgaattgcttttggaatggttggtctacgatttgtatatggaaagttatacttggttgaagaattgatcacaataaaaatgaactttgcctattttgtgcctatttaatgcatattttgcgattgtttttctgcctttttaggtgcctttttcgtgattttttgtgtctaaaaacgaagccctacttattaccgatagtcttacacacgcattattgtaatggtgtttttaattaactaaaaccaaaactgcgacagaagcgcataaggtcattaggcaagtgtggtgtgactgattatataaatgtgttattcccgtcatttttgaacttttgaagtgaaaccctgaaggtaaattttttcaactccaattcaaatgaatttcgtaaaattatctttaaaatacgaaactgctcaaataaatgaaattaattttact

SEQ ID NO: 14371 - DNA, 1469 bp, Heterodera glycines
acgatcgatgcgacccaaaattggtggaattggccaaaagtgttcgatgggataagctgatttgtaggtgcatatattataggaatttttaataatcaagacggcttttggccagacaattcattggccaactcagtccctctggctcgttttagccatttaaagaatcgtttaacctttatttaattgtcaaacccactcaaatttggtgtcattaaaaagctcttaacaggctctaagctaaattaaattcaaacgcaaatatgaatagctttaaagttaatcaaataaataatcttggtattagcgataactcaacgtttcctctttaaaatctagcaaatatttacagagttgtaactaaaaaatctcttgaaaaagcatcactcaatattatagaaaaatcctattaatattttctaaacattgagagttttcgaatgaaaacaaattggttacaaagaataaagttttgggtttaaacttgcggacggacaaactcagaatttagcacacacttcattgctcagattcggttcctccaaataaggacaatcataaaagtttgaaaatttaatttgacatccgttgtcccctcctctcctcagccataagctaattgacatttcatttcaatttattaattggccagaaattgcaatgcttggcttcccctgcgtgcgtcaaattgccgaaatgtggttcatccgatctccgaaaacggaaaacaatgttgtcaaagcctttataaatggatagtttgtttgaatgcttattgttgttgttaatttttttctcaacattgttcagccaatgtcaaaagcaaatgaatgtgcggcagtccccttccttggttttctaccgggtacatccacgcaatcacttcaccaaaaatctttactttcgttatctgattcataatcgctttcactttcaaattgaaaactcttactaccaaatctggtctatcaattgatgtctgttcatgaaacagattctcagagatctcctcccattgcgggttacatgtcatagtcaaaaatatatcaggcttgccaaaccgtcgaacaactgccatagcatcctgaaaatgcttttcaacatatctcggactatttgtcacacttggaggaagaaaaacttccttcccagtggcaaacctctttcttgtgctcttctaatcaacatattgtcaatattcttgtaagcatcagctaaaatccttttctgattgttctttatccaactcattctgtctccttcaatcttaacatattcatcaacacaatactgttgaaagagctttcctccatataaaatcggattaaattctctttctctaattgccaaactataacacaaatactgtagtcttgtcactcttctgttacagttctctgtttcatttcagggtgtcaaccaagcgtaccagaaagataaacagtgggtaagtcattggagtcaccatc

SEQ ID NO: 14372 - DNA, 827 bp, Heterodera glycines
tccggaatatgtactgaacaataactcgctttgaatcgacctgcttcaactccttgtggtgctgttgtcgcaaccgtttgtagccgcacatttgctcgtacaaattgttctccgcttggtaatcctgcacttcctgggcaatgattttcgttgtcctcagagtggaaaatttcgatcggcgcaatgtgttgatttcatcctggaaatgaaattaaatagcaacaaaccaaaaagtaacaactcaatcccaccacccgtactaccttaacttgttgctggtccaaaacaatggaaaacgctggcgctccttggcgctgtgcttccccattttggtcctgccccgtttcgttgttggtgttcgacgaggtcagcgagtcgtcgtttccgttcaggctgataattgtacggttccgagtcggagataaatgattgtgagccgtctcgacgccgttgttttggcactcttccgccgatggctgtcgattgtggcattcttcgccattgacgggctccttaaagcgccaaagagggtggcatttatcaaccattttgaatttggggacttcaaaaacacctccacgctggcctcgacactgcacgtctccgaaaggcgctcattgtcattagactcctccagacagaccaacttgcgcagttttccgtaccgcgagtggtcctgctccttggccgcctctttcattcgtttgatcagatcagaaatcacatttggaggccgttctctgacaacgaaaggatgctgaaattgaatggaaaattgcatttggtaaatgagtaaaccaacaaaaaaacaccttttgacatgcact

SEQ ID NO: 14373 - DNA, 1716 bp, Heterodera glycines
  misc_feature (1659)..(1659): n is a, c, g, or t
  misc_feature (1675)..(1675): n is a, c, g, or t
tgaaatgtaatttttgtcggtattttaaaaaccaattattattaaagttggaccaagttcaatgcaggtgatgccaaaggaccaaatgtcggcacgttcatcgtaaacaccgccagtgtcttgtgcgattatcacttccggtgccatcctaaacccaatttccgagaatttaagtgggttttgctttttaaatgcctaccaatatggacttccaacaaatgtttgggctggcgaactgagagacgcactgcccaagtcggccaatttgacaacacccgactcggtgagcagaatattaccagcctaaatcagtttatttgagcattttgaagatataatacatgttcaatgggttctattggacagatcattttttaaaccgaacaaatattgcgaataatgggcaattttgtcacccaaaatgagcctaatttataagtccgtgtccattcgaaaacaaacggtgctcattctcaattgtttggtgttcgcttgcctttatgtcgcggtgtatcctcttcaaactgtgcaaatgtgcaatggcgttcaaagtttgctcgcaaatcgctgcaatttccacttccaggaaagcctttttgtacacctcaaatttaatggaaaaattattaaattggatttaagggggagagaatcaccaaaaacctttaaaatatcggcagtcgacccgacacaatattccatgaccaacctgaaaataatatttagtgagtgacgagccaaaggaattttcgcaggcaaataccagcaagagtgctccttgagaaaggaggccttgtaacagacaatgttcgggtgccgaaccgacttcagaaagcgcacttctctgatgatatcgttccatttctcgaccgattgtttcccagagaaattcattttctgaattcattcagaaaacgtcccaaatcccaagaatttgttgttacttttatcgccaccgtttcttgcgtgtctttgtcaagtgcctaaaaatcgaagaaatttgtttcggtaacgtacttaattgcgaacacacacataaaacactgatccgaatgcgccatgcccaatttcgcggaggtcttcataacgctgctcggggtccttcaatgagaataattcggcgacctcgggatgctttaaatttgctggtttcaattttgtgtttgagggcatagcatcaagcttaaaaatttacaagtttataatatatagggtccgaattactatagtttaaacaccctgtttttttcctgagcttaatttgccaaatcccatcaacatgccatcttcatcttcataccaatgccaaggctgccgcactaaccccgacaaccgaaatccggttttttcccgatcagaatttttgtcggtcggcctacccaactctcgagctctcgactcgcggcaaccctgctattcggtttacaatttgcgatttcgatattcgaaagagtgtcaaaaatatttatttggcattatgttttatgagcattagacctgctgttaacggttaaagcaaaggatcttgccaaaaaaagcagaaaccaaatttcgggctcctttataggaaaaagttgaaacttttcgaaaagttagaaattcttaaaatcaaattacaataacttaagaaagtgcataggtatgtttaatcggaggttncatccatttttacttnacatttagctacatgtgattggacattgattttaaatcaaa

SEQ ID NO: 14374 - DNA, 800 bp, Heterodera glycines
tttgcaaaaaataaataagtaatgaaaaagtcagaatttcgaaaaattgtagacgagcaagcgttggcattttttcaggttaagttagtcctttacaatggagaaggcctgcaaaatttggagagattatatcgattttagtgcgctaggttcgatgaaactttttaaaatataagcctaaactttttggcctgttttaaaaggaattaaaaatttttaaaaattttattcatctcccttttgatagaaaaagcatcagagagccttatttaacttttaatgaacatttggtgcgtttcagagcagtttgtgaaaaaataaaaaaatcgattttttcaagtgtccgtttggggtactcaaacaattatggggagcaaaaatccaacgcagaattaaagtccaggctatagggaagctattcctgaagtactccggtttttccataacttttgtctcttcccccccccccccctctcctcccccctcttttgccacccctctctctcttccccccccccttttccccagccccttccgtttccccggtgtttcttctgcttcttccaacttcgcataattttctgcctggcttctccttgcccaccccttttttgactgctcattcatttgcaaaatgttgggacttcgtcgacttttttggccgctgtctctttcaaataaatccaattgttcagcacatttttgccttttgcttcggtagtcgtcgtactttttgcccccgggggttgttctgctgtaaaagatatcttctgtttctgctttttgttgttgttgtccgc

SEQ ID NO: 14375 - DNA, 3147 bp, Heterodera glycines
ttctatttcaaaaaaaaaaaaatttcaagggcagggcccctccttcccgaaattttatttttttaaaaagaaattgaccccttacaaaaaatttcggttgaccaacccacatgcacaaaaaggaaaaatactacaaatggcaacgggtgtaaaatcgccaaccgccaggaaaaaaaatatttttttcttttttgaaaaagtgtaccgtgatgagatcctggaagcccacgggcttgtgaaggtacggaatgcgatcggcggccatcatctcaacaaaaaattccaccgaagccaacgagccaaactcgacgatcaaatggccactttgtctgtaattccacgcctaaaacaccgacagattatacagagagcaatgtgcaccagagatttcaaatgagcagcttcgcccaaaaattaaaaaaaattcatatcgttagattttttaataaaaaacaattttgaataaataataatatagccttaaatttaatattatttttgtttgaaatttttttttcaattttcgatgtggggatcgtaatgcacccgatacagaacatatgcagttcaattcttaaaaaaatagataaaactcggtttgttttttaaattctaaaccgaatacaatctttggcacaacaattaaatttccctatgaaaagggatttttttttattcgattgtaaactgtcaaatttttttttttttttgctgcagcccaacccaaccccaaagcgcataaacgcacctcgaacgtttcaacgaaacggacctgcaaaatggggacaaaatcatttaaatattttccatccctttttattaccggcccgatttgctgactgagtttctccttgagctcgcgcccgcgcattcccaccggcacattccacatgtaaacctggcaaattggaaaatataaaatttcatttgcataacaaattggagatacaagagtttagcacaaacttgaaaacttaagccgaggtgaaaataatttttgtaacatttttcgtttttttttgaggcagggggggcatcagcggatatcatatcagtattcaaaaattggccagcacagctgaacaaacattttcccatatttttgccctataaatttgcgtttatatgcctaaaaattgtgtaccattttattaattttgtggtattttttggcatatatgctaaattttggaccgcaatttcactgaattcgaccactgtttaatgcttatcaacataggtgaaccaaaactcgtggttttttccatgcaaaaactcaccaagaagttggaggcgacgttcaggtgtggtggcgcccggcgttcacgctcggccattttgtttgagtgcgggtggcagtggtaacgtacgatacaatgctattacaaaatgcaaattaaaaaaaaacaaaaataaaaaatatgaaaaaacaatatgacgaggcattaaagaaccccaacaatcaaatggatacaaattggaacacagaaacccactgtattattatattatcgtatatgcaatgacggctttcaaaaacaaaaacaaaaaaaaacaattaaattttgggtgccctttttcatgttcggtccatcatcagtttggcctgctgttccgactcgggttcgccttcctcctccagacgttccttctccttgacagccagcaccttttgatggtagaaaaaaacaataattacctaattaataagtgctgcaattatttgacagacaattttagctaagaaaatttcgtaattcgctataactttaaaaatgctattcgatatcagtgagcttaaaaacaacaaaatatgaatttttaaaatttctcgaagggcgggggtagaaaacatgaaagtacaaaaaaaaattttttcatggcaacgaatttgtctgaaaattaattttaaaaattctggcagagaggcctactcccccacattcctgtcttttttatcaagcccatcatcaccaccgtccaacctggtccaccatcgacgcctcccatggttcaactcggtgcgactcatggtacactgcggtgagcagatatgcgatgtagtcgaggttctgacgccgcagggggcagctgagattattttaaaaaattgctttcagtaacgaaaaattttaaaatttaacaaatgaaatgtgataattattagggtttgtcgggaccgggaattttgaggttgaaaaaccgggaatttcccggtcatggtcaaactggccaaaaccgtgacttcggtactcagttttacgtgttttggtcacggtcccgaccaactctaatgattaacgataatttgaaaggctggcctttttcggtccagtttgtacaattatatgaaaggagtatttttgccaaaaaaatatgcctataccctcataaaagtttcgtttttcatatttcgtagatccaattatagttagaaaaaccggacttgtccgccttgaaggtcacggtgtccgtctcctcgtcatagcgatcgccaaccaactgacgacatttgttgtgcgcatgagtgtcctaggacaagaaaaaacattttttaaaaaattccactggttgtgaattcagttttcggcgcaaaaactactacaaatccctgcttttctgccccggtgctaaaatttaggaaaaatggagaaaaaatcattgcacggaagagcaaaaataaaaacaaaagtttcgggcgactcgcatgaaaacattttgtaaaacacaagtcatgtatcctaaaacagttcttgacttttgacaattaataatgacaaaattgcattagttgttattttgaatgaccgttatatttttggcaatttttttatttttttgaattttactctcagatttatgaacaatgaatgaaccgccaaaattacccccaaaaaatgcgtttattttggctctaatgcactttatgagtccaatcgacttttatgagagtccaatcaattggacaatcccgggtttttatacaataactttgttcatgttcaaacaaaccctatctggttggtatcattcgaaagcacaaagtctgaataatgtaataatacgagaaaacaagagaattctaacattttaggaaagttacaaacgaaaataatcagcaattaatttattaatcaattctttttt

SEQ ID NO: 14376 - DNA, 3275 bp, Heterodera glycines
  misc_feature (3109)..(3109): n is a, c, g, or t
  misc_feature (3203)..(3203): n is a, c, g, or t
aaaaaatatggggaaagactaaaaaatcacgggttttacacaattgggaagaaaagagaaaaaatcaatgatttaacaacagcttttaaaatattaaagggttaactagcctcgatgctggtaaaagcttccttttctcagaaaggctcaggaggcctttacttttacgggtaaagcgccacacggccaaaactcaaaataatttttcaatagaatagtaaaaaactggaataatcttccagtggtagcggtgcaaattaataaggcaaaggaattcaggggtttactaaaagcaatgagttctgagtaggattttccatgttgccatatttacactatatttttatcacctgtgaatttttaacatttgatttatttttatatattttattacggtattcattttgtattttttatttgatcaaatttatttgttttctttttgataccatgtaagagcactaatgtgcctttggtttgctcgataaattaaattaaattaaattagattaagaaattccctggtagaagtagaaaacaacttaacatctttttgaattttcttagagttcattcttctgccaattcttaccgtctctttctcttacgtcctttcggcaccgttgctaccgtattctctttaacatcaaactccgttggaatggtacggtagagttgggacattggggcaataccattgcaagaacattggcatttggtattggcacatttgcgcacgataaaatttattgctaaaaaatattttaatgtatttttagcatcaaaatacataaaaataaaaccattataatttgggattaaataaataaatattattgtatatctttaaaaatgatttttaatgtatctttaaaaatgatttttaatgaagtgtttttttattcgacaatttgagaactgattcacccaccgcctcctccattcactcgccaaaacgattatctggctaaattcccttggctagaagccgagcatcaaaagattagcaattaacggtcctccacactccgccccctttttgcttctgctgccttggccactcgccgtcgcatccctttggtttgattggccatatgccgcgccgctcgaaattttggcgcaattttttggtgttgttgcaattggtttaagctattatagaatggagtggatgacaaactaacttatcaacatttattaatttttggtcaattgaaaatgcaacttcattcaaatgagtgacagttaaaaaaaatcccacttaaaggtaaactttccgtgaaagaaaactgtttttagtccatattttagtgatagtttgcactggttttatgaaagactccggtgcatttagcaaaaatgaaaataaaaaattttattttataatttctacaggatgtttattgggttttcatgtttatctcttttaaatctatcctaatctcttgcaaaatcccttctgccgctgctccatcactgctccgtgttgcccttgaccaatgccaaaagtgcgtctcggtaagctccgctggtgtcccctttgatcgcctcctccaggctcttcttgtgcaacgtgtgaaaagcgtgcttaatgggatggcaaatattattgttaaatctataaataagaattaattaaggcttttgatttcttgaacattcaattaacagaatttaaatttgaaagcactttgatgtcagccaggtcaatctcagaccgagaaatgaccagacgaatcaaatccgagtcgcgtgtgccgagccctgaaaaagcagagagattaataaataattaatgcagttaaataagtaaattgttctgattaataaatattgattgatccattaattattaaatttacctttcatcgaattgaacaataaatccgcaaaaaacacagaagcgttgcggacatatttgattagtgccaagaaactggaaatgaaagcattaacagcaaatgacattaaaaatccaaataattataaacattggatccaattagcctaattagactgtctccccttggttctcttatacaatatcatcactaattggttcccgccccttctcccattaccccgtttcgttgtgaccgctgaattcttgcttaattccctcctcaatctcgtggtgcgcggcttgtcggtaaaactcgaaagtttcccgaagctgaaatttttaacaaattatttgcaatcatattgttaaaactgtgaaacattttcaactataaataattgattatatattaattttaattaattattgtctggtaatggcaaaggctttgataagttttgtttgcctgggcgaagctgcgagtggcaaacacctggttgaacaccacggcgttaacgccccgtcggccctcgccctctctgaacagtttcatggcctcttttttattatttgctttcatttttcatgttattcattattttatttgttttcttgaaataatagttttattttttcaatttgccatttaatgatgttgtttatgtatgtgctaattgattattttattaattttttccaatttgccacttaattacgtcgtgtgccaatacaatgcttgcgggcgcactttcttcgcgagagcagctgagcaaagacaccaacagattttggaaaggtcccttcgtcttcgctttgatgtcctcctccagctgattgtgctgatgccttctgtccaactgctcatacgcctgcttcagcgccgttatttgtcggtttatgcgcgtcgccaaaatttcgattagcaccgccctacggtaacaccgtaatgaaatgtatatacggtaagccatgaggtaaactgtaactagaatccaccatcaattcgatggcttatatgaacattaattccgccaatttttaaaacaaatagctaagtttctcctgtggtcattatggcgtttataccgtaatctatcacttaaacctgttgagctactggcgttcctttttgaagttctctccatgtgctttatcccaattcaattgtaaatgtactcactcattggagccggacaatgcggcacgcatttggttggcatcgtaaacggcgggcgtttgcatcaaagaaatgctttgtaaatttanatttaaatggctgtttttgcattttataatttacatcagttcttcaaagtcgcttttgaactcctttttcagcatggcaatcagatcagtgccngaattgttttttgaactccaagccaatgcttgacgctaaatttatgaattttaattaataatgttaaatttg

SEQ ID NO: 14377 - DNA, 1737 bp, Heterodera glycines
  misc_feature (9)..(10): n is a, c, g, or t
acccgtacnnggttcagttcgtcccaccagcgaccgcaagcgtactcgaagccatcctcttaagcaggcaattagtagccacaattatcaatttgtatcgaactgttcgaaaatgttccgccattcattgccaaattttcgcctgcccagccgttccacgagtgcgataatgtgcatttgttggcccattcatccgcaagtttggccaagttttcgtcccattcaaacttgcgcatgttgcccgcctttggcattttgttgccgcccaatttattgtcggcattgcccagggctaattgcgatcggaatttgttgtgacaattgacagccgcttctttgtcctcattcgttggcgtttttgtgtattgctggacggatgggccttgaaacgattagcaaaataattacccaattatcccgctaatgaatttaaacaattgacttaccgaaaagcatgaaaaagagggcgattaagttaatcaaatgcatttgattttgcttgatttaagttgtaatttatggttttcttctgttaattttttcggcttataaaggccattccgtccgttttccattgaaaaattaaagctgaataaatttgattaaattttaataatattttctcctcataacttttcaatgaattttgacagaaattaaattggcttactgaacaaataaataataacacataaaataataaagttctggtggccatcccttttcatcaaaaaacgattctcaccgctgcgactgttcaaattcaaaatttattgaatatttcaaactttaatattgttggaattatgtatatgtataaatccaaaaattaattttacttaagatatgcctaaaaaagatcttttgactggtcttaggattttcaggcaaaaagtgtgtgaaaagaaaaaaattcggtatttgtaggttttgtcaccccctgaaaaaaattttaaaaaaaaattttttctaagccgatatatgtgaaaactagggatgagaatttaagtcacgaaaaatctcaaaaaagttgaaaaatcgcgccaaaaagtcacgaaaaagtcataaaaatgccaaaaagtcacaaaaaatgccaaaaaagcactaaataaatccaaaaaagtcctgaaaattagccaaatgtaattaatagggattctttttttaggcaaatgcctaaaattttttcgcacttaatacgaatagataagcacgaaaaaagccctttccgcttggtcttgggtgcgtacgatgacttttataatgcctatttttgcctatttcggggtttttgtgtagaacacttttgaagtcattttaaggtcatttagagtcagcaaaaaaaaagtcattagacttaaattcccatccctagtgaaaacgaaaaggtaatagttaggtggttcccccacttttggcagaaattttttgttttaaaaagtcgtgaaaacatgtttttaatgggttttggggttgcttgctgatcacgaatatggcatccattttggcctatttcgaatccctggcccgaactaaacaaaagtcgaaaattcgaatttttcagaaatcacttatattatgtacgaatcttttgagactttttgttcgagttcgggtctggggttcgagataggacacgtgatcagcacataaatcgtcctagaaaaaattatgaaaaaaatttcaaaggggtgacaaaacctacaaataccaaaaattcgtcgctcggcttttaag

SEQ ID NO: 14378 - DNA, 3995 bp, Heterodera glycines
  misc_feature (3967)..(3967): n is a, c, g, or t
aaaaaattttattttagaaaaatgttcgaagccgggttcgggcttcgaaactgagccaaaataaggccggattcgtgctcggcgcctcagattaccctaaaaacaattttctaaaattttatttaaaaaaaaaatttcgggaccaataacctataccattgccaacttcaatggcctccatgcgaataaaccatcgaaaaccgattccccgacttactattccgacaaaacttcgtcattgctctcattgtctgcctttctcttctaaaataaatttatatcggataattcaatcaaaagggttaaaaatgcaaccaatgttccatttttcttccgaggaatgagtgccattcggtcaatgacaatgccggcgaggccctcaggcgaaagatggccaaattcagagacaatttgcgtcagatccaactcaggaaacatttcaatctaatttaagcaaaagataatttcaaaagtttgagacttattttgcgctgaaatcactcacgacatctctgtgcacaattttcgggtctgtcccttggtttaattccccgtccatttcgaactgttattattactggcgtcactttcacaaccaccacacctcaaaacctaacaaagtgaaaagagaaattactgaattagaaaatgtttgccaaataaaggagagagacagaaaatgtatgacggatttcgtcccagtccaaagttccctaaaagatggacgaaaccgaaatcacatgaagcataactccaaatgaaatttggcataacgtttgttcattgatttaaaaataataaagtaaaactggaaatcggaataagtcctaatctatcagcaaattgatcctctcaaaaaatacccatgcttttgttaccagagtcattagtttaaggttattttttatttcgtttctcccttaaaaatagactaaaaattatatatcgttcttaacaaacctataatatttttaaaaattttgcccttcgtttggacccttgtaaaatgggaccgtttccctaatcccgacccggatttcaaaattccaggctctaaaaaactaattcgaagtttgaaaattttttaagttaaacaaatgaaaatagtaaagatagcattacttattaacgaaatgaaatgagttcataaaagattcaaacttttatcaaaaaacatcatttggtgttattgctttgtgatttgagctctttggtcgccttgtaaactccgttttcaaaaacaaccaaattctgtttgatttttctctgcataaatatttggacagcttccaacgagggtgccatttttccgggacttgtgaagtttttgaacatccgatgcaaaaattgggcagtcagaggttcacaagttgccctgtgcataagctgaaagaaaaggcaaatattgagcttgcagaagaaacaacgaggcaaccgcttaccaaaccctttgtgtagttccaatactgctccaattcctcggccacatcctcaaccaacggcttctcctcctcctcctcgtcactgtacatgtattcgtaaaaagtgccgctctgatggacagcgctctgagaaagattagattctatgcaaattgctctaaaaataatataattgaatttataccaccccttaatacctgcttcaaatagttttcaatggcttccgttgtcgagactaaatagaatgtgtcctcgagagttatcgggtcactgggcccttgggagagaagtcctttggatgtccaccagtccaaccgcttccttaggtccaatatttccagttcggttgcctcggcaagtgatgcgacgtcccaaatctctgaaaatgagttagacagttattactacaactatttaaagagctatttggaaaagaatattttaaaaattaaaataaaaaattcttaaaaaagatgaaaattttcgatatttcttgtaggtacccctatcaagatcatctgtccaaatcgcaaaattcgctggaatccagatttttttcaactgaaattgattttctttgctaatgttttgtcccggcgaagttttgttcttctccgtgagaacttaatgcaccccactagcattaagttgcttcacaaattcaaaacaagtccacttacccttttccgtgaaaagaaggataatttgggcttgggttaatggtgcaacaatttgaacatttctcccatcaagttcaagctccaattccacctcaattaaacatttacttttgttagtatttacgttccgtttacttgggcattgtttgtgtgccaatttatggaccttgccggtttgtgttggataaaaatttcagtgtaacgactaactgcttccttaaagacgggccgaaatggcgtctcgctctgctggccatcattggcaacaatttcaggccaataattgaatgaaatgatccgtggacaaacggaaaatggcaaagatgcattcgcatgacttgccattttacacgactcgcgaatgtcacgcagcataacctaccaaaatgaacagaaattccaccaaccgcagtcatcccgaggtgtgcaaagagactgacctcgcaatggttcagctctccgtcggtgaagcgccgtttcattgtctccaaataattgaactccgactgcaaatagcggtcccatccgttgtgcacgagtcgctccgccagcaagtgctgatactccttgacgaacaggtccttactcccgtaaatgctgaccaacatgttgaacacgtcagccgactcgcgaaaaaggcgactttcttctgcaaaaagggaacaatagcttaaaagattcaaaaaacaaatccaatcaattttgattaatgttaaaacacttcgaggccattttagaaaaatctgttgacaaatcccataaaaaattgccaattgccgtgtccgaatttttttctggttacggatccgaatgaatggaatgccttttccgcccttttgtcattcccacttggatttgcgtctattgggtccggcgtccattccatccaccgattctccaaattgtcgtcaatcatgatcacgtactcgtcattcactcttaatcattggaattttaaggaacataaaattaaagttgttccaaaaatgtaattgaatgggtgaatattttctgttttattccatcccaaactccactcgtgcagttggtcttcgtccagcatcagtgtcagtcggttcgcatttgcaattgccatttgcgaggattggccatcgcccggcttctccgtggtgataaatgttataatcgttcgcattgtgtcggggcgttgtctaaaagaattgctaaatgcacataaattggtttggtgagcttcggtttacttcacatagtcgcgaatgatccgacaaattctgtggacaagaacaaacgaacggtcgcattgggccaaatattcgacgattgtcgcataacccttcaaaatgtcgtgggtattgactcctgtgtaaacacaaaacaaaacaatgaatccacacattccgccaaccaatgtgcagcagtctttttctgaccagcttctccaatttttcggaaaattgttcccgcgaatacgaatcatagtgacgaatgagacttttaatacgcgaaatggccgaattcctatagaaaacatgccggtcgaacatgtcaaaaagcataaaaacaataaaattctattgaaaaaatatcaaacaaaataattattcagcataaacaactgttaggtgcacgaagaaggaaaaggtttatgttgagccaggaattttatccaacaaatgaattgaccaatatcaagcgaaatcaaatggacccgtaattggtttggagttgaaattagaaatattagcatcggctgttcctttcccgggtcgttgtttgcctcgactactccgcgtcaccatcttcgtccgacaacaccatcatcgtattctatagtgaattatgctttattaaaagataaaaaanaagatattggcttgccttggcacattga

SEQ ID NO: 14379 - DNA, 3757 bp, Heterodera glycines
tgattttgtttaaatttctaattgtaaattaaaaaaaaaaatttacggctaggggggggggatgaaacgagggggagggggacgaacggttcctgttttcccccaccttgaatcgtgtgtccggcacattggcaaatgcgtccttctcccactgctttttggtgttggctttggggtcggcattggtgtcggccttctcccacagcttggtgccatgctcgcgtttctccagctcgtattcagtgatcggcgtgcctccgtcccgcaacggtggtgcccaatggagcatgattgagttgtaggtggtgtacagtgaatccggtgggtagggccgccctggcacattgaatggcgcgttggccagcagcggttcgtccgcgcagcgcacctaaaaaattggaaaatattaactcattatttcaacaaagagtaaagtttaatttctgggtcttttgtaataaaaaattaaacacaaaaaatttgagtctaaaaaagctttggattttataaatacccaaaaacggataaaaataataatatttgttatcataaattcgttaattaatgataattatgcatgtttaattaatattaaatcaattaaagttgattaattaaatgttatttaaaaatttaaaaataaaaaaaaatacaaaaattttaattataaaactaaataaattttaaataaaatcaattagcaaattgcattcaattttgcaaaatttccacggggcgtctgcctattggcaccattggatcttaccacccccccccctccaaaaaaaattaaaaaaaaacacagagaaaaaaagtggcaagaagcaaaatttggccccaccccctcccgcctcaaaattattcccacctcaaccgtcgtcatgtcgagcagctgctgctccccctcactgtcggccacttcctcgttcggtgcctcttcgtccccagcgtaagccgctgctgccgcctgtgccggccggtccgccgcggtgctgccaacgcgtcgccttccgccaccggacgcggtccgctcctgttcatgattttttaaaacattaaatatttaaaagttttgtttcgattatggggacaatttaaagcaaaaattttacaaagaaaaaagatcaattttagaaaaaaattttgaatattgatgctttagcggaaacatgatcaacagaagaggaatcattgaaaaaaaatcaaaaaaaaatatttgtaaatattttataaaatgcaaaaatatgcatcattaaaaaaaatttttttttcagttcattataaaaattttaaaaaataatttttctcaaaattcccaataaataattaaaaaaaaccgaatttgcttaccgtatttttgggtcgtggcagcgtcaagttcttgctacaactaaaaaataaaatgaattaaaaactttttttttttcattttttgttttgtttaaccaaccactgtatgtccaagggggtcaattcaatggcatcctttctggtacttctgcgcggctggcgacgacgggcggtggaggacaatggttggcctgctgatgagtctgaaacaaaatgcattattttaataaaacatattctatataaaattatgtgaaaatataattatttaatttgaaaaaaaaaacaataatttattttctttagtttgaaataattatttttaaaaaattaaaaaattaatataaatttaatattataaatatatacataatttaaaaaatatatatttaaataaatgaaaatattaatttgataaaaaagtaaattttaattttccttttttagtgaagaaataatataattaaagtacaaatattttaaaattaaattatcattaaattaaaaattaaaaatgtccgtggaaaatgtttaactattttgaactaattaaaaattataaaaaatgaaacggtttaaattaaaattgaaaaagagacaagcggataatcgtttttgaactaaatgccgaactggtaaagaaagccttttatctaagattttccatccaaactcatttcttacccaaggatggtccgatgccatgtgcagacgaaggttgtgccgttttaggagttcggatttgcgtggcgtccttttccttttcgttggcacgctgcgatttcaacggcacaacactgggcttctgcacagacacttctttgctggaaatttttgtgccatatttaaatgaaaattaattttaaaaaatagtaatattttgagggctcctggaaaatgcgtcagtggaaaaggtgccagtaatacagtatttttataataaagttactactgtagcattaagtattgtattacaaaaggtcgaaattgcactgattcactgacgcattttcctttcacgatttttatttaatcgaaaaaattgaattgtcaataattttcttttgccatgtctttaaatttgtgtcaccatcaaaaaaagaagaggcactaattttttttttttgaaatttctctgctgactttatcacaatggtcgggcaagcgccagccgtctcctcgatgttgatgggcaacgtgtgcaacgacggtggactgcgtccgtgcgagttgagcgcaatgacacggaattcttcaaaaagaaatttttgaaaaaatttttttgtttacctactaacaaattaaatattaaaaaaaaaattaatgattcatcataaaattttagaaaaatcgcacgaaaattttcgaagggggggggacgacgcgggagaaagtgaagtacacatttaaaaacaattaccgtaggcctggaactcgcgcaacccgggcaccaaaaactcggtcaatggacactgaaattttaacgaaattgtaattaaaataaaaaaatctttttattgggacccattaaaatattcgttgtgactattgtatatggaaataccgtaccatatccggtgttgccatctcccattgttcgtgaccccattctcgcttctgcacaaggtagccctccagtttgcagccaccgtcctcagctggcggttgccaagtgagcgtcacacaattaggacctgagtttttgtaaaaaatcaaaaatattatttttggcgttccgtctctaccaatggattgtgcgtggacttgaattggcattcccggcggaccatagcgttgtcgcaatttgattcggtcggattggggcgacggtttgctccaacccgccgcattctttgccgcaacgcggaacacgtactcgccccggtcgctcagattttgcactttgaaatttgttgaccaggtcgcggattttttgcatgtaacctaaagaaaaaaaaaaaaaaaattaaattttgaattttcacaaaaacggggcaatttttttaggatattcaacgcataatcctaatgctatgaaaattttctttgtattttttataaaaattttcgtttttttctaaatttttttttaaatttcgggtgtgggaagcgagctgctcacttcgagaaaaaaaactcaacaataattacaatacacaccaaatactccataaactcacccattcgttcgaatgttggtccttgtgctgtagttcgtagccacgaatttttgccccgccgttggatgccggcagctcccactccaattcggcccatgttcggccaaagttgcgcaccacggggtttgtccggctggcttggcaccgagtacttgacaaccggctcaggcaacacctgtgttttaagcgagtaaattataattttttatttttaaaatgtctatttt

SEQ ID NO: 14380 - DNA, 1681 bp, Heterodera glycines
  misc_feature (15)..(15): n is a, c, g, or t
  misc_feature (76)..(76): n is a, c, g, or t
tttataaaatttgcncaaaaattttccaaatttgccaatcaaaaactatagatataaaataaaataaatacacatntattaatgacaaaataaaattctaaaaataatggattcacaactttcgatgttgatgcacaagttgatcagataccccacaaaattgatatgcagtgactcaattttagccccgaaatctacttgaaaaacgaaaatttgggaaaaatttacatgaatttttcagattattattcgcctcaactgcttagctcataaaatcacattataaaaatttaatttttattacccaattcttcaaaaaatttatttatttttttttttgtttttagacaattcaatccacaaatagtggtccacaaaagtcggtccgcaaatgtcggcgaaccgttcgatcgcatagtcacaggacagtacgtcagaagtttcgacgcaatattgaaggagttgagcgtgttgtataggtgacgggacgttagtcaaaaaccatcaaaatgggcgttagtcaaaaaaccatcaaaatgaaaaatatcgatttttgggcgttagtcaaaaaaccatcaaaatgggcgttagtcaaaaaaccatcaaaataaaaaaaaagatttttgggcgttagtcaaaaaaccatcaaaataattttatgcgtagctgatcaaaacgggcgttagtcaaaaaaccatcaaaataattatacactatacgattatggcctatatgcatgcaacactcaattaatgccaaccacttccaaaatatttgccgcactgattattaattaatgccaaactatcatcaacaaaacaaaaccaaaatatttacgcaaatgatgacggcacaaatttattaaaatattcgataatgccaaccaatctccaaatcaccaaaaaatataaacattttattcttgatttttcattaataatgtaaataagcataaaactctcatttagttattcatgtaatttattaaatataacgaataaaaaattaaataatttctttttaggatggaaattccaaaatctgtttatataactattatttttttattcgttttattctttataaagcgaaattaaaatccatctataatatctggaggaggtagaacttcaaattttgattcggttataaataatgaaacgatcaaaaatttgctgaataaatatgaaaagggacaaattcattcaattaatgaattattagctctaattaacgctcaatcgtcggtgaaaattagtaaaccaacattagagcgctacatggcaaaaatcaaaaaaagtcttggagctgcttattttgtagcaaatcaaaacagaaatactggtgaaaacttcatagttcggcacgaaatgagaacgttttgtgaaaaatgggactataatttcggtaaaaaattttcaaagaaatcctataataaaaaatttagttgaacccgattttatctttggaaacaattttgaatttaatcccagtcgttttggcccgggtatgttggatttatttaaatcaactatacttttaaaataattttaaaaggccaagtgtctccaattattggtgatggtaattgtttttatcgggcgttatcattgttgctgactggtgatgataattaccatacagctaaagaaataggcttgactaatggaatttttggaaa

SEQ ID NO: 14381 - DNA, 1555 bp, Heterodera glycines
tgctatggatgcatcggaacattttaaatgggcatctaatcttgacttcctatgtgctgcaaaattgtcaaattaaatgttatcgtttgtagcccaaatccacaaaattccaaaaacgaaattaaattcgtatggaatgtttatacaccgaattcaaaaaaaaacacggtaaagaaaatattttgcaaaaaataattccttctctaggtattagtagaccaagatccagaatacaagtcagtttttaattattatgatggaagtggttcttttaaacaattaatttgggaattttttatgtaaaatattaattttcttataatttttttgcaaaattctttggaaataaatttgataatctttgattatacggctgtttggaagtggttggcattaattgagtgttgcatgcatataggccctaatcgtatagtgtataattattttgatggttttttgactaacgcccattttgatggttttttgactaacgcccaaaaatcttttttttttattttgatggttttttgactaacgcccattttgatggtttttgactaacgacatagcaccatcaaaactaaggacatcttagaacacaagaatgccatttccaaatcaggacaagtttaaaacattgggacatgccaaaattggcaatgattcctcgaaattccggacatatcaggatacacgattgaatatttctaaatcaggacaaaataaaaaattgggacatgcaaatcggcattgcagtaatgactcattttttagatttgccttgatttggaaatcggaaaactgaagtcttgagatgtcaagaattttgaggaatcatacgaacccagaattacaacaatgccaattttaagctgatgtcctcagacgtccgaaaaaaattcataaactcgctattctagtgtctaaatttttcaattttgaattttagaaaaaattatttagtttaaaaatatagcataattgaattttttctaaaaaattaaaattttccattccgtcacattaaatattaacattttgagtttttctttaatatagcgccaaaaattttctttcgaaaatgtttttgcaaagaattgaaaaccaatgggtcaaaggctgagaaactcttggaatttttaacagatttttaagagatttgcaatattaagcattcataaatagtaaatgccttttcacttataattttaacaataaaataaaaaattttatgcatggagaaaggataatttcattggcatttaattacaatttttgagtgccaaagtcttatgattctcaaaactcatggcattttgaaagattctaactatccaaagtgacaataaaattaacagaaaatgcataaaactgtaaaaaagaaaattaattaatcatttttcatgtaacagttttaatgagatttttaaagagattttcatcatttttcatgtgaaattcataattatatttttattaaaaagttttgaaactttccgtctcacctctgaaagctaataattaatccaatggttttttgaaatagcttaacaaa

SEQ ID NO: 14382 - DNA, 1517 bp, Heterodera glycines
cggtattcatcgatacggtgctagtgagtttcttgaatcgcaagggactcgaaaacaaaaaaatttaatacatcaaatcataacttgggtcaaattcaaccaaattaatatttcatgaaatcattcaaaagctctaggtgttctctatcagaatattaatttccaaaatgctttataacattttttaaatattttttttaattttattaatcacgataaagatatcgctccataatattaatttggttgaacttgagccaagtatcaatttttatgtgttacattttttttccagaacccattggcggaagaaacgcgcaaacccatatcgcgaaatatgacaaagaatctaagtatcattaatataaaatcaattacaaattctacactcatacgaatgattttaatttgatggtgtgggattatttatgaggtcggaataatttttgaaaacgcaatttttatgtcgttttgtcttttgaaataaaatgcaatggattttttgttttaccgcatgtgtggccgagtggttaaggcgttgcgtttatatcgcaaagggatatttcctgcgcaggttcgaatcctgccgcatgcgtaccactttttttgttaaccaacatacaattaaaagtagggaccagtagaattttgctaaggccgaccggactttgaaaatataccgggacgttcccgggatcgggactcccggggccctaacccaacttttgaccgggatctaggactttttcagaaaatttgaaaaaaaagtttaaataattcaaatttttcaatatgttctctacaaatgattagggacaggtatcgaattatatttataccaacgatcaaagtatgtatttaaaatagcaaaaaattgacgaaattattgaataaaaatgaaaatttgcattgcaaattttaaagaaatcaaaaaatttggaaaagaaaaacatataaatttgttgattaattttagaaaaatttctttttttatgtggatggattttacggaggtttttaaatgcatttttgaaaatgagcaaaaatataacaaaaaattttagttaaaaaataaagaaattttagtggatttgttggattgattcgaatatgcggggttttttcttctcaaaaattgtgttcatccttctgagtcgcatatttacgtttattcaatactttgtttttctttacatctcaagtcagtaaattgaaattttcagctgcacatttaattaacattttcattgaattctgtttaccatttgaattaaaaattatatgccattagcgtaaaataaaaaatttgtcttgtcgtacctcagttttttgatttaattaccgtgctgtgaaataaagttaatttaaatttaattattgatttaaaaaaacaaaattattattagcccattattttatagagaatcagtgagactcgccatgctttagggtcttgcttcagatcaattcccgggtttttcttgaaaaataaacaataaaccaaatgagaaaaattt

SEQ ID NO: 14383 - DNA, 2630 bp, Heterodera glycines
  misc_feature (59)..(59): n is a, c, g, or t
  misc_feature (72)..(72): n is a, c, g, or t
tggtctttactttttcttatttgcatacttcaaagtatttcgcgaacagttggcatttntaaataattgttnggaccaaaaaaccaaattctaaaaattttgacacaaaaaaagaaatgattattagttgacaagaagtcagttggcgaaatgtaggcgaaatgaatgtttttggcttagttagcgaaatgtagttgtgccgtcgttctcgcacgaaaataggcaaaaaaagaagcatttttcggcactttttaactttcaacttattattctcaattcaccatcaattcgaattcgactttcttttagattattctagagtgcaacgagaccgggaatttttgcaaaaaccgggaccgggacttgccgggaccaaccgggaatttaaaaattcaaaaaaattcaaaaattttttaaaaattcaaattttaatttttttcaactgaaaataatacaaaattaaatttttattttgttttttatttaataaaatccaaaagttaaagctaaattaaattaatgaaaattttcaaacacatttctttaattatttcaaacaattaatcattttttaactcaaatgatcgaatattattagaaattcagatttgcttttcacatcactttttttcggcgcgctttttccgaaaaacttttcgtgaagaagggggtccggcggtgccgatagtcgttgccgggggaaattttgaaatttgggtgtaatttgttaacagattttcaacaaaaaaggttggtttttgggattattaagctcaattggtaggattttcatttagaaaaatgataaaatatgtatcaatttaaaaaaactatgaggaatcatattttgtcgataggaaacccatgagtatacaaaaacaaaattcaaaatatcttaatttctgtagagggactgaaccaggggaaagaagaacccaaaaatccgagaaaattcagtaatggtaatcggatttcagagaccgaaaaaaccggaaatccggtaaaataaggataaatacacattccaaaattaaaaaagaatgccattgtaatcaaatctgctgcattcaggtgctgcaatttcgccgccgtcgtcggcgtcgcaagcgaatgaattcggctgcgctggcactaacagattccgacctaaatccaggccgtggctttctaaaattcattacaattatttttggattgatgctgtgttacgagattctccaacaatgttatcatgctggtggactcagcctattagaacgccaattaattgcaaatatggttagaacgcgaacgcctcaggcaattaaatgtaaagagaatttgcagggggaggggggggggagggtaaatggaaaaaccctaacccgaatattcgtgatgttttttacaacacaaaagcggcatcgcgagggggtagtactgtaattcaattaaaatatttcatttgagcggcgattgatgctttcaatgcgttggacgaaaaattttatgtggcgaatgaggaaggcaattcttgcccaatttgtaaagagattgtgcccgggacaatggccaaaccgttgtcatgtaatgtaagaaaaaaaacaaaaaaaatttatttatttaaatttaaatatgcaaattttagcacattttccacaacgaatgcattttagcatggtattttttgtatttgtacatttttaaagagaaaatcatttttattaaggcttagcaatcatttcacatgtccatactgccgctttggtaatattttaaataattataaattattcgatttttaaattattaaattgggaaaacagttttcctgaaatttctttaattgcctgaaaaattttgttttatatcaattcctgcagtaatgctttaaatcaagaaatggcaacccaaagtgccttcggcgtttcgtcaaatggccaagagaatggtgccacaaatggaaacggagtagcccaaagtactgctgctgtgggaaacccacccgaagtggtcattgatatgccatcggatgggcaaaacggtggaaacactgttggaacggggacggacggtaccgaaacaaatcgacacaacaacggcacggcaaatgtgggataaattggtggacgaattaagcagatggggtcgacgaacgggtgatagattgacaaacagtgattgttcattgacaaatgacaaattgttgtcatttgtcaaactccaaaaaaatgttagagataaaaattagaaaattctaattttttgtgcgctgcttaatcccttagaaatagcttaaaaattcttttaaacattaaatctttcgcaagggtgtctcaggtcaagggcactacgacggacgattgagacagggggagggcggggggggggggggtctcggtacagagttttcatacgaaggtcataacttttctccggaggcgaccttttatttttatttttttgttatctcgagacactccttgcgcatgtatgatcgcaaatgaaaaaatggtagtgaaattaattttgtccacaaaagaaattttttttttcagattttccctgatgcatatttcttcttaatgggttagtgggaggaggcacggagaggtcgataacgaccagaaaaaattgcattttgaattgga

SEQ ID NO: 14384 - DNA, 989 bp, Heterodera glycines
ctaaatttacaacgtttttatttttaaatttagtgtaaatttgcatatttttgaaatttttccttctcgttttctcattggctaatgcatacatcaataatagacaagattaaaattatattcttttatttaaatttatattttaataaaaattatattttgacttttgaatactcaagaatttttttgacaaacatatgccgatttagtgtgaagaaaccaaaaccagtagagtaacttttctgactttcagttgttaaaagcaaatataatgattatgttgctagatattatgtttgcatgcttagcaattgaagttatttggacccgaaaaattttgatcaaagatgatttttgattatgtttatagtaatttttttttatttaaaacaaatttataagttatcggttcatttactccgttttgtaaataaagttatagataattttttgtattatcagaattatttggaattaaaaacaattaaaacttaacttaccaataaatcaactttattacaattattttcgcgcttcttttctctctaacattacaagttccattttttttacttcataagtagggctgtgaattttaggttttaactaaattttttgctcgattgatttgaagaaaggagctcaaaaaacgcatttctgtattaaaaattttcgattctgatgtcactatcggtcactagaaatcactattttggctacttcgtcactaaaatagttaaaaatcactattttggcgttttgtcactatttcgacattttttggaaaattccttaacaaaaatgcaataaaaccaaaaaatacacccctaagaatcgacctaaaaattttttcaaaaaatacacccctaagaatcgacctaaaaattttttcaaaaatacacccctaagaatcgagctaaaatttttcaaaatatactcctatgaaaagaaaaaaaattttctcaaaaatttactttcttggcaaaaat

SEQ ID NO: 14385 - DNA, 1788 bp, Heterodera glycines
  misc_feature (71)..(71): n is a, c, g, or t
aaaacggcaaaaaccgtattattcactctcatcgggagctgccggaggggcctcatttgccctaatttggnatgaaattttggagatgttatcggaaggttttgaaaattatgtaactttttaaaagctgcgttaagataacgatttattatcggcattgttccccttgacattttccattagcggcggtgaaatgcttatacaggaagaagattttaaaaccgaatatatcttcgatctttttgaacgactaacaaaacatcaccacgttcataagatctgttttcaggatgcaaacgggaagcagaaagaaatccacaaaggccaagaaaaccttccccttatcttgctatattgtttagccaatggaaaacgtttagacttgtatttgtgtaactgattctacacagaataatgcaaatgttgaagccttgcaaactcaaaataaatttaaaaaatgctactaacaaattacgttgattaatcatattcaaatataattagttaaaagattaaattaaaaaccaatataaaatatttagtttgcttaataaaatttattttgctttgcttgattgctgtggctttgtgtgtatacggtttagggccgaaacacaaataataattaatttaaataaattaacccaaagagacaccgtactgatgaggcccggtctctttcggttaaatttgcacgtttcgcgaagtgcccatttttgcactgtcgcgaaacgccccatttttacaccatttttgcactgtcgcgaagtgcccaagaatagtactagaaatatattcattttaattcttaaaaatactatttattttagttatcatttattttgacttaatttaggtgaccaatattaaatagaaaattataattctaaattaggaaaatttcggtatgtaaaaaaagtaaggcaaatataagtcaataaaaatattaagtgcatacagacaataaatgtaattattcaggatttggcaggataatgccggagggaatgccgtgccgtgttctcccttttggcggggagaggaggggggggggacaggaaagggagcaaaaatgaatcttgggaagaatgttaaatctgtgaattaacagtgataattcttccgctcatataacagcgaaaaacagtcacagttttttgcgcaatcgacgatttctggtttttatcggaaaccagtcacactaatgagagaaatgttgctgatttgctttgtcacaatcaccgcgcaaatagtcacaccaattatattcaagccgttaggtttcttttattgtaacagtttctacaccaaatataactgtgaccaatcaatcattatttaagtaatctgattagctgcaaaaatcacactcctcatagtcaaaatgaaaattattatttttttgtttctttactctctttcttcttgctgttgcaaccccgtaatgttattaaattccttaaaaacccttaaaactgcaaaaaccgtattatccactctcatcggagcagccggaggggcctcatttgccctaattttggatgaaattttggagatgttatcggaaggttttgaaaattatgtaactttttaaaagctgcgttaagataacgatttattatcggcattgttccccttgacattttccattagcggcggtgaaatgcttatacaggaagattttaaaaccgaatatatcttcgatctttttgaacgactaacaaaacatcaccacgttcataagatctgttttcaggatgcaaacgggaagcagaaagaaatccacaa

SEQ ID NO: 14386 - DNA, 2175 bp, Heterodera glycines
ccctcccccccccccgccttcctcagaatgactctgcttccactactatccacttgttttgtatgcaggaagaaaagagaaaggcgcacttatgcgtctctacccctcataaaaagtggaaatagagaaagggaattatattgtgtggagaaggaaagcaacaaatcgttttctgtctaattcttcccccattttctatatggaaaaaattcattttccatccagtcaaaaaatgtaataaacctcaaagccagccgaattgttcgtgcgggttatgctcatagcacaatccccactgccacgtcccgttatgattgcgatgtacacgcctaaaacaattaatattcaaactaaacctctggcccaaaaaacttaccctctgcgcctgcacccgttaaataaacacacaaagtaaagatagactttcccagaaggactaatcctccttcctccactttgcaccaaatttccatcttcagcttcgattgccgctttggcagtctcctcgtttaaatataggttattacttatgacccaagggtgggtagcaaccataaatctaaaaaagcagatcattcaacgcgtatcaaactactagaatcgtataattttttcgctttttgatcactttttttgttcctcatttctaagagcattattttgttgagtgttatggcatagcagatcgattattttctcgtactgatacaatttatgaaattttgtgtttttaactcgcatttgagaatttaaattttttaccaacccagaaaccagttcctggcccggcaatttggaaattcgaattgacctgttttccagtataacggtcttggggaggtcggaaccggaaaaccatatttgaaaatgtcgtcttgaaatctcggtcttatacgtattttaaaaaaaaaacaaatttttttaaatcgacaacttgcgcttgttcaaattttcttgtagttttgccccttcttactatagcacataatctgctgttaaaaccaaatgaatagcagtgaagaaacaacggaaaatgttgggatgggcggaaataaggacgaacggcagacaacttcaaaagatgagaccgacgaaagcagcagcgaaaatcaacggaatgaacaacgccaacgacaaatggactgcgaaaaggaggactcgaggtgagcatgggctggacaatgcaaaaacagtcaatgaaaaactgaaaccgaaacatcggaggggggggggtgagatgaatttgaccaccgaaaactaaaactccatgctttgaaacccaagacgaattaacaaaggaattgggctaattgagcatatttgagggcaattaacgcaccaaatgtgtattttccaattaacatttgttttcatttgtccaggttcgaatgcaatatttgtttggacatggccaaagatgcggtcagtttaccagcgacgatgccttttcactacgttttcatcaaccgttccatttttgccttaggtcgtttcgatgtgcggccatttgttctgttggccatgccttttccaatggatggacacgcgtccctatcgccagctgtgccccgtgtgcaaatcggcgattagcaaagacaaggttttccatttttactgaatttatcggaatggacaaccaaataaaaaagccaattcacagtctcagtcacattccctctaaaattgcattttttgccaaggtgattccgctctatggtcgcggtggtggggacagcgacccgcgcgagaaaattccgccacggccgcaaggtcaacgcacagaggagacaaatcaggtggacaaaagacatttttaataaatgatagcagagaatcattcattgcttccatcccaattttacttatctaatcaatgtttacccaaaattccattaaacttcattgatttgtcaattttccgtccagggctttcccgggatgttccattggggcggcgacaacggtggccatggcggcggcggtgtgcaattttcgaccccgatttgtaagacgcaagcggagagggcacaaaaacgccaaattttgcctgttttttaattccaaagttttaacattcgtcatttataacttaatttttcttaaaaaaattgttttaaaatcgcaaaaacagcaatttttgtgaaaatttgttaacaaatcaaaagcggttaaaag

SEQ ID NO: 14387 - DNA, 1816 bp, Heterodera glycines
  misc_feature (1796)..(1796): n is a, c, g, or t
gtatggggatggtgtacatcataggattcatcactatacgcagggattctgaggctttcccgaagagctaaacgaaatgtgatttcagattcgtgatcagcgtgctaaataacctgtaaagacatatttgtggaagtttttggcagaaagtatttcgcccatatcacaacatgttcaaatacctttgtagttgaatttataatatcatttctatttatattaaagaatctttaactatagttttgacatggctaaaagagtatttggtttaattagttatatatggagttgattccattattttgttgccatcacagtaaagggaatgaattttttgtcgtttatatttgtgttaattatttttttgccttaatggtgtactgctacaaaaaatggcatcagactgaagaacactgttgagctgtgtaccagggatgtgccgaatcggaatcgtaatcggaatcgcaattaatcggatttttggccataatcggaatcggcgatttaatcggaatcggattttgtctggctcggcacatccctgctgtgtacggtccgttagaaactgaagacaaaagccaatcaccgcaattggtacaagaaaaacagtaaaataaattttggcatattgttaattttattatgttaattaattaatttgttatattttttagttggtctgtcgcccgcaacaaccgaaccttggccgtttaatggtttttagaaaagaaatgaagaattttttataaattttttttattaatttactggaatattattttcctttaactattgacgatttaaaaaaatatcgattcgcaaaaaatataaataaacacacaattacaatacattataaaaaagcatttaaatgttcaaataggcaaaatgaggacaatgaattgatgtcgtcggcacattagctaatagctaagttttcttttagaaattaaataatatgataactaagaattagagttgagcgtttccaataccggtaccggccggtaattatcgtaccgtttgaaaaatttggtgcctgtaccggtttttccagtaccggttcaagtgcgctcaactctataacaaataagaatgtttatttgggtttctctgaagaaacaatttgaaggaattcagaaaatagacaccaacagaaaaatgaacaaaataattgacagaagacagattgatttaaaaataaaagaaataagaaaattaagtaaagaataaatttgcttaggattgttgtaaaataggaataacggataccaatactaatttttatactcccccatttgatattcatttcgaattacacaaaattttcagcgatgttcaatttttttgtttccatttttcagatatcaaatttttctataaattttgggtttcatataaatttggcagttattacatcattttttgctacatatatttttttaaataattttttgcatcgttttaatttttattaattttcgataaccgatttaatccatagcaatgaaattacagaaaaaattcaatgcctatggatattctgcgcggttggccacttcacaaaaagtgcaaatttgggcgcttcacaaaaagtacaaatttgcaaaatttttgactaaatcaattcataacttttctcatacacaaccaaattgcaaattcttggtatcatacgatagcccttgacttgttttatcagcttgctaaattttaaaaaaattaccttattttttgcttttcatatcattttttttgaagcgctttttccaaaaaaaattggggaaaatgggggncggcggtgctccaaaataat

SEQ ID NO: 14388 - DNA, 2589 bp, Heterodera glycines
ccggacccccaaaaaactttttttttaatttttgttttgaaagtctcttgtttcatttgacactttttatgggtttttaatcccaactttcactccttcaggattggaggagggcttcggcggttgggtgccacccgagttgcagtggggctggcatttgccaaagtgtctgcgaaagttcacggccaacatttgaatgaatgaaaagccattgcatgccaaccgaaaatgccatggcatctataccaactgctgtccctacgaatttcatttattttaataattttagtaccaattccaaacccccataaaaaacaggtcttaaaaaggagcgagaaacaacaaaaacccttttcataattgtaataaaaagagagcattttgtgccatttttgttactacactcatcacactgatcacttaattgggtgcggatttatatttacgaaaaataatttttaaaaataattaaaatggttgaaaatttgccggaaatgccttagaattaatgccattatcatgataaaatccaaaaaaaaaaaaaatttatacattgaaaaattattagtctttccttaaaaatagagggttcgtccttatgccaaagaatttcccaaaaaatttcaacctttccggaaaaaagatactttcaaatttaacctaaatataaatcccatccccattcatcatcacttttccaaaattgcatttaacattttctcgtttttgtgaatgtcgtcggccttcttcattttccattcttttttttcgcatttcaattttttataaatgctctacaaaattcacttaaccaattttcgcacattctgctccattatactgtatccattatactgtacttttctcccttttttgtgttttgtttgcccaacataaaacactcagcgatttcaatttgatatttaacaattgcatataaataaaaatggtttttggtaattttattggtgattgttttgatttttaaccaattttttgagccctaaggaactgaatcaattttcgtcatacatatattaattgctcaaaagcaacacatttaaattcttgttctggaaaatctttccctcgagaatttgaaaatccaatcctataacagaaccaaaatttggttttccaatccaattaggaattggaataatgaggcaaatttaccatgggcattattattactcaaaattaaaagaggaagtaaaaattaaatattttattttacaaaaataatacaataatattacataataaaaatccccttaatttaaatcccttctaaaaatataaaataattattataaatctttacatcatcacaccctccaaaatcatcttttactcttctcattcgtcctctttcttctcgtcctcactgtaaaattgcgaaaaatcggttaaataaataattatttgaaaatcttacagaacatctaacttcatgacaactagaatgcagcgggaccgggaattttgggcaaaaccgggaccgggaccaaccgggaaattttaaaaattcaaaaaatttttaaaaatttaaaaaaattcaaattttaattttttttttcaactgaaataaaaattaaatttttattttgttttttatttaataaaatccaaaaattaaagctaaattaaattaatggaaattttcaaatcaaattttcttcagtcatttcaaacaattaatcattttttggactaaatgattgaatattattagaaattcagatttacttttcacatcacttttttcggcgcgctttttccaaaaatcttttggggaagaaagggggtccggcggtgccgataggcgccgccggaggaaattttgagaatttaagtgtgatttgttaacagattttcaacaaaaaaggctggtttttgggattacttggctcactttgtacggattttctttaaaaattataaaatatgtgtcaattaaaaaaactatgatgaatcatattttgtcgataggaaagccatgagtatatataaaaagaaatttcaaaatattttcatttctgtagagggatcgaaccaggggaaagaagaagggaaagtcaagagatagccactaggccatttgcacaactgacagtgttgcttttaaagaatatatttatgattatttttttattttctatcatttaactcccccattattaccagtgcttgtttttcccggttgccctaccgggaccgggaaataaattttcaaaatccgggaccgggatctcggatgaccggaaatccccggcccggtcccggtcccgctgcactctaatgacaactcgtactaggccgaagcttacggcttaaacttaggcctatgcttaggtttgtaaaattttttattgtataaattactttttgtacgagttttgcttttcaaaaactgttttttcgatgcgctttttccaaaaaaaaattcgggaacaggggaactggcggtgccgattggcacagccgggaaaattttttggactttttaatgaatttgttaagaaaatttctaaagtttgcgacccctcccctcgctgcgaactcccccctcccccacctcttttacac

SEQ ID NO: 14389 - DNA, 2683 bp, Heterodera glycines
  misc_feature (2662)..(2662): n is a, c, g, or t
tttttttttcgttccggtgctgaaatggttgatataacatggagaaaaaaaaattaggcccgaagagcaaaaaaaaaggtttcttgaaagattttttgctagaaaaatgttgatttttgctgccttttcaatttttcgtgccttttttgatgttattgttatttttttatgcctttttcacatttttcgtgcatgtccgggctctacatatgactaaacatagtaaatttactttatttaataaaattttggcaaaatagtttaaaaaaattcaaaatttttataaattcttttgccttttcgaaaatgccattcttatgagtgtatatttaaccccgaccacgagtcggggttaagggtcggaagcgtcgtgttaacccagaaaaatgtaggggttcggggtcggggccagccagaccctagttcgaaataaaatttcattagttaccacaaaaaccctaaaagaaaatttttacctgcgtaaagcactgccattgcgttttctccgtccaattcactcaaaaaattttgggttcgggtttcgggttgagaaaaacctcgggtttcgggttcgggttggcatcactgttcgggatgaaaaaatcagatttttaccaatatttttacggcgcatttttacaaaaaaagacttttattgaatgggcgagggaagagaatccgacgccggaaaaattttgtaacttcgtcctgatttattaacagattttcaccaaaaaaggacattttggcaatgaaaattctgatcaatttagaaaacgtgattttatgcaattttgagtctggaaatggtgggacttaaaagcaatgaaaagcacaactttaaatagaaaagaattttcgtatatttttttacaattaaatttcaaaaaaagcaaaaaaatttggaccaattttgaaaagaaatagtgcacaaggatgggaggggtagacgaatagagaactttttaggaagggacgcaccccatctgatattccaccttttctgttccataagaggccaaaggcgaccgtcgccgttgacaagaagttgtccaattaaggtacttggaatttccgcattaaaatgtggtacaaaattttggaactgtcccacctcgcggtgggacttaaaagcatggtgacgtgaaattacaaatcttcagagtattttgtttcgaatttttacaattaatttcaaaatgccaaaaaattcggaaccaatttaagaaacgaattagtacacaaaaagggagggaaatctttaggacaaacaattagcatctataaccaaatttaaattttgctcattcgaacacaataatttcgaaaatttttgattaaaaaaaatttctgctacttatgtggtttaccgcccataaattttttttaagtcttaaaaaaactttcaggggttttgatggtcgctgaacacgaatccgacgtccatttcaccctatttcgaaccaagtcctgactcaagatgattaaatttttaaaattttaaatttcgactgaaaattagctgattttcagtctcgggtctgtaactcttcagggattggttgccgcaaaaaaaatctttcggattcttccattacagacctagggctatcgattgatatatatttcgaccattttcggcgctgggcaatatgatcaatatttaccatacttgcaatagcataggatttccttaattcgattcctgatttttcacaaattttcatttttcgaacattttatctatgtctaggcatgtctccgttttttgttagatacattatttcctgaaatagagcccctgtggcgtttgtctgggtttttacttcaaaaagtttttttttgcaattatataatttaatagttagactttggtattttgcgcaacttcggtttcacctcatctgcgccttcacgcgtgggtcccattacttttgcgccctgtgtcataggcgtcaaaatttttttaaaattaatttcgtgatttatttgttagcttcgaacaaaagaatttaatagaaaataaaaaaaaattatttcgaatatttttttggttgattaaattgtgagaatgattcaaaaattttaaaattttcaataaaaataaatatgcattgtataaaatttgaaaatgagaaaaattcgtaatttagaagcagagaggaatcgattggtatatattttgtcgaaattccatgcgtttttatctgttggacggttcagtcccaaagccatttgcccatttcagtatcgggtctgtaactcttcagggattggttgccgcaaaaaaattctttcggattcttccattacagaccgagagctattgattgatatatattttggccattttaggctctgggccatatgatcaatatttaccatacttgcaatagcataggatttccttaattcgattcctgatttttcacaaattttcatttttcgaacattttatctatgtctaggcatgtctccgttttttgttagatacattatttcctgaaatagagcccctgtggcgtttgtctgggtttttacttcaaaaagtttttttttgcaattatataatttaatagttagactttggtattttgcgcaacttcggtttcacctcatctgcgccttcacgcgtgggtcccattacttatgcgccctgtgntcataggcgtcaaaatttttt

SEQ ID NO: 14390 - DNA, 2081 bp, Heterodera glycines
  misc_feature (2074)..(2075): n is a, c, g, or t
ctctgtaccaaaatggccgggcatcaaaaggctcttcgacgtttttctccgtttccgcaaaactcttcgtcccaggtccaccgactgactgttcctctgatcagtgatcactgatcaaccttccccgctaaactctctcggtttcagcatggtcaaagaattcgagaaggtccgcgaccaccccgacccgagtgcgatgctgttcacctgcatggactcaaggtgtgaggcaggctgaatcggaatcccggactttttttgggctaatttgcaatttgtttttttgaaccagtaattttattcatattaataattagggatgtcaaaaatatgtacaaaaagtggtcaaaatatgtacataaatatgtaaaaaaaatcccgaaatatgtcccaaatatgtaaataaaatttttaaatggttatttttttggaaaaaaaattcttcggaaagcgtgaaataggcacaaaatgccataaaaatgacctaaataggcctagaatcacattttagtattttaaaaattagtttggttaatttttattttcacaagaaattttataaaatttaaaaaattctcaaaatatgcaataaaaatttgaaattatgtacgaaaaatttgccgaaattttggatttttttttgaaaatttccgaaaatttctgtaaaaaatccacaaaatatgtaaaaaatgtatgaaaaagtccgaaaaagtccaaaatatgtaccagatatgtataaaagcccgaaatatgtaaaatatgtaaattaaactcccggtttttgtttgcaaacacaaaaaagaaagtgtttttcctactaattagagcatggagaatccaggaaaaaatatgtatttacataaaattgacatccctattaataattttttgttctaatttttatgcgcattgatctctcatccattgaaatgtctttgcttttcgtcctcaggttacaaccgtccaaatttatgggtgctcagatcggcgaattgtttgtcgtccgcaattccgccaatatggtgccggtggcaaaaagttttggtgtgcaattaattaaatttttctaaaatattttaaaaaagtgatttaattgaggcgattccggcggagaagtgtccgtcaccactgaaccagcagcactcgaattggcgattaggtgcaaaaacagtttagttgattatgttgtatccatgtaattaaaaggcgtggaaatgtccgacgagtggtcatttgtggacattccgattggtaagcagcggacggactgacaaattagcccagaaatatttgtgaaaatagttttttcaaagggtgaaatcattttcaaaattcttttggttaaattccgccgattggcccattcgccattcattcattttccaataaaatttcgctctaattttctgctcgttcagcaaggcgatcaacacactttacgacctttaccatgggcgtccgtttgacgccgagtcgccgatggaccattggctgcgacggaacggacaccaaagtgtgcagaaattgacccaactgctgatggcggggcccggaacagagttggaattcgcatcggagaacggactgatggcattctgcgctcacattgaccgaacggaccaactgagcgcggtggacaaactgtcgcaaattaacacacttcaggtgggcaattgaattgaagcgcatttgaatacactaatttgtaagggggcaaaaaaccccgacacaattcgagtgccattagggaaatatacactgaatgaatagtccaaaaataatcagagttgatgatttttagaccgtttttaaaataagcggaaggtgctggccggcagtgcgaataggaacaccgagtaaattttcgagaatttttaggaaattaagtccaaaattacggaggaggagggtgggagggcggtaaatgtgcacacactgcaaatttcagcagctgaccaacattgcgtcccacgagtttctgcgggaatacatcgtgaccaaaaaggtcggccttgatgcgatgtggttcgacattttcaatggcgaaatgtcggtgtttttttggacctgcagnngcatgc

SEQ ID NO: 14391 - DNA, 1581 bp, Heterodera glycines
  misc_feature (1560)..(1560): n is a, c, g, or t
  misc_feature (1572)..(1572): n is a, c, g, or t
aatcgtacggtctgttccgtgcccaatcaccgtgggccaaattacaaaaaggctgttataaataaatatcgatcgaaaatgcaattaaatttgaaaaatattgaaaataatgaccgaattaatagtgggaatatatccgagaggatatgaaaattaacaaaagcaaaacagctgcacaattatacttaactattaatggtatctcattcaaaatttttaattatttagaacttttttaaatgttatgaattttagtttgctgctcattttaccctataatatttttatattaatttacaatacaatcaaatattttgttaaaattagagtgccacgggatcgggacctggtagcggacaactgagtaccaaggtcccggttttgaccgggaccgggactagtcccggttttttcccggttttcccagccaaaaattccggtttttcaacccaaaaaggtcccggtcccgtggcattctagttaaaatgtgtcaacatttggctaaactaattaccaaaaaatgccaatcaaatcacaccgatcacttcattttctgtgtccccctgttcaataattgcttgtgctatttgcttgtaaaactgctcaaaacaaatctccaaaaagccatttgaatttgccaattttatccacgtaatttctctgttggccaatgcgttgttttggttctgtttcgtcttgcaaatgttggacagagtcagaaagaaatcggcgaatattcgcaaattcagcagttttttctccaaaacatatcttccgatctgtcccttgtccgccaatttctccaaattaataattttaagcgataaattttctcaaaatattgcaaatattcattgggcaaagtcagtgaattgagaattttctgtggcattttctcttcataattttgcagcaataaattgccaaccatcgcagcaaaattttggcaataaattagttgtgacagattaatcgacgccaaaatgtcacgggaaatgcccggaatttgtgaaagcattgcttcaacagttgtggccacgaaatgcacagtttgctcattgtccgcttgttgcatctgctcattggtgggttgaccagcagcagcggcactgaatgcttctgcttcctcagctgctttttggcccggtgcccaccaccaattcgatccgcttaaggagggcatcgtcatcgatgggtttgacgaacgagttggcatggatatggcaacaaattggtggcattcatctccatattagccgggttgtcttaattaattgtgttgtacataaatatttgtgttctcaattgatttgcaattttttaatttactcaaatgtccttttgcttacttattcttattaatcctgccgaactgcttgtgctggcttggcacgaagaacatgatgccaaaatggcacataaaaaaccgcagtcattggaatggagaagaaggcacccttttgatgtttataattaaatatgaatttcaactaaattggtgagtctgttccgccagtggcagtttaaaacgcggccactaacggacaggcttataaactnttttttatgagntaatcattc

SEQ ID NO: 14392 - DNA, 3973 bp, Heterodera glycines
cgacgaatggtgggccattgcgttaagggaacgtgcaaaatggcgcctaagcgattggcaaatgggagagaaaatgattgattaagggtgttgatctgatcacataacacccgcccaccccccattaagcatcgcttcgtctctcctctctttggccccgtttcaaatgaaaaataaaatttaaaaaggcaatggccccttcctttaaccctttccgaaattcagagacggcttttattgccatgaataatgaaaggaaatgtggaatcaattgaaaaagtgccccagaaaataaaatatggagcagaaaatatcaaaacgaaaattggaacagaatttgggggaacacttttggaacagcgaaagggccaaagagagagggggggggggggggggaattgagggaaaagcaaaagtggggaaaagcacaatcgcaagggacaccaccggacaaaaagggcgagaagtgcgggaaaagcccaaaaccccgtcggattagatgactagcatggagaatgaagttagtccgcccccacgcggaaggaagggaccctttgtgcattgggccaattctccgcttcacttttggattgtgcccttggggggggggggagagggaatggcacgggagggaatgcccttcgccgcgccgttggcccattcaaccttttcctcctcctctcttccgcttccgtccatttcttttcgctccttggcgctgtcctttcgctttctgtgcccatagccatcgaaggatttatcggaaaagctttcatgtgcactcactccccgcctctcctctccctctctgttgcctttattgtctccccctctctctctgcgctcccatctctaacctcttcccccgcgccccaaatgaatttagtagcgatggatggcggctttttctcgcaaagcacacacacaccgccgactacaaagcggatgacgtggaaagaggagagaagcagggattggcaatacacgggagagggaaggcaaattgggtaaatatagggccaaaaccaaaagtgggaagagtgcccaatgccaattcccatggtttagaaatgggtataatgaatgccaatgacaaatggtctttctttaaagcaaaatttatcagcaaaaatgagtataatcttggtggtgctttatggtttatgtccattaaaagtcacaacaaaaagacaaataaaataaattagcctgtagacgcccaagcatttttgtataaaaacaaaagcggagtaagtttaacaagtcgatgacaaccgcttgttaggctcttcattcgacttcagcggtgggttgggtggtgtcctcagcctcgtattcgccctcatcgtcaacggtggcatcttggtactgctgatactcggagatcaaatcgttcatgttggactcggcttccgtgaattccatctcgtccatgccctcaccggtgtaccaatggaggaaagccttgcgacggaacatagctaaaaaacgttttgaaggacgataactaatagttcgtttttactaaccagtgaactgttccgaaatgcgtttgaaaagttcttgaatggctgtggagtttccgacgaaagttgccgacattttgaggccacggggcggaatgtcacagacagcggtcttcacgttgttcggaatccattcgacgaagtacgaggagttcttgttctgcaccgacatcatttggtcatccacttccctcatcgacattcgaccacggaacattgccgcaactgtcaaataacggccgtggcgcgggtcacacgccgccatcatgttctttgcgtcgaacatttgtttggtcagttctgccacggaacacgcttgatatgcagccgctcccttcgcagaaagcggcgcaaagccgggcatgaagaagtgcagacgcgggaaggggaccatgttaacggcaagtttgcgaaggtcggcattgagttgtccaggaaaacgaagacaagtcgtcactccggacattgtcacggaaactaaaaaagcaatgaattaaaacaaagacaaatgtagatgaaaatccaaaaaccgagatgattgagatccccgtatgtggggttttgaagcttcaaagtgcggaaacagatgtcgtaaagcgcttcattgtcaatgcaaaaagtctcatcagtgttctcgacgagttggtggacggaaagagtggcgttgtaaggctcgaccacagtgtcagaaacctggaattcgtaaaggtcgaaagaaatttgaaaaactattgtaatacttttggcgaagggacgacagaaaacgaagacataatacggtccgggtattcttcccgaatctttgagatcaacagagttcccattcctgaaccggtgcctcccccgagcgaatgagtgagctgaaagccttgcagacagtcgcacccctccgcctccttccgcacaacgtccaacacattgtccaccaattcggctccctcggtgtaatggcccttggcccagttgttgcccgctccgctttgtccgaacacgaagttgtcgggacggaaaagctgaccgtaaggtccggcccggattgagtccattgtgcccggctcgaggtccacaagcacagcgcggggcacgtacttgccacctaaattcgaagaaaagtatgcattacaaaataacattataattagtaaccatgggcctcgttatagtagacattaatccgttcaagttggaggtccgtttcgcctttgtaagtcccgtccggttgaattccatgctcatcagaaatcacttcccagaactgaaatttggttgtgtgaaaagcaatttccaaaacaataaactaaccttcgaaccgatctgatttccacattgaccagcttgaatatggacaatttcacgcatttttaaaataatttgtatttattctaaaatactatttaatcactgtaaataaattcttgtgtcttctccaaaaagatgtaaaaatgaaaggatgtaatggtcaaaaggaaacgaacgatgaaaatcaattataaattataaaactactccttctccctctccattcctccccgttctgttccgccccaactaatcgcgcctattgcgtgtctatctttgagctatgtggagcaatggggcatattttgtgcgtcctgtttgtgcacatattgttaagccgcattaattttagaaagatcattttgccaaaaaaaaaaaaaaattcaaattgaataattcaaatttttttattgctctttttaatttatctaactgtcaatttatgctttacatatttcttgattttactttttagatttaccatattcctcagttgattatgaacaaaatatttgccaacgattctaaggctgtttttgaggatgatatgcatatcggcgaagccttcgatgaagttttcaaacagatatacgagcaggaaaacgaggtatgtaaattgttactctttgttggtcactaaaatagtatttttgatttaagatgccattcgacagatgtagagaaatctggaaagaagttgaacattctgaaaaaacgcttgtccatgaaaccaatcatttgttgaaaaatcaaggtgttgattttactatttctggtcttttaagttttacgataggtcttcaaaattccatcgaaaccgaaatgaaaatgctcaaggatgctgaggcttctttggatgctttgaagaaacgtgaattggagttggttcgccattacaaagacaaacaaagcaaaatcctgtcttcgctggaccatggcatgcaaatcttgatttaatttgatcttttctgtttttagttgagcatttaacccagatggttgacactgacatcgaaaacgaccagaaaacattgaatgacatcttgaggagctatgaagatgagctgcaagagatgaagaacttaattatggcgaaaaaacgattgctttccgactaatactagaacgtgtgtcattcattcattgat

SEQ ID NO: 14393 - DNA, 1602 bp, Heterodera glycines
cctgaaagaatgaagcggcggtggtcgccgccaaacactgctcggccatgttggcgccggaaaggtgcgggaattgcatggcatttggcaaggcggccatctgcgaagagcaccagccgtatggccaatatctgctaggaagagccgtccataagtgaaagggatgaaaaatgctgagtcattgtccaatttttagttacttaaaaagccgaccgctcgattcgctttttgtgccttcccaattccccccccccctcactgatcagctgatggtttgtccgctctcactccgattctcccacctgctgatccccgtcctgaacagttcgttctgcatggccattgccgtgctcattgtgccattgctttccatcgcggcccctccgccgatggcacccgttgattcttttcgcgtttggatggaacgaagcacccgattgatggatgagacctgaacaaacggagggacaatgacaaaatgcgggactgagttggccacccacacttggcagtgtctcgtccgtgcacactttgtcctgcttcagccggtctctgatctcccaggcgaaaatggacggctgcgcatctttgtacacctaaaacgaaccaataggacgagacgaaagacggaaaaacaaacgaaaaatggcaaatgaaaagtgtatcaaaatgccttggatttgtggaccaaataattcctttttttggttgttttgtgcccgaaatgtcttttcgccgttttctttctccgtttgtcttaaactcgcctttattttctcgcacacttctctggtcgccactcgtggctttgatcttaagtttgccatttttgtcaatgttttgatcggtccgttcagtaccctccgattgccctcggtttgattgtgccgtattggtagaaacgcgcgagaattttggaaacgcatccgttcgacaccttaacatttgcaaacacaatgatcacccaattatcgtcgaatattctctgaaatctcttcctctgatcacccttttcgaacttcgcgatcgcaaattaatcccccccccaatttaccagcaaattgcgcgaaatgtcacaagggcgcatcccatcctcggccaagtcgacaattcgctggcgaatttggtcgggaaggggtctgaagaggggaaaggcatttagtggcgaattgtgccgatgggtcggtcaccttccgttgacgaagacacctcccagctgattagtgccggtgtgaccttccaaaaatgttttacctttataattaagtatgccggaagttatttagttatacgactttatatgtttataaataataaattattcttttgaaataaaaagccattattttggttcctttttggaattgggcattcccccccccccccctctttgcccctctttcccttctccgctttctttgtcccattgccaaaattattattttattgcccattcattcgctcataaaacagtgttgtcgtttttgtctgtctattggaatttttaaaaatcagtggctaaattgctcaaattccgctgtttcaaaagagcaactaatcagcccacatacttttggttgtaataatagcaaatgcttttgc

SEQ ID NO: 14394 - DNA, 604 bp, Heterodera glycines
tcgccgtcggccgaccgtttcatcgttttgatggccttttcgcccttcccccgccaataatcgcctaaaaactcaaaaaaccatcgccattgacacttttgtaactccgagaagagatgcgatttgatgggaaacaaaggaaaaacttaagcgatgacaacgccaaaaatatgtcaattttgatgaatttgtcgtactttcgtcgtgttgtccaattgaacaaccgtaaaaaggaaaaatgatcagattaaaaatttaaaaaacacggaaaaatggaagaataaccgcacaaggaattcgaaataacaatgacaaatggcaaatagcacccgttgtgccaatcgccaaattcaaattggcaatgcaactgacagatacccgccccccccgtcctttcacctaatcctccgtccgttccaccccccccccccccgcgccccctaagggcgcataaattaatttcagttttcctctcatcagagcgactctccggggaattcacttcacttcacctcatccatccgtcagtgggccaatggccctaaatgcactgatgagcattcaatgactgacttctcattacatatgtgaatggttctaatcg

SEQ ID NO: 14395 - DNA, 2063 bp, Heterodera glycines
taagcgatgccaccgccaaaaatatgtcaattttgatgaatttgtcgtactttcgtcgtgttgtccaattgaacaaccgtaaaaaggaaaaatgatcagattaaaaatttaaaacacgcggaaaaatggaagaataaccgcacaaggaattcgaaataacaatgacaaatggcaaatagcacccgttgtgccaatcgccaaattcaaattggcaatgcaactgacagatacccgcccccccccccgtcctttcacctaatcctccgtccgttccacccccccccccgcgccccctaagggcgcataaattaatttcagttttcctctcatcagagcgactctccggggaattcacttcacttcacctcatccatccgtcagtgggccaatggccctaaatgcactgatgagcattcaatgactgacttctcattacatatgtgaatggttctaatcgctgaaacgctttccaatgccttagacacgaaaaaacggccaaaaagtgccaaaaaagtcagtggcacggtttaagggacagacgaaacgtgtgagtcgggtcagcttagtaggccgacaatgtgtgggtggcactgttcggacgatggctttacctcgcgaactgggcgacgatgccatcgaatggttcggctgctcgcgcttcaacatttgtgccgagtgcagctcgtttccgtggtggttgtgctgctgttggtagtggtggaggaaggcggacgcctggtcatgttggaacaacgcactttgcagcatttgctgctgtgaaatgccttaacggaaaagcactaatcaaagcgcgaaataaattcaaattgtgacacaaaagcctaagtgaaggaaacaatcggcaaaatgccaaaattatcgccttagtgaatgaatgcgttgtgcccatcaaaatgccgtccctccatttgccattgaatgactgactcaccgtcagcaaatggcaccggaaaagcatttcttaccaatgtccaaaatgtgatgtccgctccctgaagcgccgtcaataccaaagcgtccactcggctgaatgtcgatgttcaggctgagcagactttgctgcccgagggggtgcccaaaatggtggtgatggtaaccggaagattggtaaggaagaggcgatctgtatttgagggagcacgaagaagaaaaagcggaagaagaagaagttgaagttgaggcggtgcaggaggaggaggacgaattggagcagttcaaagcgacggaagaggacgaagaggaggaagcagtcgtggtgaaggggcctaaatgggagggacaaattggcaaaaaacggcacaaatgatggcatcaaaaaagagagacagagagagatagagaccgagagagtcatacacaacaaattaagagcaattaatggaagtgcaacggatactgcgttaatttgccattttccttttgttttcttccatttttacttttaacagtccatccttcccctccctcttcccaaattcattcactcattcttcgcttttcttcctcccattccctttcatcagttgctcatgtcattggccaactcccttattaattcccccccccccttcggctttctctcccccaactttcaatttccccctttttcccattttcattccatgcattgatgggatccgctcaagcgcaaaaatattttcattgggcaaatttagcgcaattgttctgggctgaagtcgttgatagagcggggaagggaattaaccggatggccgaatcacgcgggcataaaatctccgtcaatcggaagttgcgggtggagggggcgggagggggcaaggcattgtgccgtcggcagatgcctgctgaccgagtggccccattgttagcgatgccctccccttcccctcaatccgcaggctggctaatcacttttgagccgcctggatgggcacatttggtggaatttggtgacgacggaatttcacctccccttaaaccattttgttggttcaacgccggggaagagaaagagaggagagagagagagagagagagagaaggctgggagggacagaaac

SEQ ID NO: 14396 - DNA, 4350 bp, Heterodera glycines
attttatcagttttttgattcaattcagattgagaactttttgaaaaaactcgaaaatagagcaaattacacacttttatttttttttaaaccgtcaaaaccggtatatttagactagctaagtctaaatttggggataaagttgaaccaatgcagcaatctgactccacttttctccatattattcgacccttttaaaaatcacccatttaagttaaggggaaccgaaattttttcaaattttttattttaaaatttatttattttttaatagcttttaataattttgaatttttcattcatgttgggttaacataaaaaaacgcagcacgcgcacatcaatcactaaactgctgcctcaacatggcacatctcaattattcgtggatatacaccaccaacccacgcccatggcactgctttatttcatccactactaagctataacccattcattctttcatgcaatttttgcatagattttcagtgatttaattagattttgttttataaaaaaaaattttttaaatattaataaaaattattgtacaatttttgtttgaaacttgagcaaattagacacgattgaattaaaaagacaaatgacatcaaaaaaactttctgctgatcactagggattaaaagaatgggtgcaacccaaaacgtcgccggaagactttttggaccataactttgtttattgtcaatcgcattaagcattcttggtgttgtccgaaagctcccatgtgtttatttttatttgcaaaatttcaaaaattttcgttaaatttcaaaaaagttatggccagaaggaactcaaaaacctattttttcgaacttttttttttttgctctgaatttttgtacatgaaaaattatttttgaaattttgcatgttgatagagtttttcaaatgctttcgaacaataccccgaatatttcatttgttaaatttttctcaaaatttcttcaaaaatccattttaaatgaatgggttgttctaatagaggttttttttttgaaaaaataaataaaattaaaaataaaatatgcattaaaaatatatagaaatatgaaataaatcaaccaatgcaaaatttttaattgtttttacaattttaataaattttataaattattactttagatttgatatgtacattttaaaactgacaacaatcatcctcttattttgtttaatttattatttcaatgttatgtcagtgatcggcgaagaaagtttttttttattaatttaattaagtcgaaaaaaataaatgtttattgaatttagtacctaaaaatctaagtttatgccgtaatgtttttttttcaaaatttgaacaaaaaattgacattttaggaattctttcttttttatattaaaacctgattttttggataaataaagtttctgaggttatgttttaattaataagagctcagttaaatataaaaaattaattatttttgagattttttcattttttatttaattatttaatttttttacaggatactcaacagccaccggtcgaaacgacaactgaaatgccacaaactgcagcaggagaagcgcagcttggtgaattgaaaattgtgcccgaattggccgactcaacaccaacaaaaaacaatggtatttttaattaaaataaattttttaaaaacaaaattttcagcgacaaattcaagtgattctaacgatgaatccaatggtatggatggaaatgttttttgcttatatttattatgaatttaataaggaaaggtattgaaaattataatgcttaaatatttttaaaaaatttcgaaaattcatttttctcgttcaaaattatacaaattttccgaattttaataaattacatattttttttaatttttttttttgggcaaggacataaagtgcccgtacatttttattggttttaataaaatgaattttaaaacaaaattttatttttgaatccgagtaaataaattttcaaatatcatttttttcgaacccaaccaaataaatcgtaaaataaaattttattttcgaacccgaaaacaaattttaagataaacttttttcgagtaaattttaaaataacatttttattttcgaatcctaccaattggaccattcatttgacgaacattcgacagctgagcaattgttggtcatcgcattggtcaatagatttgctcaaattagtgaacgatccattgagccatacaaagagattgttgtgatacaaacgcttgaggcaaattcaattaataatttaaatttaaattaatacataattggtttcttacggtacaaatactgtattttgaaaaagaacaaaaatggatttaaattttcgaattataaattttcatcaattaatgtagaaaatctttctctcactcaaactctctctctctctctcgctatctctcagtctctttctctctctcttcctctctctctctctttctctctctgttgaatatgaaaatatttaattgtattaattaatcaattttaattacgtattaattgcctaattaaaatataagaattttctaactaaatttttgttttaagcctgtccataaaatgttggaccacataaagtctatcatactaagtgagatgttataccaacgacgtgttgaccaattcaagtgccgacatgacttgaaataccggcttcaaagcaacttggaccttgtcaagcaaattttcatgaaaatactgtacaatgacagtacacaggatggaaaagaaaaatttaccatgtccaaaatgttggtggacggtggcttgaacagcttgaaattgttgctctcatttgctgctcgtctctcagccgctgtgggaggtgtactatccaattttttgtataaaattgcgactcatactgtagtatctctcaaatactgtgagatccccaaaaaacggtgatagattttagacagaaaaattataagaaatgagaaaaagaataggtagaaattttcttggaataaattgctataattctaattgtttttgacagttttgtttttttttaaacttaataaaatcagactaattctcgattgaaatcatttaggaaacaatggcacaaatttgcgttcatttttggctgcctattcatgccttaaaaatgtgtcagcggatgaaatgtaaaataaaaaactgaagattgtttttttgtaaacatttattttaaattatacagaatttttggctaccgtattgaactaaaagtggacacaaatggtaacacaattcttgtccgccttggctggaaggagtacacagttggccaacaactgatcagcaaaagtaactaaaaaatttattggcgaaatgtttttttttaattttgagattaatgcaaatattttcaattttatgttgttattaagctaataggcaatacaataaactcccataaaaagattaaagctttaaaattcaaaaaaatcaagggctttcatatttttctttaaaatttggaggaatttttgattttttttgtgctttacattaaattatttaaaatgattaattaataaaattatttacaaaattagaaatccaggaaaagtaaagacctttacaaaatttataatgaacaattttaaagacaaatttgatttttttttaaatcttaaactatcaaaaaacaattttttagcaaattcaaagtttacaaatttataattgacaattaagcattaatattttttttaatttttaaattcacaaaaataatttttaattttaaaatgattttttctagccaattttaaatttcttcaacaattggccaaaacggaactgagcccgcaggatgtcgtcaatgtgtgccaaaaaattgacaattcggttggcattggcgctgccatggaaggcacagaaagcgcagcaacaaaattattttcggcagttgcagcacattttgaagcgtcaaacaatgaaattcatcaaaaaaatccatctggaaaaggctaattgaaaaaatttaaataaaaataatttattttattcgaattgaaaaataaataaataaaataatttttatctcatactatttttttttgtaaaatttcaaaataatttttaaggaattttttcaaattgcatattttagagatacgttacaaaaaaaaaacacacataagttttccaatgctaagatttcgttcttgggcccttcccccccggaacgagaccttttttttttttttgcttttcatatcatattttttgcggcgctcttttttcaaaatttttggggaacaggggagaatttagtagattttccctcggtttttaacggatttcacaaaaattataacttt

SEQ ID NO: 14397 - DNA, 1412 bp, Heterodera glycines
tcagatcaacaagggtcaattggatggcattgccatgtcatttagttcgattactctcggcaccaacggaccacatgcgaccgcctcgtcggattcgatgatggtcgactcgaactcatgaacgcgaaatcaaatttttgtttaatgaaaacccataaccatttttgataccaactatattttatattttaatgaattatctaaaaacccagctcgtttttttctctcattttttacataatgaatcgactaacttttcgtttttttgcagtcttacacaaatatatataatgataaaaaaacgagttgagtttcatcctgaatttattgagttctaatttttctctttaataaaatagaaaactcaaaaaaaaaattttttcgacccgttgaaaatacaaacaaaacaatattagtttgaaagagatgtgtcaaagttcgtcactaaagttattaatcatccgagattcccttatcaactcctccaatatgaaatcggtcctctgaacgacttgcttgcagccagcagaagcataaattggtgcttcacgtggaaaaaactaaaaatagaataatcagacgaaataaatcaaataaatgatgagtttccatttctccaaacatttaccgaaattgagtcagtaagtcgttcgagctgttccggcgtgtaatttacgttcagtgaacgcaaataatctttgaaacacattgtgacgtgtcttctctcgagcggcaaaaaaggcacaaaataatcaattaggtgtttgttgataaggcgactcgatttaagtccaccatcgcctgcaaaatgtttttaaatgggtgaatataacaaaaagccgataatttatttcaaatcggaccttcgttatatgcactgatctgaatgatctcctccatttctcggaaggtgatctcttccctgggctttcctctgttgtaatattccaacgttcgttgtgcaatggaattggctccgccgttacttaaaaatttgaaaaaattaaactcaaaaatccctaattgaaaagaaaacttattacctcaaaaaaaggaaaatgcttttgcgcgagtcgattccgttcaaatggtcgtaaaagtcaatgaacggcacaattgcatccaacacttgcattggcattttgtccatttcgtcgaatatgaaaagcgaccgttcgcaattcgtcaaatttgtccgtatccaagtacgaagttggccctttaaatgtcaaaaaccataaactgaatttttgttgatttgttatttttcaaaaagtgcctaatccaataaaatgttccatttttcgcctaatcacactttgtatttgtcgacttcgtctgcatttgggaagtgatgagtggccacgaattggtggacgaattggctgcgcatttccttctttgtaatcgct

SEQ ID NO: 14398 - DNA, 1786 bp, Heterodera glycines
  misc_feature (1758)..(1758): n is a, c, g, or t
actttccaattctaagaaaaaaccccgtccttttcactgttgctcctcacctccctcttctgattgtgaatgttcactctctttgactgcataaaacgcaaaaccctccggcgctctgaccgttttgcccaaaagcaaatgtcctcggaacagtgctgctttgagcccattagcgccatcctcagtctggaagaatttggagaccaatgccggcccattaaaatccatggaaaatgggagggaatgcaattggctgggtttcttttgctccaactgattttcagcacgtccatcgctaatcaaagcagccgtaaatgtcgtatttgcaccttcttcagtcatttcatcactttccgtttgttttccaaattaaccattaattcattttaaaataagaaatgtattttttgccgaattcaatcggtcagtcttattacaataaataaaaacaaatataaaattaacaaaaaagaacaattaaagttggtctttgttgatgttgaagaaacccaaccccaacacaggtcatcaaacatttgtcctcacttccgtttttcatcgcatttccgccttttccgacgatttctttcataaccttccaccattcctccaatttaaacatttgctcgaaaaacatttgcaaattccgaagggtgtgtacgctaaaaacgagtaataaaaagacaaagaattgaaaaatgcacctgttaattgtgagtggaccaaggagaaatttcgaaacatctctgtcgcagagagtcatgaaagtggcggccaaagattgacaggacgaatctgcacagcctccctaaagctttctttcttatcacactataatacaatatttttccgtttatgggcataatctagattccatatgtcagtagcttgtcagggcctctcctttcacgaatataacataatttttgaaattcggattctgaccagatgaaaacaaaaaaacctagtcgacttttttgactcaaaaattttcataaaaatttaaaaaataactttccaggggcgcggaaaacggtagagaagaaaggagcggtcccgtcctgattagtaaataaatatttaaaatcagaaaatcgagagaaaaataattttaaaaatatttaaaaaatccctggaaaaggtagcggtgtaggtttttgttgacctctttggaatgattagaaaaaaacaagatatatgtgtaaaaatgaacagttcgaacccatgataagagaaagcacttaccatatgaatttcatccagcaaacgtcttgccgcctgttccccaatttcttccggcactgtttggtcttcgttttggcccttagggcgcgacatcgcttctccatggaaaaatacgccttcggtggtttcagccgtcaagaagattccaaagccgggagatctttaaaacaaatatatatttgtaaaattaaaataaataaaaacggacagtccgccctgggggcccttcctctggtcaatcgtaatgtaaatgtcagaaatgtttccgtgaagcatctttttagctccgtcaatctgaaaaagtgtaaaaggacacgaaacgacggcgtaattaccattcgagatgcgattgatggcgtcactttgcatacgtaagcgagacctctgatcttgcaaacttttcctggcttaatgcattgcacagcacgcaaattccttttgatgggactggagaaagtcactgaaccaccgccactcggcttgaaacctctggctttgatctgacaatataanaaaaaactcaataaataaagttttatga

SEQ ID NO: 14399 - DNA, 2625 bp, Heterodera glycines
caattttatttacaacttaattttagcactctgatgcttttttatcaaaaaggaagatggagaaaaaattttttaaaaaatttttccttatattttggttatatcgttttgcttttggtggggtgcttggaacagtggaatcatgcgcacccgtccgatctggcaagataggcaacgattgctgactagccaaaaggttcggtgccgtgatgaaacgaaccatcactgcttaccccgcggcacccgacacggtcccccgaaggaatggatttaattaaattctctccttcggggatttttttccattaggtcgtccgttagcgttcgattgctctagtcaatttttaaaaatttttgttgaaatatttgtcgtgctctgaagggcgggggggggttaaaaaattcaaattttaatttatttcaagtgaaaataatacaaaattaaatttttattttgtttttatttaataaaatccaaaagttaaagctaaattaaattaatgaaaattttcaaacaaatttctttaattatttcaaacaattaatattttttggactaaatgattgatattattataaattaatatttgcttttcacataacattttttcggcgcggtttttcaaaaaatttttgggaaagaaggggggtccggcggtgccgataggcgccgccgggtgaaattttgaaatttgggtgtaatttgttatggtttttgggactattaagcttaattggtaggattttcatttaaaaaatgataaaaatgtgtcaattaaaataaaactatgaggaatcatattttatcgataggaaagccatgagtatacaaaaagaaaattcaaaatactttaatttctgtagagggattgaaccaggggaaagaagcagggaaagtcaaggagactagccactaggccatttgcacacttggtactttgagattattccttaattttttcctttaactccaattttcatcactaatttttcactcagacccccattcttaccagtgcttgtttttcccggttcccggttgccctaccggaaccgggacctgagcttttcaaaatccgggaccgggacctcggatgaccgggaattcccggcccggtctcggtcccgtggcactctagttaaaatctttgaaaaattcaaattttagtattcatttttgaaaaaaaaaatttttttttaattttaatttgaaaattcactatgtaaattaaaatttgtataaattttatgaataaaaatatgcatatatacattacatatttcaaataaattccccgccgaaaacaaaaaaaaaaatttttttttttcttcaaataacggcattttctgtataaaaatgccaaaaaatttcgactttttttaaatttaaatgtttaaaagcattctttttaattaccagtgactaatccttttttataagagacacaaaatgaatttgctttttccctcataatgccttcacaaatccaaggccatttccgaattcagcagaagcaggcagcagttgtcccccggcttttaccaattcccactttgctgctaataaattttgccaattcaaatatgccatcattttcattattttattggccataaatttggcccatataaaaaatggcctttcatggcgtcctataatttgtgctctggccaaaactttcaaattccggattgcctatgccgatgccagtgccaagactcaaaaacccccggcacccggacacgagtttaaaaaaattaggaaaaatccggcaaaatttttcaaaaacccggcacggagccgcaaaacttggcaaatgccggtttttcctggcagactggtatccctgatgtgattgtaaaacaaaattaccatttccaaaagataatgtaattatagaaaaaattaatcccaattttaaattttttttttttaatcaaaacaataatatttttaaaaactttaatttttatattctttttaaatgaatttttatttatttttattaatttatacaaaaaatcattcctcaaaaagttaatgcccataaatcattattttttgcttgtgccaccattttgtggctgagaaatgtgccgtcaaaatatttgttgttttccttggggatttattcgcctttcttctgcgatgaatttatgtgtgttgccaaaatttgtttgctatgccatcaacggaagttttatcttggacatgccgccaaggacgcccttgaaaaaattgaaaactgactgatttccgtcctttttgaaatttttaatgtccttttttcctggaataatccatcaggaataaataaactccccacttttttcaatcaaaaaaaaatttgcgtactttgggcgcgaaaaattcttgaaaaattcttaaatgaaccaaaacaaaaattatttggggctgaatgtatttgcatggatatgaaaaattttagtgctaggtttgattttccacgacaatttgaatttaaaaatttttaaatttatttttgggttgttttaattcgaaaatttcttcaatttgaaaaattttcaaaaattgttccagcagttgaaccagttcctcaaactaactgaggttgttagaattaagaaaacaaaaatttataa

SEQ ID NO: 14400 - DNA, 1879 bp, Heterodera glycines
ctgcaggtcactttcattataaaaaaggaattttgtgagacttcgaccgaaactcaattcaaacaaagtgaacgggattttgactaaaatttgagttcatttcaattaaagtataaataattatttcagtttgcaaagataaaagcaattagaagaattttgaaatagttgaaaaaattatgtcaacgaggcaaaaaggttttaaatttcggcaaaaaagtaccgattgagaaaatttaaaattttaatttcataatatcttaacacaaataaagatttgaaatcgttatcagacctttgaattattaaaaaatgcttttttgaaatgtataataattattttcttcatttatctcaacaatattataaacttttgtttccgctttattctttgaattttaccgaaacatttgctgtggcggcgtgtaggggggtgatgtatattataagcacaaatgttcttttcatgtttggcgatgtataacattgatgcttatttttacatatttgatctgataaagtgaattgtgccaaacaatatgtcggcacgaacacacataaaaaaaattgtttggacatttattaatggaatacaatgaataaagatgggtctagggataacacaatagaagaaaatggcgaattattggacaaagtgatagatttgagaagagaggcggggacagggaaaaggggccaggccatagaccacattcataattaacttttcctaaaaatgagttggatcgttttttcctgtccaaactgcaatggcctcaactgcatgaggcccgttaactattccaaacccttgatctgtgttcatccttccatcaaaaacctgaccgactatctccaaaaggaacccacggctacaccaaattgtacatcaacaactttgtcatttttgttgataatcatcaccgtgatgctgaccattattttgctggaccatgtaagtctgagcaaaattgatagaccaaatctccattcaaatcagtgttagggatttaataaaatttcgtaaaatattattccctttaaaagagatattttaagcatatttggcgcaattttgatattagaaaatttgaaaatcttttgaatacggtacacaaacacacatatatacaagggatgtcacagaccaagctctgtacgacggttgactgggacaggggtgctaccggactgttttttataagaaaataaggatttctaggcgccgacggagaaaaaattttggaatttgcaaagaattttgttttgaaaatttattcattttataatttatcacattttcccttttgttaccaaaccctgcccccacccttcattatgcccccccccctttcagtttcacaaaaataaataattctggtctctttaaatttagctttggtcaaaattgagccgattatgggacgactacaaattgcgtaaagaacttgtgaaacgtcgcaatcagaaacgtctgtttttggatttttcattaattatttaattcattttaattcgaattaaccaggctcgcgaaaccatcagtcgcaacagcgtccagcacaaccgttgccgttatatgttccgccagtgattacgggggtcagtttattaaaattttagaattgtttaaaaaaaatatttttccaagtgaattagaattaatttttaaaaaattccaggtcaaccgtcaggagcaagtggcactccccgcaatctctgtggcagtggttaccgatgtgccaaaaattgagcaacatgatggagacgatgatcaagaattggacctgcgttaggatacgtagccagagaaaattttagataaggggaagcaactgggtggaaaattgtggaaaatatttttaaattttttaaaaag

SEQ ID NO: 14401 - DNA, 2123 bp, Heterodera glycines
cacacacacatacacaccacatacacatgcaaatacgcatgtacatgtaaatttcactaattcttgtgcatttgtgtatttttttcaatttcatcttcaaatccttaattatgcatttctctacccaaaactgaacacttccaacccttaattatacttagcttaaaaaaattgtatcttccaaaccttaattttttcaaaattgtatcttccaatccttaattatgcactttttctacctaaaagtgacaactcacatcgcttaattatgttcaaattttatcttccattgcttaattctgcatgcttttaacgtccttaattatgcacttttctacctaaaatcgacaacttcgctcacataaaaaaatggtgtcttccattccttaatttttctacctaaaagtgacaacttccatcgcttaattattttaaattttatcttccattcgttaattatgcatatatttttatgaaaaacacgataaaattacaaaaaagatataaaattacaggaattagatataaaatatgtacatgtgtttatatgggtgtatgcatgatgtgtgcatgtgtatgtatatgaagataaaaatgaatgatgaagaaaacaattacaaagtgtgaccaaagtctaaaattctaaagttaggtccaacaatccctttaccaacataaggagagtaagttttttggagaggataagaagtgaccctcccatctttgatgctcggccgcagaaaatttggatatatcacgttgattgttgccgctctcccgtctctgcatatcgtaacacctgctccttgaatgtctcataacgaagtccttggttcttgatgacatcatagttgagagtgaagccgcgcactttgagcacgtactcaagatctgcgtcggcaggtgcatccttgcggcgcagcttgagtccgtactgaacacatttattcataaaatttattattttgtaaaaataaaaaagcaaaatttacttgttttgcgccaccgctgcaaaactccaaaatctcatgatttgggtattcgtccgtgaattgcccaaggtgtgggccggtcttcagtggacaattgtcatccggatgggtcaaaataatgctgtcggtgtctgaacaattgtatttatgtacatagaatatatgatttttaccggtataaaggagttggcaagaaggtgctctcaccactttctgcatcgccttcagcaagaggaggcgagcagccgaagtcgtccacaaagaaataacttaacaaaaaaatttttttacgagtcaaaaatttttacaaatctttagtagtagtactattaccgatattggagcatgcatgctcctcaatccattcttttttcttctcgtagctgatgagaatgtgctgctcatcgagctcatcgattgctgtgacctctagcgatcggttttcgagatattcggtgagcacgactgggtcattggttataagcgtttgcgacaatccaaagttgcgcaaagagaaacgaccccctaagaaaatattttaaataaatcgaattgaattttcataaattacataaattgtttaggcaaagctttgcgatggagcgcttgcccttatttggcatcatttgtgttgagtcgatggtgatgccaaacttttcgtagcattcccgcacgaattgtgcttccaggtcagcgttgcctttgatgtttgggtcgaagccgctggcttgtattttttgtgccataaactcggtgatgtaggacttgaagagcttgtcgtcactgtcttgatactgtagcacgcgaaagactttggtgacacggtagccttcgtccagtgcagcattcagctcaagcgaagtgcacgtgctgacccaaccgcgttgttcatcggagtgacgacagtagtatgcgtcgtctgcaccacccgttggaaagtctttggcacactgtatgcagagcggaaaacaaagacggtcgtccactttgacaggcaagacgggcacatcacaacgccgtggcggcaccacccacactttaagcagtgataagtcgtatgggttgtcagccgcgcgagtccattccacttagaagttcagcacgtgcacctttgggtgccccaattgggta

SEQ ID NO: 14402 - DNA, 4296 bp, Heterodera glycines
  misc_feature (4283)..(4283): n is a, c, g, or t
catactgtacccaccaatttccaagtcggaaagaatgtcgatatttgtaaccacttttgttggttttttttgatttttcatatgccaatgtcatgcaatgtattatttgtatcattacaaggctcagtcggctgaagaaaattttatacttttgatttgaattagacgggtcttgaataactgcaaaaaaacatcatagagtccaaatagccctgtatagagtttagagccgaaactagtaacatctgacaccacgtttaaacagctgtaagaattgactaaataataaaagtgtcacttttccatattttaattttgtagtaaatataaatttttaagcgcagcttggattattaaagaatgaaatcatagcgtaattagtaatagtttttcaatttttaatttaataagcccaaacttcccggttcccaaatttctggtcgcaaaaaattctgcttaaataaaaggaaaaaatgatcagtcaattaggaatggtttcaatttaaaaaaaaaagtttaaaaaaatgtttacgtaaatcctaacaaaattaatgcaataaatccaagtccaaaaaattgtaaacattgacctaaaatggtaaaatttgaattgggtttatgactaaaatgtttatcattgaaattcggtactcaaaaatgatagtctgctaaaacagctccgacaattaattaattcatatatcagcagttttgaaagtataatcaagaaaaattaataaataaaaaaacaggttcatcataggatggaggatattcaatggcatttttccccaaatcatattgggcatttatgtttcgtcctccgtttttgcttctttcacagtgaaatcgatggccaatgtcactttgtcctcgctttggtcgtaaaagcctttgcttgggtccatcagttccttaattatgttaaaatttaattgggcactatttatttgaattgtcacttacagcaattgaaataaaattagagaatccccagttgttcgttttattgttaaaagtatcttcattagtaaattctctccttaaatcctttacgccgctcttttgcgacacaattcgaagagttgccgaacatttgcaactccaattttctgctcaatatcaattaattaattgttgttaatatatatattaattattagtaattttacaccttcttttggagcatcgcacaaaaggaaaatggccaaccatttctcattgtcagtgctttcatttttcgttttgatttttgcccatattttccatggaaatcctttgatgtgcacagtttcgcttttacgttgactctcaaagatttctcgcgcaaattccgacactttttcaatttccattgaaagtgtgccgttggatttgttgggatcggaaatgaatttctccatttttggctcatcaacagttatgacatcaatggccaatgccaatttgtcctctgctttgttgtaaaagctcttgttcgagtccatcaattccttaattaaccataattagatatgccaattaagtaaatatgttaaattattactcaccgcaaaagtaatgaaatttccaaatccacggccgatggttgatctgttgataacccggtcacacaatgtcccaatggaattctccgcttcggtcttttctgacacaattcgataggttgcaaaaaaaacgcagttccatggtcctcctattttagtaatgattatatttttaaaatagtaattaaaattggaccttcttttgcatcgcaccataagtaaaatcccaaatatttcttctcatcaatgcctttcgtaatttttgctttaattttccatggaaatccatttatatacacggcatcactgaatctgcttctcccgacagactctcccgcaaattccgacattttttcaatttccaaggcaagtgtccctcttcggttgcccttggctttgttccaattaaaaattcgtccatggcttgggaatttcaacgagtacagcccgggcactccacgaagacacagaaacggatgggaattgaactgataaacgccgagcacttctttctctgttaacacaccggattgaactgtaaaatttcaaaatttattaccctgtaggcatcagttctctttgtccagttttcccataaattttatgtaaaaatttctgaccctccttgtccatgtatgaaattcaagcattaaaggtaaaatttcatatcaaccaaaacaaattcaatttaattcccgatttcaaaaattttaccgacgcattttgcaaaatcctcctcatggatattaggaaaacgaattttgaacagtgcaggaccaagtacggaacgacgatttcccgaggagcattcaatgccattctgacgacatttttcatcggcccaacggagtgcctaaatagaaaaaaatatcgaaattaaaaaatgaaaataaaaaattaaattgaaattacaattttccaaatttcaaattcatcgttgagtaacaaacgatcactctcgagaagattgcacaatattttctgttcaatatgcaaaaattcatctgatccgaacaagtcagccgcattttgacaaatgtaacgcaaacatttgatggaaaaatccttaaaaattgcttacacttggagcatgaatctcacacaatttcgacaagtttcgagctcaacaaacccgaattcgaacaaaagcattattaataagggttgtaaattatatggattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgggtttttagtccatattttggccattttttggaaattttcacaagaaaaatgaaaaaaaaacgaaaaatacacccctaaagatcaactttttggaaatttttaaaaattacaccccacaaaacacgaaaaatttgagttttcgtcgtcattttggcattttcaataaatatgttcgtcatttttttgcgaacatttctttttttttaatgagaattttttcgaaatttggcaaacttggaggtgtttttgatacaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttaatgtccatatttcgcgttttttagtccatataatttacaaccctaattattaaaaataaatttgtttttctcacctccaagtcgaaaaggagagcttgggcatacgcaaagaaaacattgcgcaattcagggattggaatttgcaaagaccggtcgaccaaatcagggatattgtactttttggctaattaaaaaataattaaaaatttaaaaataaatccaccggcgtaaagcactgccattgcattgtctccattcaaatcacttaaatcgtccgcgtaaatgaagctcaacatcactttgaacgcttctgcttcaatgtcaggtatctccacaacatcaggacaattaccagaaactaattgaaaaattaattagggaaattagcagagacaaaatgaagaacaaataacataattggcattttcccttaaaattattatttttttttaccattttccggtctttcttttttggcgtcaaaacggaacattgcctcaaaaacatcggaagcgctcttcaaaataagctgatgtgctggcaaaacctttaaaaaacgtggataattaatgaaattgcaattgaaataaaattaaatttttatttttaattaaactcgcctcttttgcgtctccgtcccccaccaaaaagtgcacatccgaatgctcacccgtgctcaacaaatgtttcatccgatccattgacgatggcattttatattaaaaaaattgcactcggaaatttgatcaaaatttttgtcttcggtaattagctctgaaatgaggcgcatttataaaagggataaaaataaaaatttaaaaaaacgaattttagttttaccataatttttgatattttttgaaagccttttcaaattttgaaaaatcgtttgccaaaaatttgctgaaacttccatattgtttaaaaaggtatttgcncaatttatggatc

SEQ ID NO: 14403 - DNA, 1142 bp, Heterodera glycines
gcggccaagttttttttttaaaaataagacaaaatggctcaaaaactaagattcggaccccaaaaataagattttttctaaaactaattacagcgtgaaagaaacgcaataaaaacatgaaaaatcgacttaaaacattgtttataaaaacaagggcttgcaactgaaaatttttgaaatctgcatttggccgacaaaaaatcatcatttggggtcaaaaataacattttggaaaattttattcaaaatcaaaaaatcaataaaaatgtttttttcatggcgctctttttccaaaaaaactttttggggattggggggtgtccggtggtgccggtaggcgccgccgggaaaatttttgaaaatttcactgcactatgttaacagatttccaccaaaaaacgaccaattttttagattttgagccgatttttttgaaaaaaaaagttttggggacccggcggtgccgataggcgccgccggaggaaaaatagaaattttgaccattttttaacaaattttcactgaaattttggagaattttacaatcacgaaaatgaaataaaaatgtaattttttcaaaaatcaaattaaatcaaatattcgcttcaataaaaaataatatgtcaaaacagtcattcaaattttacatttttattttcaaatcaaaaaataagcacaaaataagcacgtaacgctaaaataagcacaaatcttagaaataagcaccttggccgccctgccaaaaaatgatcaatttttatgacaatttttgcaagtattaagggctcagtgaaaatttttttaaataattctaaaaatgaacagaatagagaatttttggctagaacctaaaccggtaaaacccggtcaaaaatcgccggttcgggccgggttgactttttcagaagcatccggtttccgggccaggtttctcaaaaaccagtcaaaccgggtttttccaaaattcaccggtttccgggcccggttcatatttccgcatttttaaccggtttaaaaacttctttatacgcgttgcctacaacttttttttagaacaactcgttaatacacctaaaaaatctgttaacaaatcagaaggaataacaaaaaaaatttccggcggcgcctaatggcaccgccgg

SEQ ID NO: 14404 - DNA, 1572 bp, Heterodera glycines
  misc_feature (1554)..(1554): n is a, c, g, or t
tcataaccgtgttcagcaacctcgaaaacccctaaaaatttgtttttcatttaatttataaattttaaattttgttcgaattagggttcggggttcggaatttaaacaaaataaaggtcatattcgtgatcagcgccacaaattaccctataaaattatttaaaatgtcttttgagtactttttatagcacggccaattgagtcccagctgaatttggcactccattttcggcacttttcatcctgaaaaagggcaagcgcgcccgtaattctatttttctaacccatttcgaagctttttacatcaattctgaccgtttttatgcatttttgggtttggggactatgatcaatatttaccctaaattccacctattttaacgatttttagagccaaaaaatcgtatccccaaataacactaacaaatccattcactcattttcgcgtgtgtaaaatgcgatttttgcgcaaaatgttgaataaattatttgtatcattaattaagcgttttcagctgattttgcatgagtaactgtttaatcattaaaattaatttattttttacaaataattaaaataaagtagtaaataaatattaaaataacattgtaaaataacaaaaaatcattctttctttgcttcaattgtgtttatatgggcacttttccggaccaattgggcatcttaacaagggaatggcattttctgttcaaatttcgctctctctctctcttcacccgtccggatggttttggtggaaaaggcatttgaaagtgcgcagtttttctcgtccaaatttccttctcaaatcgctgatagtccgagggccaaaagcgcagtgaaacggcgccatttgagaggacgaacaattggcgttggctgtgcaaaaaggtcaaaaggccacgacgggtgccggacagaaaaagactgaaaacccataattttaattttaaatccgtttattaaatacaaaatctgttcaccggtgctcctcatttaacaccgttttcgcaatctcttcaaccgttgctgtaccgccacaatgccaattgctgaaatgttgaattaataattatggaatagaattttaattaatttgacaattggctagtgcttcttcggtcactaacataaatttaccaaaatttcggtacttatgtgatttagaccacatagttcgggaggaggaaaaaattgcaactgaacctgtgaaagaatgttgaaatcttttgtgttttacactttggtccaagtctccgaatatttaggaaacgattaaaaaaatcacgtacagtcatggtcatatgtttatggtagggtgctctcaatttctatttgctttgataaaacttttcaatgaaatcttttacgcttaatgttttgatgttttttatagcattttctgtggctttccaaaggcaccattatcttctctagggaatatttagtgacggagcaactttcgcctgagtgtaccacaccctatttttgggtggtcataagtttatggtagatttgaaaatgacaaaatgaaaaaggatttgatgggccanaaaattctgaaataattc

SEQ ID NO: 14405 - DNA, 2308 bp, Heterodera glycines
  misc_feature (47)..(47): n is a, c, g, or t
  misc_feature (49)..(50): n is a, c, g, or t
  misc_feature (53)..(53): n is a, c, g, or t
  misc_feature (55)..(55): n is a, c, g, or t
  misc_feature (64)..(64): n is a, c, g, or t
  misc_feature (70)..(72): n is a, c, g, or t
  misc_feature (78)..(78): n is a, c, g, or t
  misc_feature (83)..(86): n is a, c, g, or t
  misc_feature (90)..(90): n is a, c, g, or t
  misc_feature (92)..(92): n is a, c, g, or t
  misc_feature (94)..(96): n is a, c, g, or t
  misc_feature (99)..(99): n is a, c, g, or t
  misc_feature (103)..(106): n is a, c, g, or t
  misc_feature (112)..(113): n is a, c, g, or t
  misc_feature (116)..(116): n is a, c, g, or t
  misc_feature (122)..(123): n is a, c, g, or t
  misc_feature (126)..(127): n is a, c, g, or t
  misc_feature (131)..(132): n is a, c, g, or t
  misc_feature (134)..(134): n is a, c, g, or t
  misc_feature (137)..(137): n is a, c, g, or t
  misc_feature (140)..(141): n is a, c, g, or t
  misc_feature (144)..(144): n is a, c, g, or t
  misc_feature (149)..(149): n is a, c, g, or t
  misc_feature (157)..(157): n is a, c, g, or t
  misc_feature (166)..(169): n is a, c, g, or t
  misc_feature (172)..(172): n is a, c, g, or t
  misc_feature (188)..(189): n is a, c, g, or t
  misc_feature (198)..(199): n is a, c, g, or t
  misc_feature (205)..(205): n is a, c, g, or t
  misc_feature (207)..(208): n is a, c, g, or t
  misc_feature (211)..(211): n is a, c, g, or t
  misc_feature (214)..(214): n is a, c, g, or t
  misc_feature (217)..(219): n is a, c, g, or t
  misc_feature (225)..(226): n is a, c, g, or t
  misc_feature (230)..(230): n is a, c, g, or t
  misc_feature (232)..(236): n is a, c, g, or t
  misc_feature (262)..(262): n is a, c, g, or t
  misc_feature (266)..(266): n is a, c, g, or t
  misc_feature (269)..(269): n is a, c, g, or t
  misc_feature (275)..(275): n is a, c, g, or t
  misc_feature (280)..(280): n is a, c, g, or t
  misc_feature (290)..(290): n is a, c, g, or t
  misc_feature (313)..(313): n is a, c, g, or t
  misc_feature (331)..(331): n is a, c, g, or t
  misc_feature (334)..(336): n is a, c, g, or t
  misc_feature (346)..(347): n is a, c, g, or t
  misc_feature (354)..(356): n is a, c, g, or t
  misc_feature (375)..(375): n is a, c, g, or t
  misc_feature (377)..(381): n is a, c, g, or t
  misc_feature (385)..(389): n is a, c, g, or t
  misc_feature (391)..(391): n is a, c, g, or t
  misc_feature (405)..(406): n is a, c, g, or t
  misc_feature (409)..(409): n is a, c, g, or t
  misc_feature (416)..(416): n is a, c, g, or t
  misc_feature (425)..(426): n is a, c, g, or t
  misc_feature (428)..(428): n is a, c, g, or t
tttgtcagttccattcacggtcagccatggcttttcctttaagggcncnncgncnccccccccncggctnnnaccccnccttnnnncccncncnnnccncccnnnncccaannccnccccanncanncacnncnaanaannccnccccncaaaaggnggacgaccnnnngcnggcagcaaccacagcnncaactcggnncaaggngnnagncancgnnngcgccnnccgncnnnnnaaacgaagcggagacacaaggcaagngcancancaaagncgganggcccgacanaccccaaaaagccaaaaaggacnaagccccgaacagggccnaannngccaaagggnngggccannnggagacaggcaccatcggncnnnnnacgnnnnngnatcaaacgaaccgnnggnccagggnctattccgnngntcgaaagttcggctgatctgtttcttcatttaggcatgtgtttatcatcagtaagcgttggctttgcttttgcttttgctcttctgctcccccccccccctccctttagacatgactttcggtgaccttctcctcacaggttcgacatggcctcagtttttctcttctcacaaaactcattcagttttttgccatcccaatgagtttttgatcagaaaacatgaatttctgcgccacgtcggcctctgttccatcattcacgtgcgtccgccaatgtgcgtccgttggactgtcatttgcgcttttccttttagttttgcaattggatcggtttggcggtctccgggctgtccctcactcttttgaatgttcgtcacattctcttcatgctttctgctgatcattaccatcccaggtggacaaactgatctacttccggtggcccttgtcttatgagagagcgatgtccaaacggagagcgatttgcttatgcggcggagtttggatcgtttctctggggtttttggattttttagaagtttaattattatttttacttaatttgaaggtttgtttcttatgtatgggccgagaaaattgtttttgtgacgcccgtttgcatgcttcaggtgagaggggtggaaatagcgcaagggtaggagagaaggggaaggcagtgagagtggaggaaggacagaaaaagggagggggaagaggaaacgaaagagggggagaaagaagtgccaaaagagggaggttagtttcgttgttttgttattctaatggacctatgactggtgtttcaatataatcgtccattttgtactattctatttatcactcaccactcattggcatcctccgccccttcctccacaatttcgccctcttcctcctcctcatcatcatcactttggtctcgcattacagtgccgttgtcatttcccgtccctttgagtgtcgcctttgtccctccctctgcgacgtcttgatcttccccaacttcgtcaattcggtcatcctctgaaaagagttcgacctctccgcccccctcttcctgttcttcctcctctctgtcgctgctcttctcacttacttcctcatcctttgtttctcttcttttttcttccttttcatcgttttttttatttttcttctcttcaacatttggtccatcattttggtcaatttcggcagtaatttgtttactaaataaattgaatttatgatggtttatttattattaaatgtgtgctatctgcatgggtcccagaaattccttcagaacttgaattaaaaaaacatgggttcgcatatgtccaagtccgtgtttgttgtaatgaataactgacggttcttccgcacgactttgccgctttttttccactatgttttgtgcagatgttcgctttttacgtccaccgacactccgtcctccactgccaaatgaatcgttcgctccgctgtcgtcaaaatcaatgcgcgccctctgtggactgttttcactgcgattggtgctcaaattggtggccataggatcaactggcggcgaattcgaggtaaaagcaacagtcgaagtctgaacaagtgggggggggggggggaagggagagcaaactcttgacaatttgagacgggaaacctttgtaggtccagcagatgcttccaatttggagggtcggtcgaacgcaggggtggcggaacgggaacgcgaacgggaggatcgtcgctccatctctatctgtttgtgagtgaaaacggaccattttgcatcattcaaattcaaacctcttcaagagcattcgcattgaattccgcttccgctccacgcaatcgcctcgagcgacgagctgatgatggtgtctcgtcctcggccccac

SEQ ID NO: 14406 - DNA, 2376 bp, Heterodera glycines
  misc_feature (74)..(74): n is a, c, g, or t
  misc_feature (2343)..(2343): n is a, c, g, or t
gcattggtcgaaatccaaaaatcaatcgcattcgccacagaaatgcatcagtcggagatgcaccacttctccanaaaacattctgcaaaatcttctcattcgcctaagtcggccacagcaatgtttgtttttgttgatgccgaaaatgagacggacgaaggcgaaaatggtggaggaaagatgaagcaaaaggacgaagaaaatacggaaacgaaggaagggtaaagcatagggcagaagaggaacaaaagaccaaacgaacggacaaaagaccaaacgaacggacaaaagaccaaacgaacggacaaatgaccaaacgaacggacaaatgagtgaccaaaaatggagagaccttcgctttgttttattggcccaacaaaggacaaataatcatttttaaatttcacatttgataaatgtctcttgctttttttgttcaataatataagacttttgacttgttatgtttggatgttctgatcaaaaaaaaaaattatttttatttttcgatcagttcattgttgcgttatgctcagaatttaccaaataagctgagactaaaaagagcagcttcttaaaaggcacaatttgttgaacattcaactaattgtaagtaaagtgaatataattttttgagatttctttgtaaaaaaacaatttaaatttcttttatttccttttttaatttggaattttaatttttaacctcttttgacgcctttttctaatcattaaacaaacattggtttatttcttcctaattattcctaatttacccattcatttgtccccccgccgtccctcggctccctcaaaagcgttgtcttttaccctttccccgcaggaaagtttcccgccggcaattcgcccgtcgctcgctttgatttgttcaattgtggcggacgacaaatgcaaattaattggctgccaaatttgccttttctttttgaaaatccccgaatatttgaaaaggaaacccaattgaccaattaggcgaagggaaagcgatgaattaattctgtgcttttctgctgaaatcccccccggcgtttcttccacaaattttgcgacccattaaatcaaatcccccaaattcgtcctccacccccacctgctactctctctctctctctctagggagaatgccctcagggcaaaatgggacggtgtcggagtgaaagaatgcgaaagatgtgggcagagacattcaaatgggtaaaacatggccaaaaacactcacaatgggcgcgaataatggggttgaggcaggtgatatgggcaggagggaggggggggggagagggagggccgtctcaatggacctttctcgaggcacgtttctctcatcctaattttgattgcacttgtgccaattacagtgagcattgaaacaagcgcataaaatgatgagtggggaggggggggggggaaaggcgacgatggccattgactcggaaagaaaggcgttcatgtcaccagtgttttatgccgttgttttattgttgtcttcacattttgcttttgttttgttggcatttgcttcgtcttttcttttattttcccattttcaaattccctccaatttttccaattcattgccattccgtcgcctttggtccgcttcttaggagtgcggtaatccgattactatctttaaatccgttctatatttctggatttatatgaattggaagtgcgccggggataatctggaatggataaatctgacgagggatgcgatgaatttggagggcgggggggggaagaagacgaagtgacaatgggaaaggagaaaaggcgggatgagtcgcattggcagaagaatttatttcaaaatgaccaaagagtcattctctgaccactcgctgattattccaccaataatttaaccaaatgacaacaaaacaacacaaacccccttaaggctcttcgtccattattcactctccccccccccctttgcttttgtccttccatcccaattcactttcggtctttctttggcgataatcgcttaattacgcctttggaggacatcgcccttcggatcctttctcgcgttgtccaaatctcatcaaaggcataaatcatgagaaggagcacgcgatggaaggagaaggcggataaaaagggaaaagaggcgcagatcgaatgaaccgggggggggggggaattgcgggaatctgagggtgtgaattacgagagagattgagaaggggcgataaagcagctaagagagcaaaagagtggaaccaaacgaaaagaatggaagaaaaagggaggaaatggcaaggggaaagggaagaaattaaaaagaaaggtgagaagaaaacggaaaatggngagaagagaagaggaaaggaaagggaaaagtga

SEQ ID NO: 14407 - DNA, 3550 bp, Heterodera glycines
  misc_feature (2752)..(2752): n is a, c, g, or t
  misc_feature (2855)..(2856): n is a, c, g, or t
ctaatcactcttctaatcgctgttgtacctcttctaatctctgttgtacctcttctaatcgctgttgtaatcactcttctaatcgctgttgtacctcttctaatcgctgttgtacctcttctaatcactgttgtaccacttctaatcactgttgtacctcttctaatcactcttctaatcgctgatgagttcaacggatttaaaaaacgggcgcgaagcgcccgttcaaggccaacaaaaattgaaaaaccggcgcgaagcgcccgactgaggccgcgaagcggcctaacaagctaaaaaacgggcgcgaagctcccgtctgaggccgcgaagcggccttaatagcccaacaaatttagaaacgggcgcgaagcgcccgtctgaggtctcgaagctgccttaatagccaaacaaatttagaaacgggcgcgaagcgcccgtataagcccaacaaaatttaaaaaacgggcgcgaagcgcccgttcgaggccgcgaagcggccgaaaagcacaacaaaaattagaaacgggcgcaaagcgccgttcgaggacgcgaagggcgcgaagagcccatcttgagcctcgatgtggactaaaaacccataataattttttaaaaattcaaaaaaaaatctccaaccaattcgatcaatttgaatcgcttcacagtctaggtagcgaagctcccaaagcgcgaagcgcttttgcccagctaaatagccgacggttcacgcacccgctagtttatatataactaaagaaacaaggcaactcattgctaaaactaaaatctcgggaacggctggcgggaggggctcgggaatgtggcattgcttaagcaactttttgaggcgcatccaggaaaactataggcattttggtccgagggccaactgagcgccagcggcgctgaaatggctttttgggggaaaatgcatgcagtttttgggccataacttttttctgggaacccggagccaaaaatgtctgctgaaagggccctaagttggaatgtttgggaaatttttttcttcttggtcgagaccctaggatcaaagcccgagcctgcaaaaattcgcaaaaatttttttccattttttcggtttttcagttttttgggaataactcgctgggcattgcgctgagcgtgtcggcgccagcgaactttttaaacagtttttcaggctgcatctaatggtttttttaaatttctgaaattttcagaaattttcgagctaggccccctcgtcacttttgaggtttttgaattttagtattttttacagatttttcctggaaaaacgaagaccactttcaagcaaccgtttttcacgctctatcgattggtgtaattgtcagaaaaatttttcaaaatttttttggaaatagaaaatttttggctggtgagcataaatttcagttatgtgaccataacttggcaggggttgattttaacaaaaaatcatcttagagcttttttgtagagaattttaaaccctatctattatgctttgtcttatctttttatcttaaatatgcaaaaagttataaaattaattgtgattttgaaactcaaaaccaaaggggggaccccatggttttgcatttcatgaaatttttttttgcttctaaattagccaaaatgcatttttatggcataatttgaggtgctgaatacgtatatacgctttattttgcgtttcagattttttgaaaggtgtttaaaattttttgaaaaatcgtcaaaatttgagccccggaaaatccagtgaaatttcgaaaattcataactctcttcatttttggtcaaatttagtggaataaagctgtaaaaatagagaaaaattgtgagaattttatgggatttatttgggttttctaacatcaatatgaaaaaagttattccagaaattctggaaattttagatttttcagaaaaaaattcgtaactccttctgaaaagctatttgagaaaagtaaaatactacaaaaaatccgcaatttttttctctataatataaattttattttacatttttatcacatttttaaaaaaagatataaaaataaaagtcattttgtaatttgggaccacaggggtgtgaccatgatttttgagtggaaaatttttttcaccaaaaatcttccaaaaatatgattttaggggatatttgggcgctgatcatgaatatgcaatcatattttactttagacatggttaagagctcagaatccctgtgtgattggggattctgagacatcatttttgggggggggcgaagtacggatccgatcggtgtacattatttttctttgtatttttgggttatttttaatgttttattaatttaaaatattgtttaactaataataaataagtttgtaattaaattaatttttttttgatgaataacattttattttgaaattaattattattttttaaattaatttaatattgttttattaatttattttaaattattttttgacgaataaatgttttttttattttgaattatcgacaaaaattccttttaatttgaataaatatctatattatacaattctaactttatttttttttaaaaaggataatttttttaattaaaccatgattctctcttaatcactgttgtacctcttctaatcactgtgtacctcttctaatccccacaaaattaaaaaacgggcgcgaagcgcccgtctggccccacaaaattaaaaaacgggcgcgaagcgcctgttctgangccgcgaagcggccgaatgcccccgaaaattaaaaaacgggcgcgaagcgcccgttctgagggcgcgaagcggccgaatgtcccccaaaaataaaaaaacggnncgcgagcgcccgtcctgaggtcgcgaacggctgaatgttcttacaaaataaaaaaacgggcgcaagccgcccgtcttgaggccccaaacggcccgatgcccgggcaaaatttccgccctaaggcccggaaagggggcgaaagtcccccccaaaaaattaaaaaaagggggccaaaacccccctcctggagggttcgataaaattgctaaaattaaacataattttttataagaaaacggggaaaaaaccccttccccctaaaagggaaaaaattttttttcccccccacaaaaaaaaaatttttttcacccctttttttcgcggggggcccccctttttttttttttttaataaaaaaaaaatggatttttttttttttaatataaaaattttttcgccccccccctggggggggggggtccccgcggggggggggtttttttttaaaaattttttttctgggggggcccccaaaaaaaaaaaacaatttttttttttccccacaccccccccccccccccccccccccttattttttttttttttttgaaaaaaaaaaaaaattttttttttttataaaaaatatttttttttttttggccccccaaacacaccacctcttctgttggagagggggaggggggggaggggggggggggtggggtttttttttttttttttttttttttttttt

SEQ ID NO: 14408 - DNA, 2505 bp, Heterodera glycines
caaacgcgctgctaatcaactaataatctatgttatgccagagcagcgatcctaccaagtcacattcaaaaaaattgaatttattattttatttctaatcatataatgcttttcattttttattaaagaagttctcactgtttgtgcattcgctgggtgctcaacagcttcaagtggcggcacaccgatcggtcatagcccggctcctttacttgagcattccgaagttcgaccacttcggtagccgtcagaaataccttcacgcgctcacatttgcccagataggcatggctacggtcgctcaattcattctgtatggattcaatgtgacaaaaaaaaagcatcgaagcattgggcactacaaatgatcaaataggaattaaattttgatagctccccctatcattggggcaccaaataaatatccctcaaaaaaacgaaaaaaatttctcaactggccaccaattcttttctctctctcttcttttctttctctcgctcctcttttctctctttttcttttattttctctctttcctctttctcctcttttttcttcagtctctcctcttttctctgtctctctctctcttttctctttgctttattcttctctcctttttatctctccctctctctctctctttctctctcctcttttctctctccctctctctctgtctctcctcttttctctctacctctctctctgtctctcttttctctctgtcttcccttttatctctctctctctccacttttctctctccctctctctctgtctctcctcttttctctctgtctccccttttatctctctctctccacttttctttatctctctctctttctttatttctctctgtcctctttctttctctctcttcccctttatctctctctctttctcctctttttctccctcactctctctatatctctcttcttttctctctctctctccgtgtatctctctctctctccttttttctcttcatccccctctctctctttatctctcccctcttttctctctccctctctctctgtctctcctcttttctctgtctctctctcttttctctttgctttattctttctctcctcttttatctctctatctctctctttctcctcttttttcttcatctctctctctctctttatttctcactcccctcttttttctctccctctctctctgtctctcctcttttctctctgtcttccctctttatctcattttcccgcagctcctttcttctctcctctttttttctcactcccctcttttctctttcctctcttctttttctctccactctctctctatctctccttttgtctctctctctctcctcttttttcttcatccccctctctctcttttctccctcccttctttttctatgttcttttctcttttttctccctctctcctcttttctctctccatctctctctgtctctcctcttttctttctctctctcctcttttctctctttcatcttttctcttcatccctctctctctctctttatttctatctgtcctctttctttctctctctcctcttttctatttcccttcttttatctctctcactctctctctatctctccttttgtctctctctatctctcctcttttctctctctccgtttatctctctcaaaggggaccatattacaaatttctccatagtgatgacaaattcgctcgtctctccgttcagcatcatttgacgcgatgaatacagtagcaactggctgttgtcgtacaagaacgtttggctctttttgtccaaaaattcggcattttctgccagaaaaataagcaccagcgcccaatgcaactcgtgacgcgtctgcttctccttgctctcgctggaaaattggggtgtagtctcggcacaatttttgctgtccgagattggcactacgctaatgagtcactcactcattgcgaggcacacgggccaattcctgcagtttcgattggcccttttggtactcagccacgaagcgaagctcgtgctggaatgctttgtctggcacaacacccaactccaactcaaaagctttgagcagcatttccaccggcgcaatgccacgaatgttttttgctgattgtacttgcatgttgttattgttgttttttaaaaaaaattgacaaaatcaatcttttaaaagataaattaaaattcacaaatagattagttgataagaccagagaaaaaatgaataggtaaaaattggttaaaatgaggggggagggcgaatgttggacagaagagagacgaaagaaagaaaaagcaaattgaatgatcagaaaacgacgggggtggcactgctgaatattaatgaagctgcgctggggttcatctgtcgattaaaagccaaccgatgctctcacgggggggggggggggggcggggggcaatcggtcgcaaagtccgagccaaccgttttttggccatcacaatcgtttagcattagcattat

SEQ ID NO: 14409 - DNA, 3044 bp, Heterodera glycines
  misc_feature (46)..(46): n is a, c, g, or t
  misc_feature (110)..(110): n is a, c, g, or t
  misc_feature (142)..(142): n is a, c, g, or t
  misc_feature (163)..(163): n is a, c, g, or t
aaattcacattagattagttgataagaccagagtcctcctaggatnggtaaaaattgagaaaaatgaggggggaggcttaatgttggacagatgagagacgaaagaaagnaatttgaatgatgagaagacgacgggggtggnactggtgaatattaatgaagntgagatggggttcatctgtcgattaaaagccaaccgatgctctcacgggggggggggcggggggcaatcggtcgcaaagtccgagccaaccgttttttggccatcacaatcgtttagctttttaaattcgaattatttaaattcaaatattttagctacttttttatttgggagaacaatttgttaacaaatattgtccacaaaattttccaactcatcaatgctgcacaaaaaatgccaggattaagtcgaattaaatccaagttgatcagaaaaagaacatttttatgaacacatcaaaattcatcatttaaaattccttaagtgctaatgaatgaatgcatgaatgaatgattggcgcaagcatctcttacatcatcatcttcctattacaaattcgaaaaagattcaaaaatagaaataaataaattaaaaaaataattgacttttttttacagaaaattaaccatttgataaaaataaatattcaaaaaatgaacggattgaatcacagtttttagttgtgagaacatacacttatgtacataaaaatgaaaatgaataatgcacacaccaaattcatcgaattaatgaatattaattttgtgtatgattcatttatttgtgaatgtttttgattttagacataattataattataacaaatttatgtcaaatctcatcattatggcttccatttttaggcaaatgcctaaaatttctgcgcacttaatacgcaaagataagcacaaaaaacgccttttccgcttggtttggggtgtctacgatgacttttataatgcctaactttgtctattttgaactttttgtgcttaatgcttatttttatgcctatttcgccattcttggcgtctttttcagcactttcggaaaaatccttaacaaaaacgcaagaaaaatgaaaaatacacccctaaaaatcggcgtgaaaattttcagaaaatagacccccaagaattgaaaaaagttttcacaaaatcttattctcaaaaattaattattttttcttgacaaaaattttggtttaaaattgtccttttgaaaaaactttaaaacaattgaaatataagcaaaataattttttcttaaattaatttttattaaaatttaaaaaataattttttgaaaaattcagaaattttataaaatttttttaaattttcataatttctttagttttttaaataagaaaacattgaaattttttactccatacaaactccaaattttttcaaatgtatttttcttaaaacaatgtttcataaaataatcacctcctatactcgcatttccaaattttgaaataaaacccaccaaaaaagcagtaagtattccaaatttggtttgcccttctccctcgccaactgatggaagaccacaatccatcttcaattgatgcaaatttgcattatgcaaatgaatcatttttccttaaaatttgctttttcattcaatggagcacgagaatgaaattgttattcccccattttgagaaatgataggtcctttcttgaattattaattgaaattgaatcagttttttgtgtgatgggcctgattgggaaggtttttttttgataaatgtatcaattttaaattgaagaatctttattattgttttgatttaaattacttatctctatttttgtttaccacaataaaatttcatgcaaaatgtaacaaaaaaacaaataaaaaataattagcatgtgagattttgcataaaattgtgaactaaaatttagaatttttaaaacataaaatcatcgccttgttatggagccaacaacaagaaaaagattggaaagaagctaaagaaactgaagagaagccaaattttcatactttgttaagccaaaaaagtgcaaaataggtgctaaaaattggaaactccaatgtctttatgcaaaaaaaaaatcccaaaagttaactaattttttttatcaatttctcccgcacaactgcaactttgtcaagaaaataaataataaattttggagacacatttttgcgaaaatttttaatttcttagagggtatattttctgaatttctggtcaatttttaaggttgtctttttctgaaatttttaggatcgattttaggggtgtatttttcgttcttattacaatttttatggaatttctgaaaaaaggccaaaataggtgcttaaagttttcgaaaataccaaaataggtgctagcccccgttttatgtgttttaggtgctagaaagtcgttctaaatcgaaaattgttcggagaaaatgtgattttcgtgcttctctcatcaagtagtatttaaatcatgttaattggatttttcagggcgctgaacataaattcggcatccagcgctgaaacccgaaaaggagtccaatcacaaaagatgattacccatttttgttgtgccataataaactgggctgctgattatgacccggcatgcattatgccgaaatcccgcatcccggaaacatacttacataaaacccaaaaaaagaccaaccacaagagtaaattgcaaaaaaaagattatctccattttttgtgtcacaataaatttagtgcaaaatgtgacgaaaaaagcaaaataaaaaaaggaatttattttctttcccccgtagaaccatcataaagcataggacgaggatttttaaatgtttataattaaaataaaatgaatatttcaatttcagtaagaaatttaaaaacatttctatttttttcaaatcaaaaaaatcctcgtcttgctaagtataatatatgtatcacattcgaaaacaaaaaattggtctttggacaaaacaagcagtagcatcggcagatggcaacacgagatttttgtcgaatttcccgtaaa

SEQ ID NO: 14410 - DNA, 1298 bp, Heterodera glycines
atacgaatgcagtcctgtgggttagggcacctcctgtccccttcggcgacagcattttcttgtctttttgtgtattttttactgtcggattgtccattcattatccgattgtccgggagccacttttaaaacatttttttataaatgagactaatatgctatatgcagtccagttgttaaatcagttttctttttcagttttttctatgtttaaattgcacagaagcacagaaaaaatgcttgatttttttatttattaactttaattattagtatagggtgacaaataagtcttgtaccactaattttttgttgtaacttttaacaagcaaccaaaaataacaaaaatatattcaaaatgtgctcaaaagattagggaatattgctacataatagtttttcctatctttatagagtacttagatagatacaaaaatgtgccgaatttttttgcagaaggcacgcaactcccggatttttaaaaagtggacgaaatcaaaaccacaaaacaattgtcattttgggataaattctgttaacaaatttttataaaatttcagattttttcatcggactaaagaaagattcaaattctgaatctctctgggtcattttcaataaaactggaccatttaaataatatatttgattgacttatttgaaaataatttttaattaatttgcaatttttttaattgttattatatatgtatatattttttgcttagaaaaataaaagaaaacattttttatataaatttttatctaataaataattaaaataaattaaactttattgaattttttcttcgagagaaattgtcgggttttcctgtttcccggtcccggctttattggtaccagcaagtctcggtctcgctcaacttcacttaaaaatattaaatatcaaacttattttgattttcagaaaattattcatttacttcggatgagcgtgccatgcaaaataattttgtggccaatcttcatcaaaatggcatttcgtttttggcagattatgccgcactttggctgctcgggttggacatgcttcaaatgtataacaaacacgaacagcagattaagttgttcattagtcgaagttgcagctgcaccatggaagcatgggtaattattaattaattaaacggggataattaattcattataatacctctaaaaattgacttatttaaatcaaaaataatcatatgataaaaaaaataaataatttattagggctgtaaattatatgtaagaaaaaatcgcaaaatatgtacataaaatatgaaaaaggt

SEQ ID NO: 14411 - DNA, 2303 bp, Heterodera glycines
tgcaataaattattatttcattttagttaccaaaatcaattagaagtaaaggcgtacgattggtaaatggcatttacgtgctaaacttggacattgtgttgaccaagcgttgctatgtgctcagaatgaacggcactcagttgggcaaaccgatttgtccgttggaaaaaaatttgccattggaggaaatcagtgggataaaggtgaaacggatggacgagagtcggagttatcgtggtcaaataggtcgggaccaggaatcgggtttgatcaactcttaatttataaaccagaagaaatttattggttaaaaatatttaacgaataagtaacaattgtttctctattttttcgttagctttttctatggagaatatttatatgattgttcggcggtgccagaggcgccgccgggaaaatttttgaaaatttagttttggtatgtttacaaattttcacaaaaattgacattttttaggttaaactttgaaaacattaagaatttctaatatatttgatatctttcctctttaggtgcaaggacaaatgttgcttcttggagatcctcaagtgaacgaaaatgatgataaaataaaattcactcaagaagaggtagatctaatattatatccatccctaatggaataattaaaaaaaacatttaatttaggcgcccgaaatacgtttcgattggtgggctttgccgaagggaagtgcgccgttggactgtgctcgtctgtttgccaaagataaaaaatacattggcaaaatggtaagacgacgcatttgtcgtgaggaagatcctactgaaaatgacttggatatgtcctgcacggctattcaaagcagaaaccgattttggcacggtgccaaggatgaccaacaaggggagcagaatgagaaggagcatgccaattacccaatggcacaaattcgaacagtgtacaaggcaagaaatggggaaattgggattaatattggatgtgaatattcaaatggcctgaaacccattcggccattggtttgaaaagaattcaattttctatgggtataaatggagcaaaggtcaacttgggtcccacatttccatgcttattctttggatttttgaactattatctcttttgtctcaaattattaggtcaattttggtcccggcatatgaacgacttttaactctttttcatgtgttatgtttgtgaaacaggctcacttggaaacccaaaaaaaaaaatttaagatttccaaattacgattatttactcttcccttttccattctcttcccaggactatgtggtggttgagttggaattcgccgccactttttccccgctcaattggtactgtttcgtcgtcgatgccgcgtcccccgcgctgtttaagcgccgcgtgcgcgcgttggccaaatgctttccgaatgtaattatgggagacgagcgcccgatgaaaagtgacggggagggcatgatggaggcggtgttggactgttttgagcgattggacacgccaaaacgcaaatgggaatatgtcactctgttgcaagtgaatgaatgggccacaacttatttaatatatgtaatacggtatatgcgcaatgtacggtatacaagacaattagcacaaggtttcaaaatatcacagaaaataatttttaataatttgttaattttctggtctgatttttatgatatctatgacccaaaaaacggaaggcattatcatattacaaaccagaactcaattaatcattattttttattattttcttaatagaatcacgacacggcaatcaaaacgcgtgttcaaatggcacaaattttcgcttggatggacggagcaaacgatgttcaagttttagtgccaccgcctggacgagttgacaaaattacaggaatggactggagttttgaggcattaaatttgttcaaaaatggtaatgaataattaacatgattttaagtgctttaaatggtttcaacaataaatttaacaataaattattatttcaataagtcgaatgtatgccaatccattaagtgtctcaatattgcttatcagagcaatttgagaggcgaaatttttcgagactcgagccatgagagcacttaaatatattaaaaaggtcctaaaacttagttattaaattaaatatgttctcagaataacaatgaatccaaccaaattggcttttaattttaattcttttacaatgggtcacagaatgtcaaaaacaaaaaataaaattttgtcttatcttactttctttctttttttttcttaattatattacatttaaaaata

SEQ ID NO: 14412 - DNA, 1629 bp, Heterodera glycines
cataattagctaattgtctaattaataatttcctgtcattacattagcccattcgctgattattacgacacttttttgtcctttggattccccgcgatttatctactgtttgttgtgttctttttgcggaaacaagaaatgaaaaagaatattcaacagaagcgactgaccacaattgttgtgtcgacccattcgcttttcaaaaaggtgaaaatatttttaattttccaaattaatttcccctttttcaaaggttgcaaacaaaaacaaaaattgctcttcgggcggtgattatgcaaaaatcgtaagtcaatcatttatcagcagcacctaattagtgtgttttccatctctaattgccaggtgtttgtccaagtggccgcaattaacggcataaatgtggccacttttgtgctttataccgtaatgcagcaccttccgatgagcaaatcgctgattgtcgtcggcttctacttcaactatttgatgtttggtcggtaataacacatttggcaacaattaactgttttattaggcattccgccaatcgtttatttattcgtcaaccgaacaattcggaacgaatgccgcgcgatggccaaaaaattggtcaaattctgatgaaaaggaagcagcactcctccaccagagatcaccaattatttttcctaattcctttatcattctttttgtatctcttttcgttttttcctttctctcattccccaaaatttgtaacattttttttgtatttattatttagcgaataaattgcatttatccaattaattttcatagaaaatagaaatgacacaaataattgcagtgtcagaacaattatagcccatgctcatcagtgtagaacaattgtattcatccgcatcaatgcgttgttcaccagccgtactgagtggccaattgctgggccaatgaaaccgtttccactcggccgacgtccgtgtccgtcccttcggtcactccgacgagaaatgctgaacactttcatttttaattaacgaaacaacgggaagtggtgatgagctctgttcgttcttgcaatcgtaacgccgtgctgtccgtcaatctctcctgaacatttgtctaattatggcaattagtgagttggatcgaaccgctgaggcaagtgttgttggtcgtggacgggggctgcgtaattggatacctaagcaaagagtgggcataagtaattaaaattatgttattacgcacgtcactccttcgcaggctaagccacggtttgccaaaacgccgggctaaaaaaagtaattaattgggccaatggccaatgattgtacatttctaaaggcgctcactgccacattcgcttccattggatccaactaagaaaaaacaaaagatattgaaagggaaggggcggggaaatcacattgaaattgtcagatttggcccaaatatttccgtcttggccacaaatcgccgcctttgtgattgggcccgtggcttaacattgccgtgaaggcgaattcggtaattacagaaaatgggaaattcaccggccacttggttgacaaaagtgtgccatttggtggcgtccatttttaatattaaagcgaattaatagggcttaaattcagaatcgatgatgga

SEQ ID NO: 14413 - DNA, 1910 bp, Heterodera glycines
ttttcccataattttctcgcggttcgataggccgacaggcgccgccgtcggctgtcaataaatgctatttattaatgtttgtttttgtttatcacacaaaaatttggcgaaactttgttttggggttcaaagatcgtttataagttttttttttttaaataatatattaattttattttagttttgtaatttagcaaaataaaaaaaatattaaattacaaataaaaatgggtttatttttgtacgattttttcgaccacaattcttccggctgacgattcgtccgctcagcaaaaattagcagggaaaatataaaatttgaagttttagcttaaaccacaattttgggcattaaatgttatatcgcctaaattcataaaatttaaattccaacattaaatttttactggttttttcgattcaatgcttaattccgacaaaaaaaacttttttggccgatattctcgagcatataaaactgagcctaaccataattataatttaaaatacttggtaaggaaaaaaattttcaccttttgctcatcaaaaatttgttttttaaattttacagtcgaagtcaaccaaagtcgaaatgaacactcaaaatcaacatttaattgtcatttcataaaaaatttacacattaaaatttcgattttttaacatcgctgctacggtgctcaacgtccgacaaagttccaaggtctcaaatctattttgtatttttcgaatcgtcgatttttccttggcggacatcgcatccaaatgaatcgttcggataaatcatattatttatcttttttcaaattatatgtacataataaatgtgcttttcactggtaattttgcatcaatttttgcagtgccatcgatgggtttttgaccatttccgcaaatgtttgtgccggcgattcggtggcattggcagccgttgccatttgtgcctttttgttttgctcgtagtttttgagtaccctggatttcaatttcaatttcgtgattgattttgatgattgcttgccttcgtgcaaacacttctttctccgagggccattcgcagtcgttgccctggtaaattggtttcggcgaattccaaaagagtttcccgccaaagccttgctctaaacaatttcaaatttaattaattaaaataaattaaaaaggaaattaaaacgattaattaccttttaaaaagtccacacattctttgttatatttctggaatcatttgtgaattcgaattctgtgtttgtttctcccttttttcattttgacctgaaagaaaagcattgggtccctcgcgtaaacagtcaaagacaatttcccagcatctgaaaatagaaacagttaattaattgattggttaattagttagttaattatgaaggctgtgcccgacctgtgaccaccatatactgaatgtttgcttcttccaccgatgtttcgttgtcgaaggaaggcccaactttgataatataaactaaaaagaatggtatttactaaaaatattaattaattaaaaaaacaattgaattttattacattgccttgggtagaaatattcctccgtgtacatccaaaatttgccagtgccaactttgttcaggtcccttttgaaggtttcgattggcccgtgtttggtcaccgtgcggtacgattccttcagcggagaaaagaaaacaattaaaaaaatgcaaatttagcgaattatttcacttccattgagaagccatcttcgcccatcacactgtttggtttgactaaacaaaatttaaattaaattaaaataatgaatcaaattggataaatgaaagccttctttctcacattatggcggaaacttacagtaactgacggcacagtacatttagggtcgctgaatgtcaaaattcactgctgctttatacact

SEQ ID NO: 14414 - DNA, 3930 bp, Heterodera glycines
  misc_feature (12)..(13): n is a, c, g, or t
  misc_feature (3380)..(3380): n is a, c, g, or t
  misc_feature (3391)..(3391): n is a, c, g, or t
  misc_feature (3400)..(3400): n is a, c, g, or t
  misc_feature (3405)..(3406): n is a, c, g, or t
  misc_feature (3413)..(3413): n is a, c, g, or t
  misc_feature (3417)..(3419): n is a, c, g, or t
  misc_feature (3427)..(3427): n is a, c, g, or t
  misc_feature (3434)..(3435): n is a, c, g, or t
  misc_feature (3439)..(3439): n is a, c, g, or t
  misc_feature (3443)..(3446): n is a, c, g, or t
  misc_feature (3451)..(3453): n is a, c, g, or t
  misc_feature (3463)..(3463): n is a, c, g, or t
  misc_feature (3473)..(3474): n is a, c, g, or t
  misc_feature (3476)..(3476): n is a, c, g, or t
  misc_feature (3480)..(3480): n is a, c, g, or t
  misc_feature (3484)..(3484): n is a, c, g, or t
  misc_feature (3497)..(3497): n is a, c, g, or t
  misc_feature (3502)..(3502): n is a, c, g, or t
  misc_feature (3521)..(3521): n is a, c, g, or t
  misc_feature (3523)..(3523): n is a, c, g, or t
  misc_feature (3530)..(3530): n is a, c, g, or t
  misc_feature (3538)..(3539): n is a, c, g, or t
  misc_feature (3545)..(3545): n is a, c, g, or t
  misc_feature (3549)..(3549): n is a, c, g, or t
  misc_feature (3552)..(3553): n is a, c, g, or t
  misc_feature (3573)..(3573): n is a, c, g, or t
  misc_feature (3579)..(3579): n is a, c, g, or t
  misc_feature (3585)..(3585): n is a, c, g, or t
  misc_feature (3589)..(3591): n is a, c, g, or t
  misc_feature (3597)..(3598): n is a, c, g, or t
  misc_feature (3600)..(3600): n is a, c, g, or t
  misc_feature (3623)..(3623): n is a, c, g, or t
  misc_feature (3625)..(3625): n is a, c, g, or t
  misc_feature (3678)..(3678): n is a, c, g, or t
  misc_feature (3684)..(3684): n is a, c, g, or t
  misc_feature (3689)..(3689): n is a, c, g, or t
  misc_feature (3692)..(3692): n is a, c, g, or t
  misc_feature (3714)..(3714): n is a, c, g, or t
  misc_feature (3729)..(3729): n is a, c, g, or t
  misc_feature (3745)..(3745): n is a, c, g, or t
  misc_feature (3755)..(3755): n is a, c, g, or t
  misc_feature (3760)..(3760): n is a, c, g, or t
  misc_feature (3771)..(3771): n is a, c, g, or t
  misc_feature (3780)..(3780): n is a, c, g, or t
  misc_feature (3788)..(3789): n is a, c, g, or t
  misc_feature (3804)..(3804): n is a, c, g, or t
  misc_feature (3811)..(3811): n is a, c, g, or t
  misc_feature (3823)..(3823): n is a, c, g, or t
  misc_feature (3825)..(3825): n is a, c, g, or t
  misc_feature (3829)..(3829): n is a, c, g, or t
  misc_feature (3835)..(3835): n is a, c, g, or t
  misc_feature (3865)..(3865): n is a, c, g, or t
tcactgaatttnntgtcgagaaaaatcactcaaaaagcgagccaacactccaaatgattttgataaatatagagggcagaagcatttatgtacaattacaattatttattattttgttaccattcatttaattttgtatattttaggtctttttgtttttttttcattttactcttaattatctaggtatggattattttaagaatactagtaaaatcataattttattgtttgattaaaaagtcattggtttaaatgaggcgaacaaattcatttatgcaaagttcatcacaatatagtaatgcatttattatcataaccaataataaaaataaaatttaataatttgcgtgtattatttttacagaatgtaaattaaattttatttgttatctttaagttattaacaaaattatcttttattgttatgtttttttaaatattcatggccagaaaaagtctctttgctaggtagatttttaacgattattacttcgtttaaatgcttttctttgaataaaaatcaacttatgtttttcctataggttttattaataagtatttgtgtctagcatgttgaatctaagtttaattggaataatttggttttctcattgaatttgttattatgacaaccttcattaaattatttaaaattgtgatcgttattttttcactatttagttaatttgattatttaaaaattaaatcaaaatcgttaacattttacttagattcgttttaatatataaaaatttaattttcaagcataagtatcaatgattttattgatttttcaataaaatatgtattcaattttaatttcttgcatcgtaataaaatctttttatccaatctttccgtttttattattaaatataagattattttattatgttgccttaattataatagcaaattagaaataattttaaagctattttataatttagaaattatttttctctaaggctattcatattttggttttaacattttgttggaaaagaagaagcaatttgtcgggggtttctttgccacacttctaaattttgcacaaatagtctatgaattggccaaaacctgctttaaaaatccaataccaaacaaaataaatttatgcaacaaataattaaaagacaatccaaaataaataaaattcaatcaacaacaaattaataaaaacacaaataaatcgacgaccaacaaaacggctaaaaattatcaccgacgataaccaaaaaaatccactaactactcttgaagaaaaccaaaatatttgggtcgaattcaaataaacattatgccaaacaaattcaaacaatcaaataaagggtcaaagagtcactaatactacatccccggcctctaagaaagacggtcccctcgtctttaagtaaaaataacggcgaattcggcatccgaatggtggggttcaaggttttcagctagtgtcgtgacggcttttaaaaatgtgggcatttgtgtcctcgaaaaattttaatgtgtttgtccaaaagaattttatcgggaattttgatgaagatccacgttttgagccactttgcactctccactgacaataagattcgtccatttttcacgctgaacttttctaatcgccaaattctcattaggccatttttattgtccgtctcactgctgccaatttttttttcagactttttcagcttatccagctccaaaaagttgcgtgcttcctcattgaggtgcagagattgagtaactaaatcctgattctgctttgatgagatggacgagtcgaacaatttggagatgaactcgctggtgcctgactgtctaacggtggccaggttattggtcacggcatgtttcatcatcccaatgcccctgtccgtcttgtcctttatgtgcaaaatgtggttttctttgtccgccttaattttggttaaaaatttttcggttgccacaagttctgttgcgtttgcaggcgaaagggaccgaattttgtcctggtcatccgacgaattggagaccttattacagtccaaatttttggaaatcgggttttcaacgatttcggcccaacgcagtcccaccggatcacaaaattcaggctcatcgccttgtccctccataaaccgctgttgcaaactcgcagcaactttgtcaaaatccgcacatatacgctgtgaaacatcataaaaaagataaccaccgcggcttcgtttgaattcgttgtcaattgactcacttatcataagataaatggccatggctcggctgtacaggatgtatgcatcctcttctttcccttcctgcatttttgtttttcctttccattcgacttccaccaaaaagttgagccgcgtaaaattgtcgagacggcgaagtgaataaagcaatcgtttgtcaatgtcgcaggcatgttttttgagcctctcatacgaaccgtaaagcaatggaagcaaatttgttggtgaagatgaagtcggcataattttgttttatcaacacgagataaaacaaaaatccaatttaaagcaacacgagcttttacaaaatttaattggtgtagcacaacacgagtgctttcgacgataagttgtaaaagtggaccaaataaggcggatgaagaaaaacaaacccaacacgagggtattaaaaatttgaagaacagtcgataaacccaacacgagggtattaaaaatttgacaagcagtcgatgaacccaacacgagtgtttttccaaattagttgctttaaaaaaaaatataagaaatatcactgaagaaaaaccaagccgtccgccacctagctaacctttgttaccaggagcgccatgttggaaaagaagaatcaatttgtcgggggtttctttgccacgcttctaaattttgcacaaatagtctatgaattggccaaaacctgctttaaaaatccaataccaaacaaaataaatttatgcaacaaataattaaaagacaatccaaaataaataaaattcaatcaacaacaaattaataaaaacacaaataaatcgacgaccaacaaaacggctaaaataccaccgacgataaccaaaaatccacccacccttgaagaaaaccaaaatatttggttcgaattccaataaacattatgccaaacaaattcaaacaatcaaataaagggtcaaagagtcactaataccacagcgtttgtttatgtctatgcagttaatttggactggaaaacggaaggaagtcacagttttgttatgtattaggaaaatgcaatagacattgtgtaaaacattaaaagttttttcgaataaatggtttaataattttgattaatatttaattttgtcataatgttgtggaataaatttataaatgattgtgctccattgttancaaaattaggnttggccggnttccnnttacccnaccnnntccaaaantacactnntaanaatnnnnttctnnntcaaaaaatnttaaatttanncnttcntcanaaaactcattacnccaantcaccttcccccttatcantntattttnatctaccnncttatncganttnnattttcaaaatcaaatcccnttcttnaaaatncccnnnaattcnntntccaactttccctctcaaaattncnttttccatttttccattttcacatttcactttttcttctcctttacactttcnttttcncttcnttnccttttcattaatttccaaaanaattaaaagaaaaanataaaaatattttatnataattctcnttctnccaattaaatntttcattcnttccattnnccattaatttattcnttttttnttttattttttntntacnaaaatncaacttttacccacgattttccttcctttncttctcacttatcgaaagcttcgggaagcttttttgctcaccccactaattaattggctatttaa

SEQ ID NO: 14415 - DNA, 3077 bp, Heterodera glycines
aaattcacacttgaaaaattttttcacttttttgttcgaattcgggtccggggttcggagttgggtaaatacgagttaagattcgtaatcagcactctcgaaaaccattaaaattggttttgagcacaaaataaaaaaaatgaggaccacaattctttaccattgtcgatatctttcatttcattgcttaggacttaatgatttgatgggagcgcacgtcgaatggaaacgcgaaatggaaatggaaatgatgcagcgaagccaaaacgccaaattggcggccgtccgaaatttgcacgactttcttttaaatgggccaaaggagccgaggtttgagttaagcaattcgaaattcgcacaaaatgattgttggcatttcatttgtctcttttagcacttcgtttcggcaccctttcattgtcagtgccgaggcccgtgccgaatgtgaccaaattttgagtcattttgagaagagaatggaggaagaaataaaaaagacaaacactttgttaagttcgaccagcaaatccaaagaaagtacgaacgaaatcgttttatattttaatcatttttaattcattttaggtccacaaaagaccaaaaacgagttggacgcattcaaaaagctttacttgcaaattttgtttcgcctttttcgagaattgtatcggcaaagtgccgaaaaagtgaccaaaagtgggcagaaaggcatacggaggcaaagggcggagaaggcgcagctgaaaacgatgaacgaaggtgggcaaattgggggcgggaaacccaacacaacctcaaaatggcaaaatttccgatccgtaaaatggttccgattgaccaatattgtcccgattcgtccaacccatttctttccctttcctttcgcagcctttgacattgtgccggaaatttcggaattgaaacggcactgttttttgggcgccctttggctttgcgacggacaatcggttcgctttttcgactatttgaacacagaaattggctgctcttctttggatggaccgcacatcaattacatttgtcacattgccatcgcagccaaagaagtgaccgggggaagcgaattttgagactattctcgtcctttttgaaccttaattttcgagaagtgttgacatttcccctttatttagtcggcaattttggagccgctcattgaattgaccacttttttgccctccaattatttacacctcgccaaaatactcaattcgttggcattgatttatggtggtcattccgtaaaaagaattcaaaaacaaattcaaacattttacttgttaaagggaaggcccaagattttgataagttggagaaattgtggaggaaaatggacaatatgaaacggaatgtgccatacgaggaacagagcagccgaatgaaggttaaaattggcattgttacattttgccaaaaaagcgattttagctggttttggcaaggattgagcatttctatcggacggcaaacagaaaagtgccgggaactcttctggcggcgctgaagcgattgagcggtcagccgtactttatcagtgcacacgcgaaaaagagagaacggatgaacgacacgaaaggacacagcgacgagagaatgaacgaaaattgacgaaaagagcatccatcttttgtcgaaaggacacatttcattaaataaaccgcttcaatttgagcgattttacatatttttatttatattttcagaatttgaaacgagtaataaaatccgtattatatattttggtacaatttgtcggatttacccccccccccccgttcctttttgggtccggaaaatccgtcagtagacaattagtcagcaaattagaatttgaaacgagtaataaaatccgtattatatattttggtacaatttgtcggatttaccccccccccccgttcctttttgggtccggaaaatccgtcagtagacaattagtcagcaaattttttaagcaattatcgagaagcttgctatttaatatcaaaaaaagaatttggatgggcttttacaacacttcttaattaaaaaaaatccaatttatcattctatagaaataatcttttaaattatttaaaatgcttattcgttacttttataaaataaaacaaattattatttaagtttttccaatttaattcatttttacatttttatttaaaattttgcgtttcaaaataaaattgctgatggattgtccaggcgcacttcattttcaccatttcctcgtcaacatatttcccatgcatttgtcgtcgtgacggcgatggaatgcctttggctcatcggtcgctgttcgctttttgccgttattttaacaaaatgtccggtgccaattgaggcggtcagttgaaaagcctgaaatggtgggcaaataaattcagtgatctgtcgccctcttctgctgacgatggcgattagcctttacttcttctttatgattattaattactcgtagtgctaattaacgcgaattgtcgattaactttgctcacatcgctcatccgcgccttcagccgataattgtgcttcatcgtgtccagcttcgccttgcgcagtcccttctccgtgtacataggcgaataccaccgaaattatgaaaaggcaaatcaaccgctaattgggcccatttagtgctttcaaacaatttccggaaggattgggccggcatttttcgaggattgtgcccttcttcgaatgtgagggattttgcagtgatttaccagggaaagaaataatcgcgcagcgcccacaaattaaaggcgagccaaaagagcaaacagcacaagccgaacgcgtaaaagaggagcagacgatgctcagaagaagaggagaaaagagggggcaaattcacctcaaagggaagggggggggggagaagctttaatagctttaattaattatgatgccccgagggcgtaaagcttcaaatcgcatatgaactgtctaacttctcactttctccctcctacggaacgagtcgagccaaatacgaattgacccaaaatgagatgggaatttgtccgctcgagagtctctttcctcgactctttttc

SEQ ID NO: 14416 - DNA, 987 bp, Heterodera glycines
ttcgcaaatgtgaaacacaatgtcactgagtttttcagcattgaactctctcatccgaaagaagtcctcttaaccaaattactttgtattaacaatgggaggacggacgcgacaaaccattgctaagtgtgcgaacgaggttcagctgcagctcccacactaatggggaaaacacgctttattataaagtatcttgggctttattgcactttaggcgtccaatcaatgaccattttctttggccataactttttcctaaatccctactaaacggaagctatgtcgatagaaaaatagaccctgctctatcgactgacatgttaacaactcgatatgttccctggtcagggtgaccattgattggacgtatagtgcattagagcctaaatttgtttccgtcaggccaaaccttcccacggggctgtgtcctccggaatcagccactgtcgcttccttcgctggtaaaactccaatttaatttgcacagggaaaagtgtttcccaacgatcttcaaacgaaacacgatttagccaattattagtaaaatattcgttttactgaccaattccgtaaatccgtccctctctttgggatggagctgcacaagcggcggatattgaggcagaaccagtcaagaaataaccgtcgctgacagttcgatcgaccgcgtccacaaaaatgcttatttttccgtcgaactcagagacaagctccggactattaacccgaatctgaagaaaagaaggttttgacaaacgaaagttgacatacgtaagaaagatcaatgtaattgcacgagatttcctcgtgtcccaatgagccgagagaatagtcaatattagtggagtatttaaactgaaaaggaacataaaaggagtaacacttcttgtaaaaagggaaaaatatacttttccaaagacacgatgtaccaaaattgtatgaaaagcaacacacacaactttccttaaagtgccgacattccgccgt

SEQ ID NO: 14417 - DNA, 2386 bp, Heterodera glycines
  misc_feature (1152)..(1152): n is a, c, g, or t
cattttgtatatttcttaaatgtcacaatcatcgggtcaggtgaaaatgaaagtgaatttgagcagacgacgattgtggaggacgcggagggtggcggtgatgatttgatgaaaagagacaaggagaacaaatatatacgaatgagtgaatgggttgggacggtgggagggacaggcgccggccagtcacatttctccttttccttttttattctgtttctccttttaattttgtgtatttctttttctattaatatttactttcttcacatgatcttcatgcttttttttttgcataaaattttttttataacattaatttccgaatttttaaataccgacttttaaaatatgtacacacttaaacttttccaagttgaaggcaaaatttccaaaattcttgaaattaattaaaattaagatatgtacctgaaccaaaaatattaggtaagtaagtccctaaatcgaacaaattttatatctaaaaaaggtttatgaaaagtaaaatcttttctaagcgaatgattagtaatttgacatctctgaaaaaagtttgcagcctttagaagaaattttgtacggattatttacatatatttcaaggaaattgatttagaatgtctttgccaaattctgatcaaattctccatttttctaaaatatttcgtctcttgcttaattcccaacttgggtatgaacttagacattgtaaagagccaactcacaaaaggattattcaagcaattgtgctgggcggaaaaattgtccgcattgacaaaagcggcaagtaattttgtgatttactgtttcttagagttggtccccgactcggaaaattaaaaaaaggataaaattcataaaaaatgtttccgaacctcataaaaagactcatccgatttgtgccctattttttatatgaatatgaaaatgttttattataggtttaaaaaacgaatcatcctcttctgctggtgttaatgtttttgacaaagcgaaagtcattggtgtcggcgttgagtcttttgtggaattggattctcgaggggtgttccccggtgatttgttctgctcggtttgcttcggcgactgactcccctcttaaggctttggcggttatgagctaacgtcgcaagattccctggccgagtcttntaagcagaaacaacatccatccacggtcttcccagtagttcagcatcaacaaatgtaacaacaataataataccaattctttctaaaatttaagcttttcgcccgatgacggcttaactcgcgaagaggaggcctttttgaggagagcggcgatggaagtgggcgtggtgtacgcggacaatgagtgctgcgtgttagtaaacgagaaattcatttaaacttcaattagagagcccatcggatcagtgaacaataagccagcaacttcagaggattctgatgtttatgaaccagtaataccgaaggtaaagaaatttattattaagactaaccagaaaagagtcgaaataatttcatgttttactatgatacgatcaaataaaactaaatattagcttaggattaccacccatcgtttgccagtgccaagaactcggctcagatgaattcgagtagggaattcagtgtcccgagctcaagatttgcgcgtctttttaattttggacggctggccgtgggtttgggcacgggtgcggtggccgaattcgcacgtcgtacggtttcggcggggatgcaaaaggttaattcgccctcccatgtgagtttttggattaattttccaagctttttctttagagagtaaagtctgtggagagtcaatcgacgggcgcaattggtcacagtcaaagcgacaactctcatataaaaccctcaaaccctctattgacgacatcaaacgcagaaagaatagcccaaacgctttgccgagttcgaggcgcagcgctaaaattgggacaaatgctctcaattcagggtagaaataaaatattttactctaaagtttcacatgactttttttttgcagtattaatagacaaaattatcattaatgagcagtgagaaataacaaacaaaattaaaaaaatcaaaagttttaaatcactaaaaatggtgactttcattttgattccatttatttaagccggtttgaccaaaaaaaaagaaagcgaaattatgtatgaatttgaccttttattcgaattagggttcggagtcggagtttgtcgaattggtttatgattcggtacttccgggttttgccaccccccctgaaatttttttaaaataatttttcctaggctagtttttgatgctgatcacgaatctgacgtttatttttagctacaacgtgttttacgcgagttacgtgaaaatttacgtgtaaaatttaaaa

SEQ ID NO: 14418 - DNA, 964 bp, Heterodera glycines
cgactcgatacatcgaactctgtttgtctcttccagccaacataagttgtgtttttaagcattgaaggaactgttcgtttggcgcttcatgcaggtcgtaactccgttgggttcggtttgttagctcaaaattcagactgatccgaattggtccaactttctttttgctccaaacccctccatggaccgttaccaattggttctgcttgatttcggctcgactcgtagtttcagcaaaactttcattgacaaatacatgcgcatcctcaaagcggcttatgccgctgatcgtgaagaggtaccatttcatttccgtcagcttgacgggagcagcccctttcccccggcctggattagtggtttcagttcccccactcttcgaccctcccgaaaactttttaattttcaaaaaacatagaattttttttcaggttttcttatagaaaattttcggggccaacctatacgagggaactgatacggggagagggggggggggggtggggaaatgtagtgcactcctgtttgacgcccctcccccttctccgcagatgctaaaatggtcgcgtgagattggctttctcaccggttatgagaccaaaacgatggaacaagcccattgcgaagccatcgccatcatcggcgagacactgacctgtaccgatgcttatgacttttcagaacaggcacctcacatacgatttgataaattaattggttctatttaagagtgtgaccccacgcatcaataaactcgtccccgtgatgttggagcatcgtctgacggcgccgcctgacgaaatttattcgcttcatcggaagttggccggttcatttctgacggctgctaaactcaaagcatcggtcgcatgtggtcggttattaatttggcttgaattacttcgctaattagcatctattttacctgatcctttattttatttgtcgatgattcaggaacaat

SEQ ID NO: 14419 - DNA, 3615 bp, Heterodera glycines
tgtgtttcactttaatttgcgccccgtttgacgcaatgattggtataatgtcggcgatggcacatcgcgcggcatacaccgacaacgtttcccgagtcaaatggggcttcacagtggccaaaagcttcaacaaccgtttgaattgctgcactgattttgtccattttctggagaattcttccatttcatcctcttcatattcggcacccttcgctttgatcagacaaagcgcttcaaacgggcattgtcaaaggagaacacgttatcgtccaatggaattttcacctggagaaaaagcggagggggccgtgaataacagaattaaaaaaaaatctttgatcatttttaaaaaattctaaaatttgtccaaaaaaatcgctgaaaattattttaatttttcaaaacataaaaatctgttataaaagacctagacatttttttctgagttttcttttatatctaagaaaaattatttaattttcaaaagaatattctaattgtttaaatgctgtaaacagttggactctactgcactttaagagtccaatcaattgacaatacctggtttttatacaataactttgttcatgtttgaaccagggacggtcaccagattgggtgtttgtggggggaggcctaaagactcctaggcagcaatgtcttttaaaaaattggggcttgtcaaaacccaactagagctcgaaagttgctagtcagtctaccaactactgaagagatctgagatttcctaataatgttctccatcattttgggacttgttttgctgatattgttttcctactcttcattgcttccagttgtatggtggttaggatttttttctagaaaacttgatcagcttatagaaagagcattaaattcggttaaattggatggaaaataattttctgaggtttttattttgttggagtcgaaaaagttgagccgcaaatgtcgtttttcgctgtggccgcaaatgtccgggccgcactgcgcaacgcgacgttgtagctcgaaattggcctcgcaaagtgcaccgttcccagcagcatggattcgtcgagccggttgtcatcaacgagatctcaacccgaagcgttgtcatccaattcgtcatgccggtgccgagcattgaggagctcaccgaattgtgcaaaatctgggagattgatttggcggtgggttgcaaagtcaatccggcagccaaggcaaagccttgtgcgcatgggtatgtgctaagcatcgaaaaaaggtcattatgtgtaggatacgaaatcgatgctaaagtgattttttcctaccaggaagcgaaggatcaggacgcgcaggaggaatttgatcaaatgcgctgcggtgagctcgacggatgcgttgaactcatcccgcagacgtccgtcagggccctgcaggaacggatgttcacgctgcggtccaatgactgctcgaaagtggcgaaggacgaggcaaaggtgggccgaatcatgtcgattttattgggccgaccggtaaaaccggaaagcccaaaggccaataacccattaatgacttttggggctctttcaaaattgaaagagggacagatcgacacagcgctgtgcatgctcgacgaggtgccgcgccttgtcttccaacaggccgggcccggcaccggcaagacgttcagcgcggcgtcgatcgtggccacggtcctggccacggatcccacggctcgtgtgttggcgctggccccgccgaatgtcgccgtcgtcaagctggtgctggagatgcaggatgccctggccgccggaaaccacgtggagccaatgcttgccttgttctccgggacaggtaagttgagatatgccaaggaagttgagcggatttccccccacctgctcgccaccgcggtggaggcacaggactttcaggaactcctacagaaggaccaagaacgcgtcaaggtggagcggtacctggacgcctgcgagcggaacccacgcctggcccaggaaatggcagtggcgaaaattgtgcaggagcacaaaaatcgccgcttgtgcttcgccaccttgtccttctgtgagcaacttccggcactgtttggggagacaacgcatttgatcatcgacgaagctggacaggcgccatacgtccaaatcctcaacttggtaagccaactcccctgcctaaccaaggtactgatcaccggcgatcgccgccaactgcgtgtccatttgccctccctgccgatcgcaatccgtgaggacttcggcatggacatggtcatccagaacctggatgtggcgcgagggacggacgtcacaacattgtcggtctgttttcgctcgcattctgctctcgtccgctgcacggaggccggcttttacaaaccgcacggcgagctgctgactcctggacgcgacgactcggagcgggcactcatgaccgaccaaacggccttcaaattgccgaaaaagggagtccctctaattttggtccaccagagcacgcctgcgcaacgcgacgaagtgtccacctcttcggccaatcctggccaaaccgacacagcgatgagagccctctggcgtttggcgcgggccttccccggcacactcatccgctgcatttgcttctacgccgcccaagccctggagattgaacggttggtggcccaacaagaaatcccggacattttagtgacaacagcggacgcgacacagggccacgagtcgtcacttgccgtcgtcgtcacaacatgctccgtcttcgacggtggagccgactctcagcctttctgggctgatgccgcacgggtggacgtcgccatctcccgcgccagccatggaatgatcatcatcggcgatttgctgctgctcaaccggacggagacgtggcggcgctacctggaccaagcgacgactgagacaacagtggtcggtccggagtacttcgacttcgagcagttcaagaaccccgacaactactacgacaaggacggacagctgatctcagccaacggcggtgcggtacggtcagagcatttctacagcaagtacggtaaaaatgtgtggtacaacaactccggtgagtcaaggggggcggagaacagatatcaaccttatcttcctcaaggtggcactcgggaacgcactcgtggcaaagctcaaacttctggtgcgcgcagatgaaagaaagccaagctgtacgccttcagccatggacggcagttgcgcttggacctccttctttcttcattcccctccctcacgttctgcaaatttccttttgttttgactctctctttctcactctctctcgtcatccatttcttttaaaattatcattcattttccttttattctgaactgttaatggcctttctttccccaattcaaaaattcttaaaaaatgcgtcggttttcctcacactttctctggcccattcttgttctcttctcatcatgcttttacatcccatccccaaaccggaatgacccctggttgcttttctccgatttcccatgccatccatctgagatgaaggtggaccgctgttcattattgcaatgcgcagcttggccgtggaagttcggattggagagacgaagggcgaagccgagagttggacccattcat

SEQ ID NO: 14420 - DNA, 1213 bp, Heterodera glycines
gacgacccaaagtgtcaatgccgatcaaaaatgattggaaataccaactaagtgctgaaaatgaaaagagtcaaaagcaatgccaaatgtgaaaaggcacctttgaaagagaagtacttgccgaaaccgacgaatttgagctgtgttttcagctcaatgaactttccgtctgatgctctcagtgcgtcgaattcgcagccgtaaaaaatgttcaacgaacgaccctcgacaatgagattggctgaatttggggggggggggcaaatagcaacacaaggaatgcctgcaatagacctttgaatattccgtcgagctcggggttcggatccacaggtgccgttgtgtcgggctcgcctccctcgggttcgtccattgtgattaattgctcgaactttcgtccggcgaaggacgctttttgcacgaaagtgttccaattgcttttgtcgtcttccccgtccggacgagtgaattctctgatgaaaataacatctgaaaaggaaagaataaacgatacaatggacaatcactcaccgttatatttaacgcaggccaacttctgacttttgtcgttcagcgattgccaaatatatggagaaatggcaatgcgactcattgggcctctgcgactgacgaattcacagccatttaaagcctgcattaaaaccaggaaattgttttgaaattccaagcatttgacctcctcgagagagctgccctcgtcgtaggaattgagcaaccaatcgaaaactttgtcgaggccttaattttaattgctcaattggaagatgacaacctaatcactttctgaacgccacttctctatttgcttgtgtatcccttgagtaaggtcaatgttgagcttccgattcatgaaaccttcgtacacatacttcagattggcacatcccatttccaagtgccctttttttgaatcataagagaacactccaagctgttctaaattttagaaaatgcggtcatagaaagcgagaattttgacgaacttgcagagaatattgcctttccattataatgaaaatcggtagaaagataatcaatcggttcagacattatcaaattagttgtcagtcacttttcaagtctgaaggaaataatgtacgtgtgtgggtatgtggactcgatatggggaaatggtttttttcatttatatttgagctcgaactggactagatccaggcctgggtttttcatg

SEQ ID NO: 14421 - DNA, 3057 bp, Heterodera glycines
  misc_feature (58)..(58): n is a, c, g, or t
agagcatttgtatgtgtataaaattatcaaaaaaagagatatccattttctgggatancctctaaatataaaaatcctctgtgaaataaaatggcgattgtgcacagccctccgtctctacgcaagcgcttttgtgaggtataaaatttctcaaaaaaagagatagacatttttctgggatagagtataaatgtaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaactaaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgctccgccctccctatcatgctcgagagcatttgtatgtgtataaaatttatcaaaaaaagagatatcccaaaagtcgggtagcctttcatggatccagattcagggcattttctgaacatggatttttgcccaggaaatttcagatccaggtcatgaaaaaaaattacagattgccaattttaaaaataacataatacagattgcaattttaaaaataacataaagacattcagagttcactatgggtcaagcccagtgttagacaaaattgctcataacgccaaatagcgcatttggcgtaaatttttgcgcgctatttcaaaatttcactggaaaatgccttttttgtattttttattttgatctgccataattcgcttcattcccaactaaactgaacaaatttggtatctaaaaaaagtttttgaaaagtagaatctttttctaagcgaacgttaagtaatttgacatctcagaaaaaagttgttggagtttcaaatttttatcacgttataactcaagtcctaggccgccgtttctaacaaaaatgctaaaactattaatttctctattgattctaaatgtccaaagtgattttgtatccttataaccaaaattgttagcatttacgaatttgatgttttttgtgtgttagagatgtgaaaatagtacgccagcacgagaggaaaagaaatgcaaaaattttaatcactccataactttttagttaaccctttttttgcccttaaaaacccttacattttgttccaaatttttttctctatcggtattcaaaatttggtgcaacttgtatgcatagaaaaaaagttatatggagagaagtaaatgttgatttttacataattaaaatgaagagatagtacgccaaagtgagagaaattacaaagaaaaagagaaacgacgagatagtactaggcttttctctgcacagtggagttgacccatagtgagagttcggagtcgatcgaagtgggaatcggtcactttatgtcagatgccattctacaaatatcatggccaagtccaagaagcataactactacaatcatgaaatgaagagtgcattaatcacttaaacaccgtaaaactacttaatcggtattcattttagattatgaaaagtgatttatattcacaaattgatagaaaatttgaagaatcttctacttcgaatgaagggtcagataatgagctcgtagctgatgataatgcttctcttaattctatgtaatctaactcaattaattaaatgttttattttgcactttcaggtatatgaagcttgatttcctggaccgggttaaagccgagatcagtaagctagcaataagcttatcaaaaaattaaaaactattaagtcttcaattcactttctgtcgacaaagagccaaaacgaagtacaacgagacgattgatgagtttggatggcacaattatcactgcgtaagctttttttccttttaaaccttcgatttcacctcgaagtttttagaaaattttcttccgatgatcagaaatcattgatacgaagcgccaataattttttcgacatgtgccaactgagcaaaagttgcatcgatatggcgcgaaattatgcctacaaatctcccaaaatgaagacagttcaaattccgacgaaaaagaaacataacaaataaaatttttatgaaatttaaaagtttagctcaattttatgttgatgaactgtcctttcgttctttatttaccttttttaaatgtttattcaactcataatctgcgattcacagctttgccaacagaaaatatgttcaaaggacttcggtcaaagttagaggatgaggccaagcgcatccaagcaacggtctctcaatacggcgaaaaccttgcgaaccaagtcaggtcgaacgcggtaagtcacccgaattaaatatattttttgatttaatttttgcctcgttcgcattcagagtgatgcgggcagtgacatcagtgggaggggtcggaagttaattggcaatgcgttaattgccgttcagccgccagactcaaatgttaatacaaatacagacacagctgaaaacaatgacgagacgatcatcagttttcacgacgagcaggtataatttccaggtcaatggcagttcgtataaactttttttaaatttgcaattaaaacaaaaaaatttaggttttggagaaaaaaattcattctgatttttaagaaaaatatgttttaactgaaaaaaattacgaactttgccacactaattctagtcaaattatttgtatttttttcaattttttaagccaaacctcgatgtcgctttcccttctgacaatgaatcctttgccaattccgtttcggcgtcttcgtccgcggctgttcgtcggcagcgacgactgtccaacgtttcagtcgaaagcaatgaaaagtttgacattttcattcatactatttcgtttggggtttcagtagtttcaatttctcatcacaagtcaaaacaagtccaaccttggttttggatccgatttgctcaaaggtcgaaagtaacgcggggagtgtggccgattga

SEQ ID NO: 14422 - DNA, 1466 bp, Heterodera glycines
  misc_feature (39)..(39): n is a, c, g, or t
  misc_feature (1426)..(1426): n is a, c, g, or t
acaaacggaggttttaaatttgtatttatagacattttntggggttgtaccaattttgcatcaaaaaatgacaaaattttgtcattttggggtcaaattttcaaaaaattttggtcatatcgaaaccaattttggcaaaaattagagcacagcctggacctggatccaggcctgggtttttccaggatccaggtctacagtggtacattaaccaaagctctgaactcaaacagagtattcaaaaaaacaattttttgcaaaattatatttgttggtgtcgtatgaaggctcttaatgagaagaaacatgcaataaacttggatggctatcagaatatcgtctttgatggaattcagctgtgttcacatcctttaaaccccaagaaaccgattcaacttaaaataataaacttaattaggaaatccattcttaagggttgccaaaaaaagtaataaaccagaaaatgtgtcaaaattgcttcaaagccaattagaaatcacaacaatttctggacagtcagtcacctgtcttcgcctcgctgagttctgtccaattcgctgtgaatgtctttcaatcggttttgcaatgactttatttcgccctgtttttctcttctcgcctgttgtgccaaaaacaaattgttttcgcactaaaaaaacgaaaaataataaaagattcggcataaaacaaaggcaaaaagactgactcggttgacttcgtcgcgggctttgtggacttctaccaggccaatacattcctcgtaatattgaacggcagaattgagcacttttttaaagggctttgaatccgtaagaagcgatggaggggattcttgcgattggacaacactgcttttgccgatctttgtgagaaaattataattcctaattctcaacagataacgcatcacaaatggaaaataaaatctggaaatcataattcattcggacactgacactgcattcattttttaattatttcttttatgcaagcgcaaaacaagggcgtagccagacccttggcttcgggggcggggggggggggggctgaagtcaaaaattcgatttttaggggtgtatttttggaggggtggggaattttcaatttaaatgccattaaaacaaaatatgaaaatttgctttatagcagtttaagaaaatcttccgtaatccatttactaaattcatgacttttctgctgcactaagactgactacaaaaataactataaatggggagaaaaattaaaaattttacattttatacgaacactttacttatcaattttcctgtaaaaaaaatctctataaaaagggatgaaattcgcgagaacatcattctccgcagtgactattttcttccgaacaatttctctcaacaccagccaatctacccaaccattttggcgcgacaattaaactttttanaaggggaacgaaatgtcaaaagttgcagaagttgatgagg

SEQ ID NO: 14423 - DNA, 2301 bp, Heterodera glycines
  misc_feature (866)..(866): n is a, c, g, or t
gatgatttagaaaaaagatatgagcgttcgaaatttggattttcttataatttttgtcttagactataggcaataatgaattcactggtgcagaaaatttttctttcaatatgcaaaatttgaagtggatttaacaagcagaaaaaaagttaaacagatgaattcagtttttctctattaacagagataaaaaaatagtatgccaaaatgagagatgtttttttctctgcactctctatttattggttcatgtctcgttttttggaaacggtgtgtatatctggcctagtggttacgccttctttctatctttaaaaattatttttctttgattgttaaaacaaaagcgatttaaaagcaaaaaaaatacggtcaattagttagcttctatgggtaaaaggtagagaatggcaaatcaacctttttattagtttttgcggggtatcaatttaaatgttgatatttaattaaatcaactaacattatgccatcaacgcaaatatcaacgtaatttttaaaatttgcgaaaattttttaaaatttatatgagcggtttataattttagtgcgagagataacgcaaaaatgagagagtgctggatctcagtcccagtcatacaaaacatttttgatgaaggagggtagagaaaacaatttcaatagagagcgcaatgggaagggagttcatgtctcttcttcgctgattcttttggtaagagacgcagattcctcactatgttctctattctctctctgtcttaaatctcttcccataacactctctttttaattaatttttctttattcttctttaccaaaaatgcttttgtatgactggggctgaatataacacccttctcactttntgcgttatctctcttcccccatttattttccgccaaaagtcatttttgaaaaattgctttaaattttaaaaaattttcgcaaattttaaaaatagcgttgatattacgttgatggcataatgttatgttgatattaaataaatatcaacgtcaatgttgatatttattaaaacaattttcgccaagagaaaaatgttgatttgcctttctctagtggtgacctcgaggacgaggacaacaagacgtcgaccgaatctggacgcggactgcaacatgctgtcgatgggctgcaacagactgtcactgggcttcaacatgctgtcgatgggctgcaacatgctgtcagcgttatgcgaggattggttagttgcgtgttatgtttagtacttcaggtatattcgtttatcctttaggatcaaccagatgaccaacagcaaccgatggggcctcttgtcgaccagcagcagatggaattggtggaggcccttgaaccgaacgatcagcagcagatggaattggtggagcctgagcttcttgccgtcattcacagtgcgcttgttcaagtcattcgtcgcaatccatgggcatcccttggtatcacttggctggtcacacgcctggtgcagaaagtccctgactttatttggaatgtaaaaatgcatttatttgtttcattttttgaatttttttgtttagctgtttggtgtttctcggcagtggttcttggcaggatgaacgcgttcatctactcggcttttctggaggcggcttcagaacagatgtaaagcgaccagcaaatgatggactattataaatacgtgatgcttatatgtacacgcatttggggtttgtgttattgattgttggctagcaaatgcttggagaatttcgctgattgccaatcataagtatttgtcgttggatcggtacttccttccagtgccatggcgtgttgttggtttgccctcttttctttagttgttggcgacaaggcttttgtttggctgctgtgttcgagtgttcggcttattcctgcgtaaggagctgcttttccttgtgttcgcttgcggaatgatactggtcgcgtggaatttgatgaactctgctttgttgctgttggccttcgcagttctttcgacaatggagcagttgaatgtttgttcgataagctgatttgttgatccgcgactgggtcttgtatgatctcaatcacgattggtgttgtgctgttgggaaccgattctcgcttgcgtcttggtcgtaacgttgcagcgctggacaagagcttgttgattttgtgccttctcaatgttttactctctcgatgttgtttggctttctgcatgtgtgtcggtttactgcctggcgattccttgttggtgaccaccatcacgaaagagacgttggatggttggctgagttcgattcgaccctt

SEQ ID NO: 14424 - DNA, 2011 bp, Heterodera glycines
gcagtttagcacgcgagtgccctcggcattgttcggcaaatacgcgtaacgagtggccgaggcgtaccgatggccaggacgaacatgaccatcctaattaaatgcaattacctcatggccatactaattaaattcaattacctaattaattgagtcaaagcatttggctaatattttagcgtgcttttgggaactgctcgtaggatgacttttataatgcctattttttattttgcctaatttacgattttcagaaactttaaaaagtgtaaaaatgagaaatacactaagcaattgaatacataattttcaataagtctactccatcatgtgggattttcaaaaaaattcagctctcgaatctattttttgaccaaaattcttttttaatttttccatcgaaattcatggattgattttgtgttaaacaaatatttcttgtaatttaaattaaaagtggtccataattgcaaatatatttttcaatgtttttatgttttgcaattttttcactgattttcaggatcactttcgtggagtatataaattaatatgccgaaataaccaccaaatgttcattactttctgagttccggaaggaacgtggtaaacgatttcgtggaatccttttgcatcgctgtgcccgggcacgtgccccgggacatgtaaaacaagcattgttgctgaatggaaaggacgatcaatcatgtcaaaccaaaatcttaattagaggggcgccactttggcacgggtgccaatacattggggctgtcaagagtctcgaatgccttaccgttcgccggttggttgccaatgcattcgccataccaaagcatgcacaacggacactgacgcttcacagcgaaggccaactgtaagtgatcgagcagaatttatgatcaaattccttgaactaattagtccttgtcagctggtcttttttctgcattgatcactttctactgatgatttttgattgattatggccaaacggctggtggtcatttggggggcaattagcaataattaacaaattatcatgttcatcattgaattgctcgttttgtcaccttaatgcactgctggtggaaaagatgcgaacaaagcgacaattggacgaccgtgccgttgtcgtcgtcgccgcattgctcgccgcgcatgtcactcagacaaatggcacatcgcgctgagcaatcgtcggccgggcacttttcgggcaacaattgttcaatgcgcacttttgtccaaaattgcacttgatgatgatgagattcatttgtcagtgccataaaccaaataaatgtaaaaaattaaaaataaaagttcgaaaaatctttaaaaaattaaattgtataaaattaattcgtaatttatgtaatataaaccaaaaattaaaactgagtcatggaaaaacattgtgactaaaactaaactcgaatctgtttgtccaattaaacgaagcgcaaccttggaagattttacaagtgattggaaaagggaagagtcgaatgattacatcgacaattgatcggaaaattgattggaaaagtgattggaaaagtgattggaaaaggagtttggaaaagtgattggaaaaggagtttggaaaagtgattggaaaaggagtttggagaaaataaacaaaaaaaaacgcgaactgaaaaagaaaggcaatgaaaatgaattgcgcatggaaatttgaacctttgaattactaacaaaattcagaaaaataacttttgaatgaattattttaaaaccattggaattaccgcaaataaaaaaattaaataaaaattaaatgaaattaaaaaaagctaaaagactaaatgcatctgaaatatccgcgcctgattatatggccaaaactttgttgaatatttaaaatttcagcatcttacaattgatgaaatttttcttgttaattgtattatttaaatgttaagacaatggaaaatcactcatttaattacaatttttaaatgaattgtgcaaattaaataaatatttg

SEQ ID NO: 14425 - DNA, 2424 bp, Heterodera glycines
  misc_feature (762)..(762): n is a, c, g, or t
  misc_feature (767)..(767): n is a, c, g, or t
agagagagagaaaggaaagaggaaagggagataggaaaaagagagaggaaagagatataatgaaagagaaagagtaaaaagagagagaaaagagagagagggaaagagaaagagtaaaaagagagagagaaagagagggagctaacaaaaaaaagggggggggggctgaggcacagatattgattaaacttaacgatcaagtaattaaaaacgagcataaaataattacttaaaatatttaacaaaaatttattttattttttcaagtatagatttaggttggtgtttaataatgaaaaacttcaaattatttggaaaatttcaatgattacatacgccagcttttcatcttaaattatttgtttagcttttgtccgtttttggcactttccgcttcttctgtcccttctttctcgctccattcattcatttgtcctttgccatttcctccgcatctttttgtgccgtttttccctgcacacttttcctccaaaaatggaatgccgagttggacagtgccgtgccattccaatcgaaatgccttttggcaccgtcaaaaaacaaagtcaaccgcatcggttcccgcaaatttggaagaccaccaaataaattgcgtacaaatttggcacggccttcgccctgtcgcacttcgatttgcacccaatttttgccgtcgtccaatcgttccgttatccgatcaaacaatgcttttcctttttttgacccttcaatgaccgtctcgttgactatagactctctgcncaatntaagcttttccggatgaattggcaatggcattttgtgccatttgtatatgttttcggatgggtatttgcttggaatggcattcgctgctgtgaaaattggtgcctaaatgttgtcccttttttggcaaatgccttcaattgaccgtaccggtggtgccgagttagcgatcagttgcccaacttcgtactcgttcaattcactaattgtcatttgatcaaaaagtgccgtctcttccgagtgccttttgtcctttactttcttgcctttttcattcatttttcccatctgatcaaagtgaaatttgaatgatttgaaaataatttttgcattttgggctgcattttttttaaatgaagaattgttaggaaaaataatattttttctttaaaaattttattattttttgcaaaatgtgaaattcctaattctaataaataattattaaatagattatcctttattaagttcggtccctccaaatctaaaatttaagaacagggctcggattcgtacttggatgccaagtacgtacttgatttcggcttttttgcttggaaactttaaactgtacttatttccaagattgtacttggaaatcgggattctttcatatgaatgtctttttttattcatttatttattttgttcacatttttatgtgtacttggatttcacaaatttcccccgttatgtacttggaaagtgacttggtaagatccgagccctgtttaagaaatttgcacattttcaagctttgccataaagccataaaaatgagaaaggcattcctaaagaaaaaatgttactaatattgccattattttattgttaaaaattacttacgtaaatgcgagcattgattttcacttttggttttgatgatttgctgcaagttggcattttttggctattgctttttccttgcttttccattgccgattatttttcattttcttggcattttccttacctccctcttccccccccccatccgtgatccggcttttttttttttgccatggcccttcgtcctccttttcctctcctctccaatgttcaattatttctcctaatttttctcgccgtcgtcgtccttcatcttgcccaacttcaaccagtaactgaacaaaatgaagaacaacccacaaaaggggagcatcgcctccgccacaatatttcccttccggcgacgacgaattctgacgcaagcgaaaacgatgacttagaagaaacagccgaatggattatgagggaaaagaaagtgccgagggaaaagaaagtgccgaagtggaagaaacggtgaaggaccaaatgtcatttcaaatggcaaacgaagggcgcggcacaagcggagaatgggcaattgaggcggagagacagatgcaaattgagaagcagcaggtggttggacgtaattggtttttaaaacaaaggcactagactcaattagcggcatcaagagttaaattgtattaaaagcactaatgagaagtttttaaatctattaaacgttaattcacccctaattggtggagtaattagttcaaatgaatattgtctcttttccctccagggcgctgatggtgcccggactgtttctgattcggagccgaatccggcgccgactaagccgacgccggattcaaaaagcagcag

SEQ ID NO: 14426 - DNA, 1377 bp, Heterodera glycines
tgatgaatcccctaatgattttggtaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaacctaattgctcaaaatttatttcgcacatggttacaccttttgaaattatgaggggatcgttaccttcccgaagcgcaagtataagcccaacaaaattaaaaaaacgggcgcgaag

SEQ ID NO: 14427 - DNA, 1579 bp, Heterodera glycines
aaaattgcctaaggacaaaacgccaaaaaaccccactaatttaaaaattttgccgagattttcccttgtaaaaactgaagagccgatctcgagttaaaaacttaagttccataaaataaacttggaatcgttagagggggtcaaaatacaggcctatacaaaatttcaagaaaattggtcaataggaaaaaatttttttcaaggacaaagttttttctttttctctcattttgacgcactatttccatgtctctaacatataaaataacactattcatttttttgctaataaacaatttttttaaaacttttgattaaattaggaatgttctttagaattttcccttcaaaatgagcacaaaaaaatttcttttggttttctattgaccaagttacaagcatacaaaatttaattaaaaacaatgataaaacatatagtgtctaacctcagctgtctgttttttcattggcgcattgttcacttttattttcattaacttttaatagtgtctaactcttacagtgtctgttgtttcttcgcaagtcttgttttttaattttcgtttcaatactcatttttttttataatgatacgcactttttgtcaaaatgatgatatacgagcgctaggcgccgcttcgcggcgccccaacccccctctcggtttccgataatttaaaataaattttgatagagtttactttttttaagagtagagtcaaaaaataaattttttgaactctaactaaaaagtattttttatttttaataaattcgtttttcagtctcataacactctctcttgtatcgttttttaaaaaattaaggttgtttttagagtcgggacagtgccaataaacgccacagggaaaattttttgaaaatttcagtgtaatttctaaaaaattcacaaaaatttttttcaaaaatttcggaactcggaattccaacgttttagaaatcggaattccgaccccaaattttttcttcacaaaacagatatagatttaaaatggaagagaatagaaagtgtcgaaaaaccctgctaatttagacatattttgttctcttccgaaatatccatggttcaaaatccattaattatcacaaaaaccatgaacgatttatattattgacgataatttaaaaaatcggaatttttaagtttccattctttagtagatttagtgtatttattaaagtttttaagcaaatattgataaataaacagcaaccaaaaatgagaaatacagtttcacgattactttattttttctattatttttggcaaaattttataatcataattattttatttgtcgcattaatttgaatcaattttttttgacaaaaaactttggtaatagtttagatggtatgacacctttttcaaaacttttttaaaaagtcaaaaacaaatttctatgggggttttcaagcacgctgaacacgaatctgacactcgataagatctatttcgaacccaggacccgaattcgaacaaaaatttgaaagttaaaatttaggaattatgcattttcgggctataaatggctttattcagggaaacaaactaaaa

SEQ ID NO: 14428 - DNA, 1270 bp, Heterodera glycines
cgggatcccgcgggatttttcgggatcccgcgggattttttcgggatcccgacctcggaatccgtcccgagcgattttttaaattcatcgggattgatcgggatcgggataaatttatattaattgattaaattgtaaaaaaattatttaaggcatgttgttaaatgttctcatttttgaaaatctgattttttgggcatgatattccaattttgaaaaatttctataaaaatctgatataattcacatctcttttttttcttcaatcgaattgatcaattataaatattagataaacatttgaacaaaacttggcacaaaatgtaaaaaaaaattgggtttgagcaaatcccgataatcccgctggatcccgaaaaaaatcttcgggattgatcgtgatcgggattcagttcgggatcccgactcgggatccctccgaccccagttgtccggtctctactgactaattgcaagaaaaatacaaattttaaagaaaaccaataatttaaattaatttattattcctgatcttacaagccaattaaaacactataggaaaagtgaaaatgaagtgtataataattactgaagccttgcaaaaaaaacgtggtgagacgaaccgaaaatggtctcagtgtgggcaaacccaaaataatctttttgtgggcgaaccgcaaatagtctcagtgtgaataaaaatatttatatttattatacgattcactaaatcatataattatataaaaaataattttataaacgttttttttaaattttcctccgtgctgagtcgttcgacaaaaaagttccgtgtgcgcgttccacaataagtttaacttaaacctttcaatttcatttgatcatggagttttattatggtattgatttcattattttggaagctttattttgaaaaaatttactacctgtgttttcacaaatttgtagagaaacactttctggatgacgaatattgaaggagaatgaatgataagctattgatacttaatttatttatcattgtagattgacccttaatctgttacacattttatgtatggatttgatatttttgtaaatgctatttttgcttaaaatggaatttcttcagtttttatcaaaattttatttaagaatttatcaaccataattttttttaaataataatttcttccaatgttataagtcaatattttgtttttgaattaaaaatgtttttactaccattaaaccattaaagtattgaattacatatatttgaaagttaccg

SEQ ID NO: 14429 - DNA, 1768 bp, Heterodera glycines
tgattatatattcggttcgcccacactgagactattttcggttcgacctagcacccaaaaaaacttataaaaaaatatgtaatgtgactgaagtatatataaattgtttaatatatgtattcttaatttaaaagaaaatgatttattatcaaaagagacataacgaatcacaaacgtataaaccaatttaataatttttcattaaaatagaaataaagtcgatacatcaaatctttctgttttataagttgcgaaaaatgcacgatttaaagaaagtggtgcacgagaatttataaaaatgttaaatataaataaaattttaagctttactaattttggaaaagtttaaaaggtaaatagaaaaatattatcttttaggttggaaatagctttcatttaaatatctcagtacagatattttttcatcaaattaatcaaactaaaacctattgaaaccatatataatagaactaaaaaattcaaactttgagcccagatgattgaaagcagcgagtctttaatcggaagttcaaaagcttcagaacgttccatgagcttaataaataaaataaaatttaattacatatttttaaataaaaagcaaatagaaaacaaatttattgattttaatattaaaaattaatacaatataccttccttttatattggtaaacccttaaaatataaaataaaataaaataatatatttacttaaaggcaaatattccggaaaataccaccaaagtatcagaaaatatttatttcaaattttattcttgaaaaaaataaaaataaattactgtgatcgcgacctgaaaattaggcagattaacaactaaaatattaaaaaaaaactctcgaaaaaattaataaaagaaaaataacaataatatataataaaaaatattaatgaaaactttagaaagtaagcagatacattatgttaacaacataaggaaaattttgaaaaattaaatgcaatatttctactcccgtcggaaattgagggataaaaaatgaatccaataaaagctcttatacctaatatttaattttcattatcactagggcccggatttttatgttttaacatattttttttgcggcttagttatggcgagagaagcccaaaaatagcattatctccgaacaatttttgatttagagcgacttataaaaacataaaaacacatattttggcgttttgtcacataaaatatgttagcacatattttggagtttggcacatattttgcacatattttggcatttttgagaaaaattgcaataaaaatacaagaaaattgaaaaatacaccccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgggccctaattataaaggttatgaggaagtaaaaacgaataaatctcaaagca

SEQ ID NO: 14430 - DNA, 1581 bp, Heterodera glycines
aaaaaatgggaaaattatttttggtcaccgaactgaaaagtgaattgttcgaacgaatccactcgggaagtaataaggaaatcataccgtataagtcgctcgagtcacatcctatgtcttagtacaggtatcagtgagtggagcactcaagagcatagatgagatagggtaggcacaagactcagagatcagcagagcggtggaattgacaggtaggaggcatagcgtgggagagggagtcgttggagacagagaagcaatgatagaggaagggaaagggacgagagaggtgcataagggcagtgttgcaggttaaaggaattgtggtaagatgttttaaagaaagcaattcaggagcaggacaatgagactaatcggacagaacaatgacaaaaggaaacccaataacgatggacttttcatttttgtaattacaataaaatattgccaagacacaatgaacttacaataatcttaattgtttatttgtcgcaaatataagttaaattagtttgctgttagtcattaatatttttaagatttaacccaaccaatttcggaacccagactacatagtgcatattattccactaacacatcctaccacgatacctttctcaaaataaagaccaggtccgtcaaagtccacactgtttacgacaaacgatggaggaagacgccaaagcggtccgatccgagtgaaaactgttgtataccttaagaaccgcctaattaaaagacgttgaaacataaaatgtaacaaaataaaaaagcagcaaaacatttaaatcaaaaaaccaatttgaataataacaattcttcaacaaatatgatgtggcaaaacaatgaatgcgatcgattgtctcaaatccgatcgtccgcttgttgtcatttacttgcctcctttctttttcttgggaccaacagtttcctttaagcaattaaacccattagacctcaattaagcttacaccgactaatacccttttgcccacagtttccgtttttgacttcggctgctccttctctgcagtttttaccgcggcaggttgtgtcttgggctgttccttatcagcggtccgtgcagcgacaggttgtggcttcggttgctctttctcggctggctttgtcactaggggctgaggtgtcttctctttctcgctctccgaaattttgtgcaaaagttcctttcgcttctgaaccaaacgctcctcgcgacgtttgcgggtttccttgttcttgttgcgacgtgcctcggcctgttctctgaaacacaatataacgggttgagccgaattcagttggacccaaaaaccatacgcaagctgtttagaacgttggttttcggtttttttcttaaagatgtattccatgaggttgcgcttgttcttgaacgcatttccttttgctttgaggtagagctcatggtaaaggtgtttgtcgatttttttagcatcacgataacgcttcgatagatgacgaagcacacgcattcgacgcatccagatcactttctctggcatacgcgcattgcgagtaccatgacgcttagccgaacccatgtgacggccctaaatgatt

SEQ ID NO: 14431 - DNA, 1810 bp, Heterodera glycines
accaattaaccatctgaacattctgtagttgccttattcacgtgccttttcacttttctcgagggacaagtgcaactcctcgtcgtcgtccgtctcttttctgttctgccttcgcatttccggcagtgtttcctttacgtctcttgtttaaagtaattgtaattattcagatgtattatcaattatgtgaagtaatatcaatagtaatatttattggattcgtaatgggactgattttctcctccttcactcaactcgcatgtgtacgtcttagccgtcgagcgctttttgcgtcagttgactgctctcaactacgtaatgctccacaaaatttttgatataagtcctatcacatcataatcgtcattataatagtagagaagtcgtcgtcgatgagtaaaataatcaggcgtaataaaaaattatttttataatatcattgcggtcatatacgcttgccttctgcatacattgtgacatcagtttttggcagggtagccagattaaaattttcaaaagcctcatttggcatgtaaaaaaacctcattttggatcaaaaagcctcatttttacaaatttattcaaaacacatttaaaatgttcaaatgttatatttttgattgtccatgaccactttgagtaattttttgctagaaataagcttttttgtgaattctgagcacgaaaatcgaaattgattttttttttttttttttgcggcgctttttccaaaaaacttttggggaataaaggggtcggcggtgccgataggcgccgccgagaaaaatgttgtcatttttaatgcgatttgttaacagatttgtccacaaaaatgaccaaattttgcgattttgagcaaatttttaagaagataaaggatttttatggtccggccgtgctgacaggcgccgccgggggaaaaattaagaattttgaccatattttagcatattttcattaaaaaaattctttattttgcggtttttctcaaaaaaaccacaaaaagcctcaaaatttctcaaacaaccacaaaaagcttcaaagcctcattttgaaaatttagcctcattgacctatcaaaaaaccacaaaatgaggctaaagcctcagatttggctaccctggtttttaccaataacaaaagaaacaaaaaggaaaaattttttttttgagatttaggtaagtgaaaattgatcaaattattactagggctgggatttttatgtttttacatattttttctgcggcttagttatggcgagagaagcccaaaaataacattttctccgaacaattttcgaattagagcgacttataaaaacataaaaacacatattttggcgttttcgcacataaaaacatatcgcacatatttcggagtttcgaacatattttgcacatattttggcatttttgaaaaaaatctaagaaaaacacaaaaaattcaaaaatgcacccctaaaaatcaactttcttgccatttttataggctctttcaaaattttctttatttatttcgtgtaccgaaaatcggattctccattaattcgttactggatatcgaagtttcttgctggaacttactcaactgatggaaaaataatctttaaaacaatttatcaaaaaaggactaattttacccccaaacacctccaaatgttttttatttgcaattgtgcgggcgaaaatgaaaagaatgagttttttggaatttttatgcaaaaataccattggtttttccaatttttagcacatattttattacatatttcaggatttttagcacataaaaatcccagccctaattatta

SEQ ID NO: 14432 - DNA, 796 bp, Heterodera glycines
ccccccccccccccccccccttgtcccacaaaatttttggaaaaagcgcgccacaaaaaaagcgtttttaaagcagaaaaaagtcgtcgtaaatgaagaaaatgataagtgaaaacaaaaaaatgttggaaaaaatccattccggtgaaaaatacaagccatttgaataaatattaaccattttgcattgcatataataaaaattttaaatgtccttgaatttcatgaattttccccactatgtccttgcaaatcggcatacccgtccttggaaacggagcatggacgatggcaaccctggttttaatgctttggatgatcatttgttttgtttcagaatatccaaattaaatgcgaccttcaacttccaacctggactcaaaatctattatcgattcctacttaaattcgacggaagattgtcagtttttattgcgagcattaggtaggattttcttttgtacttgccttccaagtataaacttaataggtaacttgttttagagaaacaagcttttgagaatgtggtcttcgctttacgcgctcaaggaccgctaacacaatacactgagttacttttggatcatctgaagacggcgttgtcgtaagtgcaacaaatctcttcaagactatttgtttgtttacagtattgatgatgatgaatttaacataaaaatccgaattgcttctaataatccgcatatctgtcgtattgcccagcggtaagtatttttgttacttaaatatttaaattcttaaattaggctaaatccttcctacgacaacgatgcacgat

SEQ ID NO: 14433 - DNA, 1078 bp, Heterodera glycines
  misc_feature (51)..(51): n is a, c, g, or t
  misc_feature (53)..(54): n is a, c, g, or t
  misc_feature (58)..(58): n is a, c, g, or t
  misc_feature (61)..(63): n is a, c, g, or t
  misc_feature (66)..(66): n is a, c, g, or t
  misc_feature (69)..(70): n is a, c, g, or t
  misc_feature (96)..(96): n is a, c, g, or t
  misc_feature (106)..(106): n is a, c, g, or t
  misc_feature (113)..(114): n is a, c, g, or t
  misc_feature (126)..(126): n is a, c, g, or t
  misc_feature (130)..(130): n is a, c, g, or t
  misc_feature (138)..(138): n is a, c, g, or t
  misc_feature (152)..(152): n is a, c, g, or t
  misc_feature (236)..(236): n is a, c, g, or t
  misc_feature (269)..(269): n is a, c, g, or t
  misc_feature (280)..(280): n is a, c, g, or t
  misc_feature (287)..(287): n is a, c, g, or t
  misc_feature (300)..(300): n is a, c, g, or t
  misc_feature (307)..(307): n is a, c, g, or t
  misc_feature (329)..(329): n is a, c, g, or t
  misc_feature (341)..(341): n is a, c, g, or t
attatttcgttttaaataaaaaagtgtaaaaataaaatcttacttggaggngnngggnttnnnatnggnngggaaagccctttcggaagttatttngagaaaattngggaaannggatttgtattngaanaaaaagtnaaaattgttgtaangtgtgttgaattatgtaaaaatggttaaaaagaatgataattaattatttttatttttgtagattaaataattaatagggttgnaagaattaaatgaaattttaaaaattgaatttngattgttgttngaatttnggatatggagttngtaattngtagaaatgtaatgggtaaatntgtggaaaagtnataaaaaaaatttttttttctaaattttcagaaaggataagaaaggattggtgcataagctgaagcgacgctttgcactgttcgccaaaatggatttgcaagaaacagaatgttgggaattgcacgaacgcttggccaagctaaaagtggatgaacgcttggccaagacaaaggtggccaagaagaagaagaagccgaagccgaacaatttcaagcagtttgacgccgacttcggcaaggccatgatgacgaaaggcccggtgtttgtggaggatttcatcaaagcgatcctcctctgaaatctgatcacttgctaatgaggggctaattaatgggggagaaggcggcaaaacatacaaaaataaaatgaaaattgaaattttcaaaaaatgaaaacccgtggaaaaaaaattgaaaaaaattttcaacaaaaaaaaattagacaaaattcattgaaattaaaaaaactactaaaatacgaaattttctaaattttgcaaaaatataaaaaaagattttttgtttttttaattaaaaattgtacgttttgcaaattccgcattctttttgtcttctcttcaaacaatttttcatatgaaaaacttgttttcattagctgtataccaaccaaccaaccaattccttcaaaaaatgactgttacaaaaatttccaacaaattgtataactactgtacccgttacagtattctgtcacaacttaaagagatcatttaata

SEQ ID NO: 14434 - DNA, 2472 bp, Heterodera glycines
cattttcgaggcatttttcgagaaaggcggcgattttaaatgttgagaggaatcaattggcatacctaatttagatatacctttggaggcttagtatcaattaatttgttaattagataattaattggtaattggaaagattattttcgtttctttccttaaatttgtctcttttcatttgacactctttcgttttaagttttaaagaaatgatcaacattgaaaaacacaaataatgaaaagaaataaaaattaaattaaattaaaaaaacgaaatacaaaaaaatatatgaaaatttaaaaatagacaaatttgaaaatgataagtgaaattaaaatgtaaaaatttttttaatggatcataagaaaatgtttttggcatttttaattttattattttttggtttttaattttaaaataaaatgaattaaaatgacaaatacaaataaagaataaataaatgaaaaaaatggaatttaaaaaatacattaaaaattagagatcggcattttgagaaaatacggataagggtaagggttacgggcttgacatcaatacgggttacgggcttacgggctaaaaacccgtaaaacccgtagtcagtaaaaacccgtatccagtaaaaatacgggcccgggtaagggtttttttcattttgataaaaattagtttataaatacaagtcttgaatattttaagctaaaagactttattttacgacataaaaatatgctcaaaaatttttaacgaccactttttcaccctactttttttttgcggcgcggattctcaaaaaactttttaggaacatggggaggaaagtccggcggtgccggtaggcgccgctgggaaaaattttgaaaatttgagtgcaaagattttatagaaaaaatgcccaactttgcgattttaaacgatttcatgaattttgctgacagtttttcagtaaaatgatccataattttgaagaataaaccaatttcttaagaaatttaagaaatggaaaaaatgatagagaatttgataaattcaacgaagtgctattgaataacataaaaatttatattgattttttttccaattccataaaatttaccaacatttaccagtgctttttcgattttcacagaaaattttacaaaagtaaccgcccaatttcaatgttttggcgaattgactgcacaaaatttaaaaatttactccatttcaccttaaaaaaacgtcagaaaaataacccgtaaaacccgtatcgtaattgtacgggtaagggtaagggttacgggtttgacatcgatacgggttacgggctaaaaacccgtaaaacccttaacccgtaaaaacccgtatcagccgaaaaaaatacgggttacgggcccgtaaaaacccgtatacggacccggcccgtagccgatctctaattagtaccaaattttctatactttattttttctctaaaatttatcgttaggacaggatgtgtccacaaatatccattttgcacctcactagagttcccactttgtaaattttcgtaaattttgtacatttttgttaattatttttttttcaagaaaaagccgcaaattttatcagttaatttgttcttttttaggtaattaattggtaattggaaacaaattattttcgcttcctttattaaatttgtctcttttcatttgacactctttcgttttgaaagtttatttattgaaaaagcataaataaaaaggatattttgtgatttaatgattaaataaatacaaataaatgatgcatataaattaattatgaaatttaatggaaacaatcacaaaaagaaatcataaaaaatggaaatatttttgggttattttgaaatttgtaaaaaatgtgaattaataattataaatagataataaaaaaagaaatgaatagaaaattaaaaaatacaaataatgtaaataaatgatgaaaaataaaagaaataaaaataaaatattaaaaatttagatcagaggaagaagaaatgggagggaaataatgtttataatataaaaggttttttttgcatttttattttgtgattttttgattttataatttttaaataagatgaaaaaagtgacaaatacaaattaaataaaatgaaagaaatgaaaagaaaaattaaaatgaaatatattaaaaataatgaataaaaataaattaattaaatctaaaatagttaaataagtgaaattgaaaaattgttaaaataataaaaaacaattttaaagggatttaaatgttgacattagaaaatatttttggcatttataattttgttttttttttgggttttttaattttaaaataagataaattaaaatgataaatatatattaaataaaaataaagaaaagaaaattaaaaaatgaaatatattaaaaataatgaatgaataaaaaaaataaattaaatttaaaatagttaaataattaaaaatattaaaa

SEQ ID NO: 14435 - DNA, 1718 bp, Heterodera glycines
  misc_feature (858)..(858): n is a, c, g, or t
attttgactacaattataaaataataaacatatatcttctcaagcagatttgcgcaatcattgccaatcaattggctaatgcctgtgccattgccttccttcccctccccttttgttgccttccaaattggttttggcatttctctctctgcccacggatgcctgctaaaattgaatatcatataataaatacaataaatattcaatgtaattcttaaaaatctgaaaattcgtataatatttttagaaaaatattattattattccccattttcaacagattttaaacaaatttatttattttaaagaatggtttttccgtattttgcgttaaattcgctgtttaatttgtttttaattattcttttggctgccaatttgccgcattttgtggcaattcgcatttcggtaaagccgtccaatttgctctatgtggcggagttcacttgttatgatcgtaattataattatcgtccgtcaaatgcttcttcttctgcggatggcaccaataatgatttgcatgccaatgatcagcagcaacagcctaaaattgttgtcggaagggaatttaaaagttgcgagattggtgaaatgatcatgaggacggtcgacttgggcagctgcaaccagagcgacccgaaggcgtacattcgaataacgaactcgctcaattcgggcgaatcggtcggttttaaaccgactgaattaaatacagcaaataaattttaaaaattaacaaaagcatttcatgtcaaaaagaatcataaacattaaagctcggcctgggcctggatccaggcctggattttttctggatccaggtccaggtcattttttggcaacctggatttttcttgngcctggatttttatttgagttttcaaaaaatgattaaataatttaaaaaacccattattattgtcaattagatacttttagatgttcctaagcaattaattggttttttcaaacctttcttttgctttttcaaacaaatttcaaaaaatccaggtccgggcctggatccgggaatcgagaagcctggatttttcctggacctgggtttttgtccaggaaaaccaggtccaggcttttttcgaaataccgagctctaataaacatcgtgatgtatccattaatccaatttagaaggaatttgagatcatgaaggatgaattgttggcacgaaaagcatccgtcgtgttcgaatttgacaccgtttcaattgctcacagatttgtcaaggtgtaccaatcggcgttgttcggcttccgccgaattcgttcggtggatttcgaaatagaaatattttgcgactttatccaaacgaatggccaaacggaacatttcacaattggcagtgccattcagcgcaagggccaaaaatatgtgaaaattgcgatttatgagatggaattgttgaccggttgtttcaaagacaaagtccaaattaatatttattacagcgaagaaaaggtggcaaaaaaggtgccaaaaacttactaaaatattaaaaacattggacagaatgccgtaagtcatgaataaatccctttttaaaccatgtcctcagcggtttggagcagtactcggcaaatgcgattttataagatacattaaagttcggcttctggacaactcagctgatggacgattcagccgtacaataaaaattttcaaaataaaacctaggcccaagcaagcataagcctaggtct

SEQ ID NO: 14436 - DNA, 1399 bp, Heterodera glycines
ccataaaatatgggaccaaaaatcgcaaaatatggacatctcacgggaaaaatatggatataaatttttccaaggaaaatatggatatataaacacatcctagaagcttcaaaccaagctaaaagcatgtttttcatgcgtttcaggccttccatagtccaggaaaaaatataaggatttccattggactccctaataataatcttacaatttatttgttaggtgccctgtttcacgcgattgttaatttttgccgggagctccaccggggctgggaggaccgggaactcccagctcgcttcctggctccgttcaattcaattttaaatccataatttaatttagcgccaaatcgctttcattccttgtggccattattgcacttgcagaaactgctcaaaagaattgttaaaacagtccaaactttgtgccttttgtcgcgttccgatcactggcactttgcaaattcggagaagcaaaagcgacggggaggcgaacagatcggaaaacgggaatggaccatcgacggcgagggaatgttgtatgttttgtgagcgaaatcaggtaaaagttcaatgacgaaaagggcaattaattcgggaaattggtaattaaaaacgttaatgagttgcaaattgattaagtgcgaaatcgcccttatcccttgcggacattcaaatgcttgttttaaatgtgccaacaataagaaaaaattaaagaaaaactgtccaatttgtgaaaaaagaataaatgacgtattacgaatttacacataaataaatgagcaaaaaacaactatatatttttatttatttgtttttttaatgaaaaactttcggcaattaaaaatgtctaatcaaatttgatcaaattaaatgtgctctttcttattgggacaaatttatgtagcaatcaaatttcagtccccccactcaacgattatttgatcagccgacaaaccttcgccgccaaaagctttgttttgtgaataatcataaaatgttttttattttctttttttttaatttccgttatattgtaattttgaggaatcacaatgtttacacaaacaacaacatttataaaattaagttcgccgccgttcgtttttcgttctccgtttcctgtcatttctttttctaatcacaacaaaaaagggatacaatctgaccttgcaatgtcaatgatcactctttgaaccacaaaacaaaacaattcccacgatataaaaagaattaattaattaatgctaattagttcattaatgagttaatgacagtcaaaatagtgtgccgcccctttctccgcccaattcactgccaaaaacgcctgagggcggggggctttgaaagtgaacacgaagagaagaagcgcctgcagcgcaggagaagaccaacaa

SEQ ID NO: 14437 - DNA, 1535 bp, Heterodera glycines
attcaacattatttattttctttttaccaaaaataaaaatagataatttaaattttactttatatttttaaattttctgaaattcttaaattcgataaaatttgctaacgaactttcaaaaaaaaaaactttgataagacccccatttttaccagtgcgtattttccccgaaactgtgagaaccgggaattcccggctcagtccctgtcccgctcaactcaacttttaaagtttaaacattgggttaattaaaaatttaaattcacttttctgctgttcttcaaatggacacatttggacaaaaagaaccaattttagttcacttttttgttctttttttaaatatttgcatttttcatcacttttttcccaatctttcgcactttttctttcttttcccatccctccgttcgttcattctttcgtttgtccattttctgtgcgcttaaaatgcagatgagctacaaacaaagcatacaaatgaataatgccagcgaaatgcgatgcccttctctctctctctctctctcccacttaaatgggaacaaaaagcggtgcattacaaaaagcagcggcaaaaaaaattgaaaagaaaaagcataagggacaaaaatggggtggggtaaagcaaaagcaaaagaatgggggggggggtaaatgataaatgaatgaatgcaatgcttaattttcatccattcattcatcaatcctttcatttgccgacaccgcccttaaaagcacaaacattaattaattcattcatccgcttacgcaacaatgaaaaatgatggcatttcccggcaaaaagtgcaaaagtataaaaagaaaagcggcgtaaaaccattttttgtaaattttgacggagaaagcccagcaaaatcagctgaaaaggggcgataattcacttgccccgtccgcatttgtttgttacctgttctgctgctgcccattgatgtgcgttcatcgcttcccgtctgatgaggcaaaacaatgcaaaaactttaaaaaacaccgccgcttttcgctaatgaaagcggcggcaaaagaaagaggtggcgtgggaaagcagcagcagccgagccgatgaaaccataaatggttgggcgggtgcgtcgtccaactcgcagcggcagtacccgcggcagaaaatagcagaaaatccttggtcccccacccccctcccgcgtccattgtcccccccccccccccgcattttccccaacggatttattattttgttggtccgatcaatcgcttggctctctctctctctctgtgcacaccgcccgctgctattctctgacaattatttatttaaagtttcttgaatatgcaaatattttgcactttctttgcttcttctgcttcttccattcccccaatttgcttttgtcaattgattttctccccatttttatttttaattgtctctatcgaaactcaaaaccgtactcattagtctgtccattagtctgtccattgtcctccctctcccattcgttgaattcatacaaattttggcttttcctccgtat

SEQ ID NO: 14438 - DNA, 1194 bp, Heterodera glycines
tcagctggtagaacactggtccggaaagccagagacgccggttcaaagccggcccgccccatagtttttccctcaaaggcttccccgctcgttcatatatttcatggcgacccttggcggcttccagttcacccagcagcagcagagaagcgaaaatgaagagagaggataaagctggcactggaagtgatcgaatctgcaaccttcagccgagcagcagctgacgcagagaagaagaatggacgaggacgtccataagagaggcccggaatgagatagagaagaagaagcttccccgagaggaagattaatggatcaattgaggcaacaattgatcctatatgatcgagcaaagtggggagctggagagggcagggtcggtagttcagctggtagaacactggtccggaaagccagagacgccggttcaaagccggcccgccccatagtttttccctcaaaggcttccccgctcgttcatatatttcaatagtaattatacaattattttttgagcaatttttttttagtaaaaaagggtaacacatttcaaagcaaaaaatcatttgttttgctaatggattcgaaaaattcctttgctgaattccattttccgacggatggctcaagaagagaaagaaagtcgaatttggaagaatcggactttctttcggaggttttcgcctcaattgctgcctaaactatgctttttgttcaattatcgagactattcggattattaccttcaaatatccgaccaaatattgaagacaaaactccgttcggatttggttcactccgatcggcgaattgcgcagcacggcgatcagagtggggaggagaaagtgcttttggggttcggagtggacgaagttcagcgggagagacgtgcaaagcattgagagaagggaacgacgccatccgaacacacagaaaagctgccaaacatcggatcaattctcgtgggtcaactggcacttttgttgccccttttcacctgattttgaatgtccccaacggcgaagtggccgatggcgcggatgcattgctccgctaaggcacccatctgaggacaaagcggcgatgcattgcccccccggggcatttgtcgttttgaaacaaatttgcaaaatggaacggaaatgcaagtcatccgaagggccatcgcatggcccaaattcgacgctcaaaaag

SEQ ID NO: 14439 - DNA, 2470 bp, Heterodera glycines
caactgctggcggaagtgttggaaggcgacgatggaaagacaatacatccaaaggacggcacacaagcggactttgctgaacggaaagagtggaattaatcaagtttcgtttcctactgagttgcgctcagctgggcatgcggcattgtgccggcgccggacgatgaacagctccgcccgcccgctgtgccttggctctccgcgctgttgtgcctggccacgccctgctgctgctgcttgggtccggccgtgcgtccgtccgcctcttccgtctctttctttgccttccgatcggtttcctctcttttctcatagtcattttcaagcagagatacggtgaaggaagtgatcacttcacaaacggatagtcttttctccccgatgtacagctccaattcgttggactgactcggatcttggaggaattcgctggggccgagtcgttttgcgcaaagagaaacaaattcgagcagagagcacgagcagaggaaagagaagagagaaagagcactgtcagagtcaatttgccgactgatcaaacgccccatctgatggacgatgaaaacggccacagaaagtgccggggactgagaagcatcggaggtgacaaaagccttgagtgcaaattaacagtgaatgggacattattactcaactaatgagcacactcactcgagccgcattttgttggaacaaatcgcacagaaaaagcgctgtctttggcccgaacgtgtgaatttgtgtcggtgtgtcctcagaatcgaccaaattgccaaaaagggcgagtgatttagtcaaaattctgaattttcactcatcacaaattgccaatcattaatcacctcattcccaattcgttgttgttcaccaaattttgctttctttggcctatcaaattgaccaatgacaataatttctccaacactttcgttctcaaaatcatttgtctgagcatcgctttctcctaaattccaaagtgtccattttcaatcactgctcattttgtgccttggcattgtgcgcatttcgcagggcactgatcagttccgtgactttccgctgcactcccttcagttcgttctcctccaattgcccctcctccgctgaatttcccaatctttcgacctttgtctgcaaaatattcaatattttggcacttttttgctgtgccgccgttttctgtcccatttctctgctccaatcgtcgccaatttccttttgtgtcgtcgtttcgaattcccttcgatttgtttttttaaattttattttttgcatttcccaatttattaccgaattattttttggcgccttttcgcccgttttttcttcgttccattggcattgcttttctctttgatttcgtcgaccatcaaaagctgcattaaattctgatcagaaatggacatttccgcatttcttgctattattttgtccattggcgcattgcccaatgagaagctttcgtccatcgatttggacatttcctcggaaatttcttctaagttttgtggcaacgaagtcattctctccaattcgttcttctgatttttccattattattcttattatttgggttttctttagcggaccataaaatcgtagctgatcactgcgttttgtaaaagtgagtccgacttttggtcagctttggccaagtgtttctccgacataatgtgggccaaaagttgcaggtcattccgaatgatttccttggaaattgggaaggacttccgtttcgtttcccttccgttcctctcactttgcttccgcaccggaaacagcctttgattccgctcgcttcttccgcttcgccctcgaccgttctgtccgaattggacgacctctgctgaagtgccaaatcggagggcatttggccaaagtcggccaaagtctgtgcccacaaatgggtgggtcgtggcgagcacagttccatggccctccttctcacttgctctttgcactgttcgtaattttccgtccctttttcttgctgaatttttctttcatttttccttttcataaatttccgacttttctctgaattttgtccaacagtttctgcttgtccgccaattcgctttccttcctttggcttatcttttggctgtgttctgccactttcgccttgtacttttccatggccttcgtccggtgtttcagtgcgttgtattgccgttctaacctttggtttgcctggtcttttagtcgttttgtgcgttgctgtcaaatggcaaatccgttgcttcatcattagaggtctttgtttggtgccaaatccatgtttcacgattccccccccccctttggcatttgtttggctctttcccaccacctcttccgcgtccttccgccgcttctccgcttcctctctctgttgcttgttctcctcaatgcgcttttgccgctcctcctcggcctttcggaccaaatgcgcatgtcgattcctttctcggatttgggtgaatcgctt

SEQ ID NO: 14440 - DNA, 831 bp, Heterodera glycines
tctcgctataaaagccctgctccttccgcttcaccttcatttcgtcctcttgcgccttctgcacaatctcttcgagactcttctgccggttctcctccgccttctgaatgcgctccttcaccatctccaaatgtgctgttttcttctgttggatttgctcccgcttcgtcctcacttccccaacccttcggtggaggaggtgaagcctttgtgctttttcctgctttagcaatgctcgcaattcttccgctctgcgcaatttgttctccgatgattggtcaatgtcttcggcccttctgcgattttttggttaccatttgaatttccccgggaatcgccgattgccttcgcttcgtcggcgaaagaagctttgcccggagctgtgccaactctcccgggtttctataatggctcggctcggcactgttcgcctgagtttggccttctcttccgtcccactcactctgtgctccctctttgccaattgcttcgtcctcccttttctctggcaattcctccaaattgtctttgtccacaaaatcatccgaaaagtccggcaaattctcttcctgaatgggtcaacaatgtttactgttcgtcctgctactgcttcacctcctcctcgatctctttcttcagactttcctcctcttgtgccaaactctcctcttcttccgtcatcgctttccattcgcaatcgtcgctcaactgatcgatcagtgtcttcaaacagcccgagattcgctgctccctcccctccccctcccccaattgctccaatccctccaattccgtcggtgccttcgcttttgtctccgccgtccctttgct

SEQ ID NO: 14441 - DNA, 1051 bp, Heterodera glycines
aaatttaacaaatataattttcatagattcttaacatttctagttacttcatacttctattaattgaccatcttgagagaaattatcatttaagttttaaaaatgattatttcataatttgtataaaataacacaaattattaattcacttttttagcgaattaaattaagtttcacatattttaaataaatctgggtgtttaaaaaaataataatttgtttatggatttgttactgacggattgtccacgacttttctttcacaaagagtcggagaataatcctagataaatcttgttctagtgttcagttgggatggattccaaggtcccaaaattttcgggaagggaatcggaattccgaggcccaaaaatcgggatttagtgcagctggtgtccagaattgaattgtccgcaaatgtccgtccgtaaggcgttagtaggcgaaatgaatgtttttggggttggtaggcgaaatgtcagtaggcgatatgtccgtacacccttaattgaacatgaaaaatcttttttttttaaatttacaaaaatttaaaccagcggaagagttgggaatttgtaaaaaaacattgaaaaaatggaaaaagaaatttggcataaaatgcggctaaagtaaaattaaataatatttttattttttgtattatttttaggatgcgccattcgaatgaagataaagctaattatgatataaagaaagcgaacccgtcgagtcacagagaaactgagaatttttgaaaagcaatcgcacaactctaagtgtttggacaaaaagcaaaaaagaaatcgctaatttatttgcaattttgaattggcattatttaccggcattttcagtgcctgctgtatcttatcctcaaaatagttatttaggtgctgacaaaatgagttgttatataaaaaccatcaaatgaaaatgttcaacaaagaactgcccataacttttgtcaaagtcaaccaaaattcaacatttttgggataattcgagatagccctaagtgtgctctattataccatcgtaaatttttttgaaa

SEQ ID NO: 14442 - DNA, 1612 bp, Heterodera glycines
atccccaaaattcgggtccccaaatgtcgggatccccaaatgtcgggatccccaaatgtggatccccaaaagtcgggtccccaaatgcgggatccccaaagtcgggtccccaaacgtcggatccccaaatgtcgggtccccaaatgtcgggttccctaagtgtcgggtccccaaatgtcgggtccccaaatgtcgggttccctaagtgtcgggtccccaaaagtcgggtccccaaatgtcgggatccccaaatgtcggatccccaaatgtcgggtccccaaatgtcgggttccctaagtgtcgggtccccaaatgtcgggtccccaaatgtcgggtccccaaatgtcgggttccctaagtgtcgggtccccaaatgtcgggtccccaaatgtcgggtccccaaatgtcgggttccctaagtgtcgggtccccaaatgtcgggtccccaaatgtcgggttccctaagtgtcgggtccccaaaagtcgggtccccaaatgtcgggatccccaaatgtcgggatccccaaatgtcggatccccaaatgtcgggtcaccaaatgtcgggttccctaagtgtcgggtcaccaaatgtcgggtccccaaaagtcgggtcaccaaatgttgcgatccccaaaagtcgggtcaccaaatgtcgggatccccaaaagtcgggtcaccaaatgtcgggatccccaaaagtcgggtcaccaaatgtcgggatccccaaaagtcgggtcaccaaatgtcgggatccccaaaagtcgcaccacagttaaacttatgatcatctgtacatcattatgttattttcaaagacccaaaagaaagtttcatattttttgtaaaatgaatgcttttggtttcctaaatgaatgatggtcaaaagttgaccgaaaaaatcttaactgacgacatagaatatttcgatgaatacgaacagtaaagaattgatcacagttagcatataaatcagaatcgccaaattattttgaaattttctctgaggaattcatacatttaactattaaaatttcccaattcgtgatttatttaaatttttgtttctggcttggcgctgaaacgacgtcgccgaatcgtaagcgcaggggcctatttcaattcagatcatatcccatatatgacgtgtcatatatcatatgcatgtttcaattatacactgacgtgccataagatcatatcgtatgcggaactcacttctgacagccacatatgatatggtatcatatgcgagtgtcatatcagttttgggttgtttcaattcaaattgctacatatgatatgatttctatatatgatgcctacatatgataccgaatttgggataaataaagacctattaatgagatttaggccatttaaataaaaaacttaacaaagatttaaaaaatgaagcatttttaaattttattttcgtaaaaataggtttaaattttttatcttttttttagttgaagaaaataagggcaaataacaaaatatatttttactattataaaaaaaaaatttaataaggatttaaattccaaaaattagcttaacagctgcactaaaaataggttttttactcttaaggcccataggaaaagggaaa

SEQ ID NO: 14443 - DNA, 2053 bp, Heterodera glycines
  misc_feature (14)..(14): n is a, c, g, or t
  misc_feature (1710)..(1710): n is a, c, g, or t
  misc_feature (1733)..(1733): n is a, c, g, or t
  misc_feature (1740)..(1741): n is a, c, g, or t
  misc_feature (1744)..(1744): n is a, c, g, or t
  misc_feature (1749)..(1749): n is a, c, g, or t
  misc_feature (1766)..(1766): n is a, c, g, or t
  misc_feature (1788)..(1788): n is a, c, g, or t
  misc_feature (1799)..(1799): n is a, c, g, or t
  misc_feature (1827)..(1827): n is a, c, g, or t
  misc_feature (1830)..(1830): n is a, c, g, or t
  misc_feature (1834)..(1834): n is a, c, g, or t
  misc_feature (1855)..(1855): n is a, c, g, or t
  misc_feature (1859)..(1859): n is a, c, g, or t
  misc_feature (1864)..(1864): n is a, c, g, or t
  misc_feature (1877)..(1877): n is a, c, g, or t
  misc_feature (1901)..(1901): n is a, c, g, or t
ttatttctataacnttttttaaaaaaagtgataaaaataccatataatatttatataatagagcaaaaaattgcggattttttgagctatattatttttataaaatactttttcagaagggagttctgaatttttttctgaaaaatcgaatttttccagaaattctggaataacttttttattttggaagatagaaattccaaataaatctcataaaattctcccaatttttctctattttaaagctttattccactaaatttgaccaaacacgaagagatttatgaattttcgaaatttcactggattttccgtggctcaaattttgacgatttttcaaaaaattttaaccaccttccaaaattttttcatgaaatgcaaaaccatggggtcccccctttggttttgagtttcaaaatcacaattaattttataactttttttaaactcatggtaaaaacataagataaagcacattagatagagcttaaaattctctacaaaaatgctctaagacaaatttccgctaagatcaacgcctgacgagttataagcctcaaacggaaatggggagctcaattccggaaaatttttctatttccggaaaattttgaaattttttcaaaaatgccaccaatcgatagagctcgaaaaacggttgcttgaaagtggtctccgttttcctgggaaaaatcggcaaaaaataataaaattcaaaaacgaaaaattttcgagggggcctagctcgaaaaattttgaaaattttcaaaatctgaaaacgccatcggatgcagctttaaaaactacacaaatgctcaagcggcgccaacccgctccgcttaacccccagcgagttattcccgaaaaacgtaaaaccggcattttgagcgccgttcagtcgccaatttctacaggctcggcatttgatctgatcaaaaagtgatcagtgacaaagttgtagccaacatgtctggggtgtgccctctcagcagactttttccgctcccggtttccaggaaaaagttacagcccgaaaaccgagctcgtttttcaaagtccgccgtttcagcgccgctggcgctcagttggcctccggaccggaatttccttatttttcccagatgcgccgtcaaaagttacccctgcctgcaaaatttcagccccctccgggcaaaccacggggacttataattttttctacgaactgcaagtttattctatatatatataaactagcgtgttgtggcgcagcaattgctcggtgtagacagtatacttttggtatatatgggcgggcgctgacatgagcgcttcgcgcaaaggactttgttgctagtgcgtgcgcgattttcaaatgaatttatggatgtgataagggattttcggtctacaggcatcgtgaggacgcattcataattttgtggaggactttcggccgcttcgcggcctcaaagggcgctccgcacttatcttttttcaaaattttaaaggcgacatttgaagcttcgcggcctcagacgggcgcttttgcgtccgtttcttagaacattcggccgcttcgcggcctcaggacgggcgttcgcgcccgttttttaatttttttggggggcattcggccgcttcgcggcctcaggacgggtgcttggcgcccatttttaaactttgtggggaacattcggccgcttcgcggcctcagacgggcgcttggcncccatttttaaattttgtggtgnatattcnnccncttcncgccctcatacaaaatncattaataatttttaaaaattntaaaataaatncctctttttattattaaaaaaaactttnaancttntaataatttaaatttatttanattnaaatnaaattaatttctnaaaaattcaaataaaaaaaatatnaaattatttaattaaaaaaaaataattttaataaaatttttcacaaaaaaaataatttaatttaaaaaagaaaatttaatttttattataaaacaaacacttttctgggtagagaaaaatattaaaaataaccatagatataacgaaaataa

SEQ ID NO: 14444 - DNA, 1324 bp, Heterodera glycines
acgggcgcttcgcgcccgttttttaaattgtgttgaacttatacgggcgcttcgcgcccgtttctaaatttgttgggctattaaggcagcttcgaggcctcagacgggcgcttcgcgcccgtttctaaatttgttgggctattgaggccgcttcgcggcctcagacgggcgcttcgcgcccgtttctaatacaacagtgattagaagagatgcaacagagatcagaagaggtacaactgtgattggaagaggtacaatagtgataaaaagaggtacaacagtgattagtaaattcattaaattaaaatgaaaatattttttaacaaatttaatttaaaaaatacatgaaattctatcaattaaaaaaataattcatttaaacttataaaatttattcattaaaaaaaaaattaatttaaatataattttttatttattaactcaaaaaatattttaaatgaataaaaattgaaaaacacgaaaaaaatggtagaaaaataatgtacaccgcccggatccgaactccccccatccctcaaaatgatgcctcagaatccccaatcacacagggattctgaggtcttaacgatgtcaaaagtaaaatttgattacgtattcgtgatcagcggcacaaataacccctaatgacatgtttttggaagatttttgtgagaaaaatttttccactcaaaaaccatgtgctcccccctttggacccgaatcacaaaatcacttttatttttatatctttttttaaaaatgtgataaaaatgtaaaataaaatttatattatagagaaaaaaattgcggatttttgtagtattttacttttctcaaatagcttttcagaaccgagttctgaatttttttctggaaattcgaatttttccagaatttctggaataacttttttcatatttatgctagaaaatccaaataaaacccataaaattctcctgatttttctctatttttaaggctttattcctgtaaaattggtcaacccttaggctagatatgaattttcaaaatttaccccaaaatcccgagggtcaaaaaaattgaaaaaaatttcgaatttttaaaaaattctaaaaattatgaaacgaaaaacaaaggtcatattcgtaatcagcatctcaaaataccacagaaaaaaatttttcaccccccttttcaacccaaaaaaaatttttgaaaatttctagggggcctagctcgaaaatttttgaaaatttccgaacatttagtacaccattcgatagaactttgaaagctctacaattttgccctaggggcatttttggctagaaccaacccccga

SEQ ID NO: 14445 - DNA, 977 bp, Heterodera glycines
cagcttgcatgctgaggtcagctgttcaagaggccataataattaacatgttgaaaaaaattttttctctatgtactcttaaaattgtttttgatttttttttaaacaaaattttattttggtccattttttaggttaataattgacatcataaaaatatgcaaattgtcgtaatgttttttattttttttgttgttggaaaatcgcatcacttttttgtggttaaaattccatttttggcgggtccaacaaaagtaaatttttgaggcacaatttccaattgtggagtctcgtccatccaacaggttaagaaaatgccataaatgcgtcaggaagtaaatgtttatgccattgtttgtccagctgaaactaaaccgtaaagtgataatccacgaaaaacgcaaaaaacattatacaaaaatatttctgtatttaaaaatttccttatttacaaaaatgtttttctaaatacacaaatcttcaaaaaatatatatttattttgatatttttcaaaaaataagaaaaataaatatatttaattaatgatcgaattaaaaataaaattgataatatatcatctaaattgtaatttaatattaaataatttttaaaaattaatttttatcattgtaaaaagaagaagaattaataatgcaataaatgatttttattgcttttttttatcattcatagaactgacaaatgagaaaactgttataaaactgttataattttgctgcccctatttttggatgcgattgagccccacagattacaatattataatggactcagcaactaattaattgtaaactattttaagccaacttttgtgaatgactgtaaaaaaaggcgtaattatttcatttttctcaaattatttataataatttaacggattattacttaaatatatcttttatttaaatttaaattcatttccaattttgttttttcatcctccaccctttccata

SEQ ID NO: 14446 - DNA, 3197 bp, Heterodera glycines
gagcccaaaataattaccatgttgaaaaaatttttttttttatgttcttcttaaattgttttttgattttttttaaacaaaattttttttgggtccattttttaggtaaattattgacatcataaaaatatgcaaattgtcgtaatgttttttattttttttgttgggaaaatcgcatcactttttggtgttaaaaattccattttgggcgggtccaacaaaagtaaatttttggcacaatttccaattgtggagtctcgtccatccaacaggttaagaaaatgccataaatgcgtcaggaagtaaatgtttatgccattatttgtccagctgaaactaaaccgtaaagtgataatccacgaaaaacgcaaaaaacattatacaaaaatatttctgtatttaaaaatttccttatttacaaaaatgtttttctaaatacacaaatcttcaaaaaatatatatttattttgatatttttcaaaaaataagaaaaataaatatatttaattaatgatcgaattaataataaaattgataatatatcatctaaattgtaatttaatattaaataatttttaaaaattaatttttatcattgtaaaaaaagaagaattaataatgcaataaatgatttttattgctttttttttatcattcatagaactgacaaatgagaaaactgttataattttgctgcccctatttttggatgcgattgagccccacagattacaatattataatggactcagcaactaattaattgtaaactattttaagcctaaaaaaaggcgtaattatttcatttttctcaaattatttataataatttaacggattattacttaaatatatcttttatttaaatttaaattcatttccaattttgttttttcatcctccaccctttccatattaaaattcctttttttttgtcaagtgggccatttccgtcaaatatttttagctcttttaaagaggttaaatattcagaaaaaattgggttcacgactttttttccctctatttatggcctgaatgctcgcgaataaatgtgtcctcttaaagtttcacttaataaaacaaatataaaaattaaatcaattaaatataatttaattttaatgatctgcctgctaattgtttacatatttttggccaaactaattatgctaatgattttaaagaaagttagaaaattttttatcattacatgatttcattgttagctcatgggaagtttttaagaaaaaattttcttttttttcgaaaataaggtttatttttttttgtctccaaaatgaaataaaaaatgaattttttttaaacttctttttctacaatttttatttcaaagtcgcacttatctttaatttttcggtcatcgtacaatgggtgacgaacgaaggctaagcgccgtttttcatttattcattttctaacttttcatttcttaattttcacgttcttttttattgcccatttcgcaccgcaataaaagcacaacatcacttaagccgtaactgaaaagtgttgaagagcgcccgaggggtggtgattaattaaaaatagaaaaaaaaaattaaattaacgaaaaggcgcaatgtcattggcattttgccgtcccaggatgatggaagtcatgttggcatgccctttcgacccggctttttcagaatgaatgccgagacgcggggagaggcatggaatttgtcattttcatattagtgaataacgaaaagttccattgccaaaatataagcgtacaacgcattttgtaattggtcaaccggattaaatttatattcattgaaattttttttttcgaattgattggcatgttaaaatatttcattcaaaaattttaatttataaggaaatatttataaaatggaatttttgaatttttgatgatagagtttaaaaataattttgtaaaaatttttaaaaataaaatactttaatcaactcatttttttaaacttttggacttcaatattatcatattaatataaaaatatttaattatttttgttgtgaaattcttgataagtgaattttataaaaataaaaataaaattttttagacttcactattatcataataaaataaaaatattaatttatttcgattttaaaatgaacagttttctgcattcacatttttccattgatttattctatgaaactaatgtcaatttaacgctaaaagagtacctctgcccctaattagcatacaattttctctgggcacaatttttccatagcattcattaacaataatttttttttccgactccattaatttatgcataattattaaaacataaattaaatcttagcaaaaatgttcttctcttttaaaaatcatttcctccatcatcaattagaacaaaatgccaaatttggcattggctgttccggcattaccattcaaaatccgccggtcaaatcgaagcagcaaaaaatagaggaaatttacggcactcaaaacaacaacattatgccaattgttacgctgctcagtgttttgtatgtgtgcagtgttgttgtgcaaacagcttgtgcaatgccaatgcaaatgttggtcatgtacacgcccatcaacagttacgaaggtggatttaaattatttcttgaaatttaaataccgaaaatccataactctcgacaaatgctaattaatattaaatgtgagaatttggtaaattgccacattagcaaacatgaatcatgataattattaataattttggtgggtattgattaagcaagctttatctgttaagaataagctttatgaaatatgaatttttagaaaatccccgacaaaattacttgcccaaataaagtccataaattatttaattttttttttgccatgtttagttaatgaaaaatttagccacaaaaataaaaccaaaattaattcttgcttatttaatttaggttcggaccaacttctgtttccgctctatcgctcagacttacatttgttcagacaaaagccccaagaatttttggcaaatgccttgctgtcaaacacggatggtaccaaaataaattaatttcttaattactataaaaacttaattgttttttaagtagtccatacgcatcccatggaattggtgccgagcactgaccacagcataaacaataacaacacccgtacacgttgatgatgaagcgcattt

SEQ ID NO: 14447 - DNA, 3174 bp, Heterodera glycines
tatattttaaattgtttccaacaaattcgactccatcaattgtgggcaaatcagtgatcggcgaaagttggtaccaaaattcgtcaccaagataaacatcaccaatgatatgattgtcgttttcatcatcatgaccgtacacaaagcatgaaatgacaaacaatatactgtaacgcaaaaaggaatggaccattttctgtaactgaaagaaaagaaaaccaaaatttttatttaattaaaataaaataaagttttttaataatttacaatatttatgtttctaatcgtaaaatatccaaagtgtagagcaaaaatggagaaaggaaaggaaaaaattgtaaaattttatgtataaatttttttatgaatataataaatatggaaatatttagaaatattaaaaaattgccatttttgaatatattgatcaattcattgagttattattttttgggtttgtgataaaatgcatttgcttcttttaataacgtcaatggaataactaactttacgaaatgtgaagcaataagtattatcgaaaaacaaaagcttatctttcaaaaaagcaaaaatttataaattaaaatttaaatattatgaaaaatattttagcgaatataatttttcattcttaattgcttgagttctcttttgaatggacaacacaatgacaaaaaaaaacttattcatcaaatatttggtttaatttttttccttttaaattctttttagggttattttcagttttacggacttttaaattttgataaaaagggatcttattaaattattacagtttcaactaacatcttttcgaaaacattgggagaaactcaaaaatttgatattataattaatgaaatggcacattagcgcctccatttttgcgcctttcacatttgcgcccagaatatttagcaatgacgaaatgacactttttaccaaatactcgaaactttttgcaaaaagtttttttacaaattataactaaattttaatcctttcaccgaccggcgggcctattggcaccgccgaaaaccgcgaaagcgttaaaaattgacaaaatttttataaattacgtatattgtaaggattttatctctttttttccccttttaattattgtgtctccgagtgttttttgacaacatattgcctggcgggctaataaattgggttctaagtaatactgggaggtgcaaaagtggacttaccataattaatacaatttatcgaaagtattcaactttgccaacagttttttacagtatattttaaatagtcgacattcaaaaatttattgttgtcatttgataaatttttaggtttatttcctttttttgtaaacatttccaattttccattttttcaaatttatttttttttctattttttcaaataataatttggggttacatttttgtatgattttgagaatttctcagactttttttatattttgtctaaaaatagaacgaataaattgaaaatttattttacattggaatgcaattaaaaggagatgatgaatgaatgaatgacatgcttgttaaatgtattcaatccacacatttttttcatcttaaagacatgcattaaaagaaatttcattgaattaaattcaattaatttattcctgtaatgttcgggcgttaaacacggcgcatttttaaacgttcgttttttcggcgtattgtaacgaataaattttgtacattaattgagctgcttataaaagagtgcccgatgctgtagcttctacagttctcctcatttcatttcatttgaacaaaaatgtattttttatattaaatttaattaataaataatttatttaataaataataataaattttagaaagggtaaaatgaatttgcacacaattttctccgtgttattgtgtgcgctggtgttgtcctgcgcagtcggaaagccaccagcaaaaaagggccagcaaagtaaaaaggctgacgtcatagctaaagccgctgctggtgaaccggccgaagtaaagaacgatggcaaagcaaaaaaatcggctaccgtcgtgcctgtcgcggctggaccggtaggcgcaagtaacgatgccaagggcactaccgccggtggcaacaaggcaaccggcgacactggcacgactaaaccaagcgccggcggctctgccacgacagatgatgatgatgatgacgagagtccttctccttcggccgccgccggtggtgcaacgacaaccgatggcaaggctaaaccaagcggcgatggcacggccaccactttgtcgggtggcggtggaaaggcctccagcgcggcaaaagctggcagtggtggcacaactgtgcccgccaaggtcattcagaaatttaaaatatatttattttgaattttttgttaaaaaaatttatataaagggagaggaaacaaccgcagtaaaggtggacgaaaactcgaaaggcactgatgagacagagaaaccggaagggtaaaattaattttttgtcaaaactttaataaaaaaatttatgaaatagaatttttcgaattcttgagtctgtttttgtttaattagcctttttaaattggaaagcgcccaattcatactgttttttgacaaaaattaatttctcataaataaataaaatcgtcaaaaaaattaaatgggaaatacatttttatgaaaggaagcacccgaatttttttaaaaaagagacactcacaaattgaaaaaaaatcatttttattccttaataccccaatttttgatcaaattcagctcaactgatgccaccattactggcgacacgtttacaaaggtcaacaaaatcgcggacgagatcacagagtgcgagttttacttcgttcatttggaaaacgtggtaagaaaaaaaacaaatgcatttttaattaaattattgttttttaaatgcccaaatttttttcacattttgcaacagaaagccaacgaaaaggaaaagctttggacacgaaccaaacaagaagcggagatcgacaccgaagagatggcagaagatagcgtcgattatcgcattgtgacgcccgccatttccaaggaccaaccggacatgggcacattgtacgagcaagacacggatgatttgccctccgatccagatagaagggcaaggaggaatatgtaagttttcgaaaaaaattaa

SEQ ID NO: 14448 - DNA, 4444 bp, Heterodera glycines
  misc_feature (503)..(504): n is a, c, g, or t
  misc_feature (551)..(551): n is a, c, g, or t
  misc_feature (4338)..(4338): n is a, c, g, or t
ggtcgaaactttacaattgggcggaacggagctcaccttcgaacgccggggcaaacttaacgccatcacacagtcagaagttgtgcacattggcgaacaacagcaacaaacggtgccaaaagaacagcaaaagtcgggagaggaagggtaagttggccaaagggaattggacaccaatgaacacaaattaattgaaaggggcgcaaataagcaacaaaatggaggccatttgcaagcggaagaaaatgcaatgggccacaaaacggaggtaaggacagacagttttaagaggcatttcctttttagttcttggcaattctcatcagcccctaaaagatttttggaaaaattgaagaataaatttaaaaattcgttcacttttcatgcgccggggactgactgtccggtagtgccggcaatttattatgaagattttggtaataatctcttcattaagaaaatgatatttaaagtttgtcttattgttgacttttttcctcgannaatttgaatctctttcggtgagattcttcaaatatcaaaaacgaaanatatggaacctataattaattactcatctttttaaaatttctttttgcatatgtcagaaattacggcgttctgtcaaaggcaactccatcgcgtcttcaacggatggacatttaaggcatcgtactaatgagaacaaaaaagcagcaaacgcattattggaggggatggcacagcgatttccaacggtggcggaggttctgtaaaactaaaaaatcaagttgaagctgcagaacatttcacacactccggcttactatgattttctctcttttatttaaggtcgaaatgccgtcgcaaaatgatgacgaacaaaggtaaaatggacgaaattgccttcaaaaaatgtttataagctaaggcccgtggctgcttcgaaagtttcattaaaaaagggacgaaaagcggccaaaatggaacggaaacagaaacgccttgaggaggtgacggaaggatttaatattgttttatttgggctgcctttgcagaaggacgaaggcgagctgagcagcagtgactcggaggagccgaccagttcagaggaggaggaagaagcggcgaattctgccgacggagcggcggcccccaaaaagtcgggcgcgcgattggtcgcttctcgcgaacgacgccgcacgcgcagagtggacgagcagaagcaagttagtcgacgggacctctacaattgcactatcgcccctggggactcctattttgcctgttggttggtctgaaatcgaaataaaatatcctttcatataaaccatttttagatatccttctttggtcaaaattgaaaaggatatttatgtttttcttaaaatcaacatttactgtcatactaactttctaaaaataatgattagatttgatatcagattcagattttatccaaattgattatttcccattttggcccctttgcgtaacgagcggggagatgctgacattacctgacaataagcaatggggcggggggtcatgcaccgaacggcgcctaccgtcaccgccgaacccaaaaacgtttttcttaaaaatttgactggaaatagcaaaaatttagtcaatttttgataaaagctgttaacaaatcgtaataaaaagtacaacatttttcccccgggtcccctgttccccaaatgcttatttttccctttacattagggtgtatcgtcagcacaaaatttgcaagcattgcttcgaaagtgtttcgaacttcgtacgcgcattgtgggcaaattgagcattggacaaaaggcgatgttccgtgactatctgaatgtaatttaaccgtcacatttttcctatcagtaattttgttgtccttttcagaaaagcatttctggtgctcttcagcatcaatcgcagcagagtcagctccaacaattggtccagtcagcggcaaacccggcaactgatgccaatggcgacccatgcccaacgatgccaaaattgtgaacagaacgatcgttcgttggggcgccagcgacattttgacaattctttattttttcaactttcatttgtttgtgactgcttcttttaaattgttaatcataaaacggaatatcatttatgttcaaagtattacatggaaatcgagtttttctaaattaatattccagtagagaacacctagagcttttgaatgacactataaaatatttggttgaaattgagacaagttatgatttttattttctaccccttggcggtttttaattagtcggaaaaattttttcgaaaatatatttttattttttggatcaaaaaaatacaataatgttgtggagcggactcgaaatcgtttcactttttatttgattgatagatttttctgccttttttcccgacatgccaaaattgaaaattggcccactaatttatctcgaattttttatggtcaaaaaccaaagctgatataacaaaatcttagtttttctatacaatttagaccagtagaatccgaatatgtccttaaatgggacctatcttttcaacctgagcttgtactgctccaactccatgcatgaagttcgagctgtacaggtttgttgcgatcccagagaccaaatctaagaccatattcgaactcaacatacccgatttaccttgtttaattaaattcagaatttccaaaaccacttaaaacattatgttacttggtggtcttgaaaaatgccgtttttggagaccactttcagtctcggctctccaataattcaatttttgtaattaaaattttatatttttgtgttcttatagtcctaactttgctctatttaatcactatttctctggctctgtatctcttttatttttctttaaatcagccatcaaaaatacctaactctaaaatgaccatttttacttacttaactctaactccctacttttccattggtattgatctcttgccagaataatggcaacatattattgataataatggcgggtatcttgaatcatgattgtgttttgttgaaattaaaaaaaaaaatttaataaaaaaaatttgggtatcaaaaattatgttccaccctaagtacgggataatcacctctaatttcgaagttttttcgtgcatatttttgacaaccctgctcataaactacagaaaaaagagcccacaaagaagattatttataaaattattaatgctaaaggcgtagaaaacataatgtacctaattaggaaaaataactaaattttaaatattttagaaacgcccatctcaaattttaaatttatatttggtcaaaaaaacttaaaaatttttcggttcgattaaccgaggaatttttagaaattgccatttaaagggtaaaaaattgaaatttactcaaatccctaagaataaataaactgtaaatggattgttgtaagtaagcttttgcttacataccaatccacgcttatgagttcatttaataataataatattattttatcttattttgtttttcaataaattctgatccattctccgatcacaaatcaatgttctgttaatgttccaatcacttgccttattaagttcaccaaattgcctccactgttcattttacagggaccgaattcgccgggagaaccgccgctgaaaaagtcagactttgaaaaatttattaaaaacgttcctatgacattctgaaaattccataaaatccacgccaaggtgaaaaatcatttatgtttactgtatttactgaattagaacccccctttcgagggggttgaaaaatgaacccccggggggttctattcagtaaatacggtatttattttgctgttttatttttctacaatatttctgatttatgagtctcttaaaccgaagtgcgaatgttctgctgttgtcaatctatttcttattaaaccaatatcgtaccatgttttgttccaatccttccccccgtgccaatgtttctcccccctctcccaccttgtgctgcttgtgccgtcgactgttgcttctgctccgtgtccgtctcctccgctgagaagctttaaaggtgcgttactgtacgaatgatcgtagacggaggagacaaaatgatgaacaaaatcagcggaagggggcggaagagagggaaaaagggccccgggcgatgatgagagaggaaaagcggacgaaggaagagaagaagcggacggagatgaaggaggggacgaatgcttggcctctttgctaaaagagaatgagaaaacaatcagaagagataaaactgttaacgacaaataaacaaaaggagaagcggaaagaaaagaccggaaaaaggacatcattattanagatgaagcggacgaagagaaggcggaggagattagccatgcaaatccaaccatgggaaagccgaaaagaaagaaagagggggggggggagagagagagcgagaga

SEQ ID NO: 14449 - DNA, 1242 bp, Heterodera glycines
aaagggattgttttaatcttcgttggacatgacccgatgaaaacccaaagaggggaccatttgatttacaataataggtcaaagtaaataacatgtacctatttggtcaatgaccctgcaaatataaaatagttttgaaaataaaaaaaacaagggtctctctttggttttgctttttcatcgggccacttaatctgcaaaagtgccgtgctctctattgcttttcaaatctttcactatttagtgccttcttcgtctcgtggtccacttgctccgccccattgtgtgaactcgccgattcctttttttgaaaaacctttgcctgcgactgcccaatcgaaacgcatgccgtcatttttgacgtctacgccagttaatcgaaccaattatggaatgcccaaactgagtaaggttgttaactcattgtgaaaatatccgtttttctctttagttccgcccgagtcttcccccttttctccaaatctgtccttaccaaatgacagcagactgtccgtggacagcaatttcatccattttctgaacgacagcaataatcagcctggcaatcagtattcgaatatcatccgagaagaaatgatgatgaacaactcaacgacaggcgaaatggtccagggcagcagtaaaaggacagacaaagggacggaaggagtcggaagagggagcagcggacgacgaaaccaaccgaatttggaggagaaagcaccgggttggcacaatttcaacatttaggggttgaaataatggacgacgcgttttgggaaggacaagagtttcttccacaatcacttcgttatttatttttagataaatcagtgcgtccgattggaggagggtccaatgtttgccaagaaatgccagtgcaaataaaaaaagtttgtcgagaaattcttattaattgcgtagcgataaataaattattaaggagcccgaagatttcgagtttgagacttctcttcttgtcgacgaggaaataaaggacaaaattctgcttgcgctcgaggaggagaaatttgggggttggcgcaaaatgcggtcgaggtccaatccgacgcatcagtactattacaatgggaggacggggacgagccaaaacgaactgccgaagtcatgggaaaaggaaatccaggaacgagcgaaaaaggcattaactaaaatgacagtccaaaccaactttaattttacagtaggagtccaacaaaaagtgtttatcgtccgacaaag

SEQ ID NO: 14450 - DNA, 3584 bp, Heterodera glycines
  misc_feature (73)..(73): n is a, c, g, or t
  misc_feature (113)..(113): n is a, c, g, or t
actccaactcccaaatgcgctcagatgttgcccttcacgtcacgcggcgtgccaaagttggtcatcagctgancagacagaagagagtaaatgaggggatggcaccaacaatntggcaaaaataggaaatcgaaattgtggccataaaatgccaaaatatggacaagaatcagagaactcttatattaaaaattcaaaaaggactgaaatttttaaaacacatatttttccctgagttttttattccttttaaattaaatttatttggaattaattaaaacctgaaaaatgcaaaaattgctcatatatttttggcatttaattaaaggtgaaaatgtgatacaatttatgaatttggagggaatcatgcaacgattaacaaatttgccttagcttttggatgatgatttacttatataattaataaactgaacagttactgactgtactgcttgaacttggtgcctatcagggatggcattccgaggccccaaatttttcggaaatcagaattccgagccatccctggtgcctatgatgaccaataaatggctgtcaaaaatgatattttatttatacttgtaacaaaaaaaggaatggcaccgaaaaaataaaattaattaataaaaaagtttcgaatttttatctgttactgttttgttttattagtagaaaattttaatttatgacttttaaatacgtcttcaaaaattcttttttttcaaaaaattttaaaactttttttcgaccacctcaaattaatagcactgattcttacaaattagcctttggaaatgatgataattaatagatcgaatagatactgtgctgcttgaacttggtgcctatgaggagcaattaatgactgtcaaaatgattatgtatattttacaaaaaaaaagatgacaccgcaaaaaatataaataataaacataaaaaaagttaaattacctataaaaaaattttcgaattataaaattttaaatttatggtttcggatcttcaaaaattttctcagaattttttttaaatgcctatttttgaccacgtaacattaagtttggcaccgattttgcccgatgctaatgcctagtccaaaaaaaaactagaaggccggacaggactggatcattcatgtacaagatttcccaggaccatagtccgggtaactgggtttgatttgaagtgcaacaaggctcggagtccatttaagacgggactttgtgtccgggaatcctgtccgggtccgactcggaaaattcgggtcctggatccgggtttttcaaaatgccagccgaaatctaagaaaaacccaacgctcattttggtgtgccaaattgatcaatgaatttgcctgattttactttttaacccctgaattctgatcagtgtttaaatcgttttgaaaatgttgtgggatgagcaaataaatgagagaaaaagcaactaaaataagcgaaacaaaaagagcaacaaaaccggcacaaacacgcagcacaacacaccttttgcgagtcgaacttgttggtgccggactggagacggatttcggtgtccggcatgcccagcggggacagccccacgcgccaacgcctggcgatgttggtggcgccgtggtagttgtcctccgcaaactccacccgtgtctgcgtgttcctgggcgtgccgaagccagttttgccctggagggttgcgggcacactttttttttgttttgttgtttgttattaaaagcataaaataaaaatggaaagcagcagcaaaagccaaattagagaaaagcggacggacgaaaaaacaaaacaaaatttgctgcaaaatgacaacaaaagcggtttctttccttattaatgtgccatttatttttgctgtctcagcggcattgatcaaaacacgcgaaattgatacactgattaggccttggataaagctaccgatcattggacagagagagagagagagagagagagatttggctggtgaaccttactggacaaaaatgaaaatccaatgatatttggagagaaaaatcttttcccaacaaataaatgagtgaactagggtaaaacgggtccgggtatccgaaatgggtccggaacccggatacccggctttttcaagacccggactcggtttttttgagtccagcaatacccggggacacgggatttatccaattaaaaataattaaggctcataattaagtttaataaattcactgacaaatgagtaaagaaagatttatggaaattatatcatttttctgatcagaataatttttgtgttatcattcattaaagaataggaataataaaaattaattattgcttaatgacaatgatgattataataattttagtccttgccttctgcgagtcgaactgattggtgccgttttggagagggcaaatgcctgagaaatggaagcaatggaatattatacacatttggcaattttgacaatttcccctccaatagactgtcttcaaaatttatacatttcgttaatttggacctaattatttttgtgatttcgtgtccctaaatttgagcccagtgccggcggccgcctcaccgtcggtggctctgagctgggccaaagtgaatttgccacttttggtgcgacggtcgttgccctccgcctgcgcaatgtcaacattggccacaacaattttgagcgcatttgggtctgaaagcatttgtgacaattagtgaatttaatttacaataaatcactatttcaatcacttgccaatttttcgttactcaaaaaccatcaaattgaaaatttttgacgaaaaattgatttatgcttacgcaaaagcaaccaaattttaattctttttatgattcaatagctagccctaaatgttcctcttttatcctgcaaaatttcaaaaaatttctcaatactatcgaatggcatgaataattataataaatctgtttgcttttgagcaaagttatagcaaacatttttttttatctggtcattttgagtagcgtcataacaccggctcaataaagaaagaaagtttcatggatttttctcttcgcgaaatcgttgttgcggcgcgtgaagaaaaagtttgggtcgagactgccaaaaaaagttcgggacgagaaaatgtcgggattggggggggggcacaaccataacaatttgattagacgaaacatttttgaatgaaagattaaacaaattaagaaaatgccgaatttgccctctttcaaaagcccctctctctttctctcacattctctcccattcgctcactgtctctttctaatccctaaattttcaatttttctcttctttcttttttttgccttgcggttgctgctctccccccccccccctcgacccccccttccagaccccttcgcaaaaatttcggttgacccccccccctttccatgtatggttgaattcttgaaaatagcagaactaaataagctgatgaaataatttttatattttttaacaattttaagatttccccggaatttaacgaattgatccaaaatttcctaatttttcgcccaatggtgcctaacggcagcgccggatcccaaattcctta

SEQ ID NO: 14451 - DNA, 1610 bp, Heterodera glycines
  misc_feature (56)..(56): n is a, c, g, or t
  misc_feature (72)..(72): n is a, c, g, or t
  misc_feature (85)..(85): n is a, c, g, or t
  misc_feature (1564)..(1564): n is a, c, g, or t
  misc_feature (1568)..(1568): n is a, c, g, or t
  misc_feature (1607)..(1607): n is a, c, g, or t
aaaaaatattttcaaatggcacacgcaataatcaatccaaaaaatcactaataatntaaatttgtacctatntaatgaaaatctntaaggcaatattatttgtaaaattttattaataaaatttttttttaattttatattgaaattgttttcaacatctgtatttctttattctttaacttttattttgtgacaaaaattgactgtgattttttttattgttaattttctgccgaaaaatgcccaagaaaaactaaaaacgcgtaattctttttttataaattcaaaaatcatttaagtgaaagtgtcatatttgtttttgcactactctttttaaaataatcaaaatagggcgtaaatttatttgtttttaatttcgggttttgcgtcttggcgaatgaatggggcaattagcaaatgccattcaacaagtgcgcacatttaaatgaactggcaaaaagtagtaatggcgtaagagaggaagctgcaaaagaaagagcaaattgttatttgaaaatgataatttttttaaaatttttttattattcaattatttaaaaaaacaaaaaatatttatttattcataaaaattattttattatcattatttcaactaaaatttttcattttatttaactgttaaatttttttatgaaaatttatttttaaaatttatatttaatttatttaataaatagaattattaattcaaattaaaaattataaagaaatttccttaaataaaattatttagtgaatattatattcattataatataaaaatgcatatgtgtgtctttatcagtctccattaaacaattttttaaattggattttatggcaaaatgctaatttcaggcgtccaactaaaaaatatatgtgtaaaaaatgcagcaaaaacaaacaaacaaatgctgtttgtgacagttgacttaattaagaatgtctgctaaattcagattattcgtgcttttataaatataaacatttttcaaaaatacgattaacaattttcgaaattcgaagaatttttattagaatgatttctgacgaggaaaaagctcgtcttaaatttatgcatgttaattgaaatgataataaatgataattaggtttcctagcgaatctcagtgatgtggcaatgtttctaataacaaaagtgcattatttgaaaactacttttttaaattttgtacatttcaaatctttttattttcgagtcgatatttttaagaaagttttaggtttgcaaatttgtactttttcattgaattttggtaaaattatattaaatcgaatgagtgaataagtatataaaaagaatcaattagtaaaaatgaatcatttttatgcctatgaaaagaaaaagaattggaatttcaatagaatagattagtcaaacaaaaatttgtgccttagcaaaaagagccgtcattttaagaatgaaacaaaaggcattcaatttattcacgtaaagacagtgctaatgtgtaattattcagctaattatttccgattttattacaattgcgcatttaagaagcattagcatctttggaaatanatgnggcaatgatgtgaagtgacgaagaatgatgccacataanata

SEQ ID NO: 14452 - DNA, 2781 bp, Heterodera glycines
attgcagtaaattactcaaaaattttcccggcggcgcctatcggcaccgccggaccccctttttaccatattcttgaaaaatggagaccaaaatggcaaaaatagtattttctggagaaaaacggctaaaaattttgtaacatacaccccctaatttcgggattccaaaaaacgaaaaatacaccctgaaaaatcaattcaaaaagtgaaatacacccctaaaaatcgaattttttacttcagccgcccccccccccgaagcaaagggtctggctacgcccttgtataacctataatacaaatccctaattcacgaacactgaaaaaaatatactcacttcaaattttcttaccaaaaaagccgaaaaatacagtacttgctatagtacagataggaatccggtgttatataatgcttatgaataccgcaccaaataattaacaaaaatatttaatactaaagaatttctgactttctccgtccccatagtacgacgatgctacttaaatgtacaaaacatgcattttttaaaacattttgtgttgttttgaatttcttactcggttcatctattcttctacgatttggtgtactgtaataatcttggtccataaaatttgattctcctcgtcccgaaccttggcttgacgtacgggccaagttgtctgagaattgaaatgataaaaatttcaaaaaagcgttttggggagtcgatgccgggaaattttgctctatttgttacaaatttcataaaaaattgcactaatgcaaaaataaattaattaaaaaatatttatggaaatatttttagtttcttttggcgaaaagtgtaatatcttgaagaaaaccgtcggtaattcccagcgaaatgccatggtacccccggtgttcggttcggcctgttttcgagccgctgcttttcgattttggtttcagttcaattaaacgactgtgaacaaccctagtttttattaagttatttcattttcacaataatttacctaaaaaaattattttttataagataattcgctttcggataaccgccattttggaattttttttcaaaaatatgaccaaaattttctgaattgctcacttttcattagttttaaattacctaaaaaggcatattcccccccccccgacgcataacttttgcaaatcgtattgtaaacaaaaaattggaggaacaaaaaaaatctccaaattagcccagcccatctgattaaacgggcctgggcttccagccagatttggcttactcaaacgcgtctgcgagtttgaccgtgatcgatgtcgtccctgcctcgccttcccctttctttcacatgatcgatctcgtcttggcggcatgtgtccttcaggtgattctggctgaatttctcgtgccgctactcttctgccattttcgatgtcttctccttgctgattttcgggagaacaatctttacaatatttcccgatagcccaaatagccaaaatgcaaaaaaagccgccaacaattagcacgccaactgtgcttcccactgatcgcttcttccggcgtctttgtcgttgggtttctgtatgaaaattgaatgaatgcaaaaactattcaccatctaaaagtttttaaaaacgaataaaacttcgttgaatttttgttttttaatcgttttaaaatataaattaaaaattccagttgataattaaaattagggaaaaatcactaaaaccagtaatctgtcatgacggggaccaaaaatgccgtaatttatctgaattatatgtatgacgatttgaaacgctcacaaactttttgcatttttttaggttcgccaatccgtcgactccgtctgttgtgaaactcattatcagcttaagtatgcgcttgtttcgttgttgatgttcgcgtttttcatgagcaaaaaacaaattatttttgaataaaaacacaattttaatgttaacaaaaaagaattacaattttgctccccattttccctaaatttgtgccaaaatttggtcaactcttcgagcatgcttttctgatcaatttgttgtccatctgccggtggcataatttcatttgttgagatttgcaaacgatttgccgtaccaattgcaatttctttaatcaaacttattaaattttgaatttttgcattttggtccaaagaatctaaataaataaataaataaattatttttttaaatacaccttcattaattgaagcacttaattcgttgactgatttgtgcaattttcttattaaatcagccataggtttgtcgagttggtcaatccatttcaaaatttcaaatttatccattagagttggcttcaccgaagaatctgatttttttattattagatatacaaaaaatttaactttttaccattttttccttttttatcaaactttgtcaacgtgatctttccaatcccatcgcccccccccccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttttaaaaatttattcatctccctttttgatagaaaaagcatcagagtgcctaaactaacatgtaaataaaatttggtgcgttaaaggaccctttctgaaaaaatatttaagaattaatttgcaaa

SEQ ID NO: 14453 - DNA, 3315 bp, Heterodera glycines
gtttcgttaatttgtatttcgttggtgtttttattttataagttcagtcagtgtagtgcttttcgccacttgtttctttttcgtgttggctttgtcgtcggagtaattgattaggagtcgctctgtccacttaattatttaaattagtgatgggtttgctgtagggtttattatgactttttaattatgtttggctttttatggtgtcctttttcggttttttgattgggtttggtgatccgtgtgtgtgtgtgtgtgtgttttttttttttaaattgggtttgtcaacccttgattttgtatgggcttggtgacccttatacttccggatgacgagcagttgcgcaacggtgaatttgacgttttgacgtggcaatcaggtgcagaccggacaggcagcacagtaagacgaatgggcacagcaggacaaacgggcagagcggcaggcacggcaggacaaatgggcacagcggagtggacaggcacaacagggcgaacgagcacagcgggacgcacggcaggacaaatgggcacagcgggaaaggcacggtcccgggtcgtggcaccaattcttgtcgtggcgacaagaaatttgcgtcgaactctgcggggtgaaggggacgggaaggggatgaaatgggcgaggcgcgcagagtagccggtcgggggaacgtagggggtcgggaccgatcggagagcgatgagtcgtgccggttttcgtccaggcaaatagaccaagttgggcacaattttaataagagtatgtttattgtgtcgacctcaaacttgggtaattaaaccgtcccaatcgggacggtgaaggaaacgaaaaatgggggacaaacatgataatgtgaacggggaaaaagggcacaaaaacggtgacagtaaataaatcacaaatggaaaaatgtggtaaaatcaaaaggggtcagaacggcgaaacggcgatgggaaaaggaagggcattcgggcaacggctggtccaaaaggggccacacaatggcaaaggaaagggagggcactcgagcaggcgcggacagggagggcactcgcacagacagagagcagcgaaggccgggtgcagtgaaaggcggtgggcgggtgccgggaaacttcggagggaaccgtttgtctcgaatctgaaatttccggaaaagtccacccctttaaatacgatttttttgcaccaaagtacgctacaatttctcattttaattaaaatatgtttttgtgtgttatccgtttggatttgccattttcccattaattgtttgcttttccgttttccctttacaattccaatttctttaatatattaattattaataatttgtttacgaacaatccttaacagaattcgcaatttaatattaattaattttcgttcctttcattcctgaggaaatgcacttttccttttcaaacaattttccgttattcatttcaaaaggttttttcatttttatgtaattatattttcgatagttttttataatattatttttccaaaataaatgtaaaaatattttttattatttatgttttatttttccccattttattttctattgttttttatttttcctcttttttattttgggttttatcttaggatttcgcgttgtcgcgacactcccgcgcgaaagaggaaggcaacgacacataattctatatagaataggtagtagacatggaattaggaaaatcataatgagtatgaatatgataataataaatatattgaaaaaattggctttaataagggaatagataaaatttaatatatcagttacttggtcaaatgaaattccaatagtggggttttcattagtattgttagtgggaatgatttttgtatcttgttggtgtatgtattccagattagctttcaaaataatttcagtcttaccatcgggacatataacttcacaattttctgtaatatttttcttattatatgcgagttggatttgttgttcttttccttctttatcacaattcactcggaccttttgacttggacattccacattggctaatgcggtaccaaaatttgttttgcatgatagagtccaattagcaccactagtacaggaataacatccttccaatgatattgtaacaatattacaaatatttttatcataaatagctttaaccttatgtcctttaagtgtgacttgcatttgaagagaagttgtttgttgtattttagctttaatttgggaatcgaagtatacgtaacttccctgtgttttaatgggtaaaaggttctcttgcctagcaaatatttcggtaagtggacttttttcacattcacaatgtacaacggaatcacctccgtggcattgacatgcttctggtggaaaagtgcaactaaaactttgcgcttctttgtttttacaccgtaatatatttttgagtaaattttcgttcgcaactattgctgcttttaattcttcgcgaactataataaatgtcgaaccaaataacggcgtcggtggaattgaagtcgaagtcagtgtgacagatatagaactattaatcgaatttttccttcaatattttcttgaatatttattgagcatccaaacaaacatagtttaaaaaaaattaattataattttttttagaaaaaaattataaactttattagccaaacaaattcggcaagccatacggtaggaaaccggtgctgttgatatacgcggtaagggtatcctatggtctgtctatatactgtaatgttccgaaaggatcccgtcaaacccaataggttttttgtaaacctattcacgtcccgattttgccgttaaaaaaacgctagaaaatttcctcattgtgcgtggggtagaggtgtgcgtgactgaaaaaacccgtgaatcgtgcccgtgaaatgacccctgaatagtgacggtagcccaaaaacctgggaaattcacggttttcgtgaccgggaccgttatggcggtgaatttttttgctttttacgccgtcttttttgcggtatactttttccaaaaaaaaaattctaaaagggattacggtggcgccgattgacgcgatgcacgaaaaatttataaaatttgagtgcattttgtgcacatattttgtccaaaattgaccaaattttctgaattggagccattttttaatgaattaataaattttgggagccaggcggtgccgatcggcgccgccggcgaaaaattgaaaatttgaatgctatttgttaacgagattttgtccgtaaattttaaatcggcaaattttgcaattttaaaacccatttttgaccctgccaggccatgc

SEQ ID NO: 14454 - DNA, 2534 bp, Heterodera glycines
aatcagcacgtaaaagtgggttgctaagctgaatttgcttaaatatcgtaacttcgcttatttttcccagttgggtgcctaccacactttggacctcgagctgaaccgcgtctttaccctggagaagccgtgttgggacgccatggacttgcacaggttggaactgtgctcggatatcgcaaacaaagccgatgtggctggcattgtacgcattttgctttgtgtgcttcactttctgattagcatttaatgcacaaatattttacatctcatttccgttttgaaattttacggggagaggggcaataatcaatttttttttttaattattattgacattccgtcgtgacttttcccgaaaaatgttttaggtaatgcatgaaggccttgcgaatgtttgtctgatcggttcttcaatgaccgtggtgaagtccaaaattgacatgcaggttggtcggaacgggatttatttaattgtctttttagtaattaaaaattgtttgtttttttcagatcgctcgcaaacggaagggactgacctcgcaacatgacaaaagtttggtcgcctttatgaatgcaatttgtgccgcatttgttcggcacgtgaacatcgaagtgacttccccccatttctttttcactgccaaaatctctcgccgattttcagctgatcaaatgcgttgttgtcgctagtccgggattccttcgcgatcagttcatcgagtttttctggcagtacatcgaacgcgaagggctaaagcagcagttcgccccgcacagaggtaaatttgtgctcgtccattcgtcaagcggcttcaaacacgcgctaaaagaagcactttcggacgccactgtcagccaacggcttagcgatacgaaggcactgatttttggaaaaaatggcattttccaatgttaggtcattttaggcacaggccgaagttaaggcattgaacacgttcatggagctgatgtgcaccgacccacagaaggccatctacgggtacagacacgtggtgcacgcacgcgaacaacagtccatcgacactttgatggtgtccgactcgttgttcaggcaggcgaatgaatttggcatggaaataattggcagaaacatttaaaggtccaaagaaattgcccagaggaggaaatatgtggaccttgtggagagcgtcaaggatcaggcgagaatgaagcttattggccaccgctttatatattttttctctcttttagggtgccaatgtgctaattttctcgagtatgcacgtgaccggagagcaactcacccaattggtgggttttattggcattaattgccataggcatccaacaaaaagacggacgaattgttttagactggtgtcgctgccattttacgatttcctatcgccgatttggacgacgaggagtgggaacaggagagcgaagtgccaaacgacgaggccgagagggaagagaacggacggacatgagaagaaagcggaggaaaaagggggaaaagcaccactcgagaattgtttttttcaaatttcattgttcccaaatgcctaaaatacataacaaattttatgtgttggttgaccatgaatatttttgtaattatggatgaagagcaattaaatgccttaataatttttttcgcaaatgactttaataatatattttcgttttccgaatggcgcgtcctttcattggctttgcgtttgatgccttcaaacggcgtttgggtgcccatgacttcccatttctccgtggtttcatccatggattcaattagtggggcttgcttaatttactgaattattccaaaatttatttaaatttttaattattttaaatgaatttaacacaatataatttcataatttttgttttcaagttatgatgcccaaagggtcaaagaaattggtgccgaaagggccgcggccgaatgggtcgtccgttgtgaggggaaagtgaagtgggaaatgccaaaatggccaattcaatgtttataatattttgctttctcagatttgaccattccccccacattttctccgattacaacgctttgcagcggttcacttccgaattggacccgaaaagagagtccgaccgcgtccatttggtggccgtcgatgccactgactcgtgcatgtgcgtacttttggcattggaacacaacattttcaaatgccatcatttcaattgtcttaagttcgggctggggctgtcgccatttcgatgggctcagtcgcctccaaaatgttcaatttgtgcgctgcaaatcgctgacagttggcacttttgcgtttgactaagccaaaaatgccccaaaggacaatggcctccaaatgctcgccgattcgtccgtctccgacactttgctaacacttcacatcgaaaagtgtccgaaagtgaccaattcaggcatcagacatttgcgcaaattgaagttgaattgggcaaatgttcctctaaaaacatttgctcctcttttagagtgctgaattcgctgactttgcaaaatttgaaaaatgtttggaagc

SEQ ID NO: 14455 - DNA, 1750 bp, Heterodera glycines
ttcttggtatcaaaagaaagcttatttgtcccgggaattcataaatccaagaaaagagcaaacactcgacaacaagaaaaaaaatacaacgagaaacactaaatttaacttatttttttgagtatattcaaaaattatttttggtctgttgcttcgagcccagaattttgatatactcaaaaattctatagacttagatagttttaatttaatattaaaaaagtaggtattgattgaccgagttagaattatggccaaagaaactgaagattgggctcataaaagtcgattggactcctaaattgaaaatggagtcttggttttatgaattcaaactactttttcctgtatttaaagcatttttttttcgttgttaaaggtccaactggaatgcctgctgttgattgtttgaatggatatcgcagttacattaatgatcgcaatgcagagttaattatgggagatccattgaacccaaacatggaaacggatttcgattttgctggaaatttggcgctttttgacaaggctgttagtaattacaatagtaataggatacttatgcagttttaagattaaagctaacctttaaaaaataattttaagtgcaattattacgctgtcattgcatgatttatgcggggacccaaacaaatttttcccgcccgcaggggtgcaccccaaaatttcgccgcggaaatttcgccggacggaatttcgccgggacataatttcgccaaaatttttttttaaaaaatttggaaattttcaagaaaaaattcttagaatttttttatatggaaattccaatgaaaaatttttgaaaaattttttagtgattttttggaaaatttttcgaaaaacttactaatttatcataaatttcaaaaaaaatccttaaaattttttctaatttttttttgaaattttcttataagaaattctatgattttttcttaaaaaatttctaagtctaattttttgattttatttttttgcggcgaaattttgtctcggcgaaattccgtccggcgaaatttcggcggcgtaatttcggcggcgaaattttgtcccgtcccccctgaaacacacctccccgtcccttggcaccgttccgcccgcagcagcactgtcagcccgttttggcacgcgcttcgcctcgtcgcctccctcgtcatcgtccgtgtcggaagggcatgcgcagtcggagcattcgaaacgcgagaatttgcttttggccggcattttggtcaacggcgggtccaaacagccgatgtggtagtggcacttgcacgtgtcacagtaggccaacagatgggcatcggttgtctgtttttgttggggggggggggtaatattagaagcagacatttttccttccgtcgtttccccaacgaaaaatttgaatttttttttcatttaatgtttaaaatttttcaaaaaaaagttgagaaaaccacaaaaatttttcttgaaattcttgttgaaaatttgaaggtttttgaaaaaagtctgtttaaaaatttccaggagggaaattaagtgcacccaatttacacaccgactcaaaaaaacgagacacgtgacaataaagagagagtgtagagaaaaaaacatctctcactttggcgtactgtttttttatctctgttaatagagcaaaagtgaatttacttttttctgttcaactttttttctgcctgttaaatccgcttcaaattttgcatatcgatagagaaaaaattctgca

SEQ ID NO: 14456 - DNA, 1646 bp, Heterodera glycines
ccacataactccaaaaatcccttttttaaaatctatgatttttagaaaattaaaaaatacaactttttcaattttttaaaatttcgaaaaaattgtttaaatgaaccctatgcggcggtggaaaaaacttgttcttttggtttatgaagaacaataattattttgtttggaagatttattatttttcaaatattttctgacggttcaaattattgcatacaatcactctcaatcatttatttaaaactatttaagatcgctaacaataagattgagaaatgtaagtttgaacccgattttagacataggcgcaaatgcaaggtaaccggaaaaaacggcgcaaaaaaggcataaaatttttaacaattcttaaattaatcaagcaaattgattttttaaaattcatcaatcaggggctgccctttgttttgacttggagtggatatcgctgcccgaggcaaccatttttttctgctttttcagttttttgcgacgtttttttataaaaaaaattttgggaaggaggggcccgggggaaaaatgaaaatttgtgaatttttgaaaccctccctgcctgatgaatgtctttgagaaggccggcgccaaatttgaaggcaaatgggcggccgggacggcgctgaactcctccgcaaactgtgccccgtcgaggccgagcagttcatgcttttccgcaaatgcatcgagaaggcgcgcgttggtgtgcaacagtttggcacggcgttgctaaaaaattgacgaaattctgatgaaacaaagctattaaaacgttaaaaaatgcaaaaatttgaaattttcattaaaaattttcatgaaaaaaattattttatgtaacttggattaattgagcaagaattaggtagcttattgttttttcaaacttttcaaaaaagtcttaaaaatttcaagaaaaaaaataataaaattttcagcgattttttggaaatttttttttgaaaacttattatttcgtcataaaattaagtctctattaaaaaaaaaattcttgaggacgaactgctcccctccaacccaccgcgggcggcacaacaaccgctggcaccgcagcggcggtgctgctgctggccatcgaagtcgtcacgtcaccgtctccgccgtggcactcgtccaccgccggcactggcagcagcagcagcaagcgttgcatgcgctgctgatagtcgcgcagctgggccacccgcttacgcgcctggcgcgcgtccaacgcgacggacacgcggcggttccactgggccatccgacgctcttccgcctccacaaagttggcataactgttgttgggaggaggggaaaatttcaaaattgcccaaaatttttggattttcaaaaaaaataaaaaaattaaatgctatcctataaatttagaatttttttaattataaaaaagctttttttggattaattggtcgattttgttccaaaaatttaccccttcaaccactttctccgataaagagaaatcgctggaagattttcccattttttgtttgaaatattgcaattaataaacttacgcaattcgcatgcgcgacacggacgcgtccctgggcgcgtgcttctcgcagtacaaatagccaacatcggccggcgaatgattgtgctgctgc

SEQ ID NO: 14457 - DNA, 3592 bp, Heterodera glycines
cttggacctttattatttttgatttatattaacgatcttcctgatgctttgccatcaggagtaagaattaaattatatgctgatgatgttaaattgtatatttgttataaagcaagaaccgaaacagaaattatgcataaagcattgcataatttatcagaatgggaaaataaatggcagatcagaatctcaattaaaaaaacttttgtattcatttggggaataaaaaccccaaagaaatatataaaattgatggaaatataataaatgttgtggatacaattagggatttaggcataaatattgataataaattgcaattttccaatcatgtcacacaagtaataaagaatgcatatttacgtatgcgttctttatttcgggttattaaatcaaaatcttctaggatttggattattttgtacaaaacttatgttagaccgttattggaatatgctcctgaggtttggaatccatctcttctaaaaaatatttaaaaaattgaaaaatgtcaaaaatatttcaccaaaagagttcttttcaaatgcagccttccacccattccataccaacaaagattagaataccttcaactgccaacacttgaaagcaggccgaaagctttctgatctgttcatggctcataaaataatttatggccgaacagatctgaatccctttgaaatacttaaaccttctaaacgctttaacattcccttttatagacttaactcgaaagataaattaggcaaaaaaattataccttttgcggggcgggtaacaaaaatttggaaccaactcgataaaaagcttattgaaataaactcattaaatcaatttaaaaataaaattaaaactttcatttctgtaagattgaccggaaaaataaaagtcgaattctcaatgtaagcggatttttcccttttgtggactttttctttattgacaaataaacaaatcaaaaagggctgtatttcaggggaggggatttaattcagtaaatacggtaataaaaaagacaaaaaaatgttgttaaagggataggatggcatggcttatgacttttactctttcctttctttgcctttgagtaagaacaacaactgatcaatactcgtgatcagtctctcttcccctttccccctcccctccatctctctgtctttctctctctctcccccctctctttctctcctccctccgctgtttcacctgtctgtccgagtcctccatccaattgactgagaaaaggtcgcccaggcaagtgtactctaagccgacgattggtgtgtcacagtaacaaccccaactcgactcgaaagcattcgaagcagtgacggcgaacactgagatcggcgacagaaaggaaggggaaaagtcaatgggcaaaaggggggggggaaggaaaaggagggtaattagagggtaattaaggggtgatcagaaaaatcatttattgttggtattgatgaggaagaaccgtttatttgctgtgcaattttctggtcgaacatcgatcccgactcgcaggcctccaaataaaatgtcatttggccatacattcgtttcgcgtgcattttttgcaaagtttgcgttaattcctttacggttaactgttggaagagaaagttacgatattaaaaagggaagaaagttacgatattttcagtgtaatcgccgccgtagggaaaagcgaccaaaccaaaagcgccgtgatcagagaagaaaacgaacactttgtcattgctggtgctaaatgaggaacaaataagcaatcaatcagtgggatggaattagaaaggacgaaaaccccaccaaaaagacaagcaaaattagccaaaagtaaaaataccatttttaaaaacaatttataaaattgcattttataaaaacgattgattttaaattacaataacaaaaaaaaataatattttccaaattttaaaaactcattgtaaaaggggagatgattggggagatttcaaatcaacatttttgcctgaaagaagctgaaagttggtcgattttttcttaaaagtacaaaaactaattaacttaccaaaaaagtaggaaaaagtcaaataaaatcatattagaaacttcaaataaaatgtaaaatattttttaatcattttaaggctctttgtgtcaccagaaaaaagagtcatttgaaagcaatcagttttgaccaaaactaattcaacaattagtcggactatcatttagctaattgccctttgatttatcgaaaatcagtccgactatctttactgatcatttcaaatccatcaatgttttgtgtacccgccttttcagcactctcttcccctccaccgcttcttcgtttccgagaagaatggccttgaaattcgccggtgtcacttcgtcgcctctgtagtcaattcgaacgcctaaataaattaagacgagaataagcaaagtttaagcaattcatcagaagcattgccttcgtacacatctttcattgtcggattgttgaagagtttgccggggtaagggtttctgaactcattagcacagctaattagggtaattttgcgaattggccgtgccttttgttgtgcgcaatgtcgtcgtaaatcatcgtaattattctgtccgggctcactccgtggtcgactaacacatgccacgcatggcaaacatccgcctgcaattagcagcaattaattggttaattaatggcgtgtctttagtgttaggcttttgctttgcctggtgcctgtaattccaccatccgttggaccccgcgaccaaaacggcccaaatgttttggtcagcggcgccttcctcgtccgattcggcccttttaatttaaattatcatttttatttaattaaattaaatttataaaaatactttgtccgagaatggaaaagaaatacaataacaacaaaaagaatttgcttattttttagcatttctttttttgtttccttaatttttacattttattttagtttaaaatttatattacatattagcaaagaaaatcaaattaaaagataatggaatacgttaattaatttgtgattgtattccgcggttttcttaccaaaaatggcgactgatttcttctcctgaaactgataaaatttaataagcgaaaaaaaggaaaaaagaagaattagttgaatgaaattgcaattaaatcggcaaaagataaaatgggaggaaaaataatgggaagaatttagaaaagaaaatcaaatcatcaattaatttgctgaaaaaaaacaaaacaaaatgatcaggccctttaaaaagatgtgatttcaattttgtttttgcatatttaaacgcctttttagacattttaaatttttaaattttaattgccaaattaattttgcttcaaatcattttcaatttatgtaaattcaaatggaaaggaatcacttcgcttgcgcactcgggatgacctcatttcgggaggtgctaattgtgtctgcggggattttgtggtgtgtcactccgttttcattcttcgccgccctttcgctcgccgttctcatgacaaatgacaaaatgacagtcattcgcccccccccccctcactttgtgccgatca

SEQ ID NO: 14458 - DNA, 1477 bp, Heterodera glycines
  misc_feature (1456)..(1456): n is a, c, g, or t
actaaaaacatttgtgcgagaacacttcggtaaagcggacgattttcttgagaggtaaaagaaggagtgaattgttttaaaaagttcagaatttatttatttatttattcaatattattttaagcccacaaccgatcgattggaaggaaaatccaccgaaattgcaaaacattgcggacccagaattgaagacttttgcaaatcaactgcatgatctttggaaggaattgggcaaaaaaatgccagaatcggtaaaagggaagaaaggggaaatgaatgtttagcaatttcaggcgaaagaaaataagtcgacgctgatttatgttccgaacccttttgtggtgccgggaggccgtttccgcgagttttattattgggacgcttatttgatcgtgcggggactgctcgcttcaggtcaattggggggagtgaattagggagtgattgggagggaatgccaaagacaaagtgatcggagaaaggcagtaaaatgatcggaaaactgatcagagagaagagaggggatgagtgagtgtcttttgaattcaaaattcacaggaatgaccgaatcggtgaagcacatgtgtgacaattatgccgagatggtcaagaagtttggctttgtgcccaacggcggtcgcatttactacaacaaacgttcgcagccgccctttctcactttgtccgttcgtttctcataattttgggaagtgcctttagtttttgtaagacgatgctttttgccaattatcagaatatttgataatttttaataatgttttatttcctctatcagcatggtcaacgattattttgcggagaccggcgacacggaatacctcaagagcattctgccggttcttgaaaaggtccgttggaggggcaaaacgaaggcccattaaaattacaaaggcatcgaaagagataaagtcatttgctgatttgtgttcttttctgttggccttgggttgtcttcttcactttctttcccttctcatccatttttgataggaactccaattttggcgcacaaaacgatcggttaaagttaatgcgaaagggaaggagaggactttctatcagtacagagcggaaagcaacgtaaaagtggcagggcaattggaagaggcaacacttttaaggtgccccgtcccgagtccttctgccaagatgtcgacttggtcagggacatcccggacatggcggaaaagaagagaatttggaatgaactcgcttccgctgctgagtcgggatgggatttcagctgtgagaaggaaaagggaaggcggaaaagccgaagacaaattcagcgcgatggatcgagaaggacgaaagtactaataacgagacgttacagtggaaactgaccagactaatgatcaccaaaattgtgccggtggaccttaacgcgttgatttgtggcaatttggaaatgctttccaattagtaccaccanaatcggtgagtgtccgcagaa

SEQ ID NO: 14459 - DNA, 957 bp, Heterodera glycines
  misc_feature (940)..(940): n is a, c, g, or t
attttatttacatatttcgcgctttttcttacataaacaatgaagccctgctaatgagtgggcataaatgcagcaattgcagataaaattttgtcaattggataagctccttggcgtttgcaatctgatttttttaaattttggtgcggcctcgtaacaggaaaataccgaatatttttattaaaatatttatttggccaaaatttttatgaatttataatatttgtatcacaatgatcacttgagtaggtaatagggtcgaggagcctttttctttggatatattgtgatttaaagttatattatatcctacccaaacaattgatcactgtaataacattttacaaattcatataaattctgtgattggagcttgattaagtattcaaataaaattaattaatatatatttctttttattattaaataatgatgtggctattgattaaaaatattatggaattttggttaacaaatttaattcatttcctattggcgattaataaaaggaagcaaaaaggtattcttcatatgtatttttattttttcattagatggtaaacaacggaagtttcattagtctgatgcaacgccaaaaatttccattaccttataaatttcagtataaatttgaggagcaaatttgaaaatattcattaaaggtttgataaaattttattgaattttatcctttgaaataaaatgaattttcctttatttattattatttttatttttaccttcacaaaaagtgctaaaagtgatgaaaatggtaaaaacaatgcattaaattaaaacaattattatttttattaaattatatttagttttcatattttaatttgcaaatttaacatttaaggcaacgcaatacaaaattatgtggaagacgcatttaaaacactggcgaagttatagttagctaatatgcattgattgngctttacacgcatgatt

SEQ ID NO: 14460 - DNA, 3241 bp, Heterodera glycines
aatattatttcttcgttcggtttcgaatttgtaattttgcctaatttagtaatcacattgctcaatttgcccccgtttcgcttcttccgtctccctttccaagagaagcgtttgagaaagcaattgctgttcaggaggtcaacgaataaaaatgcataacaaccgtcaattttataaaatatttaatttaattagattaattaattaattgattaattaattttataattaaatgattaattaattttctttccaggccatgcaattgctttacttccgcgtcggctgcgatttcgactttttgttcgaagcgtacaaagacgtggtgaaaacagacaaacaaataaaacagatggtgcacattttgcgagaagtgcaaaagcagggcataaaacagccgcagacattgctgataatgagatcggcaagcaaattaattattgttgattaattaattattagctaatttgggatgaaaatggtcaattaaatataatagcaatttcattttttgtttttgtataggattatatgctgaacaaagtggggagcaacacagagaatggaaatgatcactacgagattaaacaggcaaaaaatattgagttaaaattaaaaaaaaattaaatttgaaatttattttcggatcgaagcgaacaccggcgccatcggcggattgggaaatgatcggcggacaagcgaattgcaccagagactgttaaaacgcattggcatggacccgacaaatgcaccacaaaatgagggcgacgcacatctgatcaactcactgtttatggcatggtaaagggggcgaaacagctgaaaatgctcggaaaggatttaaaaattattatttgtaatggcacattttcaggaaattgtataaatcgggaaattttttgaaatttaaggaaggcttttgacaattgcgacgctcttttggtcattttgacgcatgtcaaattctcctacaaatacgaactgcgcaaaattgaagatgaattggaccgattgtctggtggacaattgcgtgttgcttacgtttcgctgaatgacggatattatgagtaaaagcatttaaatattagtaaattaatattttcaaaggtttatttggtaatagtaccgatggtagtccgtcccgtccgtccccctttttcggaaaatgaaattttagaatttttttttcgagaaaagaccgtataagggggtttaagggtcgaagaatccgaatctgacagaaatttcgacctatatctaaccccgaacccggattcgaacaaaagtcgaattcaaattttaaaatttctctttgttcctttaaaaatggtttaaatgatctttttttaaaggaatgttgacttttagtttgtctcccttccaaatccaacattgttggtatcattcgaaagcttaatctatttagaagtttttccaagatattgcgttgcgattagacaattgttaaaaaaagttatacatgaaaactgcgaaaaagtcgaaatttttgaagttttttcttaataatttttttccaggctttaaaatcttttcgctttttgtaaggctaatagagcctgatgagcttccgaatgataccaagattgtcggatttgttcgacaaagaaaaaaatcctagtggaaaaacatgctggggccctaacatgccggctcaaccgtgccgaccaactgagctactccgctccctatatgtcagccattttaagatcaaaaatgaaaattcgaaaattttcattttcgactttttgttaaaacccggcttcggggttcgaaataggtcgaaaattatgtcagattcggattctccgacccttaaaaccccttagacggtcttttctcgcgaaaaaaattcattttctgaaaaagggggacttacccccttcggtactattaccgtttattttacacatttactcactttcactatgaccgaattaaagacaaaatttttagttttaaattggccgctgattcttcgcttttgttaaatggcaaagttgttggcgttgtgtattccttgatttccgcacttggctataaagcaaatgaagaagcaatggaagcacggaaaatgattgaattgtcgacagcaattgtaaaaataaataaataaaataaatcaattaaaataaaatggaaaaactcagtgaatttttatagtctcactgacaacaacaaacttaatctaaacaatgtcatttgaaagtgctcaatttgctttaatttttagaaggcgccgtcgttggcaattgcaattagcagttcgaagaaaatccaacaggtgacagcaataaaagtccattaaaataacaattaatttaattgttcagcttctcgcctcgcctggcggtgttgagagatttttccccgaccccgcagaagcggacaaagtgaaggcaatccgcgaaattttcaccggcttatggggcctcgaagggcatgacgagaaaaccgaacggatcattgcggtagaggtgaacggcaataaacaataattaattaattgtttaggatgccatcgaaaatccgtcaaattacgtgctgaagccaaacggcgaatgcggcggaaataattactacgacgaccaattggttgaaaaactgcgcacaatgaccaacaatcaggaagaacgagctgctcacattttgatgcaaaagttacacccaatgatcacaaaggtgagagacacaaaacggtggtgtactgtaagagtgaatcgttgaaaatctaatacggtaccggaaaactgaagtacagttgctattctttttgaatgttttgttgaaatttagaactattttcttcgtccaaccattttgccacggttgggcgtcgttgtcagcgaattgggcgtgtacggtactctgatgggaaatatgctcgaccgtaccgtatcgtacaatgcgcagagtgggcatttgctgcgtacaaaattggccggggtaagtgcaaatggcaaaatcgtcaataaaaatccagtttttatttttatttatttttctgaatttgtcacatttttccccgcaggccaacgagggtggcatcagtgttggcaccgccgtgggcgactccccctaccttttttaggccgatggactccgaattgataaagtggcattcccttcgttttagtcattatttccttttctttcggttcttgtccgatgatttgtacaacaatgcctattaatttatttttgaaaaatcttataataaaaa

SEQ ID NO: 14461 - DNA, 873 bp, Heterodera glycines
ctagcttttttctctcgctctcttccaccacccccactctatcatttggccaatttttgtttatttattttttttattttaatctttagtccttcttttcccattgctgccagctgccgttgtgttcttgcgtcagccgcgcacgattctcacgaggacgcaaaaaaaaaaattcgctcattttctcctctttttgaactgtaacactctctgccctgtctgactgtctcgcttcctcaactatttcacaaaattcgtctctctactatcattcccgaacgcattcataacacacattttgttgtctgctgccagctgcgtgcgtcttccagtctttttggccattacatgcgctgaattttgtgccagccgcgcacgcttcccatcacgttcatttgttcctcttttttctctatctctctctccctctccggttttccatcgtcgtccggttgccgttaatttcttgccgctgctgctgccagccgcgcacgcttcccccaccggcgcggcgccgttggcccgtcccccttttcatgctctcgagattttgacgacgtaactccgttcttcatgcgctttctgttgtgtgtctgtcttgcatgcactcgcaactcttgtctctgtttcttttcccctccactgtacatgtttcaattttcctccatttctccgtgctcctacataaaaaaaaaatatctcctttttttttttgcgctcccctctggggattcattttggtccccattctcgttttgtgttctgtgtctgtgctctctaacaattaccttctttctcgactctctctcttttctctctatctctctctcttctctcgcacttctttctctactctctctctcttctctctct

SEQ ID NO: 14462 - DNA, 2228 bp, Heterodera glycines
  misc_feature (2211)..(2211): n is a, c, g, or t
tcgagttctctgaccgactggtgatcgaaactttattcatatatctgtgattattactgtgattgccaaaatgatcagctcttttctaaaacactgattctgacaccattttcttatccaaacggatcattgtgaccagtgataaaatttgattaggatcaaatgacccaaaaatagattatccttaaaggtgtatcaaacgacataaaaacataactccgatcactctgttaactgatcagcagtcagacatctagctgcacataactaccaaatgctttcaccatccgccatttccaaccatcgaatgctggcaacaacggtgatgatgatgacgccgttcggttcgccacaaacaccaatggcatttgagccggctggcagcaattgtgccaatgttgtcgccaccaacatggcacaaccgccgccttcgaggcgctcaaaaaagtcacggcttgactactccaacagtctgtgtgccatttgcaacgcgccagcagatggttggcggaatatttaaatttggcattcatttggcatcgttaactcaagggcatactgtatatatttgatgagtaacataccgtagttgttgattaatattgacataccatattttgagccgcgttaattgatttggcataatgtcaccaaattaaaggtcttcattatggcgcaatctcatgcagaagttgtaatgccttttttcggcgttctgtcacctacaaacaggcaataacattcagttttgatctaattaagtaattaattgcccctaattaattactttttaattaacatcaatttattttgtcagcattttgtttgccgcaagggtggcaattgtgatgttgacgtgagtgtgcgctgtgcctgcagggcgtgccgtttggcaaagtgcaaattggccggcatgcgcgacactggtgtggcatttgaaattattaaaaagggaaaaaaataaaataaagcaaataaaaatagacatttgaattgatcaattttgtatattcatatatgctaagaaaatcaattaattttttatttattcattcatttcttttcatttttatattattttttaaatattaaaaattaaatttaattcaaaaagttttatgtaatattttagaaaattgaaaaaaaatatacgaaatgaacttaaaaattgtcaataaattctcaaaaaagggaattatccgaacaattatcaaaaattatattataaatttattttcaattttttcccacttaattaaggcaaagggatttttaattaactaattaagtatctttttttaaacgatgtactacatttttacatgaataaaatagatgtacaaccgaagcgggatccgaccggcagtcaaaagaatcgtcgcgcaccccaacggcgccggcataccgatgtgctgaatggcatcattgagggccgcgttttgaagacggagatgatgccgtcaagcgtcgccactgactgtaagtttaatgattactactgtaatcgactatgtgtgagttgacactatatgtcaataaaatattatttttaactgagtgaattggtactgtaaataatgagttactttgtattggtgggtttactgtcattagtgtatttggaactactgtcatcagctgatgagcattataacgattacagtaaattgattaacggttttgttggttttgctttttattcgatacctattaaattgactgctttaatttaagtcgagattaactgtgaattgtttggttacttttttattgattactgtaattggctttaattatgataaacttcacttaactttcacatataacagtttctccgaacacgttgctgccctccgtggaaagctcaatggaaaagcattacacaatgccagaaggtaaaatttaaaatttgttaattaaaatatttaaaaaaaaattattgaaatttcagtgaatgcatgccatcagcaacaaactttgctatcctgctgcccgccctcaacggcacaacaaaatttatgccagttgaaaaaccaggagcagcacagtgattccaggtaaaatttggaccaaatgctgattaatttgaacaagaatttgcaaaataatttaattatttatatcaaaaatttatttaaaacacattaaacaaagtatttaataattatcgaaaatttatataaaatacctaaaagttattttaaacaaaantttaataaaaaagaaat

SEQ ID NO: 14463 - DNA, 2258 bp, Heterodera glycines
tttatataaaataaaaaaaaattattttaaacaaaattaataaaaaagaaattagattttttggtcggtggcagatattcagcgctattgttagacctttaataattgtaaatcctttttcattgatgatttaaaaaaatccggcaattttcaatacaaaagccaattacttttaattggtcacataatttagagcggataatgcggcaatccaatttataaaaagtatcaagcgcgaaacaatggatgacgagaacgatggagacgacgtggaggtggaggtggagcaggacgacacggcggagcggctgtgccatgatgccatggaacagccgacgacaagccatggtcctcaacggcacattgtggcatcaaatgttggcaatgcgcaacaacggcatcagttggcacggcaacaacaattaagcaacacggaggaggccgaacagcgcgaatttgacgagtaagtgttgaaaggtggtcaaataattggtcatgggtatggtattgggtgttttttacttggtgaatacggtacagactgttcggaataggccatttttatataattatcatgataaattgcttaaatagagcccctccatatgatggttgtatgattccgtattttcctttttttgagcaaaaatattttttgggcttatgtgcctaatttaaagaatagctaaatttgtcttaattattagtagagaccgcaaaaaaaggcaccaaaaatcgcgaaaaaggcactataataggcaccaaaaattgaaaaaacggcatgaaaaggcacgaaaatcccgaaaaaggcatttaaaaaaattttttctaaggtttttttagggagcaaaacacgtaaaacttaaccaaaaacttaatttggtcatttaaatgattattaaatattttataatgtttttcgaataaggaaaatttttaaacctaaaattttttatcaagaaaaaaaaatgaaattttttgagaaaatttttcaattcttaggggtgtattttctgaaatttttcaattcttagggatgtattttctgaaaatttttcaagtcatttcttaggggtgttgttcccgattttattccattttttaatggaatttacggaaataacgccaaaaaaggcatcaaaatcggaaaaaaacgccaagaaaggcaccaaaacggcaaaatgccaaaaaaggcatttaaggcacgaaaatcccgaaaaaggcaaaaaaaaaggcataataaaagtcaacgtagaagccctcaaaccaagtggaaaatgcgttatttatgcttaatatatcgaaactagtacgcagaaaaaaaaggcatatgcctcaaaatgcggtttctaattattcgatctttaaaatatgttgggcgtgtgaaccgttttagaaagaatatacgaaagaaaaattgttagaaaatctcaaaaaattaatttaaataataaaaatttaaaccaatcttgttgcttctccttttatatgcatgtagttgtttatcatatgtttaaaattttccggaatttcttaggaaatttttttttttggcggtggcgggggattaccttatttagaatttttgaaaactcgaaatgtcaaaacaataatttgcaaaaattgccgaatcgtttcccatatattttgcccaagcatttttcaatttttaaatgtttcaattttgtttttagcctagtacggagctatcaagaacatatgattttgatgcacagggcaatgacaccaattgaagcattttggtgtgcccaatacggcgaagtgggcaaatttatcacattggcacaaattggcatgccgtaatttagtgccaaaaatggagaccaatggaacccacggatgtggacttgttgagtaaagtcgaattggtatgggtaaatttggcaaaaaaaaagttttaattttagctattatttttttttcgaattattttatgcgaattttagcggcggattgttcgataattgaaatatttattttttttttaataagaattattatattaattttttatttccaaaataataataaaagagaaattttgaatatttataaacataataaataagaaaaaattatcttaaatatttaaatgtttaaaattatttaaataaatttctccataaattactcagggtggtctgatgtattggatagacaagctgaggccgttccctgatctaccagcaaatgctcgaaaggtactgttcaagcggtactccgttcgaaagctagcg

SEQ ID NO: 14464 - DNA, 1691 bp, Heterodera glycines
gtaaagcgaatgattagaggacttggggacgaaatgtccttaacctattctcaaactctaaatgggtatgaagccagggttgcttgactctgaacccagtcgttgaatgtttgagctccaagtgggccatttttggtaagcagaactggcgatgtgggatgaaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatggatggcgctggagcggacctcctatactccaccgtcattggcttgtgcacgtgcttgtcgcgtagtctggccatgacgtgtaggagggtcgtggtggttgcgtcgaaggctttacaccccgaccaaacaaaaatttctgagcaatttgaaattgtcaaaaagttcaacagaatgaaaaacaaaaatccatttctaagtgataggaaaatcatgcaaaaattgggaataaaaggtgccaatttgagaggatggaagaaaagttcgatcaaatgaaccaaaaatagataagcagagagcgagagagagagatggagagagagagagagagagagaaagagagagaaggaaaagaagacagacaaaagggaaatacaatgggaacatttctttttgtcgcgtcctttattctagcccataataaatttcttatttaatttaagaatattctctcattttgccgttttttttatccctggtccttctgtattcggacgatgaaatctttcgccttttactaaaggtttccgtgcaggtggacgcttatgggttaaacccaatttttggacagcgctttctccagggagggcgcgaaaatttattagaaaaatcaataattatcttttcctcacccggcataagcagccaacaaatgccaaatggcatgcaaatacggcgtgccaagctgaagccacaggtcgcaaatcattttgtcggccagccaacagctcactgccattatccatgcgaacaaaatgcgtttagtcaattggggagcctcggaaatgccaccttttctgagtagaaatagcaaaactatttcacacaatttcaaaataaacttttgccaaacaaaccgagtgccctcgtggtaaatgaaaatggcacaaggcaatgaagaagctatcaaaacgaatgcattcactgccggttcaatgaaaccgagaacggacaccgaaacggacaaaagaatgacggccaaacgaaagtgaggcctaagggggaaaagaatggtcaattagtgggaaaaaatcaataatttaattattttaaactcatcgctggagcgctcaggaattgttgtgcttttctgccaagactaaaagtttatttgtaattaagcagaatcctcaattcggattatttgccttttctcgccacatttcaagaggataattgtcgaatcgaccgacccaaggtagccgtagaataagcactgatttaaatcattaatttagacatacaaaaatgtttcagcagatagtataattccttactagaccagaatttttcgagataagttaggattctaaactttttcgatcgatatttttcaaaaaaataacaaaaaaaaattaaatatcgaaaaactgaaaata

SEQ ID NO: 14465 - DNA, 963 bp, Heterodera glycines
cccccccccccccccccgggggcggggccaggttttttgggtccccccccccccccggactttgactcccgcaacccccgccccccggcccttcccccccgggggggcgcgggggtgaaaaacccacccctaagaatggcatattcgtgggaataaggcaaaaaacgtagacaattttgattttttttaaccattttgacaaattttttatgaattaaagttaattttattattgttcattgatgtgtagtgttgtagtggttagtgaatcaacattgacattactttctgtcgtgagttctattcacgttgacgttttcttttttaattttaaaattcgcctggcgctgcctatcggcatcgcagggcccaaaaattcacaaatcttattaaaaaaattctctaaaaattgcaaaaacttataattttttggacaaaatctattaacagatccatcagttttcaaaaaattttcccggcggcgcctatcggcaccgccgtccccccaaaaccctattttttttaaaaaattagccaaaaacccttaaatttggttatttttaatgcaaaaatgaattagattgaggcgatatattataaaggaatgtggagcccaaacacaccattcataaaaattaattttttgtgggttttttttgctgctaattcaaagcaaacccccgccccgtccccgggggcgagtcatttcctcacacccgaacccgtgactctgttccacgctaaccccaccccgcaaaaagtcacccccgcccacggagctcgaaccctagttattactttgaaaaaaaataacgaaaagcattcaaaccaggagggcgtccaaaaattgtatgcgaaaggcgtacaaaaatcgtacgcccctgcacggagcacgggaaatggaaaaggcagaaagaacaggcaaatggaagaggatatttttgatgggttggaaaaggagag

SEQ ID NO: 14466 - DNA, 2888 bp, Heterodera glycines
tttttatcgtttatttgaaaatggcattttcacttaacaatttaattttaaaacctaaccttccattttttcttttccctcacaaatttttttacgccgctcaatgaattatgtacggacaacagagatcaaaaccaattcgccgtaatcgtatcgactaattcattcattatacaattaaataaattgtgaattgtattttttaacgttagaaattttggtggattttctacgtgttataagttttaaaaagtgaataagtaagttattatggatgagagaatttttacgtacaaaaaatttattttatgaaatataaggaaaaaatttaaaaaaaaagaggagacttttttgctatttaatgaactttttctgcaaagtttttttttcaaaatttacaattagcacgatacaaaaagtaattattatgcgtaagacattacttaaatatatttaaaattttgaattaaaaaatattttcagaaaaacatcttgcccaaaaaattaaaaacaaaaaatttgacatttttaagatattttcaaaaattaaaacaaataccaaaaatggctaaatttggtactaaaaaaatttggcccagcgaattttttaggaatatcaaaaatacggttttttgcattttgttctgattttgaaaatttctgctttgaactatgtatgagctataaacttctcactttttgttatttttgagtttattttattttggctttttgagaaatttccttaaaatggaaataaagtaaaatttacccttaacaaataagagacttgaacaaaagtcttttgaataaaaagagcattttaatttaaatttaggttaatttgaatactttcaaataaaaatctaaaatttttaataaaaataattttatattttcacgaaaagcatacattgaggcaccaaattgattgaaatgcaatccatcttttttaaacgtgtcataattcttttcttaatttcctttctaataaacaacatttatatacattctttaggtttaattaaataatttattattatataattttatttattcagttatgaattactcaatttttgtgtctgtaatttttgctgggctaattattgttggtttggatggcaccgatgagaatggtaaaatggagaaaaataatggcaaaaaaataatcaaattcctcgaggatttccaagaaaatgacgcaaaagatgagaatgatttgcagattgactttaacagtgaacattctcgcgaagtgacacaaatgaacaatcgaaattttatcagtgcgaagcaaatttttaaatttttgtttttatttaaatttttttcagcctttcttcgcggaagctcttctaaggcatctgataccccgaagcctccttcttcggcatcggttttattgccaaaagtgcgaaagtttttagaaggaggcacaccaacaatgccatactatcaaatgccatttttgcagcaaaaggtatggcccgccaagggcaaagtcaataaaagatttttcaccaaaagagtggaattttttaaaatagggcaaacactggcaaatcgaccggggaattttgttacatttattataataaaaaataatttaaaatgaagggaataaatacattcaaatttatttgtatgacaaaatttttattccgttttcgcgcgagtgcctgttttagcattagaattgttcagaagtatatgtatagtatattcaggttgaccaagtttttttttcttctaattcaggataaagaacactaaaattcagattttttgcaaaacaagggggtgagcggccaattttccaatttgccatgggtccggccatgtaaatctatgatcttttttttgctttcaacaccgcttattacgcggcgcgttttttccaaattacaagaatcctattcttaccagtgcaaatttttaccggcggtaccggtactagacaaacaggtaccggcacatttacttttgaaaaaaccggtaccggtacatttacttttgaaaaaaccggtacatttacttttgaaaaaaccggtaccggtacatttacttttgaaaaaaccggtaccggcacatttacttttgaaaaaaccggtaccggtacatttacttttgaaaaaaccggtacatttacttttgaaaaaaccggtaccggtacatttacttttgaaaaaaccggtaccggtacatttacttttgaaaaaaccggtaccggtacatttacttttgaaaaaaccggtacatttacttttgaaaaaaccggtaccggtacatttacttttgaaaaaaccggtaccggtacatttacttttgaaaaaaccggtaccggtacatttacttttgaaaaaaccggtaccggtacatttacttttgaaaaaaccggtacatttacttttgaaaaaaccggtaccggtacatttacttttgaaaaaaccggtaccggtacatttacttttgaaaaaaccggtaccggcacatttacttttgaaaaaaccggtaccggtacatttacttttgaaaaaaccggtaccggtacatttacttttgaaaaaaccggtaccggtacatttacttttgaaaaaaccggtaccggtacatttacttttgaaaaaaccggtacatttacttttgaaaaaaccggtaccggtacatttacttttgaaaaaaccggtaccggtacatttacttttgaaaaaaccggtaccggcacatttacttttgaaaaaaccggtaccggtacatttacttttgaaaaaaccggtacatttactttttgaaaaaaccggtaccggtacatttacttttgaaaaaaccggtacgggacatttacttttgaaaaaccggtaccggaacatttacttttgaaaaaa

SEQ ID NO: 14467 - DNA, 2000 bp, Heterodera glycines
aaaccggtaccggtacatgtactttgaaaaaaccggtaccggtacatttacttttgaaaaaaccggtacatttacttttgaaaaaaccggtaccggtacatttacttttgaaaaaaccggtaccggtacatttacttttgaaaaaaccggtaccggtacatttacttttgaaaaaaccggtaccggtacatttacttttgaaaaaaccggtacatttacttttgaaaaaaccggtaccggtacatttacttttgaaaaaaccggtaccggtacatttacttttgaaaaaaccggtaccggcacatttacttttgaaaaaaccggtaccggtacatttacttttgaaaaaaccggtaccggtacatttacttttgaaaaaaccggtaccggtacatttacttttgaaaaaaccggtaccggtacatttacttttgaaaaaaccggtacatttacttttgaaaaaaccggtaccggtacatttacttttgaaaaaaccggtaccggtacatttacttttgaaaaaaccggtaccggcacatttacttttgaaaaaaccggtaccggtacatttacttttgaaaaaaccggtacatttacttttgaaaaaaccggtaccggtacatttacttttgaaaaaaccggtaccggtacatttacttttgaaaaaaccggtaccggtacatttacttttgaaaaaaccggtaccggtaccaataaaaccagtaataccggccggtaccggtaccagtaccgctctaccctatcgaaaatattaaaaaatttcttttatcagttgttttttttcgctaaaaataataaatttttgcttaattccatttttcttttaaaatgattcttatatttagctgtttcttacttttacttcacaattagcgaatctgaagaaattttgagaacttataccttatgcttggaaaatatatctcccatattttagtcactttatttccatataattatttacacggtgttaggtcgaagtccgaaaagtgcaagtgtgggcgtagtccaaattgggcaaataattaagtttagcttaaaaataatatttataaaatgtttttttatttttatgttttaaaacatttggatacacttttgagctttttaacctagaaatttatttttaaatgaagttacatatttgttaatacgtaaatatgttttaatgtacagtcattgtcatatctttacgacacccccattttattccgtaaatttgtcaaatgacggtcaatattaacaatcttgatatcaaaaaatgccttaattaaaagcgcagttgacttatttgcgcattttttggaagaattcagttaaaccgttaaaccggtttaaaaagtaggcactttctttttaggtagtaaaacacataaaacttatttaattttgtttaagtatttcatttttaaatgaaattattaaaattttatatttttgaataaggaaaatttttaaaccaaaattttttcaaaaaaaaaatatatttatattaatcattttttggaaataccatccctattgattaattaaaatcattaatttatctttagatattttttaaattaaatttaatttcttgccctattcggatttcgcccacacttgcactatacggacttcgcctaataattaggtcactttgttgaatcaatcagattcccatgaattggcaaaaaatggtcgtacctatcaaccttgatatgcagcaacaacaaaagacgaacacagctgaagcagcaaaaagcattgcttcatcagtttcaacagttggggcaatcgcaattccgaccaaaaatgaatcccgaaagaaaaggcccccaattggtcggtaattgttggcattaccacaatggcttgttcagggaaattagatttatcatttttgggattaaactaaggccgcattccaatttaagcatcagccgataaaaattgggggggacgaaaacacactgtcgaaaaaggggaaagctcaa

SEQ ID NO: 14468 - DNA, 3667 bp, Heterodera glycines
  misc_feature (29)..(29): n is a, c, g, or t
taaatagccttcgaaaatggaaaaacaantttggagacaatatttaattcaaaggtaaaattaaaaataaaaaaaaaattaattgaaagatgaagtttgctgcctttgaaatttttcaaaaactgaaaacatttcatttagcacttttaattgaagaaacagtttgtatgagaagaaatgaatttgaaaatatcaaagttgcttgaagaatgaaattttgattttttttttgaaaagcattaggcttttcttaaaacccgaataaaaatttgtaatttttggcataatattcagtttgttcattattatttatattattatttcctttaatatttatgtgatggttaaagcttaaatggattttttattgaaataacaattttctccgttccccgagaatttaaacccccgattgttcggggaggaaatcaattttgaataataataaatttcgaagcgttaatttttgtttgtaattttgaaaattttttcgatcataaaatgtcctgactggttttttacactgctttggtaatcaatccattaagatgtaattttgtttacatctataaaataaaatattttttcgttacaaaattatgccactttttttcctacaattaattttttttattaaaagtttttgccaattaacaaatgaataggtggtacaccaagggaaattattataaagaatgattttttgatgttttctttatttataaattattcattaacaaatataaattattattcttatttaaaggaggcccttattttgttgtgataatgttttaaaaatagctttgttttcgtccattttaatcaccgtttcactacaaactttcaattaacaaattccgatcacttttaattaaattttttaagttttatatactgttgtgtatttacaacaaataaaaatttttgtggacggtgaatttgcaaacaaatttattggagaaaaacagcagaaaaattggtcggaggaaataacctaacgagtcggggtcgttttggcgccgacgttttggcgctgacgttttggcgcccatgttttggcgccaaggtcgggtttttaaattttgtctatgtttgaataatatgaaaatatatattctttggttttctgggtcgctaatcacgaatatggtattcattttgacaactgcgaagcccgcactcgatttcgaacaaaaagggtttttgaacatatagatcagggattgtatcagttttgttttatcagaactgttttaatttggagggtccaaatcttggggtagtgaccaaattttgttctaatttcttaaatataccgtcaaggttatgtttataatcacaaacttttttgaaattttaactagtattcatcaattttaccaaaaaaaaatttatggggtttggaatttttttttgaaaattagagtaagcccattggaaggtaaaattttttcaatttttttttgtaaaatttttgatcaaaaaatttacccttttaaggtatatggcttggcgccaaaacgtgggcgccaaaatgaccctttcccacacctaacatatccattgtttttcacttcccaaattagttgagataatgtctcaaaagtagcttttctttttcatccattttaatcaccgtgttttcactgaccaattaattaccaattaacaaattccgatcacttttaattatttaatttccatcatttttcacttcccattgatcacttccgctttgatttttgctgcaattcgtcgcctcacttcgtccacttcactgttttgttccatcaattcacgtgctgcttttgctgtctgaggacgcgaatcgtttatttgtttagcggcctccttaaataattttgtttaataataaatcaaaataatgattattttttaaaataattttaaagatttattatactaaaagcgaaaatagaatatatataaataacatttttttaaaccaattaagtaattaatagtttattatagagtatacaaaaggaacatttaaattattatttaatttttaatttattttaattttttaaaatttgtttaatttttaattctataaaaaataattaaataatttttactaataattgtttttcgcgctcttgactttttttcttcaacaatttgtccctctgttcccgtaaatattgccttcgatcacttaattggctctcagaaatgccatcacgctcctttagtagactctgttgaaaatataaatatttaatccgataaattattatataaaatactatagaaaattcttacacggtatgcaaaatcgccgcccttttggctgtaaaaaaaaattaaatttacttatgacattttctctatttcatagaaattttttgaaatttattatttgcaaatttacagtttcgttcttcatttcttttctttgttgaggaacgtggatttggcccaaagagatccgcttttccaccagcttaggcggctttggattttcctcattaatcgatggcttttcctccatttttatgtaatttgcattttcattgagcaaatccgccgcacttttccgccgtttttcaaccgagtttggcacaattttcaattgtgccagacttgttgctgttggccttgtgccactcgtgattggtgaagggctaatgatgaaatttgctttttcgtcaaatttcacagatttttcggcattctctaatttttgtgctgatgtgcctggtaatttttctgcttcttcgttgctcaattttaacctactgaatgaatgagcactctaaaaaagaaataaataaatcaaatcttttttaataacgaaataattaatttttttttgctaattgaaaaattcattatttcataaaaattaaaaattattttaaaatattattttgaagatattaaataataatttgtgaaaataagctatcaagttcacaaatttcaaaaaaaaattttgttgggtttttccctgtttatattaaaaatatctttttttaaattaaaaaaaactataaaaaactaagaaaagttataataaagcctttttcctttagagtttttttaataatgataataaatcaatcggttgcttcaagaagaaactcaaaaaaagtttcctttttgacaaattgcatacaaaaaaaaaaccctcaaatttttatacattattttaaatttcatttattatttaaataaataattatttttttaaatttatactttattcagtgcttgttccatcaaaaattgttctctcctacgcatttgttccagtgccgatttgtccattagactttcgcgaattgccgcctccatttgtgaaagcatttctttttgcatgcgctgatcacgttcccattcatcacgactttgtcttaattttaatttatttttattatttaaatatataaaagtttttgtaattttttttttaaattttttattacttgcgaaaaatgtatagaatgttttggttaatgaatgaggtatcaagctgggatctaatcataatcatgaaaaaatacactatttatattaacataggtgaattaatttccaagaaaatttaggaaaataaggctgtattcctcccagaaaaaaacaaaataaaaatgggaggaaaaaactggcacttttcgaaaaataggaaacaatt

SEQ ID NO: 14469 - DNA, 2549 bp, Heterodera glycines
cattcattaaatataattagagtcgatcaaaaaaaaacctctgtgactgataaattaaataattcaattcacaaaataacgatgccgtccagttaactctaatgtacgtcgggacgcaattcatttttaattttttgcatcacttctcgccaattttctccatatgtagtagacactgccggacgccattgatatcgttttgtagagctcatcgagctgtacaaataagccgctgataccggcacgctcagcttgggttggccatcgaccgggtcggcggcgaggctgagtgtcctccggcagatgtgcccgacccatgacgggttacaagtgagttgatcaaaaaccggacccggcctgggagatagcccttgaaaaactgaaaaaaaattgttcttaaccgggccggttcggattccgcatcaggcactttttgtgccccgaaagtggtgcgatcggcttccggaaaatgaccaatcaatcacaaacacaagaactgacagaatattagaagaaagaaaaaaaaattcttttaaattagcaaaaattaaaatgtgcataatatttaatagaaaataaaattgtttctcctgagatatcaatttaatatgaatttttattgcctgaaaatactaaatgatttttaaacttttaaaaatatttcaaaatctaacatcattttatatataatatttttttaataataagagaaatcactaaaaaataaatttattatcaaactaaaataagccactgattatatgatttggttcatagattccaatcatgaagtcattaaatatatgtttcgatttgatttaaaattaaaaaatttaatatgaattggttgtgcgcctgagataagaaaaatacacaaaatatttttagtcgatcaaatttaatctgtgttgagtttaaagagaaaaaatattatacaaaataaataatatttaaaggaataataaaaagtgaataaattaaatgacaaatttcaaacttttactgattaccttctgcatttatgtgaaatttacttacccactccacaaattcgaaaaaaatttcgcaaaatgaaataccagaactatattaaaaagatttctaaactaagagcaatccttttccatcaaattaaaacttataagcacttaaaaaaaaaagattattgttttctttgtaagaaggcaaaatttttaatcagaaaattccatgaacttaatacgaggaatagtgtcttccgcacctagactttttaaatttgttcgaaacaattccaaatttcaaccaaaatccctaccttaaaatataacgataaatttgaaacttcgtcgcaagaaaaatgtaaagtcgatgataacaaaattatttaacgcaaagattttaaataaatgattttaaaaaatttgattaaaaaaattcacaaaatttatttattttttaaacaaaaatgatttttaatgtttatttaaaaaatcaaaaggaatattaaaaattatcttttaataaaaagaactaattgtccgaaaaactatatcgcgggataaaaaaatagaataattattagtaaggatgaaatttttaagttttaaaaactgtcaaaataagcacgtcttcggcctaaaaaactccaaaaataaagaaaaaattcttcttctttttttctaaggtgtatattttttgtttttattgcatttttttaacaaattgctctctaattttcaaatttttcccctcagcgcctatcggcaccgccagaccccttaactcaacaattgtagtaaaaaatgatgtgccaaaaatagttctgatcataagtaagtaattttaaaataaaatttaaataaatctatttctcatttttgataaaataaaagtggattttattttagttttttttttgttttctaaaattacagaaaaattgttttattttactataattttttcacttggaaaaattatattaatttttatttcacttctttgaatatatagtaattaccaaatagttttgaaattatatttttgtttatacatctctacaacatttatctttataaatttttaaaaaaattatgctaaagactaaaatcattataaaaattgtcaccttattgcaacgataattaaagaaatgatttctaattaaggatctaaaaagaaataataaaaaattaataaaattataaataaaaggtttcaaaatgaaaaaatgatcaccataaaaaaaacaattttgaactttattaattattgttaataataaataataaatgaccaaattaaaaatgagaaaaactttaattaaataaattcaaaatatttttttgttattaatacttttttctttaagttcatttctttgaatattatagtaattatttaaaaatttgaattttatttatcttaaagaaaataataaaaaatcataatgttgaaaaaatataaaataaaacaaaatcaaaattggaaaaataaattatctaaaatttacattaaaaacaatagtaattttttaacaattatgctatataataaaaaatatatta

SEQ ID NO: 14470 - DNA, 2944 bp, Heterodera glycines
accataactttgttcactgtcaatcaaattaagaattgttggtgttgttcgatagctctatgtgtttattattaatttgctaaatctcaaaaattttggttaagtttcaaaaaagttatggccagaaggaactcaaaaacccagtaattcgaacttttttgctctgatttttttgtgcataaataaaaatttttgaaaatttgcaggctaatagcatttttcgaatgctttcgaataataccaagaatgtttaatttgattgagaaagaaaaaaagttatggtcgaaaaattcgttcgacgacgtttcggctgacgacgttttgtcctactccgatttttggcgcctgattatgagtttgttaatctaatgatatgtaaagaaaacataaaaaattttaattaataaccacaaaatttagctaaaaactaaaaaattataaatataagtaaaaatagaaaaatcaaaattgaagagctctcaggcagcacagaaagcaacagtaaaaataaattataaaaaaattatgtgataaatattgaatttataaataattaattttttaaattttccaaattatataaaacatttcttatttaaataaagaataattttaataaatttcgaaaatatgaattaactgtttgctgttcataataatatttgtttaaaaaataatatcatttaaatttagcattagaaaaaacatttaattgtataccataaatatctctcgaataaaaaatattagggccttaattaaaccgcaatataaattacaaataataattaattaagacaaaaataggtgataaatatgaaattataaaatattttaatataatttcaagacaaaatataaatatatctttagaatctaacaaaattctaatatatataaataattaaatatttttaaaaaatttgaaaaatttgaaacttaataatgttttaataattataaaagactttaaaaatttgaaaatttaaaaaaatttaaattttattaaaaataaaaatagtgatgctttacaaaaattataaatgaatgttttttaaaaatattaaataataagatattattaaataaatctaatggcttaatgatataaaaaatattatattataataaatatttttagttagaaataaaattatcaagtcaaatatatttgcaattaattatttttaatgcattgaaaaaacttttatatgcatattttaaacaagagaataaatgaaataaatttacattcataaatcatttcatataattgtactatttaataaaaagtcgaaaaagcaagacaaataaaatcaagacagaggcggcgtgagattaaagagcaaaaagagataatagacaataaataaactttttttacaattaataaaagaaaagaaaaaatgtaaaaataacaatgcaattcataataaatcaaaaaatcacataaaaatgaaaaatcaacaaacaaaagtaatcaattcaaaattaaaataattttatcttacataagtaatgtccgtttatgtatcagggatcagagatgttaggaaacgtttaaaagaatatttttactgagaaaaattctcatttttttgaaatatttttatgtcttttaatacgaaaaaagttttgatctgaacttgtattttatttgggatcagaataaactaagatttttccaataaaaaaactaaaatttattatttattaaattgaaattaaataaaaatcattggagcagatttattttttttattttttgcaaaatttaccgtattcgtatgatcttttttttattttttaaagtttttaattgttattttgttcgtcatttttttggtactgaagtgccgattttcactaggacgtcccaaagtttaaaatggaaatttcccagtgatatcgtattaaatttatataattttattataaaattttataaattctaaattattattttgctttaaaatttcatgtttaatgattgtgctatttacatattcttatttgaaagtattatataaaattttcttttaaataatatttttcataaataatttatgaatgatttaaaatatttcaaagatttaatgcgaaaaatttaatatcaccataaatataaaatatttttaataaatgtcggtgtcgctgacagaattgttaattttcatctttggttatcataaatttttgttaaaattcttctttctctctctaggcttaaattcaaaaattctttttctcttttcttttcctataatctgatttattttgggcgagttaaaaatttaaataatttatattcaaaaaataaattttattttattatttttttataattttcttaagtgcattctgaataaaaaaaatattgttctctatccaatggctattccaaacgacacgaacaagaataaaaatgacaaaaattaaaatataatttaaaaaaatataaaaggaaaaaaatggaaaatattaaaagaaaattttttatagaaaaaaagttagttgaattatacttaaccccccagaaaaaaatgatacaaatgatataccaatcaatcgttaagaggagctaagtttggaaaataaatctccagttgcggaaatgggtttcaacctatgtttaaaccagttcgaaactcaaaaattgaagtccttaggcattctaacgttttaatgatcgaattcggacaaatttttttttctaagttatatttttgattttatataaaattcatttttttatcctttttttggtgctatcattttctttttaatgtctttttactcattctgacacgctttatttaattgaatttaatttaattataaatttatcaatttaacttttttaaattattaattaaaatttttttcgaaaagaacaaaatttgaaaccaaaaatttttattaagaaaaaaatattaaattttgt

SEQ ID NO: 14471 - DNA, 2206 bp, Heterodera glycines
  misc_feature (33)..(33): n is a, c, g, or t
aatggatttttcccccgccccattttattactncgatagctcctccttcccgggcgctgggaagtcagctaagagatcagtcgagtcagtcgggagccatttaagagacttggccaatcgatctccgcctgggagacgtccccaggcatctatcataatcccctcccttccaagccctgacaaatgaggggcctaattacggacgcgtaagaaggtctcctggaattaaattcccttattggcactgggtagtgggacctcacggctttattatatggtcatagatttcccaaaatccaggacaatttttttttaaattttgagaaaataaaaatacatttagttcgttacaaaagcaacagaaaaattatctaaaagttaagaaaaaagcgttttggtaaagagaaaaatattgaacatattggtattgatttttaggtaaattaggacaaaaattattcgagtttcaaaaacctaagtttaaaaaaaaaatgaatttttaaagctgcatttgcatttttacgaatatgcagaaaatggatttgaaatgaataaggatataaaatgcttgaaatatggaaaaaaagttgaaatgagaatagatcatataaggctttctttatccaagccaaaatctcaatttacatgctaataaaacattttgcgaaaaaaaggaaatccacccaaatcccaatagcaatgataaacttacttaaaagttctgtgttcaaagtgggttttcttttaactgtttcttgcgccgcttttggcacggcatcatcttctcgctcagaatcgctgtcttcgctcgttttggaccccgtaaaacagccggcaaatgtgtcggacacaaaaaacagaatgcaataaagtgtgaataacttcattacatccaaatattgaaatctaaaatttatgcttaaaaaatatatttaataaataaaaatatattttatagatatgactttgaatttcattttaatttgtattagatttttttaaattaaaaaaatataaatatgaatttattttttattttctgaataaatgaatacttaaaaaaaagaatttattattttttttttcattattttatgaaaatgaataaatttgtgattctgtcgaacagtgaaaaagtaataatatcatattgaatttattaatgttataagcagcaaatttgatgtaaacaacaaacaaaactagacaacaattaaatatatttgcaatattaaatataaattatacattttattattactatttttctgcttctatgaatttgccaatgcgaaaattcatacaattaaattttgtatttggttatatcgactaattactattattattaaaaataataaatattatacgcttacgtaagcaaaattttatgaaaaatataaaaataaaatatttcattgagaatataaaattgttttaaaatatttggttggaaaatgtaaattataaacagaattaatttatataaaatagagttgagcgggaccgggacccgaatacggacaactgagtacaactgagtactgaagtcccggttttgaccgggaccgggactagtcccggttttttcccggttttcccagcaaaaaattcccggtttttcaacccgaaaaggtcccggtcccggttaagcccaaaattcacggtcccgctcaactctaatattaaatattggaaagaactaaatataaggaaaaaaaggatttgaaaaaaaaaatttaattttataaagtttttgctattttttgagaaaaagaaagctttgtttatttttaaatgatttattttttagaaatatttttttcaataatcatttaattttctaaaattattttcaaaatcgaaaaaactaccaattataaaatgaaatggtgatttttttttactcgtctcgactctcgagacgtcaatttcctcaggtgtcgattctacgtatcggtctcgagtttggcatctgtttttagcgtgccataataaatgggaataataatgtaaagcaaaatgatcgtagatgataaaacacattagttgaaaaatgagcaaaaattgtctcaattattatagaaaaatttaagccattttttaatcactagggctaggatttttatgttttaacatattttttttgcggcttagttatggcgaaagaagcccaaaaatagcattttctccgaaccaattttgg

SEQ ID NO: 14472 - DNA, 1220 bp, Heterodera glycines
  misc_feature (60)..(60): n is a, c, g, or t
gataaagaatgagatttttgggaatttttatgcaaaaacacacttattttttcaattttnaacacatattttagcacatattttggcatttttgggggtttttagcacatatttcagcattttttagcacatattttattacatatttcaggatttttagcacataaaaatcctagccctattaatcaccatttcctaagtgaaaccagcagcagtttccaaatatgtaaaaacaatttgtcataatatgagcgccaaaaaacaattcataattttttttgaacatttctattttttccaaatgcgggttcaaacggagatgcaaattctattttttaaaattataaaaagcgaatttttttgcagaaataagttttgtaacattttgtcaaaaaaattaaaaacaaaatacaaaaagagttattcataataaattttatattttaaacaaagatccgacccatttttatttttacaatgtcttttttttataaaagcactttgctttacctctcgcaataatctccatcgctttcattgtataaaattttggggcattgattttcatttaataaaaattatcattttataataaaaatattttaaaaatagattttaaatttctcttttcatctttatggaatttgcttttctcttcgtatttcgctgaaaaacttcaacagttttggcctcccaaaaatgcatttgttcccaattttgtcccccattttttcgctgctttttgctggcattgtgcccgtcccaattggtggtagtggcggtagcatttttgcaatctgcaaaaagagtgacgtagaccgaaagaatccgatgccaaaagtgaaagcatttgatacgccagcgacaacaccttcaccgccaactgatcgcacatcgaccgaccgcaaaacgcagggttcttaacaatttaaatttaatttaaaatgaataatgattagagctcgcattttgaggcatatgcctttttttctgctcactagtttcgacatattaagcataaaaaaacgcatttccactttgtttgagtcttctacgttgactttttttatgcctttttttgccttttttggcattttgccgttttggtgccttttttttttgacgttttttgcgaaaaagtccattaaaaatgcaataaaattggtaaaatacaccccaaagaaatgacctgaaaatctttttagaaaatataaataaga

SEQ ID NO: 14473 - DNA, 2143 bp, Heterodera glycines
cgattggaataaatggcaaaaaaagcaaagtcaaaacgcaaaaccttaaagcactagccgattgaaataaatggaaaaaaaagcaaagtcaaagacaaaaccttaaagcactagccgattgaaataaatggacaaaaaagcaaagtcaaagacaaaaccttaaagcactagccgattgaaataaatggaaaaaaagcaaagtcaaagacaaaaccttaaagcactagccgaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaaacacaaaaccttaaagcactagccgattgaaataaatggacaaaaaagcaaagtcaaagacaaaaccttaaagcactagccgattgaaataaatggacaaaaaagcaaagtcaaagacaaaaccttaaagcactagccgaagcaaagtcaaagacaaaaccttaaagcactagccgattgaaataaatggaaaaaaaagcaaagtcaaaacacaaaaccttaaagcactagccgattgaaataaatggacaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaaacacaaaaccttaaagcactagccgattgaaataaatggaaaaaaaagcaaagtcaaagacaaaaccttaaagcactagccgattgaaataaatggacaaaaaagcaaagtcaaagacaaaaccttaaagcactagccgattgaaataaatggaaaaaaagcaaagtcaaagacaaaaccttaaagcactagccgaagcaaagtcaaagacaaaaccttaaagcactagccgattgaaataaatggaaaaaaaagcaaagtcaaagacaaaaccttaaagcactagccgaagcaaagtcaaagacaaaaccttaaagcactagccgattgaaataaatggaaaaaaaagcaaagtcaaaacacaaaaccttaaagcactagccgattgaaataaatggacaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaaacacaaaaccttaaagcactagccgattgaaataaatggaaaaaaaagcaaagtcaaagacaaaaccttaaagcactagccgattgaaataaatggacaaaaaagcaaagtcaaagacaaaaccttaaagcactagccgattgaaataaatggaaaaaaagcaaagtcaaagacaaaaccttaaagcactagccgaagcaaagtcaaagacaaaaccttaaagcactagccgattgaaataaatggaaaaaaaagcaaagtcaaagacaaaaccttaaagcactagccgaagcaaagtcaaagacaaaaccttaaagcactagccgattgaaataaatggaaaaaaaagcaaagtcaaaacacaaaaccttaaagcactagccgat

SEQ ID NO: 14474 - DNA, 4411 bp, Heterodera glycines
  misc_feature (70)..(70): n is a, c, g, or t
  misc_feature (75)..(75): n is a, c, g, or t
  misc_feature (84)..(84): n is a, c, g, or t
  misc_feature (95)..(95): n is a, c, g, or t
ccatgagcttacaaattatcgctacgttgttgctaatgagagacgattcattatctctcttctgccacgncatgnccacgggtntaagccattanaataaataaataatattcaattatttattattctatcctcggaattaaataattacataaaatttttgaaaattgattcagaaagcggccattcgcgagcacttcactgagggcgttttgaatgaacttgaaatgcgcttcaatgttggcctgactttccatccgttgccgcttcatattgtaagcataatgaattgattttgtgggtcaattcttatgatgaatccattaaatttggcacaaattatccttaaacaagtttttatttaatttttatttttttgccttttgataatgtttttgtgggtttatttcttttaattaaatattttaaaaccaaacagccatgggacgtttgtatggtgacatttttcgccacttatgatgcctgggacgggttcatgagtgaaatcagcgacgtgctaaatgaagtaagctaacgtatcaaacaaattaaatgcaattttcaaatgcccataaaaacctataataaaaaatagctgtttatttttatttaaaattaatccattgatttttttagtgattcattaaaacatattttcttgcacttttcaaattatagctttatgcgcctagtccaccgccgccggctgattccccttctgaaatggagtaagaatgatcgacagaaatgctcttcgtcttacctttttctggtgccattcgtcaagtgcctctcattcatccgcctctcttttttgccacctttttcctccaattttctcgtcccaaatctcatttggtccggcattttttctaccgttttctttgtgcattacgtccatctctcacatcatccataacttacgaaaaagctcacttttctattttttgcttaacttatacattttccaacaatatattcgtggaagcgtttaaaaaagatttgcgtatataaaattttcaatttgaaattttgttctacaacttagaaaatttatttattctaaaacaacagccaaaaatcggaattctgaccccaaaaatgccgtaatcggaattccgtgccacccccgctgttgatactgtcgatggttggctggcccttttaagaaattcattattgaggtaaagttattattaattgatttgtctttcacctattcttacaaaccaaattgggactctgaaaattttttttttatatagacaaattaaatatttttgcttaaaaaggtaaaaacgtcataaaagtgcaaagaagtcaaataaaatgctatttgcaaagaacgcttttaacttattttacggtcatttgactcaaattccgatcgctagaaatggctgaatgggtattaggtatcatttaaaaccttcggatacaattatttggaaaaatttaggtcaataaataataaaacccattaaaaaagaaaatatttcttttttaaatttccaacatggcacaaaatatgctcattccgctcaagttgtctgatcaattgcgcgtaaatcccattgatcggctgtttttttgttgttaatcgatcactatcttctcaacaattttatggcatattttcaaaattttcatttaaaaaaatattttccccatttagaaccgactttgcgattcatttgatattttgtagaaaaattaatgaattcacgcataaaaaaagcaacaaaaatttcatgcaagaagcgactaaaaaagataaaggtatcgtttttcatgcacattattttaataggtataatacggttggctaatgtaccataatgacaaatgaaatccaaagggtgtgttttacagttaaaccaatttctatttatcgcaaaaaacagttgaacaaaaggttcaaaaatatgttttttttgatctttaaaataacaaattctgcttccatcgtttattcattcaattagtttttaattaaaattttatgtgtcgccattttaggtatatttattttgaaattttttatttagttttaaatgtttttcgaaatttccaaaatcccgcaatcccgcacggcgggatcccgcaatttattggaaaatttcatttgtgattatgatttttttttcttaaattaccaactaaagaaatttttataaaataaaattcacatctattttccattcttaatcgacaaataattaatgatattcctttttttctttccatcctttgtttcttctttaatttgatcagagctgctgctgtcttttcgagcttcccattctttgtgcctttgattatggtaaattttaaagaaatttaatgttttcatggaattaaaaattataaattttgaatagcgattcaaaaaaatatatataaagtgttcaaaaaatattataatcactagggaagcaacttttagtgaaaaaactttttttttgctcaattgttttgaagaaaggagctcaaaaaacgcatttctgcgttaaaattttttcatttggacgtcacttttcgtcactagaaatcactattttggcgacttcgtcactaaaatagttaaaaatcactattttggcgttttgtcactatttcgacattttttggaaaattccttaacaaaaatgcataaaaccaaaaaatacacccctaagaatcgacctaaaaaattttcaaaaaaatacacccctaagaatcgagcaaaatttttcaaaatatactcctatgaaatgaaaaaaaattttctcaaaaatttactttcttggcaaaaatttttaattttaaaaatttttttaggtaactattttgggttttttggtcttaaaaatcccagtcctactcatttgcaactgcaaatagtgaataaaaattatttttgctcaatttttggctgaaaattatgtcactattcgtcactattttggacttttttcactattttgtcactattttggcactttttcgtcactattttagttaactatttcgggatttttcgtcactaaaagttgctaccctaataatcactaacgactcaggatatttaaaaaagttctaaattatctcattcaatgaatgggaagttaatttttggcacttttacttgattgaacacgcacttgtcagtcgaaaaaaatacatcattaatcttcgtcatgtgttaatgactatcacgtaagttgaccacacagaatgttcatttggcatgtaattaattgctaattggttatgcttgttaatacggaaaatttttttcggtaattgaaaagtctaaacattttcctttcactagcgatccaaatatatatatatataaagtattcgaaaaatattataatcactaatgactcaggataaaaattacttttaaaaaagttctaaattgtctccttcaatgaatgggaagttaatttttggcacttttacttgattgaacacgcaataataatattttttttccatggatttatttcttatatatttagcatttttatacatattttatttacatttcgcgatttttcttacataaaaaagaaagccctgttaattagacatttgaataagaccgaatttatatgtattcaaatattttttttttgcaatttatttagccagaaaatatacatactattttagcttggttttaagcgtctaagactcgtttttacttccatattttacatttttgtccatattttccatccagattttagtattttcaaaataaatttgaaaaatacacccctaaaagcaaaaaacaaaaacaaaacaagaaatactctcttaagaccgaataatttgaaaaaatcaaaatttaaaaaaaattcacttttattttgttggaaaaattcgttttcctcaatatgaaggaaactttttttttttgcaaattaccataattattcgataattgcttagcttgtgtcacatcggataatgaattgcagtgactccgctaaatattcggaacttataaaagtgcgtcaaagcactgaaattgcttatgcattgttcagctgttcatttttcattttgtgcgcttttcccatgttcaaattggcccgagaacggcacactttgtacattctgatcagcaaggtgagcaacacaaacaacaaattttccgttttgagacagtttgtgccatgccatccacaggggtagagcgcggaaacagaaaatcccgcgattgcggatacaatttgccacgaatagagaaatgttagggctatcgaatgatatcaagaatgtttaagtagttgacactagacaaaatgaaccaattttttagagaaaatttaagaattttggtaagcgaaccgactggagaaaaattggaatttcgaaattctttggggaaaataatccaaatccataattctct

SEQ ID NO: 14475 - DNA, 2103 bp, Heterodera glycines
tttgtgttctttccaatgggcttactcaaaatttccgaaaaaatttcccaacctcctagggatttttttcgaaatttttcccgatttcaagccatttttggcttttcagatcaccatggaggagtgatttgatcaagttgctgtaaaagacttttttaatcagcataaaaagttagattagcaagtattttttcagaattttttggcgcacaaatattgattttattatgattgaataaagtgatcataaacatatgaccacctaaaatgggaggcatgttcgtctactcaaatgtgattttattattaatcattattccaaaaattaaattatatctttagaaagcccacaaaaaaatgctacaaaaaaatcgggcgccggcttttcgacagcaaaggaaatttcgacaggaaaggactttttaacagtaaaacaaaaaaacaaataatgtttattaaaataaattatattgcttgttatttttactaaatttcttttaaattaacataataatatatatatattgctaaacattattgctagggatacaatttttacattttacctagaaaaatttcagaaaaatacaccttagaatcggtcacaaaaattttaaaaatgcacacataagatgaataaaaattttctcaaaaattcatctccaaattttatttatttttttctttttgattattaatagagctcccatttgggagcatatgccttttttgctgcctattattgtgcttttttcgctatttttggtgccttttttggagctgtaattattaaaaattatttatctcaatactgttttggtttaattttattgttttggagaaaattttaaaattttgctttaaatttaaaatttaattacttttactgtcgaaaagtcccctcctgaaatttataatatttctgtcgaaatatcctttgctgtcgaaaagtccgggagacgtctaaatcaaggaaatagtgggtatattagggccaaacaaaacacacacgtctacgtcggttcgaatcgtacattgagcgtcattgaagcaaagtcacgaaaaatattaaaatataaaaaaaccatatgactcctcatcgctgttaaataaaattactgtaatttgcactgttttttaagtaaaaatgcaattttttacgacttaaaataaatggaaaaaaattaaaatggtcgaaaatgctaatttttataaataaaaacgattaaaaaataaagattttgcgagcgaggagcaaacaagccgcatgacttccgctatcacctggagcggatacaccgaaatttgaccattccgcccaatgtggagggcgttgaaatggaatcccgaccgggccatgtgataggaatttctgtcgctgaccagaacaatggtaaagaatttttaaattgacaatccggcgaaacaaaggaagtgaccataaccttaagccgacatttgggagagaaatgcacacatttcaatagttttgttgatttaaagccagacccgtatccagaaaaaaatatcggggagggcacgcgaagagctttttttttcaaaaaataatggttaaattcgggcccggcggtgccgataggcgccgccgggaaaaattttggaaaatttaatgcaatcttctgataagaaaatatgctaaattttcagaaaacaaaactttcccatttctttcagagtcgatttaagtaataaataagttgtccagtttatacagttgcagacatttttgtagcatttcctgtgctctattgttatgcaaaattttatcaaattagttcacaattatttcaaatattgggaccggaacaggaggaactgaccactttggaacggaaaaagtcgacaaaaaagtcttttacaccaaattgatcagatcacttcttaccctaaaatacactgaaaatcggggattcgaaaaatgcccaggggaatggtaaaattattctagagtaaatgagcaagcccaacacaaagtttttctaccgaatatcgaatgttttcataaatatctaatttggttgataatgagaaaaattgttagcaacggctccgaaccggtcggcgctgaattgggctgttccc

SEQ ID NO: 14476 - DNA, 1223 bp, Heterodera glycines
ggtaaaagtccgccgggcccccgggcccgtccggtctctaataaatatgttatggtattaatttaaagatttaaaaaaatagaattgatcactttaggctttaggacaaaaacagcttgccatactaaaacaaccctctgactataacgacctgactataatggccagattaaaccgtacccaaccggtcgaaatcacagcaccgtatatgcattttgcttattttttctgaacatttgctatgaaaaaagggctcaattttaaatactataaaattggaaaacacaccccaagattggtcgaaaaatacactccctaagcatcgcctcgtatcgacaccgccgaaaccaaattacattgaatatcggcacaaccggactctaacattcaattaaatttttaaatcatcataaaatcattgtgttggaatgagtcaactaattaataataatcattttatcaatttttaaatcatttttattccgtgtaataaatttttaattattaacaaagttaattgagatatttggaaatatcttaatagtttaaagaatccaaagggataatttcaaaaaacctgtgggtcgtcggtaataaaataaaaatccattgaataatggatgcttgaattcactgtacatacaatatactattaagcttaaattcgccgggttgtcatgaagaaaagatagtaaaattcttaaaattcttttatcactataaaggcattccgacggaagttatcgctaaggcaatacgccgacagaacattcaacagccaagcttcaccataatgggagattttgccatggacctcaatgcgagggtaacttttacacataaaaggacgggcgggccactactccccagccccacttcgcttgcaagggctctgctggttggacatttcgacaatgaccgttacaaataaaaaataccatttaaaaaataaatcttttggtttaaaatgaacagaatggaaagctttactttggcaaactgaaaattttttgccagagcatctggcgaaacgttgaaaaagtgctataaatgtcgatttaattttttctgtaaaaaaacaaacaaaaaatctcaaaattcatcaacagaaaattttatttttcgttaattggcgaaagtaaaaaatgaagaatgcctggcataattgaaggtacttttccgtgactccaggaaaatgcgtcagtgatgaaagtatttgaaat

SEQ ID NO: 14477 - DNA, 2637 bp, Heterodera glycines
  misc_feature (5)..(5): n is a, c, g, or t
  misc_feature (2497)..(2497): n is a, c, g, or t
  misc_feature (2530)..(2530): n is a, c, g, or t
  misc_feature (2583)..(2583): n is a, c, g, or t
ttttntcaatcaaaaaggtctgtctataggtctttaataaaattcacgtttcatcacagttaatacatattaggcgaaacaattgatcacaagtcatttgaaatgataacacagagacataacacattgataatggtgatcaaccaacaacagacaattatggtcgcttaaacagtaaccaggcgacataatactgtacatacagtgagatacaataatacaatctttacagttgggatcatatgtgggaatagggtcagttgaatgtgtcctcctccctcttcggcggttgtcttctgcatcctctcccatccatcggtcgtttgtcgtgtcatctcatcgcgtggttcttcgtccattcacgggcaattcggttgtactcctcgcggttgtcgcggtacatagtcgcaatgtcctgccgcagcgcactgttcggattcgggtcacagagaagcgaagagatggagagcagcactgaaatggagaggggataaggattaaaacggcatttccgaatttgaaaaatcccattttcacacgacaaaagatcgacacttttccaaaaagtccggttttggtggtcgttttgtcttgtcgatattttgtcggcgttttgtctgctatttcacctttcgaaatggtcaacgacggcgcccacatctgcttcagaatgtccaaacaaatgtcgcccctttctccaacgttcggatggtaaacgatcgtgtcgaatttcacagttggcggagtgaatgggtagtcgcgacggaaaacgatgtccaaatggaaggtgcctccttcgtacggcgactcgggcggtcctttgatggaggccttccaatggtacaagtctctgccgtcatccatcggtgccgcggtgtaacccgtcgtgaccagttcctgatgcagctccgccagttcctgcaaattggtcaaaacatttaaagcattggttgatcagagagttgtcatttgccacctttttgatgcgtcgacgtgccattgcgaaaacggcgagcgaattgatgtgaagaacggaagaacgaacgaacgatgagaaacggcgatgaggtcgcttttgaagtgttgttgttattgcacaatgaagggatgatgatgataaacgcaaatagttctgttctaaaaaaggaaaaaacataaaaacaatacataatgaaatgaattataaatttaaaaatagggaaattgcagtttttgtaaaaaaaatttgataaatttaggttcaaatttggtagtataggccagggaaactctgataaactttcaggtcgatgtcgataatttttggaattcgggtttggtatttactatgtctttttgaaacagtgaagtttatgaaattcacaaactgaaaattgacgaggaatcagaaaaacagagtaatcatccataaaagaaaaatgagtgaatgaaaagggaggaaaagggggcacaatatttatagtacgacgcaacaagggagggcaaaagttaggtaggtacgtaggtaggtaccattgcccaaattccaaggttttctctctatataaggaggtgttttctcattggactgacattttttgcattacgcctatatgcttttcttacttgttccctcctctattcagtccttaatgttctgatttaattttttgtgttacagagtacgcaaaatataattaacccgaatgtttccaattgttttttcaatcaaaattgactgtttctcacagaattttcctgctggacaatctaaacttggaatttaatcaaaaaaacacaaaaaattgcttttccctatttttaaaatttataattcatttcattatttatgtttttatgctttttcattttttagaacacaactatttgcgtttatcatcatcatcccttcattgtgcaacaacaacaacacttcaaaagcgacctcatcgccgtttctcatcgttcgttcgtccgtccttcacatcaattcgctcgccgttttcgcaatggcacttcgacgcatcaaacaggtggcgaaatgacaactctctgatcagccaatgctttaaatgttttgatccatttgcaggaactggcggagctgaagcaggaaccgatcacgggttgcaccgcggcaccgatggatgacggcaaagacatgttccactggaaggccaccatcaaaggaccgcccgagtcgccgtacgagggaggcaccttcaacatggacatcgttttccgtcgcgactacccattcactccgccaattgtcaaattcgaaacgcccgtttaccatccgaacgtcaacaagcagggtggcatttgtctggacgtcctgaagacgacgcattgggcgccgtcgttgaccatttcgaaaggtgaaagcgacgcgggaaagagcagacaaaacgccgacaaaatattgagacgacaaaacgatccaattcaaaacgaccaccaaaaccggactttttggaaaagtgtcgatattttgtcgtgtgaatgggatttttcnaattcggaaatgccgttttaattcattgtctcncctccatttcagtgctgctctccatctcttcgcttctctgcgacccgaatccngacagtgcgctggagatggacatcgcgattatctaccgcaacgaccgcgagcag

SEQ ID NO: 14478 - DNA, 1681 bp, Heterodera glycines
caaaaattcaccagcaaaacgcacagcacgagaactcttcccctttctggtcgatttggccggaaggttggccttttttgtttggcatttaaaatgaattaatcagatgccattctgatcagtcaaaaattgttgtccaattgatttttttatttttatggaacagcgaacgactcaaagggatgccaaatggcggagaaaggcagcgggagggcatccgcataaaccaagtaaaagtgggcagcagccaaatcatccagaaattaactttgctgatcattgatcactctctatgtaattacccatcaaactttgtttgtctaatcagctaaattgtccggttattcgtttctctgagcatattttctgatcagtctgatcactttgactgtcccattcgttgatcagtccctctcaacattgggccgagtgatcaaagcgttgtacgaccgccaaaatgggaatggcacttcatctcagcagaaacaggtccaccaatattagcattgatttcgtttggcaataaacttgcgcagattccttaccgcgactctgtgctcacttcgctgttgaaaaacgcttttggcggcaacagcaaaacgataatggtcagtcattgtcagtggacgacggcacagcaaagaaatgaatgaatgaatggcacccatttttaattgtttggtaccaaatgccaaaatccagtgcatttcggcaattttatgaaatgccagataatttgtcattcattagccaatcactgatcccttcccctccaatcagattgccaccatttctccggctgatctccattatgaggaaactctgagcactcttcgatttgctgacagaatgaaagtctctttctgaaccccgagaacagttgaaaaataatgccaaaaatgtaattcaggcaatccgaacagtgcccgttgtgaatgagtcggccaccgagcgactgatcagaacaattcgatcggagaatgatcggctgctgcgggcgttggagcggggcgaattggaggaagtggcggaaaaggtggacaaaaagcgagagacaatacgaaatttaaaaaacgaagcgagtcaatggcacggtcaaaccaaaactatttgttggcactaagccaatgatttgggtgattttctgcgtttggcaacactttgactgccccccccccttttaaaatggctgctgcttatggtccgttttcagcttcaccccctcccccatttccccttcgattccgcaaagtaacaagtaaaataatgaggctaatgagtcagggtacggtaaagaaacaattatacgatagttactgtaacaaatattcggtgacagggaagatttgtaaacagatacagtggttcatgagtgagtgaggttaccgtacggtaaaaaaattctcaaataccgttaattctcgagctttttgaaagacaattccatgaaataaataatagctttaccccctttttataattaatgaatcattttaaaaattggatattaattacattgattcattgcgctcttaccgctgccaaaacgctgctgaatgacaccgtacgtgtcgtcgagctgaaaaccggagctttgcgacgagaatgagcccttgcgcttattggtgaccacattcacttcgctgcggtgcttgtcatcctcatcatgttgaagaggaac

SEQ ID NO: 14479 - DNA, 2684 bp, Heterodera glycines
ttctcatgccaataaataaaatttacttggaaaaactcccgtgcacgataatggcctgggaattggccaaattggcaaaccgtgaacgaaaggtctcaattcagaaggaattggaagcattgcgacaacagttggcggacaaccagcgggaaatggagaagttggaacggaattggcaacagaaagaagagacattcaaaaaggtcaaaaggacgggggagaaaagggaaaagggggagaatagggaaagagtggaggataaagaaagagggagcaatcgcaacagggaaaggcacaatgggatgtcaaattgcgaatggatttggaaaaacagaataaatggagggagaatcaacccaacaaaaagagtgatcgatcccccgggcgaggaaggaacaaaagtgatcaaagggataaaatggatttgcaagtgatcggagggagaaaaagtgcccgatatggttgggctatccaccaatgttcaggaaatgagtgcgatgagtttgggcgagttggagcagtcactgaacgcgtaccgggaggagacgccgcacctgtggaatttgaacgaagacccggcactgagcgatgtgattgtgcactttttggagaaaggtggcacaaaggggggggcacaaaagaaaaattgggcggaatttgggccaaagcgccgatgttggcaaaattttaccaaaacattaaacatttggggaaaaagagaagtttccgccgcaattgattcaattttttgctttcttttttaatttcctcttaaaataaccaatggattaattttgtttttcatttttattaaaatttaaaatgatttttgtatttttgtgcttcaggagacaacaaaatcggtgcgttattttttggctttgtttttgattttacaattcattttccaatgcccagggagtgggcaaaatgcgcaaattcaactcaaaggaatgagcgtaagtttttaatgagttaattagtaccgtggcttaatccaacactcgagtgaccaagtaaattaatgatggatccatcagattctgcctgatcatgcgttggtccgcaacagagaaaacaaacggatcactttgatgccgttgaacggatcagaaattttggtgaatggcaaacgcattttgacggagagggaactgcgacagaacgaccggtagatgaacagctcaaaggggatgagagggaattgggtggatttaatgccattcgtcactttttttgagcattcatttcggcgccaaccatttgtatgtgttcagcaacagaagggagaggaaaagggaagcgaaggaggggaaggagaagatcagttacgaaatggcacaaaaagaaattgcgagacaaaatttgaaaagtctgtcagaaatggcagacaaaaagtcgaaaggtaagaaaagggatgggaaggccttgccctttctcggcattgccattcccgccgatcattgaccgttggctgatcacttttttgcgtctgatccgttcatccgtttttgatcagatgaattggtgctggaggaggagttggtcagtgttttgccgtacgtttaccgggccaattcaatggcggcggaactgaaacaggcgaaacgtttcgaaattgtgctgatgccacaggaggaaaagggcggcaatggccgaggcggggcattgacagaggcaaatttgggggaaaggggaaaagtgagggaaagataagcaaatggaggagagataaagcatgaacaaagggaagccaaaggcaatgaagcaaaaacgatgttcatagaaaaagccgattttgctgatcagatcagtccctcccccttgggtttaatgggcttttttctgatcacttagacaaagtgccataattaatgttcgacaaaagaatcgaatgaatttaatttaccaaaggaaaaaaacaaagttgatcattaattggtccgtttttgcaacagatttgggtgaaagtgcacgacaattcggtggccggcagcagcagcagttcgctgtggtgagtggagaaaaaagtgccaaaaatgccaaattccttttttaagggacatcagccggtagcgaaacgaaaaacataactttgtccacccaaaaaatgccatccaattgtttttcaggttcatgtcccgttactaccgtatgcaggtcggacactgactgaacgacaaccacacatactgtaccaatgcaaatactgtattggcattctgtttaaggaactgtacgaaaaacaattggaggagcaaattgacgaagaacactcgtccacttctacagctgaacaacgccaatgtgaagacaaagcggcggcagcagtaagaattggcactgtgacagtgtttctgcaaagtttggcctatttggtcggaacggcggatgaggtgggcacggacgaattggaagggttattaataacgtaatagaaaagggacaaattgggggttggcggattttgaatagtcgggagggaatttgcttctgtaattgtagaaatgcaagaatcgctgaccatttctcgaactttggttttggcattcgtggataaaatattaaacaaaacattgtgcgaattgtgcgaaggtgcccatccaaaattaccacggggcgcaggtcggctggctgaaggtggagctgagagtgcgcgcgtgggacgaggagggcgaggagga

SEQ ID NO: 14480 - DNA, 1587 bp, Heterodera glycines
  misc_feature (71)..(71): n is a, c, g, or t
aaattcggattcgctgatcagtgatcagattggcttatcaattggcattgatttagcgtgccattcgtccnccttttccatgcttttccctcccctccgccaaatgtgtgccacgccttccgcttcttctctttgcttcttccctctcatcgtccggcttttgatcgctttcccccgtgaatggatgaactttgccccttttttcttaccgccgctcggtgggaatggcggcggtgatcgcatttgggttgactaaattcaacagcaacgggggcagcagcaacccgcggtttttggcctcgtcacaaagtgcaaatggtttttgtttgttgggggcggaatgccaaaagattttcaaaaaatttaaaaagcgttggcttttggtgtgacgggaaatgggctttttagaccgagggatgatggctttgatttcggagtgtttgctttactgcctctgcgaaattcagtcagcacggccaatccaacgcggaaaagcgccgcgggggacaaactctacgccttttcaatttgctcacctttagggaatgggccaaattttggcttaatgacgtgccaaaattacaacgaaattttaattggctgtcctttacatataattttatggcttcgctgattttggacgtgtcaaacgattggaatgcttttttctgttgggtcggctcggcttttcctccttcgatttctcatgccctcaatgctttatgttcttatttggttaaggcgtccctttgaatgcatttgtctctgtttctcatcccatcaaccagcaactctttcttcactatttcttttatctttccttctttccaccctactatttctctcttatttttctttttctttgaatctcttcaattaattgtttccgtggtgaaatgcataatgaatgaatggcctacgaaggatcactacgaaatccgtccggcggtgaaatggccaaaagagagagggaaggaaatagcattgaatattggagagggaaaaggaaaaaagataatgaaaaagggagagaaggaaaagagaggggaaaagtgaaaagggagagaaggaaaagagaggggaaaagaaaaaaagataatgaaaaagggagagaaggaaaagagagaggaaaagtgaaaagggagagaaggaaaagagaggggaaaagaaaaaaagataatgaaaaagggagagaaggaaaagagaggggaaaagtgaaaagggagagaaggaaaagagaggggaaaagaaaaaaagataatgaaaaagggagagaaggaaaagagaggggaaaagtgaaaagggagagaggggaaaagaaaaaaaagataaaaccaatgaattgacaaaaaaatgattggtcaaacgaccacaaaaaatagaaagacagcagagcaaacggagtttggccaaaacaaaacagtcgcagttggagaagtgcccaattgaattggaggttaattcctaaaaataaaatatcatttttatttttattttaaattctgaatgttcgcctaatccgacttttgcccgaaggcaccaccgctattcgccattaagtgaattaaattggataaaagaaactga

SEQ ID NO: 14481 - DNA, 2236 bp, Heterodera glycines
tgaaaagggagagaaggaaaagagaggggaaaagtgaaaaagggagagaaggaaaagagaggggaaaagtgaaaaagggagagaaggaaaagagaggggaaaagtgaaaaagggagagaaggaaaagagaggggaaaagtgaaaaagggagagaaggaaaagagaggggaaaagtgaaaaagggagagaaggaaaagagaggggaaaagtgaaaaagggagagaaggaaaagagaggggaaaagaaaaaaaagataaaaccaatgaattgacaaaaaaatgattggtcaaacgaccacaaaaaatagaaagacagcagagccaacggagtttggccaaaacaaaacagtcgcagttggagaagtgcccaattgaattggaggttaattcctaaaaataaatatcatttttatttttattttaaattctgaatgttcgcctaatccgacttttgcccgaaggcaccaccgcttttcgccattaagtgaattaaattggataaaagaaactgaacaccattttttgtgaagtgtattgaaataagaaaaacaaatttttggaaatcggattaattatcaatttaaattctaatgaaaaatgtatttaatacgccgctattttctggtgccaaatagcattttttattacaagaaaaaacttctttggtctgatggcatatttttgaatttttgcatttgccgtcctttgccttacctttggcacaattgtccatttgccaattgaaaaattaattggtaattttgaagagtatattctcgagttttttgatctcctctcttcaatttgagcctatttaaaggcgatttgtcctccgcttttgcacatttcgaattgcacaataaaaattctgctgctgatcaccgcattttaacaaagtaatgcaaaatattctaagaatcttttaatcttttcccggggtaaaaagagtgtttggaagcagcggcatgggacaaggaatgggaggcggtgggggcggcggcatgttctgatcgcgattttgaaagacggcgtaggacggagcgagtcagaagcaatggttggtaaagactgactgatcagcagatgaaccaaccaaacggcacggcgattagtgaccgtaccgtactgtacagtcaatttgcgctttaaaactcaaaaattgtcccatttctcaactcgtgctgataaagaaacatttttgttgctaatgttaacactgtgcaaaagtagcaaaaattgtgaaaagagaccaaaacattacacaaaaacagcagaacgatgagattccatccgatggtcaaaaataccgtatcttcgggtactgtcgttggcctacgccccctcaatttgggaaaggaaaattgtagaaaaatttcaataggaaattaactattattattatttaattattatttaaaattcatttgagtgtttttccattgattaaaatgaaaaaatttcattcgttttcccatttttgttgattaaattgttgaaattgttggtgcgaaattgtcaaaatgggcaaaagctgtttaaatttcaactgcggcggctgcgactcgcgtggcatttggcctcgtttttacgccatagaaattcaaaaaaaaaagccgaaaaggtgaatttttaattgatgaatggtgatgtttgattatcggaatgtttctttttactgccgttgcgaaattcactcattgccaaatccaacgcgaaaaaacaaacaaagcaaaatttattcccctttaattacctttcatttgtctgccaattttatttgttggccaaatgttcagctatttaagggcgatcactttcagcttttcatcatttacaatacaataaatatttctttttattctgttcatcattcactaattaataattaattaaaaagacaatttcgaatttaaaattaattaagacaaaatgcgtccctttcgcctcccctcgattcgtcaactcgacgattcgtgaacccagccaaatgtgacgattcgtcaactcaatcaatattacttaaaaaatggaacttaaatttaatcatcattttgattcgtttttttctttgaatttttgtttaataaaattagtttatgcaagtttttgattgaatatttcatcggaagggtcgtgattttatgtgttcttgtttataaattagcctaaaagaatgctataattgtgctaagcgtacaagaaaagctcttgaaactgctttttaaaactatttttgg

SEQ ID NO: 14482 - DNA, 2739 bp, Heterodera glycines
atttttactggacagcggtggtgcaattcatggggactccccacttgatctcataaaaaaataaatgaaattcgagtcggtcctaaaataaatgcgagctttcatattttttttctcaaaacaacaagactaacaacaatgatttggttaaatcatggataggaaatcccgaaggagataaaacattcagtcggataaatggggctgggctgtttacataaaaaggcatttgtatgtttaaaaacgaataaccggctaactcgcgataattacgtaagtgattctgattcttctgcattcagcgggacaatggtttatttgctgaggcggacatcggcagtcttacccatctgttgcatggaattattttttagtaaatgtccgcttcttttggcccgtttaccttcttccgctgccttttgcgtgccttccgcgtcaaatttgccggatcggcgaaaaaggtgcgctcctccgcgtccatcacaatgatttcgtcatcctccgccattccctcctcctccgttttcaccgtcggtttctcttcctccgcttcctcttctctctcgtccaaatgtgagtagcgttttcgcttcgtcttttgcgtctccccctcttcctccactgtctcttccaccgtatttccatcgttcgtcctccattcatttgtcgttctctttttgctcagtttctcaacaattgtcgtggcccgaatggtccccccattaacgatgttcccattaacatctgttccacgggcattggtctgcaaaaatgttaaatgaataaaaaaaagaatctgtcctgactcttctttagtgattacacattcgacgctccttgcaaagagtggacttttgacgatttattaaaaaccaaggaggagtgctttggtttgcaattttttaacagggattagaaattggtcaatgtcagattcgtgatcaccgatccgaaaaccatcgaaaccatacgacttccgcaaattcccacagcatctccaaaatcagttaccgttttctgccttgccgtcagcacgtagttgtcgtacggactgacccactcatgttcaattctgttccgaatttggttcttgcgtcgctctgcttcgttgtggtactgaaaagagcaataaagaaataatattaggtttttttatctgtcgtccatctgtaacgccctttctttctctctctctttttcactctctctatgacagtttcttctttttcagtctattctctatgtccctctttgcttctctcacttcctctccatttcccctttgctctccgtcattgtcctcctcctcgtcgatcagcacaaccgttcgaatggcactcatccgtctgttcattgtcagcaacttcttgagttcattattagaaacactttctttgtccgtccgtccctcttcctcatccgttcgtttgttattcgtttctttcaaatgctcccaacggttcgcaattccgatcagcttaatttggtgttaaattaaattgcattcttttggggtttttccctacttttctcattgttccccggggcgctgttccctctgctcctccgtctcccctctgtctgtttttgttgtttctgttgtcattgtccaacattgctgtttcgcccgtcgttgtcattgtcagcaacgatttgtacgctcgggagaggtcaatgcgcagttccaatttggcgcgttgtgccgtaattcgattggcatcgaattctccgagcacttcgtccgcgttccgttcacgcgccggagcagcggactgaacggacgaaatgacggactgttccaacggaagatcacgagcatagcaaatgatccttattagaagagagaaagtaagaaatggcaaagccgtggatgtatatatagtatgtattaaattaaatattccggtgtcttcgtcgttcaaaatcaagtcccggatttaaataatttttgaacgtgaaattgccgactttaaattccgtaagatggtggagaacagacttgtgcagtgctgcctgttcgctacgcacaattggcggcaccggagcacaacatgcgagaataccactcggttcacgaggcaaagtctggacaaaaaaacaacggttgagtcagcatgtcctattagtctgaaacattatcctcgtaggattagcagaagggggggggtgtcagggccaaaatttcaaaatttttatgattatattcccagcgaaatacacttttattttcaattcttgaattgtcgacacctctgctatttgcaacatcatatgctcaggcagcacataatgcagtgattcgtctttttcgcgcgccgttcggtccctccacgcccaaaggcgggcgagtgcctccaattggcgattgttgaaacgacgaccacgcctaagcaatttcatatgacccatgggattgaagcggggctgtttgaacaccttaaaaacgtattacgtggaatttaggatgatgaaaagtttagaaaacaaaccaattgacaaatttggacactttgcatgaacacttcgcagagcgcagaacgggccgtgtcgttgtgtgaacggtatttggccaattccaattttaggcggtcatagcaatccaacagaaaatgagtgtccgccctcgcataattaaccatcggttcaattaggggtctaatacaatatttgaatttatatttcttggggagggccgttgcacccacctttctctccaatacagcccatttgagacctgca

SEQ ID NO: 14483 - DNA, 943 bp, Heterodera glycines
  misc_feature (933)..(933): n is a, c, g, or t
ttgtttctgtcggttgcgttgctgcgaagccatgccgaaccgaggcgacagtcaaaaagaccgaccaagtaaatgccgaagtcgcgttggagccaaagcacatcggaatcagcagaaaaagccacctaacaatgtggaagaaggaataattcatcaaaaaataaaataatggcacatactttgacaatgtttgggtttgtgaatggttcgttgagcaaatgcaagtgcggccataaagggaagggatcgacgaggtaatcggcggaacgagtggagatttgcaggagacaggagaggccgagaaaagagcggaacgaatggtgctgaaacaaaattggcaatttcagaggaaggggggattattcaaacctcgacatcaaaggaaaactcgtgaacttcgtttagtgtgtcgatcaatgcctccaagtcctttaactgacggacccaaattggcggagaactctccaatggagtcggtttcttaaagagaaaaaacaattgcataaatgtatacaagtgaaaaacactgactttgacagtttcgggcagtgccatcatttgactgtgttcggtcggttcgaattgtgccaattcctcagcgtacggatgctcctccaccgcttcgtcttccgcagtcgccccattgcccagcgacatccgtccgccttcgtccgcttgcgcatcgctcggccattccctcgccatccctttccccgtgctttcctccattcgtccattttcctccatcgcttcgtcccctcctgctaacatcagtcgcattttgcctttgccaacactgcttctgcttcccacggcttttgctgtcccattgttggcgttgtgtttgaagcgcaatttgggaacgaaaggcaaatcgcaattgttgatcagttcgcgaaaagctcgttgaggtttctaaagtaatttcaaaantgtgttatta

SEQ ID NO: 14484 - DNA, 2158 bp, Heterodera glycines
  misc_feature (1273)..(1273): n is a, c, g, or t
tttttaccattttggagtcaaaatttcaaaaaaattaggtaaaatgaggatccaggatccagcggcgcccatccgcttgggaaaaactttaactttttgaatggtattgttattatctccgtatttttaaaaaattgatcaattttcgggaagggagggggccctgaagggatcattttcaaataaattttgctaaaaatttttgaaaatttaactataaattggtgtcaaaatttttttgtcattttctttatgttttcttcatcatttttcagcttcctgtttattgtgtgatgctgtataaaattacatcatcccgacacggacacgccaattaacaattttttgttgatgtcgttatttgtttttgtttttttccacctaatgtgttaccaggtgctaattaatgatcattgaatgaaattgagtgtgattaattgcttaattttaacagagacattaatagattatatgattcgaaattatgataaattacaatcgttaatttgtttattgtcactaattgaacgtggattttgttgatgagagaaagtttttgtaaaaaatgattgacataatgaatgatgaatgacattcttaaaaatattactaaaataatatacatagctcattattacataaaaattcaattaagcgaatttaataaaacaaatcgactgatttttctgaggggttaaattttttttttgaaatttccaacacttttgctaagaaattttgaaaaataaacatttttctgagggtgaccatttttaaaataaattttgctaataatttttgaaaaattttaacccacaaattggcatcacattttttatctgtgcctttttttaattaacattaatttactttcactaatatgtaattatttcatacataattaatcataatcttttgtcattttcccgctctgttttttattaattggattttcatcatccatcgtcaccgtcaccattgtttgtcatctgcatgtcatatgcaattcataattaataattgttagagcttcctttttaggcacaacaaatcgcgaaacaggtacttaaaagggcagaaaaaatcgcaaaataggcactaaaataggccaataaattagtgcttttgctttttagctagaaaaatacataaaaatttaatcaaaaagaaacttttaatttttgttatatttcaattgtatgcaattattaaatattttaaagtttttttagaaataaggacaatttttaaaccaaaaatttttgtctagaanaaataataaattttaggggatgaattgagaaaattattatgggtatactttaaccaagtagaaaatcattttttcatgcttatctgtgcgcttcagtgcgcagagattttaggtatttgttctttattaaaaatattttaaataaatttatgaccaaaaaaaaaattaaaaaatttgcaaatctaaaaaataaattttcctagagcgggcggggagttgccgagctcggggatacagcaaaaaaaaaaaccgggatttatcgagaattaaggttggtccaagaaagctggggactcggtgccacttggtcaggggtgccaccctatttattacacttattatttattcctcacttcctttttacccgccattcgttcgccattggcacgtgccgaaacccacaaaagctgatgagcacattttgatgagctggtgcgtgaaaagtgcaaatgccgtagcccgcggacattcacacggatgtgaaagctaacacttgcatttggtgccgccaaacacaatgccaatggtttcctgttgctaatgaactctctctcgttttctctcgcgctttctctctctccccctttttctctctatccctctcgtttttttcttggcttcttttatctcttttttcactttcactatactcactcatcttttagtgcttctctttcctgctttatctctcctcaatccttgtgctctctctctcttacaacctcacctttcactctttcttttccattttcttttcctaatctctctgtacgtctatcacccttttattctttttctctcaaatactcatttccttctttttcttgttttctttctatcattgtccctgtttttctttctctctctcctctcattgtttctctc

SEQ ID NO: 14485 - DNA, 1412 bp, Heterodera glycines
attagaaattttcatatttattaagcaaaaattttgcgttgtccagatttaattaacattaaaaaaaataaataaaataaataatatttttattaaaaaaaatgatttacaaattcttcataaaaatgttttcatttaaatatttcctttttggacttgttccatgttatctccacttgaaacagacaaaaaatttgttggatttatataattttgggatagaaattttttcgaaaaaatcttatcttttattcaaattcatatgaaaaaaaattctcgaccttactctgacaaaaattcacagaagcatctgtctctacatatatatatatatatatatttttttattatttttagacattttcagattttttgagccgagaatttacgttgtcaaaatttaattttaacattttatttataaaataaaaaaaatttatttaaaaaaaataatttactaattagtcataaaaatgttttcatttaaatattttttccatttttgaatttaattcttcttggaattcatttttttccgtctcgtttttttggaaggattaaattcatatttttttctacttaaagtcagtccgagtcaccaattggccaactgtaatggcttatgcatgagtagtgccacagccaaaatttgaggccaaggattaagcaaacttcccaagaaatgggcatttttaagccaccactcattcatccccaatcccccatgaaaatattaacaaaaagaaaaaactaaatttaaattattttttatttttttggttttccttttttgtaaaatattttttcattattaatttaataattttatttctttttgaatttatgcaaatatttaaaaaattaaatttcttttttgtttttaaaaggtattagctttttctcaatttgctattttcattaccataaaaatattttaagtttaattttttttaaatatatttttaatgtattttattatttaaaatggtccaatttcctttttcatattaaaaaatatctcaatgaaattcatggttcatcataaccatgagcccatctctcatcagcagtccatcatctcgaatttctaatatttgttttgttggcatattgaaattgctccccatttcaatttccaagaaaaaaattaaaataaacgaataaaaatcaaaatttttttttcaaatttttggccagactgtcccatgctaatttccccaaaattatggccctgtcaagaaaacatttcctaacttccgtgtcactgtgatgtgctgttgatgacgcaaaaatgtcgatagacagcacagcccacggaagagggatagactggacaaataaattacatttgtccaaatagaaaaattaaatccccgactaatccataagcccataaatgattacaaaaaaaa

SEQ ID NO: 14486 - DNA, 921 bp, Heterodera glycines
aatgaagaggaattaaccgtaatggagcagcgtcgcggtgatatttataatactaatattttattctaaaaaagataatttatttaaccacagcaatcgcgcggaaaaacctatctattcaattctgcgttaattgttaaaattggttgataaccacaacatcttctctaaattttttaaaaagtcgacttaaaagtagttcgtttgcaaatcacagtttatattttgatcattaaagatgcaaattctgaatctctctggctcatatttcaatttcgatcatttgaataaaaaattcatcaatttttcgaaaacaatttttctttgctttgaactaaatgtttttcttttattaattatatatatttttattttatttttttgctataacatttgcttttttcaattaggtatgttaaaaacaatttatatttagaaaagcggaaaaaaatgccttttaaaaatttttttttcatgtgatataatttgtttttttttaatcgataatgaattcgcatttttttcattaattttttaataagcggatatgcatataatccgtctaatgattcagacggatatagaacggaaagtgaaggcatgtgaagagaggccattgttgtggcatagacatagacattaacgaaaataaccaattctttattccttaaactccgccgatcatttttcactccccgtcctttccctccccccctttcccttcctctcgccagtccgtccattttcgtcccgcgccccccccttctttctctcctaaattcgctccgccgatcatctttcactccccgtcctttccctccccccctttcccttcctctcgacagtccgtccattttcgtcccgcgcccccccttctttctcacggaaattcgctccgccgatcatctttcactccccgtc

SEQ ID NO: 14487 - DNA, 1238 bp, Heterodera glycines
gataaggatgggatgatgccaggacaattccgaaaaggaaatgtttgcgtgatgcgtgggaatgaagttgtgtacgtggcaccggatcacaaaaccttggatgcaattgcaacgcaatttaaaaaaaaattaaatgccggttttaaagaaatcaataatccaaaggaggacggtccaactctagcagcatgggcgcattatatgtttgtaagtggaatttttaattttaacgttttctaacctgagaaactcagtatatacctgtattattttctgtattcttccgaggtttactatcaaaccactcgaaaaatgctaaattttcataaaattccgacttaaaatttcggttttttaccaggtaaaagcgcattttttcgatgggaatggaagaagtgctcgttgtattatgaatatttgttttttaaaaatgaatctcgaaccacttgtgcttgatagcactaccagaaatgactataatgaagcgttaacgtgtgatgatcactttaaatttgcatcatttattgacaaaatatggaaatccaaaagttggtttcgtctcaaatgaactaagcattctcacaatccctgtcttgaatgctgaaaataaaacaacttgtataggtattttattaaaatcaacctagataaattttagaatttttgtactttcgcattcaagatcttggaatattttaattaaattaatcggaatattgaatttgaaatttatataaagtacatgatttcagatgcatgaaatgatggtgaactgagagggagatgaaaaaaggaaagaaaaataaatggaatattaaacattaaattttatagtgttgattcgcctttgttgacatcggttcattaataaatgtgaatttttatgaaaatgaatactgaatttttgatcgacttcgggccataaaatcagaattagccgaaatagtcaaactctgattgatgcgttttaaaattttaaaacttaaaaaaattgtaaataaattaactgtttatagacagtttttctcccgcccatccgtcctcctctccttttcatcctccctccttttccttccttcccttcctcttcttcattcattctcttcctctccatccctctttctcttccctccatccttccttctctcatttcatcctccctccttttccttcgttctcttcctcttcatcctccctccttttccttccttcccttcctcttcttcattcattctctt

SEQ ID NO: 14488 - DNA, 3102 bp, Heterodera glycines
caattattaaaaataaaagtaataatacaaatttaaacattccttggcttgcttaaattaaaaataattaattaataaaaatttattgaaaaagaccatttttaaaatacattaaattgagcttcaaaattattcttccatttttaagtgtaaaatgtaatttaaaaaattgttttcatatttaacattcgtaaacttgctaagaaaaatttaagaaaattaaacaatttttatatttaatccatttttcttaacaaattttttgccctaaagtaaaaaaaattaataaaagcaaaaaatgtaaaaaaaaaaaaatgacaaaaaaaatgatgaatgttttcaatgaaagaaatgttacaccttaaaaatgacatttgttttatgcaaaaggccaatgacagaaaaaatgtcagcgaaaaacaattcaccaaaaaacatttttattcattttaaaattattttaaaaatttttgaaaattaaatgctttttctgagttgtcgaaacttttcaataaattctttttccggctcaaccgcattcatttttgtgctcaattcgtccattttttgtttatactccgtgtaatttgttaacatttcattgaatgcatccgcaaaatcatttttcaatgttttggagcgaatgtctgaaaaatttaaaacaaatttaaaacaagaaattaaattttaaaattggcattttaccaatcacttttgccacccctcgcgccgccaatgcctcggcattgttaaactgatcgccaaagaatgggaacaaaatcagcggaacgccacttttgactgcctcattaatgctgttctgtccgccatgggtgatgaacagtttcagcccgccggctttttttaaatttaaaatttaaaaaatttcaaatttattttttaaaccaagaattgccgactgttccagccaactcttggcatacacattgtccgccaactttttgtactgttcgctcgtgccaattggcgcccttttgccccatttgatgatcatgttcatctgcgggtactgcttgaacacttccaccacaatgttcttcagtgcaactgcgtgtgcttcgccatcattcatctccaccacagagccaaaactgagcagcacaacgccaccattttcatttgcactgttgccagatttaaatatttgtttggtgtcctgtggaacaattaatttggcattttatttgcgtccagaaaactaaagcttggctaaaaattattattttataaagctaagtccatcctgaaaacacccttgcctctgcgaaaggttgcttaacaaaatttcgattttccatgttggacttggacctggatttcctggacaaacgaccagttaagtcccggtcaggtaacttaactgaaaaaaagtcacaagaaataacaaattctaaaatattatccagaaaatccagggtttttcgtgcctaatctggatctagattttttaatatttgctgcatttccgagacaaaaatcctgaaaattcaagttaccgaaaaatggcctggacctggacccaggaaaaaccaggcctggataaccagtccaggttattatgaatgtctatttcatgacattttttgctaataattttaaaaacccaatattaccccattcaattttggcacaacaccctttggcattgtgattccgccaataaaagtgacacgattttctatgtgcatttgccgttctcgctcaatttcctgctcaacaacaggaaaatcgaggaatggttgcacattggtgaagtacaaatccatccgatactcaacatcccatgatgaaaaacgctcatgcgtaattaattctccgtaaacatttcttgataacagtgaccggttcaatgccctcaaaaacagttcttcctaaattcaaaacatatttaaaaaatgccatttgtcaaaatgccatttggaaaaaccattttttaaaggattggataacataaaaattttgagaaaatgtcatgattttctatttttgttttttaaatgcaaatttgggggcgaaaaattaaaaagcatttggttttaggctttttgaaatataattaaaatttctaaaaattaaaaaatttttagacaaatcatttaaatatccaaaaaattcatcaatttcttgcgtaaaaattcattaaaatttcaataattctctggctcagcgggcatgccttggaatttttaatatttttgccaaattggctaaaaaaaaaatttgtgccaaataattagtgctccgcctctgtttaccaatattttctcggattgttcaattgctttaatatataaagcctcgtttcgttcccgaaaataatccggattttctttaatggcactttcagttgcaaatttatgatcaccaatcagtgccacgtctcttccttaataatggtaggtaaatttaaaaatttattaaaatttcagttaaaaaccgactatcatctaccagagacaaatgctcatcatgaaaaagacactaatgagcttgtaaaattcttccaaatcttttttttaatgctgaaattttctattaaattccttgaattaaaaaaaaaaattttccaccgctacgaaaattgaataaatccttattttcttgaatgccttttgaaattggcaattggtccgttggtatagaaaattaaatttttcattgaattaaaaaacgtaaaaaaattctcacacgaaaaaaaacataaaaattaaattcatccatcatttatttatttatttcaaaaaatatttttatttacataatttttttatctgagtgatctcggactggcatcatctctattcccttatttaatagctctataaaacctcgacttatttattgattcgacgctttgtctgttagatgcaatgtccgccttattaacttttattttgtttttttaatttggcacacctggcattgcgccaactattctgtcatagcccaaatatttccattgcgaaattggtggagatgtgctttgcgtgccgacatattttgtgatggttggaaattctcgaagaacgcttatcgacaaatcgccggtgccaacttcaccaacacccacatgaaatcaaa

SEQ ID NO: 14489 - DNA, 1500 bp, Heterodera glycines
  misc_feature (42)..(42): n is a, c, g, or t
taagcaatcattaattttgactattattagaaaaaaaaatcnactcagattataaatcgcaatattttgggaatacgaaacaataaaaaaaaacaggccttgaaaacttcaaaaaagacatccaaattacttaaatctttattatgaattcatatttttgcgaaaataattatatttaaatgtgacacacacgaataaatttttgctatatattttcttgcataaatattaaaacagaaattttctttaaatcatttaacggcgtttttatgatattaatgagatcatttgattttttaatataatgccaaaataaaacaaacaaacaaaaaattgttctgataaaactcactaaattttgtcacacttggtattttcgctaattttttaaaagttagtttatttatgtcaatatatgatttaaataattaaaaaaattttatagaaatacttacttaattttgagacgcttggtttgttcggatttggcaaaaaaattgcaccctcccaaatgtgcctgtgctctctttcacgctgtctatgctgaagaaccgcgtccgtacaatttttggcatcggcccaatcaaaagtcatccggtgccacaccaaaaggcgcccatcaaattttggtggcacttcagttggctcggcacagtccaattcatggacgagaagaagctgaatatgggatgcataaattactgttttgttaaagaatactttaatgaaagggatacgatacgacacgaaaaaattgaaggattagcgaagaaaaataaacattaatgaaaatatatggtaaatggctactgtaatgaatgaaaatgaaattgtgtaatagccttaccacttgctcaacattttctttgtcggctgctagcagttcagcaaggtgtcgatgcagaacataatgtgtctcggtaataccttcttttgctaccataatcaaaacgcgaaattttggcgaagtgtctaaatgataaaaaaataatagatagaatttaaaaatatatttaaattcaccagtttttaatgatgatttgttgtttatatttgttaatggcaatgcattgttaaaacaaatttgtaaaagagtgttgaataaaaataacaataaaaattgtttcatttatgtaataatttgcttttaaataaaaattattacatttcaattattaaatataaaaatccaaaagtatctattttttatatgcgaagtaggttattggcggggaacaatacgtcaaaacctgtaaaaataatatgaaacatttttgtgtggtcccgtcgcgcacgatttattcaagttttcggcgaatcgtttgctttttgttagcgcgtcaaaacaccttctcggcccattagttaattacccgtcattaaaaatgcaaattacttaatcaggcgcgagtaattagtcaatgcagagattggattgacaatcaaaaaagaatttgtaaaagaagttgcgatctgtcagaattatgagagacaaaaatt

SEQ ID NO: 14490 - DNA, 1209 bp, Heterodera glycines
ttactccaagacgttagagggcaatttgaataacgaactcttaatctaattgcgaatgatatctaattaaaggtagcgattagcagcagaaaaggttcgtaaatactgataggctaattttgccaaggattatcgtcctattttggccattggacttaaaagggttacggtgtacaatcaaaaaatttcggtctcccagaggaaaattatttattgacctttatgcacaattttaatcataaattaggatttaattgtacctcattactcggacgctaaggttctaaaaccaacaaaatcacttttatagtgtcgaattgccacaaatgccggcgaaatatttcgaaatgtttgcgtaaggctagaaaaacaaatctatttgattctttagtggttaaaatattgcgagtctttactccaagactttagagggcaatttgaataacgaactcataatctaattgcgaatgctatctaattaaaggtagcgattagcagcagaaaaggttcgtaaatactaataggctaattttgccaaggattatcgtcctattttggccattggacttaaaagggttagggtgtacaatcaaaaaatttcggtctcccagaggaaaattatttattgacctttatgcacaattttaatcataaattaggatttaattgtacctcattactcggacgctaaggttctaaaaccaacaaaatcacttttctagtgtcgaattgccacaaatgccggcgaaatatttcgaaatgtttgcgtaaggcgagaaaaacaaatctatttgattctttagtggttaaaatattgcgagtttttactccaagactttagagggcaatttgaataacgaactcataatctaattgcgaatgctatctaattaaaggtagcgattagcagcagaaaaggttcgtaaatactgataggctaattttgccaaggattatcgtcctattttggccattggacttaaaagggttagggtgtacaatcaaaaaatttcggtctcccagaggaaaattatttattgacctttatgcacaattttaatcataaattaggatttaattgtacctcattactcggacgctaaggttctaaaaccaacaaaatcacttttctagtgtcgaattgccacaaatgcaggcgaaatatttcgaaatggttgcttaaggctagaaaaacaaatctatttgatt

SEQ ID NO: 14491 - DNA, 704 bp, Heterodera glycines
atatgtacataaatatgtaaaaaaaattcccgaaatatgtaagaaatatgtataaaaacccaaaatatgtacaaaaatatgtaaatacattttttttaatgcttaattaatttttttaaaatttattacaaattgatatagaacctgtaaaatataaacagattgatttggacggactagaagcttttttgaaggcgccagccaattttgaccaattttgctcggaaaaggcaatcaccaacaaacaaatcaaaaattcaatggcacaaatgtatgccaatcatcttggcattttgtattttatgcgccatcattggtattgtgccaatgatggcaacgatgagcgaattgagcagcaacaacaacaacaaattcatcaaaataagtaaaaaacttttattttttgataattaagcaaaaaataaataaataaaattgtgagacaaaatgccataaaaaatgtattttttaagaaagagtccaacggttttccggctttttcgttattttcaataaaattccgagctttttttagaattagcaaaaaaaagagaagatttttttttgcttgaagcataattaaaattctggatttttctgattttaattaaaacccagatatttttttgcagcccttctgccgatcgtccggcatctgaatggcaaagctaccgtaaatatgtacacatttcatatgaatattt

SEQ ID NO: 14492 - DNA, 2215 bp, Heterodera glycines
  misc_feature (23)..(23): n is a, c, g, or t
tgagactgaattggttttttatnagggaagaaaatttagaaaatttgtcggacgaaaatccgacgacggaaagagcgcggaaaagggcacgaattaatggagatgatggcacagcaagagcagaatttgaggaaaaaatgtacaaaattttcaaaatggtagaagcaaaagtattgggaaaggtcgacaaattggcaaaacaaagcgaaaatgccaaaaatgaaaatgccaaaaatggaaatgccaaattggccggcgtgagaatgataatgatggcaccggctttggcattttcggtgccggaaactgttaccgccgagcaaatttgtgacgctattttaaatgggccattgtacggattgtccgatgcggtcagtttttgttaagtgctcgcagtttttcgagaatttaggaatttttggttgaacgattaagccaaattttcaaaatgaagcgctattgaattttcattatttttttaaatttaaaaattgcctcaaaagccgcgaaattcgctactttaggataaaatcttaaaaaaaatcgtgtaataataagtcgtagaattttttatcataaaaattatgaaattcaataaataaaatgaaaatttttttttttttagaatcatttttatggccatcaaatatagcaaaaattcaaaatttcaaaaattctcagtctgcgcttaacagccaaacttccttaaaaattttttacgaaacggactcttttgctacacagattgaggacgaagcactgcttcatttcgtgaaaggccgtagggatttaaacaaaatattgacccatgtgaattggattttgccaaaaggggcatcgtcacttcgttacacagtaggaaagcatattgctgagtttgaaaccatgctaagtctactgtatttgatgcgcaagcgttggcattgtgccaatgccaaaaagcgcgtcgccaaaatcggcattgaatgcaccaaattgcgccaatacgtggacattatgtatgaatatttgttccgagtgcgctacgcaaagccggcagtgatgccgatgttccaaatgcgcggacctcgattgtaattattaactaattaaccattaattaatggaaattgcaggccccactaattagtagtgataaattaattacaaaaaattaacacttcaagattttttgattgtttaaaaattttcataaattcactttcagggagggttagtaaaaatgttaattaccggaacataactagaaagaatagaatttaaaagttgaaaatatttacctactagtttttttcagaaaatttcaaaaattttgaattttttggcaacaaacatttacatgttgagaatttttgaaaaatttgatcgaaaaaaatcgagtaaatgaaaaattgctttgcttgtacagcagggccccaaaaataagggaaactttggccaaattttatcttaaatttcagttcattccgccgaagcttggccagtatcattggcattttaaatgtcgcttcggcattttattttgcccagaaaatcgagcgggtggtagaaagtgtgatgccctggctacacacgctgaaaatactaaatgaaaatgtattgaattatggaggagcaaatttgggtaatataaaaacaaaacaaaaattagggggacatttggacattccgagcctaaattttagtttatttttatttttttgaaaattacttaaaggatttggaaaagtaaaagatttaatgcgatttataaaaataattcattttccaaaatgagttttccaaagctaatacctctttcagaaagtataaaactcaataaatttatcgatttttctttagatgaaaagatttttaaaaaatccaaaaaataatatttattttcactaaatttttaaataaagattaaaaaaacttaaaaaataataatttatatttttttaccaatttttaaaataaacatttaaaaaagaatcaaaaaatttaattaataatttttcactattttttttcattattttacgaatttagaactttcgagaatgacattccatgaaaatgttgtgcaaatggcgataaatgcgaatgacccagccgaacaataccgaccaagcgctgcgaggcttgaaggtgaaatggtatttcctggttttgtcacccccttgaaaaaaattttgaatatttctctagggctaatttttggcgctgatcaaga

SEQ ID NO: 14493 - DNA, 4367 bp, Heterodera glycines
aaaaaaacggaatctatccttgtaaatgttccaccaaaatttgacagctccttctcctccgtccaacgccttgagaagcacatggccggcgcgcactgctccttcggcacccaccattgtctgttgtgcggcagtcggttcaaatacgagtacaatttgttcttccattaccgccaagtgtgtccgtacacgctgaaaatgatcagtgcagaaatgcgacaacaggtgtcatgaagggcggggcggaaaaaggccgtagcattcattttatatttactaaaaaacatttacgctcaataaattctcaatttaaaatgtaagtccatacggcattttaaaactattttaatatatattttttggaatatttattcattttattccctaaacattatttggcacacagttggaatcggtggacctgaagaagactgtccgtcgaattgccgccgcctcaaccgcgtcgtcgcattcgcctgttttgctgccgcatctccacgccggcacttatatgccaatgccatccgcgctggtgcagtcagcccactccgccagcagttgggtcgctcgttgttcttcgtcggccgccatgcagcaacaattgacttcatctcatgacgctgttgccgaagatgtcaatggcatgccgccaacctcttcctcctcgtccgttgctgtggccaccgccgcttcaactgccgatggggaggcacgcgtgccgatgctcgattcctcctctgttctggacgccctctcggcaccggtggtgccctcctatcacagtcagccggagcttggcgactcggtgattcggcgccaaatgatgaagaaagtatgcgctttgggtctttattttgggaacaaaaaggtcgttcccgtaatttatttacaatttcgattttttcgaaataaaattatggaaatttcaaaaaatgttcataaataaaatttcaaggaacgttttttgtgtgtctatcttataattcggcattgattttgcggtgttattattattcatttattaaattctttttagatcatccaaaaacatcgccgtcacccgggttcgttctccgcctccgcaaaccttggccctcttccgcagcaacttttacagcccgttgtccgtccaaatttgcccgatggaatgcaatgtccaatttgtggtcagttcgcgccaccattaaatttgtatccgaatctcacaaatttcttttcatttttgatgggatgggttttagttttcttcatttactcctaaaataatttttttttttttttaaattttatggatggacatgagaattgtacttttaacttggaatatgttcaccacttttcctccccctcttttagcaattgtcttctacgggctgaaggtgttggtccgccatttgcgcgctgcccaccccaacgagtcgtccgtctgggagcacactttgtccgccctgggctcctcctccagcggtgacaacggtggtgcccactgtggcaatttgaggctttcatcagcgacaaaacacagtcccagccaattgtccacgacacggaagaggaaaatttgtaaatttttggcacatattttttaactgattataaaatatgaaatatgtccgctaattccatttttggaaatttcagttcgcgacagcagcgaggaccaaccaccactgctggaacttgctgattgtgtgcatgtcgactcggcaacacaactgcgacaaatcacatccaattacactgaggtactcattaaataatgattatttttgatttggactgtttcgctagttttgccatccctaatactcaaacataacagtgcacccgattcaggagttggggctttttttaacctattttggctaatactaattcaagaatcttttgggaaatcctttttaaatgccaatatttttgaattttctttttcagcagaatggacggagggaatagcagcacaaaacgacaacaccaacacgaattggatgacagaagaaaaaatgaaaatttcctattttaatcaatattttttgcaccttttcatttggcaaataaataaattactattttttgcaatttcctttttcattcatttgctaataaatgatgtagtccaacatttttgtgatttcctctaatttctgtttctttttgcgatcaaacaaatatatgtctccagtttttaatgaaattcaggcctaaaaggcattgttggcaacaaaagtgatgagcagcgcaaaacggagcattggcgacgccggcggcagcaacgacaaagcgggcacaagtcggagtccagcaatcggcaacaagcagcaaccgcaccatcagcaacacaaccatcgcattcgcaacaacacgagtaacagtcgttcgccaaccaaaaagcggagggaggaggaagaggggacgagagcgaaggtagcgacgaagaacggcaccgccggcagtggaagcaaaagtccacgacggcacagccaacaccatggcgggttgggtgcggcactggaggaaatgcgggagcgcaaatgggccaccatcgccggcccgtcctcatcatcgggcgcaaaggcacagaaattgtccacggcatcggcaaagtcggtcggggagaaggcagtacatcgccaacagcaccaccacaatgacaaaccggcgaagaaacgcgagacgaagggcggcgcacagcgacgggtgcgtttggttgggtggcgctttatattagttaatgtggtcaatgtataaatttccgctgttgtgttcgggtcgcgaccaaatccggagaattttctcagcccgcgagcatttcgtttcccgcgctccccttaaaaattttttttataaggtttcgtttcaagaaaaaaaattctatttttcaaaacctaaaaaataaaaaaaaatttttgaaaactcagttagatttttttaattttcggggacgaagcaacgaagtgcatatttatcggtcctttctttggttgacacagaccaagcaaaaatgcttcgatgatacaaaacaaaattttttgaaatgaccgacaattttttaaaacacgtttccgtttcagttgaccttcgccagcaatcacaaagccaatgatgacgacgcggaggatgacgacgacacggcggcgggaccgtccggcgccgccgacgctggcacttcgtacgcctctgcccaaatgcgggtgcttccgctgagcaaagtgcgcaccatcatggaggcgtcgccgaacgccaacgaaatgaaaattagcggcgaggcaatgttcgcgatgagcaaagcggcggtgggtgaagaagcattttagaatatgatatgtcacgaaacaaattgggcagagcaggtcgccccccccccccccccgaattttttttttaaatttccaagcagaaatttttattgattcccgggccggggggcgacaagacaaaaagtcgtcgcttggataaaaacggaaaatgcaccgaacaaagccctaattctatacggcctcagcctttgccaaaaataaccgctaatatttcaaaatgatttcaaatattcaaaaattcgtcaatatttttttataattttccaaaattaaaaaatggatcaattagtaattttatcatttttggaaagccacttcttcaggaggccttcatttcgatgcttgccaagggcgcttatcagcaaatgctcaccggcagtcacacacggatcaattacaacgagttggccatgttcgtgcatgacactgatgagctgaacttcatccaaggtgaggctccaatttttggaaatctctataaaaatggatgttttttgttttggcctcttaacggaggggtagagggccgaaatcggtcagttcctcccgccaactccgttccagtcaagcacagaacgccataaactcttcggtaatagtaaaacttagtccccccccacccaattttcgaaaaaaaaattatttccaacagatgaaaaatgtttccaagggttatcggggtaaaatgttttaatcaactaagtgtaatagcttctaaacattttgtagcttttcgaatgaagtcaattgaatggtttttcatctttttcatcaataaagacgaaatttatgctttaaacttggctggaatggactctcgggacggactgagccccccaatcggaaaagggtgttttttgctttgaaaatcccgcattataacccgccctcatgttttttaattttttcagatattctcccgcaaaaacacaaattttccgaggtggacaaattaatgacaacgaatcgacggtgatcacgaagaaggaaaggagcgtctaatgaaaagtgatcagcacaattgatcttcatttttcttgtttttattcg

SEQ ID NO: 14494 - DNA, 4389 bp, Heterodera glycines
  misc_feature (3463)..(3463): n is a, c, g, or t
  misc_feature (3472)..(3473): n is a, c, g, or t
  misc_feature (4288)..(4288): n is a, c, g, or t
  misc_feature (4318)..(4319): n is a, c, g, or t
  misc_feature (4340)..(4340): n is a, c, g, or t
  misc_feature (4358)..(4358): n is a, c, g, or t
tttctgatcattccaatgcgtattaatgttcttctcgtttcagcgtccaaatcagccatcaaagcccattccaccgccaaatccaccgccgccgtagccataacgcttttgccgaagtggaacacttaaaatttaatttaaaaaaggaacaaaaaactttttgaaaaatcttcaaattataaaattaggttgtttttttttgcacttttgaagcattcaatttttaagaaataaaacttccaatttttgccgaaattttcctaaaaattggcggaatgtgaaattacggcgtcaaaaagtgccgtaattggtctggcacagccattagaaagaaaaatggaatgccaaaaataaaaaataaaaatttatacctttcaatttgattgtccactgctggcatggcaattgttaatgaaaggcaaatggcaattatcagcagaagaacaaaaatggtggacgaagaagacattttcagtgtgaaattttgctgaaacaaaaatattctaatgatttccaattaaacactatcatctgcctttaaatagaaaggtttgcgcacattaattagtaattaatacttgcaaattactaattaaagacaaattaggtgcacaagtttttgtaaaaaaaaaaaatccatccccaattcgatgaatgaatgaataaaattaaaataaaattcatcaaattacgtgatactcttgatactctttggtcggaaacaacaaaattttgttcgttgaatccaaaacactttgaataggcttttaaaaaattaaaaaaaaaaaattcaaattaccatttttaattagaggtacaggaaaagcacacgtttttaggacttcaagacgaatctggcattccacagcgtaatttgatcaaagtaacgccagaatttgttttttcataaatttttatgcatttttagggaataacggtccgatcgaacagcattcttttaatgttcgaatgattttacgaaaatgacaaggcaaaatcatgggaaaattttgccagttatttgaaagaaattaattgttttttctaattaaaaaaaacagtttcaaaattgtaagcatttcgtaagttgctagtggtgccgtccatccgctgacgaaaaacaaataaattatgccaacattttaagtgcgtgccacgtttttttctgcttctctgtttatatacaaaaaaattttaatgtttgacattatgaaactatatataataaattgtttttacataaacatattaaaaaaaaatccacgaaatataacaaaaaattaaaattaatttcaattaaatattatttagcgatttaataaatgcctcctcatttttgcatctttataattttattcaatctcatccaaatcacacataatgttccgccggcgggcctacgtggtggcttaagaggcggtaatttttaaaaatattttaataataaataattcaatacttgtatgagggggggggggtcaaaaaaaccatccaaatgaaaatattttttgatataactttgcttaaacgcaaccaaatttttaattcttcatatcattcggaatccctaatttgtaagtgttctctattattcaaaattttaaaaaagtttcgttaagttttaagaaagttatggcttaaaatgttcaaaaacttggtttctttatcttttcagtttataacttttttgaaacataagtaatttttttttgatatttttcagtataataggaaacgcttagggctagctaaaaataccaagataataaaatttggttcgttttgggcgaagttatgaataatttttctgtccaaaattttctatttgatggttttttgactaacgtcccaacccaaaaaacaccccaacaattctttccgatttcagtgttcaatgatgtttattggacttttcaaaatcttgaattttttaattttccacaccatgaagcacgccatgttgtgcttgaccaattatatttggaatattttatggagaaaaatgagcaaaatggaaatgaaaaaaggctaaaaattgcaacattcacccttttttatatgattcgatggaaaattgaacagaaaaaacaatttttattgtcaattcaaagtgtggatgaggatggagaatacacaggcagaacattatatgagaaaaaaaaggctgctataagagggtaattcatagtgctgaactcgagaccgagacttgacccccgagactcgagaccgaaagtcgcgagacccaaaaaactcgagacgcgaggcttttttcaaaaaattttcttattaatttaaaaaatcggttaaaactttcttaaattgaaaaaataaaaattttaaggcttttcctaacaaattttcgcttttttgatttattcaaaaatggtcaaaaaatttatacataaatatgtataaaaaattatgtataaaaaacccaaaatatgtaatttttttggggaaaaaattcttcgtaaaaggtgaaataggcacgaaataccattaaaaaatgaccaaattgggcttagaatcacattttagtatttttaaaattaacttttgatatatcttttttgaaggaggaaaaaaaacgattttaaagggtaaattttcaattattatttaattatctcatttatcgatatggtgccaaaaaagaaaacaaagcaaaaacataggggtcagcaaaaaaaaagtgattggaatttttataccaaaatttatttctttttttatttaaaatttatataaattttagcataatctgtgattatataaaagaagaaacatccataacaacattatgtttaatggtgattaggaaaaattatttgttggaagttttagacgaaaaaagcccaaattttaacaaaagtcacatcgaatcaccggctaaaagtgacgaatgttttgacgaatcagttgctgagcgcataattgatgaaaataatgaaggaattgttgaatggatgctcagcgatatgctccacttttttgacaaaagacagcgattgaacaaatatttggagtaattaaaaccaattaaatttttattgaatttaacacattttttagaataagaaatttatattattttaaaaatatacaataaataaataactaaactttaatttaataaaaatataatgaaaaatattttaagtaatttaaatctgataatttttataaaatttaagacatttttttggaataagaatactaatttatttaaaaaataataaataactaaaatttaattaataaaatcaaattaaaatattttaagtaattaaattaattaaatttttatttaatttaagatattgttttgtactaaaaaaagttatattattataaaaattaaatataactaaactttaatttaataataatataatgaaaaataatttgagtaattaaaattaaataaatttttattgaatttaaaacaatgggattttantacattaanntaataatataaaagtaatattatatatttatattaaagacagattttgaaaaagaaagatgaaaatttaaagttcgatgcatataataaactggtaattctgttcggaatcgctcgatcggcattgatttgcaacgcatattttgttcaattgggtgaaatttgtaagtggggagtagaaatgccaaaacatgcaaaataatgatcagtaattagtagggttataagtagggtcaagatttttaggttttaactaaattttttgctcaattgatttgaagaaaggagctcaaaaaacgcatttctgcattaaaaattttcgattctgatgtcattatcggtcactagaaatcactattttgacgacttcgtctctaaaatagttaaaagtcactattttggcgttttgtcactattttttcactatttcgacattttttggaaaattccttaacaaaaatgcagcaataaaaccaaaaaaaatacacccctaagaatcgagctaaaatttttcaaaatatactcctgaaaaattttctcaaaaatttactttcttggcaaaaatttttaatttagaaaactttttttaggtaactattttggttttttgctcttaaaaatcccagtcctcagtgaataaaaattatttttgctcaatttttggctgaaaattatgtcactatttgttactaattcggacttttttccaccattatggcactattttggcatttttactcactattttagttaactatttcgagatttttcgtcacttacgcgaccctatttataagcgcataaaatatgcactanaaaccagaaaaaggctaaaatatgcactannaatatgccttaaattacttanaatggcttttaccatcanaaaatgacaaaattgtgtaaaatacagaatt

SEQ ID NO: 14495 - DNA, 3097 bp, Heterodera glycines
cctttgtctccaatgcgaataatttgatattataaatttgaaagaataaaaataaatgcttagataaattcttttgatccatcaaaaagatgaatttataatttagaaaatttggaccttaaactaaactgtaataaaattggatcaatagcagttcgtacaattggaagttcgtacaatagacagttcgtacaatataaatttttacaaaataatgcctaagcctaagcttggacctaagcaaaagcaagcttaagcttaggcctaagacccggctcaaaccaaagcttaacccgaaagcttatgcttatttgaagcttttataaaaactgtctattgtacgaaactccattgtacgaactgcctttgtacgagctatcaattgtgcgaactgccatgatcccaataaatttacagcaaaattaattgccttcaccactgcgctccctagggctcggaaaattgcatttgaggacccagcttaagaatattgacgaacataaaaattcatgattcatttttaaactgacaatgttattgaaaaagtgtatttttagactttttagaatttttcagaatttttgagactattgaaaaattttgaattgcatatttatttaaatttattaaaaataataattttgtgtgtaataaagcattgaacaaaatgatagcatatatcatttacatttgctttttcttatattctgtttattttacttctataaaaatcaatttttcactccatttatgcataaacattttattgcctaacattataacacccacagattcacccccccccccccaaaaaaatctatgtttaactatttgcataattatcattattttattatttcattatatagaaaactattgcatcattaattaccattgatcgtctctatatttttttatttgtaaatatgacctaaacgcaaaaatggcctaattaataagataaaacttcattcaactaattttccaaatttgtgtttgaacatgcctataattatgtgttttattttaaggcggcaccttcaaaggcttacaccacccaataggtttgggaaagtttcttggagcggcaacttcaaagggaaacagccccacatggtcgggattttgcgggtgaaaatcccgaggcggtaacttcaaaggaaaacaaccctccaataggttagggattttggaggggtccttccgttacccggacggtttcagggtcatatactattggcgcctcaatcgtcacctaaatcgtgctaaaattaaaatctactaaaattcctaatccaagttttgcacctgtgatgacttttttcaatctgcattagctctgttcgatccgtgtatatggcgaaaatacgagggagagaaagtctgggaaaatggaaaaaaaggcgaagggcaaaaaagcaaaataaaaatgttatcggccgattggcctttgctttaaagaattgtcaatttgctctttcaatttttgagccaattgctgaaatattgggtgactaattttcctatgtcaaaatttgtcccttttattctgctccttttcttcgtgtgctcttacgcatttttttgactattaaaattttctcattttacattttcttcacttcacttcttttcttggactcaatcgaataaagcgcggttacacctaaggatatgcgagaaatgagttttcccgagaatcaagaaacgagagcgagaaatgaccccgagaaacgagactgagaagcgaaaaacccgagagatttctcgagtcgcgaatcgagactctcgcacatccctagttttcccacatttgcgcctcggacatttgcgcctatgtccaaaatcgggttcaaactgaagttttttcaatccatgatagcctaaatagcattaaatgatagaaagtgattgtatccgttaaactgataattttcgaaaaaatcatcaattatccaaacaacagaattactgctcctacataataaactaaaagactgtttttttaaatttcaattctgtttcggctatcagacagggtttgaaaaagtttttttgccacatttaaaaaatttcaagatggacaaaatgctgttgctcttcctatttctgatcatcgtcatcggattgatcgctgctgacaaatgcaacaacttgtatgatgaatgaaatatttgtaaacaattttaatcacttgttttagtccaaggctgaatttcctgtcgcttcagcagcagcggaaaactcgagaatcgcgttgctgctcaatgccaacgagtcgcgtcatgttcggttcagaaactggtccttacgacaaaggcgacgtactttgttcaatttatcatcaaaaacaagtgagtcagtaaaaaaaattctgcataaatttaaaaaaacagaagaaaacattaaacccgtttaaaactttatcaaacaatttttttttggcatttcgtgccttttttctaaaaacttaactttcgtgtttttgaggttatttttgaaattccagatcatagacccatagggctatatttttttctttttttttgcattttttattgttaatttccaaatatggatttattggcggaaacccccaaaatatggattaactgttaaatttatgtatccattaagaatggcctaatgagcagatgcagcggagtgctgttcaacccttctcttgtcctcacgtgtgctcatttctgggaaaaggcagagaaagacggtgacggatcgatggcttatgcgggaatcgaggatggacaaagtgtggaggagggcgtttccaagaaggtgcagttttacaataacaaaaattactacccacttataattatggcaaaaacccccaaaaatttaatttttagttgaatgattcattatgcccctaaccttacccagctatttaaatttgaaataaaaattgaaatatcactttattcacaaagtcaaccatggtttagcccatctaaacaaaacaaaaccatgatacaatattcaaatcttgatttttctattttttgtttttaaatttaattagccattactctgtctaaggacgataataggggcgaaaaacttaattataaaattt

SEQ ID NO: 14496 - DNA, 1913 bp, Heterodera glycines
aatataaataattttttttttttttacggatcactccaaaatgtgcccagaatggggttgatcacaaaagcaacagttgtccagtcacaatcatcagctcatttcgtgtcaccagctgaccccgccggttcggcgggcgacacttcggccaaattaacctaaaaatagaaaaatatttgtaaattaattaatagttaatttaataaaaattgaggaatagaaaaagattaattacataataatattaattaatagagttttaatagagttaatttaatattcttaccggaacaatggcagaagcaccgcctacagcaaagccaagaagaaagcgaaagggaaggatagactaaaagaaatattttttcgatattctcagtggatttgggaggcggaaaatgcgacaccaagaaaatccgacaccagaaaatgcgacaccggcggaaaatgcgacaccgtagaatttttttaaaaaacggaaaatccgacaccgggaaaatacgacaccaaaattaaatttttaaaattatttttaatttaataaatgaaaatgaactacttattttccttaaaatcgaacattgagctataaaaataatttaaaatgatttaagtaatataatataaaatgaactatgattagttcaaggcaattctcatgaccctttagtaaagtggacagcagataatacaaaaaattcttatcagtttcccatttgcatatggacgagaattttcatcatcggcaattaattccctcaaaatatttacccacccacccattctcctgtcgatttctgcaatgtctgaagaaggcgaaattcgtgaggattcgccggaagcaccggaggcagttccacctcaggctgatcagcaagaagttgatcagacaatttttcgtgagaagaaatcgacgcacaaaaaaacaattcttgtccacgacggttatgagtacgggttcgacaaattaagccgtgcagaccccagtaatatttttcttttttaattcttatccgtttgtgtaagacattgagttctatcgctgtctttaccgcggagttcgtggcaacgaatattgtggtggtcgaattcacgtcagttcagcttggcaacatgatgcatccggccgattcaaaatgggacgaattgccaatgacacccatcgccatcccaaaacccacgaatcggcatgattttcgccaatcttattactttttcggcacttacagttggggggggggttagtgtaatacaaagaaaacaaagggcaaaaacgagtttttagttaaagtgccacattttcaatagataagggacgcgcaattggcactacaacaacatgctgtggctccaaatccagttcctcctcggcaagctgtttctcaagcgcgtggcaatattcccatcaatgtccgagcagagcaggggacttcatcagcatcgatgtcgcgaacttaccgcaattacgttgcgagggaggaaattgaacgtggcgacgatttgtttgatctcgccgatgtctcgcaaatcgtaattcctggtcaccttcaagatgcacttattcgtgacaacgttgttgatgggcagcgtttgttcgtgtttgcttctccgtttgcaagaaacattttggcacaatatggtcagcatgtcgcagtcgatggaaccttcaaagtgacttaacccgaaaaattcgaatagtttaatttttataatattaagtgttccccagctcattttacccaagtctacacaatttctgtactgatcgataaggtggccgtcccctgtgtttatggcatacttaaatcaaaatcagaaaatacataccttaatgtttgttttagattttttttaaattagtgatcagtgccaaaatgtttaagatgttccaagcagttgttcaatcagtccca

SEQ ID NO: 14497 - DNA, 2674 bp, Heterodera glycines
aaaatgttctaaggcaattttttggctaaaaccgatccctgacgagttatgggcccggggactcaaatgtcccgctgaggccaaaatttttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctaactcgaaaaattttgaaaattttcgaaattttaaaatttcaaaaaatcgagctttgaaagctctacaataagttcgctgaccaccccccgctcagatcaaaccctggcgcggtattcacctggtactgaagtgtactttttgagcacgcttcagttgccattttttgcaggccaggggtttgctcaaaaaaaattttaaaaaatacctccttgtagaggacccttaggcggagtgccctttcagcgggcactttttgattcgagttttacaaaaaaagttaggggccgtcaaacgcacgaaaaaatgagaaatcagtccctggtactcagttggcgctcggatcaaaaaacctatagttttcccgaattctcctcaaaaagttgtaagacccttccactactttcagacccgtcccattagccgttaagctcaaattagtttttgaaacgaaactccttgtcaatataacgtatatactagcgggtgcgtgaaccgtcggctatttagctgggaaaaagcgcttcgcgctttgggagcttcgctacctagattagctatcgggttgtgaaaagatttggaatttttaaaaaattatcagcgatttttaggccgcttcgcggcctcagacgggcgctacgcacccgttttttaaattcggtgatttttaggctgcttcgcggcctcagacgggcgcttcgcgcccgtttctaatttttgttgtgcttttcggccgcttcgcggccgttttttaaattgtgttgagtcggacgggcgcttcgcgcccgttattaaattttgatggactcagacgggcgcttcgcgcccgtttctaatttttgttgtgcttttcggccgcttcgcggccgttttttaaattgtgttgagtcggacgggcgcttcgcgcccgttattaaattttgatggactcagacgggcgcttcgcgcccgtttttaaatttgttggccttggacgggcgcttcgcgcccgttatttaaagtttgttggttcatacgggcgcttcgcgcccgttattcaaattttgttggccttacagagattagaagaggtacaacagtgattagaagaggtacaacagtgattagaagaggtacaacagtgattagaagaggtacaaaagtgattaaaagaggtacaacagtgattaaaagaggtacaaaagtgattagaagaggtacaacagtgattagaagaggtacaaaagtgattagaagaagtacaaaagcgattagaaaaggtacaacagtgattaaaagaggtacaaaagtgattagaagaggtacaacagtgattagaagaggtgcaaaagtgattaaaagaggtacaacagtgattaaaagaggtacaaaagtgattagaaaggtacaacagtgattagaagaggtacaaaagtctaacttgttatgagatgtacaaaaataatttcataattttaaatataattttatagaattaggtttatttaaaaatttaaaaaaaacaaaataataaaaaatctaaaagtttattttttaattaataaacggaataatttattttactttattttgaaatgaattattatgcatccaaatttttaaatctaattttgcttaaaaataaatctatttttcaaaagaaaaattaaatttaattaaaataattttgttaataataataaaacaaaaaataatttctttaattaaaaaaaaataaatttaaataatttaaaacaaatcttcaaattaattataaacagtgaaaataacccaaaaatgcatagaaaaataatgtacaccgtccgggtccgaacctgccgcccccccccccctcctcataagggtgcctcagaatccccaatcacacagggattctgaggtcttaaccatgtcaaaagtaaaatctgattacgtattcgtgatcaggggcccaaataacccctaaagacatattttttgaagatttttggtgaaaaaatttttcaactcaaaaatcctatgctcacccctttggtccataatcccaaaatcggttttatttttgtaacaattcgtaagaaagtgataaaaatgtaaaataaaatttatattataaagaaaaaaattgcggatttttgtagtattttaagtttcaaaaatttcttttcagaagggggttatgaatttttttctgaaaaatcgaaaattttcagaaattctggaataacttgttttctttttaagatagaaatcccaaataaatcccataaaattctcctgatttttctctatttttataatataattgcacgaaaattgatccacccttcgatttgttatgaattttcaaatattaggccaaaatcccgagggccaaaaaattgccaaaaaaaaaggaatttttaaaaaattccaaaaattagaaacttaaaatagacatcatattcgtactc

SEQ ID NO: 14498 - DNA, 3184 bp, Heterodera glycines
  misc_feature (2866)..(2866): n is a, c, g, or t
  misc_feature (2873)..(2874): n is a, c, g, or t
  misc_feature (2894)..(2894): n is a, c, g, or t
  misc_feature (2896)..(2896): n is a, c, g, or t
  misc_feature (2904)..(2904): n is a, c, g, or t
  misc_feature (2912)..(2912): n is a, c, g, or t
  misc_feature (2914)..(2915): n is a, c, g, or t
  misc_feature (2923)..(2923): n is a, c, g, or t
  misc_feature (2935)..(2935): n is a, c, g, or t
  misc_feature (2941)..(2941): n is a, c, g, or t
  misc_feature (2946)..(2946): n is a, c, g, or t
  misc_feature (2951)..(2951): n is a, c, g, or t
  misc_feature (2954)..(2956): n is a, c, g, or t
  misc_feature (2992)..(2992): n is a, c, g, or t
  misc_feature (2995)..(2995): n is a, c, g, or t
  misc_feature (3019)..(3019): n is a, c, g, or t
  misc_feature (3029)..(3029): n is a, c, g, or t
  misc_feature (3031)..(3031): n is a, c, g, or t
  misc_feature (3042)..(3042): n is a, c, g, or t
  misc_feature (3047)..(3047): n is a, c, g, or t
  misc_feature (3056)..(3057): n is a, c, g, or t
  misc_feature (3064)..(3065): n is a, c, g, or t
  misc_feature (3080)..(3080): n is a, c, g, or t
  misc_feature (3084)..(3086): n is a, c, g, or t
  misc_feature (3089)..(3090): n is a, c, g, or t
  misc_feature (3092)..(3092): n is a, c, g, or t
  misc_feature (3095)..(3095): n is a, c, g, or t
  misc_feature (3097)..(3098): n is a, c, g, or t
  misc_feature (3100)..(3101): n is a, c, g, or t
  misc_feature (3114)..(3115): n is a, c, g, or t
  misc_feature (3124)..(3124): n is a, c, g, or t
  misc_feature (3126)..(3126): n is a, c, g, or t
  misc_feature (3129)..(3129): n is a, c, g, or t
  misc_feature (3132)..(3132): n is a, c, g, or t
  misc_feature (3135)..(3135): n is a, c, g, or t
aataagaacgaagaagaacatttatgcatgataattacctcacttgttgtttgagcattattgaaacgagaaatgttttatgaaacacggctcaatttaaattattgtcccgataaattaaaaaaatatttaaattctatggaataaaataagaaaggatgaaaaagtttttagctgcgattcattacaaggtgaaattgcatttttttagctgaatatacataagtagagtgctcattttgcagcatatgctgttttgccactgctgcacagttcgccagcactataattttttggggtaataaaacgcaacttttaaattttaatcgcagttgaaaaatagccttttaacaggtttcttcgctcaaattcaaccaaatgcatttttaatttaacattgattgtgagtattataatattttagaagatgaatgctgaataggtcgtaataaaataatttttttttaaatctgtagttaatcaaataaatcgctgagtttttcaaaaaattttggtaacgtctggcggtgccgttaacgaaatctgttaagaaaattggtgcaaatcttcaaatacattcattccatttttggactgggcattatttttggcttttcgcaatttttttttgcttcagattttattttttggcgaaaaaatgctaaaaattccagtaaaatacacctcccccccctaattcgggatttcaaaaaatgtaaaaatacaccccctaaaaatcgagttcaaattattgaaaacgagtgattaagctttgttgacagattctatgtttccattaaaaaatttttattttttgcagtaaaatccccatgaacagcatttttgtcatttgcattgatatttatgatggagttgcgccctccccccttattttatccgaaaaatcgtgttttagcagtaaattaataaataccggtttatttgcagtcaccattctgattcaaggcatggcccaacaagtgctaccggacaattgtaaacagggctcaggtgaaattttcaaaaaatgtcacgagcactattgcttatttcataagttttcttaaaaaaaagtaataggacaaaatcactcatgatcaacataattaaatttaaaaatttgcacgaaatgtcatatattgtaagctaaatgtcgccaaatctttaagaacgcaattgacaaagcctacaatgccgcaagacaaatttatcaacaacggaacattggtggcactttctttgcggctaaacacttagagatcgtgttcgagccagctgactggccaatcagcggggggtcgtgcagtgctgcagcggctattgcgctcctttcaaaggccgaaaaggaactggcccgagttgacactgtggtgtcgggaggagtgctgccaaatgggccaatttcacatgtcagtggcctggagcttaagatcacgggcgcaagaaattacaatatgcgccggatactactgccaaccgcaaattttggagatgttgccgaattgccgccgaacgtaacaaatggcattgaaattgtttttagagcaaatatttttcaaattatggaggatatgcatttgtctatgacacaccttctggctgtttagtttttattgttgagaaaaatttaccgctttttattctggtttttattactctaatgcttaaattaaaaaaggaccattaaagctttaggtagcagtaaattgtcattccatctgttttaagcgatgtttttaagaatttcagactatagccaattgtaaatttaaaagtaaaaaatgaaaattataatgagaaaggacatttaaaaaggatttatgggaagagagaggattcaatatgatgaatggcaagaggcagggctggttcccaggttttgaaaaaatattcttctattttcaaaattttagaagtcaagatttcgtgtttatttgctggggtttttccaaattttttgaactgtgggaggtccggcggagccgctaaaacactgctgaaattatgaatttagggtattttggaattttgaaaaataggcattttcaacttttaagcctaattatgaaaatgtaaaaagttccggaattttgtgctaaatggtcgaaatgcggaaccggaatatggaaccagcccttgtaagaagcaatcaaacaaattttttatgaattttgtttgatgtataacagagagaagaaccatatatatatgaagaaggtaaacgaaagataccaagaatgaaattttggtttgatttgataaaaaacagaaataagtttggtgttgtgttgtgtacgaatcacggactaacaggcattgcagcgtattcatcggagaccatttcgacggcgatggcaccggcggtgtttgtgtcggccaggacaacggccggtgattgggtgttggaagaaaagtccaaaggacgagagacagacgacgaagaaactgttagggatgaagcgattttttttttctgaacatggcacgggtatgggataggccgatgtatccccggccgaaacgtcgccggatgttttcggaccattacttttttttgttgttaatcaaattacgctttgttgatgctttcgatagctatgcgttttgttagtgagttcgacttggacctggatttttgtccaggaaatcaaggtccaacatgagattaagtccaggcttttttcaaaatgtcgaacttatttaatttggttgagaaaaaatgatggtccaaaaactcgtctggcgacaatttcgacaacaatgttttgtcctgctttggagattataaaagcattatttaaaattacatatatcccctgcacaaaattttttttcattaaacatcaaaaaattccaatacctactnttatttnnacaaatttaaattcttatantncaaacatnctcccccnannaaaattanaatttttaaaanattttnttaanaaaanttnnntcaatttcacaaaatactcctattaaaacaatctcncanataaattttaaaaaaaataaaatnactcatcacntntaacaaacacnctccnccccttttnnccatatnnacatttttcaaaatnaaannnccnncnttntnnanncttctcatgcttnncctcctcanantcntcntcntcctcaacttagtagtttcgttggcgattcattgacgaagaatcagcag

SEQ ID NO: 14499 - DNA, 988 bp, Heterodera glycines
tatttaagtaattagcgcggtgttaattattttgaatgggcgacggcgtgcgaaggaggcgtctcgacaatcgatgtgtcacaactaatgaaaatatcccggaagttttccgggatcgctgattacggaaatgacaattatttgaatacttagttatcatttattgatcataatgggttttatatttgtgatcagtgatcagcgactccaaaaactgccgggaaacattcatacaagttttgaaaattccaaatcgtagtgtgcaagtttaattgatggaaatacatttttggtaaaaaggtcattttttctattacaatgaagaaaagcaaatgaagacattttaagaaaaaaaaatgttcatacagtattacaatttgaccagggatgggattgatatgtcgttcatttgtgcaaaatgtttaaatgttgggcgaaattattaaaatttcaagattttcgattcattttcgaaaaaacatgaaaaaaccaaaaaaatgttttagcttgccaaactctttaaacctatcaatttgcagtaataaagataacattaagttggggctctcgcatgataccaaaaatgaattaaattggtctgttttttgtagaaaacagtacgaattcaatattagttttaaaattaaagcaaagcaaataggtaaatcaggtgaagataatgggattttatgagttgcacaaatcatctttaacaacaaaacaacgaaaaaccaaagaaaaatatggaagaaaaagcgacagaaacaacgaaaattgcgacaaaaaaaattaaaagaggggactgacaataatgagagagagaaagagattcaatcattcaacaaatgctccaggcccgtaaagtccaaaaatccaattttttaaatttttttgattatgggtctgtctataagagaaaacaatacaaaaaaaagtaaatggccaaaaaagcaaatacacaatatatagcacaacgcactccgtcgct

SEQ ID NO: 14500 - DNA, 2326 bp, Heterodera glycines
cattttacgcgtcccatgacgttttacgcgtcccgtgacattttacgcgtcccgtgacattttacgcgtcccgtgacattttacgcgtcccgtgacattttacgcgtcccatgacgttttacgcgtcccgtgacattttacgcgtcccatgacattttacgcgtcccgtgacattttacgcgtcccgtgacattttacgcgtcccatgacattttacgcgtcccgtgacattttacgcgtcccgtgacattttacgcgtcccgtgacattttacgcgtcccgtgacattttacgcgtcccgtgacattttacgcgtcccgtgacattttacgcgtcccgtgacattttacgcgtcccgtgacattttacgcgtcccgtgacattttacgcgtcccgtgacattttacgcgtcccatgacgttttacgcgtcccgtgacattttacgcgtcccatgacattttacgcgtcccatgacattttacgcgtcccatgacattttacgcgtcccatgacattttacgcgtcccatgacattttacgcgtcccatgacattttacgcgtcccgtgacattttacgcgtcccatgacgttttacgcgtcccgtgacattttacgcgtcccgtgacatttttgagcaaggtcaccctactcccgcttcaccaattcgcatctcgtcatgtgccattgtttaggtctgcttggaaattgctggcttttgtctgcgttggctgtcatttctcaacggcccgacattctcgagaagttgttcattacgaaagagtacaatcatagaggggtctacgaagtcaggtggtgacaactttattttgatcataccgataatcggttttaaggctttgtattcacggaatttggcggcggattatcgtcgacgattttttcccttgtcatcggtcaactaaacgccaaatttttgcggtggggaggagaggccaactttgggtgtcgctaattgagaatgcacttgcgaagtataatggcaattatgccatcctgaaatccggactaatttcagaaggtataaataaatttagtggtttgggcggttactacatgcctttttttaggattttcaaccctcaccgggcagccaaccctttttatcgaccttgaatttttgagtgactccgactttgacatcgtttgggctaagctgttaagtgcgagacagctgttctttttgatgtcatgttcttgtggtgcaggtcagtttttttgcaaatttatttcgacccttcgttgtcccattttccaaagtaaatacaattgtcgccgctggcgactgaacgcgtggaaattgggggacagcccggaggatcgctcggaggacagcccggaggaccgctcggaggaccgtttggaggaccgcccggaggaaagaaatgaggaagtcctgtggaggacggaagaagattctcgaatgttcccttgtgatctttgtgattaatattcccgaagtttccccatttttcatttcctttcaggtgtgttttagaattttccctccctgtccaaatctcatatataaacccgaatatttccctttagaatcgctctcgaaaaatcattattccatcctttgattgtgcgctattccgacaaataaactacttcttgtctaagaagttttttgttccgaaggtgttcctttttctctacggtttcgacattcccggaactcagagttccgtgtttgcatttgtctaagctcgattgtcccgaagtccaccaggacagttcaactaagtctaaaggggctgtccatcccacaagtccattccaagagtgaaaaccccgtcccattcgctaagttcaataacattgtcgcggagcgtgtgcaaaccgacagccgaagcgcaaccgaccagtccagcaaacccgcacctcactcgcttcctcgacaagtggcgctcctgggaacgcgataactggcgctcctgtaaaacgaccacacaacaagtggacctcccgaaaagaccatcatgagcaacctaatccggatggtactgggcccacaagtggcaattcttcgtcaacgagtaaacacggcacggacacatgtcgaccgtgaggaagatgaagaagtcaacaacgctgcgctgatggaagcaaaagtattgctgttaaaagtattgcagcgtgtggaagctgaactagcgaaatgggaaaacgtgatttctggacttcaaggacaagaaaaacagacagaacaagaacgactcgagacattcatcaacgaaagagaagtagcgaatttgctagccgacgcacatgctacgatggatgaaatactagtggcactt

SEQ ID NO: 14501 - DNA, 2270 bp, Heterodera glycines
  misc_feature (2248)..(2248): n is a, c, g, or t
tagcaaaggcaacttcaccgttcaggttgccgactcatcatagtcaaacaaagacacttaactaattactcaactaattacccttttctcctcaataattttcaggtgctttccccgagtataatgagtgacgacgtttcacctgatcagttccttcgcggccaatggcaaaatgcgtcgaagccatcccaaatgggcggctgaccattaaattcactaattggattgattggtcttcccgtttctttaaattttattatttatattgttaaaactcctcaataaaccacaaatcaagttaaagaagtgatccatgctttttaggccgtcaaaagtttaaattttaaaattaaaaatagtttattttcccgaaattgccaccagaggtgcttttgccataataaattgttcgttttcataattacaatggcttttccatcattgcttttgcttcgttccgtaggtgtcgttgatattcatcgcctgtaccattccggcactaaaggaactccccgggggcagtgcccctgcggggtattggcgattgatgttcactgattggagcatttgtgcattccatccgccatccccgcactgttttacctccgcgtaggaccccctgaattcgaattttgtcgaattagggtcggaatttgaatatgtcaaatgatttacgcgcagttgtacggtttggaaggcgtacagcccgtgggttgggcattgcacgggcgaatccgacgctggatgttcaaatttggatcacaagaggacctcaaaggaccaaatgcgttatcggtgagtgctcaatcactgattaaaagatacaaaccgaccaaattgcccaatcgccccaaatgccggagggggcgcaagaaactaaagagaaagtgccaaagatgaggaaagggtcaaaaaggcaattatttactaccgacggaagcagcactattttgggtgccaacgaacgaagaaaggaatgccaaaaacgtaaagagaaagaggggaaaaaggggcacagagcagacaaaagagagcattaccaaataaataatttaaaaaaatgaattttatggagacggagggattcaattgatggcaaattggcagacgatggggagggatgaaaaaagataaataggtaatccattttaattggctattagggaagaaagggcgaacgaaacgaacgcgagacacagccaattaattggcaatcagtgaacaatttttgaactatgaaatacacaaattgtcaaaacattcaattatttatttattcatcaaattgttcaattatcagtgaatcatttaaaaggaaattttcacattttaatgatatttttacatttttacgggtcacaattaagctcgaaaaatagcgcgaggaaaagcaaataaattgttaaaaacattttcataccgtattatataccgtaattctctactggcaaaaaaaaaagaatttgggcggaaatggagaggcaatggaagaaagcgaatgactgactctgatcatcatttgtttgtttgttcttttttttgaccagaaggataaatcaccgcagcagcgaaggcaaaagaccgccggaggatttaaatgaaatcttaaaaagaaaaaataaaattaattgaaggccaataaattgtattaaatgccactctctgatttggttttttgatttgatttgacctgaattgttcgtcctcccaactgagtcccattcagtgcattcgctgctacaattgcctcttcataattggccatgctaatcgtcgcctgtccctttcctttggacaactgaaaaggattggcacttccaatcattggcattttatctttccgaccttcaccgataggacagcaccgaatggtccgaacattcgccacagcgttggttctccgacctcagaggccaaattgtgcactgacagagaccaaccgccggccgagggactgtctgacccattggactgagttggcacggcgcactgctggccaatggacgaattcgacgcaaccgccgcggcaatggccgcagcgtactgaaaaggtggagggaatgtgggaaagcggagaaagacaaaagaaactaattgcttataggtcattagaattaccaattctgtttctgggctgatcagtgattgtaagtgattcccttccctctccttcccccattttcacctgttgttgctgctgtgccgctgccacggacagtgccggatttgctgctgctaatgcagtcangtgttgttgcaaaagctgttgc

SEQ ID NO: 14502 - DNA, 1511 bp, Heterodera glycines
cggtgacattgtcggacaaaatacgcgaagtgataatagtgccgaagggacggaacaccgactcgagctcaaattgggtcagagacttaggcagtccgctgacgtacagattggcgcccttaatgtcatctttggagggccttgccagggacacctgtggcggagaggggcaaattgggaagaacgaaaagcgcaaaaattgggggcgggggaggggggcggggggatgaacgcccccgggggtgcgaatcgaatcagtgaggagacggaattccgccacccgaaattttttagagcatcggaattccatatcactggtgcgaatggaaatcggtgaatgaacgagaaaaactgagtggatttgttggcactcaaaaacaaaaacaaaaaaaaaaatagaaagaaaaccaaaagcaaaatgaaaatggaaaaaaaagaataattcattgtttgtcagcccatcatccgatttggacacaacgcaaagaacagaaacattaattaacatgattaattaactaattacttaattactcggaggaactgaaaaggaaagtccgtccttcgccctcacctttagcactttgttctgcagccgaagtccgttcattgaggtcagagcctttcgcgcgtcctccggccgctcataatttacaaaagcgtagccaagcgattggcctaaaccgaggagttcggaagaagaaaaagagggagcaattgggagaagggggggtggataatgccaaacggaaaatacgaaaagacttggcatggcattcccccgggggattattaagtcaatggaaaaagtgaccggaacgaaaggacaaaaaaaatccaaaggaaatgaaaagaaaagtgaaacaacgacaacaaaaacagcgcagcattcatcgcgtccatttaacacacaaccaaatttagaagatgaaactgaggtgagttaaaagcattggaaagaggcaaaagatacggtggaaagaggggaaggaaagtggaggagtacggtagcagagaatgctgaaaaggtacggtaggaaaaagcactcaccggaggatttgtcacgaatcaatcttaatcaaaatgagtttttaaaatcaaagcatggaaatgattgtctgttattacttgcacgactccacttcgcccatcgaaccgaaaagggcgcgcacctaaaaacggagagggacaaataaaacggaaggcaacactaaaaatgaaatctaaacatgcgaaactcatagtaaaaagtgaaaaaattgccaaacacatgatatgaatccgaaaatccaaaaattcaattttaaaagtaggcatttaagctaaaaatgccattgttttttaacgttttaaatgggctgcgtttgttcgtgggcatttattcattcatccgctttctatgccacctcttcctgcgtcatgttctgcggcaagtagttgatgatcaggttggtgttccgttccgagacctatctctcgcgcttttcccgctcgtcctcccctccgtctc

SEQ ID NO: 14503 - DNA, 2965 bp, Heterodera glycines
  misc_feature (48)..(49): n is a, c, g, or t
  misc_feature (51)..(51): n is a, c, g, or t
  misc_feature (55)..(55): n is a, c, g, or t
  misc_feature (58)..(58): n is a, c, g, or t
  misc_feature (61)..(61): n is a, c, g, or t
  misc_feature (64)..(64): n is a, c, g, or t
  misc_feature (85)..(86): n is a, c, g, or t
  misc_feature (88)..(88): n is a, c, g, or t
  misc_feature (93)..(93): n is a, c, g, or t
  misc_feature (103)..(105): n is a, c, g, or t
  misc_feature (110)..(110): n is a, c, g, or t
  misc_feature (114)..(115): n is a, c, g, or t
  misc_feature (117)..(118): n is a, c, g, or t
  misc_feature (122)..(122): n is a, c, g, or t
  misc_feature (140)..(140): n is a, c, g, or t
  misc_feature (148)..(148): n is a, c, g, or t
  misc_feature (156)..(156): n is a, c, g, or t
  misc_feature (162)..(162): n is a, c, g, or t
  misc_feature (168)..(168): n is a, c, g, or t
  misc_feature (174)..(177): n is a, c, g, or t
  misc_feature (184)..(184): n is a, c, g, or t
  misc_feature (192)..(195): n is a, c, g, or t
  misc_feature (202)..(202): n is a, c, g, or t
  misc_feature (206)..(210): n is a, c, g, or t
  misc_feature (212)..(212): n is a, c, g, or t
  misc_feature (214)..(215): n is a, c, g, or t
  misc_feature (217)..(217): n is a, c, g, or t
  misc_feature (225)..(228): n is a, c, g, or t
  misc_feature (235)..(236): n is a, c, g, or t
  misc_feature (238)..(238): n is a, c, g, or t
  misc_feature (241)..(245): n is a, c, g, or t
  misc_feature (250)..(253): n is a, c, g, or t
  misc_feature (259)..(259): n is a, c, g, or t
  misc_feature (262)..(262): n is a, c, g, or t
  misc_feature (267)..(267): n is a, c, g, or t
  misc_feature (270)..(270): n is a, c, g, or t
  misc_feature (274)..(274): n is a, c, g, or t
  misc_feature (281)..(281): n is a, c, g, or t
  misc_feature (286)..(286): n is a, c, g, or t
  misc_feature (289)..(292): n is a, c, g, or t
  misc_feature (297)..(298): n is a, c, g, or t
  misc_feature (304)..(305): n is a, c, g, or t
  misc_feature (308)..(308): n is a, c, g, or t
  misc_feature (311)..(315): n is a, c, g, or t
  misc_feature (321)..(325): n is a, c, g, or t
  misc_feature (328)..(330): n is a, c, g, or t
  misc_feature (332)..(334): n is a, c, g, or t
  misc_feature (341)..(344): n is a, c, g, or t
  misc_feature (352)..(352): n is a, c, g, or t
tgttttagtctgtgcccaccgatcagtttgccgccgttaggggacggnncncatnggnganaanaaggagaagcctttcacgggnnancagancacggcaccnnnaggcnaggnncnnaaanccgccagaaagggcggancgacaaanaaaaaaanaaaaanaaaacnggcaannnnaaaggancaagaaannnnaacaaanacannnnnanannanaacaggcnnnnaaaaaannangannnnnaaaannnnagggcnaanagaanaanaggngaacggnagaangannnnaaaanngaaaanncgnggnnnnngacaannnnngannnannnaaggagnnnncgcaaganaaaatcatcaagaaaagtaaaagacgctccccccaaaaaattaaaattaactattttattaaattcaaattagaaatttttgaaaattttttagatcgatctgtcctcccattttcttatgtccgtttcgccagtgatcaatcgaatgctcagcgtggagatgaaggaaaagcagcagcggtcgctcactttggacgagttgggcatcgagatggagcagttcatggaatttgtggaagccatctcaatcactgcttttcacaagccaattctaccaaatcgtaattttaatttattattttttttatttgtaatggctaaaattttgccacaacatatttttggcaacaaaattcctcttaacatgaatatggatgtcattgatttcgatcaattttaaaattgaaatcgaacaaaatgtttattttttaatttttaatcattttttccaagatcgcaatgactgaatagatatcatattcttgatcagtaatgatttaattatttggcaaaatttaagacaataaataatcaaatccattcaaagaaaaaaaatgctaaaatcttagcacaaaatgtgctcattctgctcaaattggccgactatttccaagtggactggctgaagtcgcgctgtgaggcgtatctgatcaattgcccggaaattccaataatcgaccgttttttgttgatcgatcactattgtctcgacaattttaaggcataatttttcaaaaacatttcaattttaaagaaaaatttccccatttagaattattttttgaatttggaggttgacaaattgcgtgcattttacaaggctaaccgcgaccaattgtcgccagggaaaacggctgtcagtgatcaattgttaggggaattggtcaaccgactttgtggatgatttgatattttgcggaaaaaacagtaatgaattggggacaattaattaatggggtgcggatttaagggatgaaaatttttgaaaaaggcacctaaaataggcacgaaaaaatgaaaatggcaaaaagagaataagtattaacaaattacggaaaatttttttataaaaataagaaaaaataaatcaaaggctttctaagattttcttttcggaaatgagaataaatccattaagtaaaatttaaattttaaggtggatggcaagattggaaaattggataaatccaaaatggacaagaattgaagggatgttaatatgctttttaatcaaaatgtcaatttttgttattttttaacataattataagcatattgttgccttttgttatgaaattctgaaataaattttcatcgagttatttttattctttataatttaataaaatttaaaaaaattgttattttccattccattgctcatgtgggattgccagtcaacaatccaaatgcttttgccccgggttgctgaacgtaaagaaaacatttgatttgtgacaaaatttcatttatttatttttttttttttgtggtttcacggacgctgggaattcaaggtcctccagggtccctgtccaggtagctaatatcggcttttctggtcccagttttcccaaaatttgtggcctggtaacagtttttttgataaaattaaaattttttattaattttcacgcgttaaagaaatttgtaaattttttaaatttaatgtgcagaagaacaaaaaacagttaaaaagcaaattattttatcatttaaatagatagctctgaaatttaaaattttaactatcaaaagatttttcggtgaaggagctcagcagtgccgacaaccaaatttgcctaaaaatttccgaattttaaaaatgccgggcacgtaatttttgttccttttttaatttttcatgtcatttgtgggattttctggaaatttcttaataaaatagaaaacaagaaagaaatagcatcactaagaattgaccaaaaattttcaaaaaatattcttcataagaatcgattttttttaaataaacctttaaacattttcaaagtgccacccacataacattttttaatttttttttctgaatcttaaaaaatttttcgagcttttttaaagtttgcagggaattttaatggatattttctgatacaattgtttttttttttttacaaaagtgccgggtcgttactcaaaaaccatcaaaatgcgcgtctcaaaaaaccataaaacgaaaagttttgatagaaaattgttcataacttcgcctaaaatgaatcaaattttaaattgatatcattcgatagccctaagtgttttctattattctgcaaatttcaaaaaattggttatttatattccagaaagttatgacctgagaaactcaaaatctaagtttttttttgaacatttttcgtcataacttccttgaaacataacgaaactttttgagattttacaagataatagataacactaaaatttggttgactttgagcaaatatatatataaaaaaaaaaaaattattttgacatttttttgagtaacgtcatagcaccaaaaaaagtggcgaaaaattaacgtgtaaatgttgagggcgcaaaaatggagggtgtaaatgttgacttacccattttaagtggtaaaaaata

SEQ ID NO: 14504 - DNA, 4249 bp, Heterodera glycines
  misc_feature (4220)..(4220): n is a, c, g, or t
aatttttcagttgggcattcaaattgcaaatgaatgactcgtgtacaattcacggcaaaaaattcgattgctcatttgcgtggcttttggaaagatacaaactctcagacaaatttgcaattacggaaaagattgtggtaattaacaaaaatttgcttattttccatctgcaataagaattaattatatttcgaattttaattaaggtcaaattccctgggcatcaaaaatttgcctttgtggcgggcgccgataaaaaattttttccgtcattgaggagagtgatcgcaaacataaaaaaaaactttggctgcaaccaaaaaatcattttctatgatttgggaggggtgacagaaaacgaaaaatgggtaaaaacgtaaaaacataattaaataattataaaatataataaaatgaacaaagttaatgagaatttcacaaaaatcaaacacattttaatacaattgatcattttttttactaatttaaattttttttaattcaatgttcccaaattttaaggttgatgaattaaattcgatatgcaactttgaaaggcacgtgttcgatttttctcaaatggtcgatggttcggtgcgccgcctggaaacttacgcgtggaaggtgtttttactcgcggtaacaagcaatttttttggtaggggtcagttgtatgtctgagccaagcttaaaacatcataactttttccgtgttgaccaaattttataaatttagtaatcagtggaaagctatatgtttagaaaccgttgataagttatttctaagcgattaaacaactcataaaaatttgcaacaataaacccacaaaaaagtaaaccataaaaaagtcagaatttttgaatatttttatttataacttttttacaagtcagtttatctttgtgatttttgagaagcaacaaagaaaaaagttatgacggacgttttaaacttgtctcagatgcaactggcccgctcagatttttttttgtttattttaaaattccataagctttttttaattttaagcatgttttgttggagtatgacactgtcgtttgggtggacacgacaattatctttgacaatttcaatttgacggcgattttgacatcaatgaacgagggtagaattggaccagtacaaatgccactaggtggggcatggaaatttcacaaactaatttataagagttaattgttgttttaaacttggttaatttaagtcgcttggcatggcacaaacattgcaacgcatccgggtaaacaaaattgatttaaaaagggtatttttaaaagttgatgatagaagttaattagtgaaacataatgagtagagaaaatgaaaaactcaaatttgacaaaaaagctgatctttgctaagtcatttgaaaaattatgaataatttaaaaccaaaatccataaaagcttaaaacatgtaaaaatttacaaaatgtaagccttaaatggggcatttaacagatatagaatatacacaaggcaattatttcgaaagtcagtgtttttggaataattccttattaaagttccaaaattatttgtgtgttttacattcgttttatcaaaccaaggtcatgaaaatttgtggcctcacacaattaatattttcatttttaatttaaaagtccattcattttccaggaatgtacgaatttttgccaatgttcagcaattttgaggccaaaaatggaataaactgacaaatgacccaccacaattcgagtccgcccttatcatcattcacaaaagcgaacaaacgcggcaactgatgaaatggtacaaaattaacgggaatttaagccaatgccttaaaatttaatcccgtttcaaaaagtgatggaaattcaaattttgtaaaattatcaagagttttgacggctaaatattaacggcgggcatcgactcaataatttctaaggaaattgtgaaatttgcagggaaccgcgcgtcttggaacatggaaattttattaattaatattagattctaaaatataagccaattagcaaatttaaaataaatattttaaatgttcttcacttaatgtgttaccttccctttttcatggctttgctttgtgccgccgaagccaactgtatggtgccaattggacagacgattcactgcctttatgtgccaaacatgccgatcagtccgccgaacgcgacttgtcaccgccaagaacagagtctaatgacaattctcgtatatgacttggaattccgtcgacaaattgagggtttgtttgccaatttacaatttcaaaactcatttctgattttttggcattttgtgacagattcttcatttttgacacaccaaaatccccagcatccacgttggaccaatcgctattccaaaaccaatcgtcttcaaactttcgctggaacctctgatgaatgggttaaaaaagtaaaatgttgctgaacggaaacgcatcccatttgtcatggtcataaattaacaaagtttaattgactaattaaaagatttcatcatctcgaatttctatttcgaattaaataaaaatactaatgttgacgcaaaacaaatttcatttaatttgtaataagcgaataaaaaacaagataatttttattattgactgtgaaatttattttacaaaatcaaaaattccaaaaatattaaaattataattaaaatgtttcttcaaatatagaagctgaaatgttgattttaaatgaaaaatctaatactttgtcatttttgcgtaatttttttattgagtctgcagcgggacttttctcaaaaaatttcgagtttcacctatcacaattttgacatttttataaaattctaaaattctttaatgacattttttgttattcatccctatgaatcaatccgcacaatgcattttttccattaataaatttaaattaacaaacattcttttcttatatttaaatgcacttaaaaattgtccccattcttcctttaataatttagcatttatttgaattaataattcaagaaaatcttttttcctaattatccgcaaatgtctttaagcctctttggatatgggacaacaccaatttctacaaattacttcaattagcattcattcataaattcgaattatttattcattttttctccattatgaaaatgatttcgttttttttatcttttgcttaatcatcatactctgtccgtccgtccattcccatcactattcattggtgatcggcagaattcattaaatattccataacaattttgtgatattattaactcaaatttatatatatattcattaaattttggagaatttttttcgaatgaaaaaatacaataaaaaatatgcttaaatatttaaatatatacaaaatcttttgcatttttagaataaaaatgggttttttaataaccaatgtaatttctcttttaattgtgctctccaaattcaccttttgtcagttgtcatctgatcaatcgtaatgattttttaatttttttataattcaattgttcatttggcaaatttcagcgatggattcaaagaagtgccatttcgtccattggcacattgccatgctaacaatgggtcgaatgaaaccacactgaattattacggaattgaatttcgtctgacgcgggaaggcggaaattgtgacgatgggtttgaaaaaaaacaataaaataaaaattgaaaataaatttacaattataaattattttcaatgacttaaataattaaatgttcaattgatagccttctcatctgttacccggcactgcttcaaaatggcaatcattggcacatgaacagcaatttcaagaacagaaaaaaattcatcattaatgcccaattggtaaatgattacaaaattattaatttttaattgactttattcagagcaactcaattgaaaaggaatgtgcgcaaaaaatgccaaaagatgtcggtaaaaacggcacaactctttggcgaggcctcaaagtgcgcacaatgccaacgcaaaagaacgatggaagaagcttcatttttgagtcatcatttgcctcagagaaatagttagtgtattttttaaattttttaagcaaaaatcggaagtgaaatttttaaattttaattttaatattaaatttttactaataaatatttaagcaactttttacacgcagaacaacgccaattttctgttcttttcaatttgaatcaaactgctgngccattcactcgcatttctttggtggaaa

SEQ ID NO: 14505 - DNA, 1525 bp, Heterodera glycines
gatcattttttgatcagaacatagtgtagattaaatattttggaccattttatgccaatttttttaattgtaaaaatcaattaattttaatttttgcaaattctctgatcactttttacttctgatcagttatggctattgaacattcatttgtcggtggcccactgtttgcaccgtttcattgctttgctcgcccattttcaacaacacgagccttcggcacaatcaccggcattggcacaatcgccaccatcggacgattcagtaccaaatgccgtgccaatgccaacaaaatttgcgcaaaattccacggcaccaaacagaagcagcgaagaagaccaatgccagcagagaaattgatgaaagcaataagagatagagagagagaaaaggaccatttttaaaattaaaatgccaatgctggcacccaatttttgttttaagtatgccaaaatgcctaattagccttttttgcatttcttttaaattcattctttccatctttcgttgtatctgatctctaaattttttgaatattgttttatttcaataaaatgaatgaaaaattatagaaaaacaagaaaaagcataaataattaaaatttaaaattcaaaatgtccaatgttggcacccaaattttatttgaatactgtgataatatagtgatttaaaatatgtttgcgttctgttgttttaattttatgccattttgtttgtgattttgggtgatacattgttagatagttgttagtttatgctttcgtcagttctattgattgtcgtcgactatttaatttggaattaaacgataattgtatcttcggcattgggctgtgttttgtgtttgcttggagctgttgtctttgctgtgtgcaacaacaacattattaaagcccctgacgacaacaacgctatccgttttttacgactatatccaaagtgtcagacttttttatttatattttttttacacctaaaaattaattttctttccatctttcgttgaatgtgacctctgaatttttttgaatgttgtttattcaataaaatgaatttctaaatcagtggccaattttaatggaacctttctcaattttattcaaaatgaaaatttcttcagagtgaaggggaggaagggagaacggcggtgatcaagccctgaaaaaaattttaaattttaaaatgaacgggacccctaatgggtttaaaatcttatgtttgagattatcacactcaatttatcccatgtaaattcccaccccctcaattaggcgcccacaatggtaaaattaggagacaaatttatttattctataaaaaaaatttaaatgaaaaaaatggaaaaacaaataaataattgaaaacaacaataaaaatggcttaaccaacaacaattaaatcaaatcaaattccatttgatcatttctttccgcactttgtttttttgttgttcaagtgcccacgcaaatggcttagccgagcaaaacatttgccactttcggtgcactgaatttgaaattaaat

SEQ ID NO: 14506 - DNA, 2151 bp, Heterodera glycines
attaggcaattaattaattaattaatcaataagtaattaatttttcattgtattgtacttgtgtcgttgaaggattgatggagctcaaaaattgaataggcagcagaagacatttttttgtggataaatggtagaaaattccgattaaaaaatgaaagaagcgaaattcttaaaggaaaattaaattgaaaataataaaattgaaaaaatggggcaaataatttcagagaataaatgagtcattattttaggtaattcgaaatttactttttttgtaaaattatttgaataatgaccaatgatcaaagggcatataaaaatgacggcattttcaagggaatggcacaggtcagaggatggataggagagaatgttcgtctttggtggaaaaattgccgctgatgtgaccgatggacgccgaaatcagccgatttggcatttattaattaattgggggcaaaatacggacaccggcgagtggcgtcgcacttaaatttgtaagatttgaaattgttttttaaattttattttttgtattttaatgaaattttttgcaattttgcagcgggttaatacataatatgtacatagagcatgtcatttgtaaaacatcaactatattaataccgaattaaacaagaggaggaaaaatgagggagcgattaaatatttttatacaattttttttattaacctcccttaaattcattttttatttgttttttaaaagatacaataatcaaggtagaattaaaaaattataatgattaaaatagtacagaaaaaacagctgaggaatgaagaaaatttgaaatattaaagaaaaatgagctttcttctgctgctgaagagaatgagtcatcatttttaagttgagatttaatttaaaataatttaaaaatcaaattattaattttaaatgatggaacttattaaatgttaaattaatggctgaattcatgcaaaaacttaggcccaaaaataatataaaattaataattttataatttaatttaaaaaatgataataaaaattcaattttattttaaaatgcgaattattttctctcaactgcaaaaaaaaataataaatgattgctttttcatccttagatacaattattggataaactgtataaaataatcattaccaggcctacaaatgttaactttaaagcaaattatgtggcaaatttcgccaacatttaaagccatttaaaagggacaatttaaaaagatcgcacttgaaaatggagaaaccaacaggaacatcatccgattcatttgctcaattgtgatcagaatgatcactttcaccagagcgaaactttgacactcttcttctctaattgctccacgagagtgctaattgcattgacgagagtgtccaatttgtcattgagagtcttggtttgttccacgagagtgtccacacttttctgttgcacatttttgtcttggtcaatcttctcgatgagagtgtccaatttctgcccaagtgcatcaatttggttgttgtttatattgtcctccttcttcttcaccagagtccacaaatatcgttgttcataatgtccattatcttcgactatagacacctgtgaaaagatggggaaaatttgggaaaatggcatttttttccaaaagaaaagtgccgagaagaaaatgaataaaaataataaattggggacgaaatggagcattttttgcgggcatttggccatagtttttgtggcaaaaattgcaaatttaaaatttaacaaaatttcaattagttttgagaggcttaatgggaaaatcaaatagtgagaattcttttcattttgcccttcctattctggcgtcacattctatggtttgtataatgtgtaattattataccttctattctacggtttgtataatgtgtataaaatggcgctggacgcccaaaaaccttttgctaaactgactggagattcaccaaaagcttttatttgtgctccgaatcaaatgtgaaaaggcaaggactgaatgaagcaacagaatgatcaattccccgatctttgcccaatatgttccgatcagatcagcagcaggtggacaggtcgggacgccaaatgcaagaaaagcaaagggtgattgggatgagaacaattaattgccaaagaga

SEQ ID NO: 14507 - DNA, 2514 bp, Heterodera glycines
aataaattagcagtttaagttattctgttcattttccctataaatgaatttttggctttttctgacaaccctactcatactattgcaccgcctcactctcaattagcaaattccgattcattgagtgccgttggggtccctttccggcaaacaaagcttccctcccacaatcagtgctttccgtccgttcggcccttccgtttgacacttccgtttgtctgcccttgtcgccaaaaaattggcgacaagctaatttgtgcatagactaataaaaaaaatttaattccaaaaacactaaaaacaggtaaaaatccggcacctgtacaaacccgaaacgaaacccaaacaacggaaaattccggcattttcaggtctaatcgcacaatggtctgacattaatttgcatatatttgaaaaaaatatgtaatttactcggatgtctgctgattatttgatgcgttgtaacaggaaattaattatttagtcaatacaaaaatataaattatgcgtttctcgtcaataatattaaaattatattcatattaaatattatttccattttagttttttatttttctatgaatttttcggcttttaattttgccgccctttgccttttattttgtctctgttttcatccgtcaaaaaatattctcaatgcaacaacaaattcttcgccatcttctccaaaaaacattggaatattcacaaaactcggaaaacaaaattcaaatgttgttgcgctaaaaataagttaaaaaattattaattcattttgaagcgaattttgattgaattaaattattatttattatttttaatatattttaatgaaattaagttcccaacttttcatcgatgagctcttcacaaaattattcaagtcaaaaactgtttaaccaaggcaatggaattttatggaacgaaagtggaggagcataatgacaaataattaaaaaaataaattggtttttattttgaattaatagcccaaaaattaatttaaaaaaaattatttttaaatcacaggtggacgctttaattcgaagctggccaaaaacaaagctgtaaaagtgttggcaagaattgactttccgaaagatgggaaaagccgtttcaattacgaaaatcaattgcaaattatgttgggcaatcaaaagcgacttttaaacgagcgaattgtgctcaagcagaccatttacaagtcgaatcaaaagcagaaggtgggacacggcttaatggccaattctaaggcccattaattactaaggatacgatttatagtgctaaaaactgccaaaataattagtttttaggttttaaaaacacccaaaataggtgctaaaaatgggaaaatattgtaggtgccaaaaagtttcaaatttaggggtataaaatgccaaaatttactcaaaaaaagtaacaaaatcagtattgagataaataatttttaaaatcaaatattcttgtcaagaaataatttttgtgaaaatttttcataataactcgaaaaactaaaaatatcacgcctgcccattatttttgttagttggccaaattcaaaagattttggtagagcattcgggggataacaggggatttatcggatttagtcgacttaaacaatgccgaaggaattcaatactttgattaaaaaaagtgtgtttagttaatcattccttacgagatttgcgcactcaaatcggcgaaattagaagtggaaaactcaagaaatctaaacaaaattgacaatgaaagtcttaaaagtaattatacacaaattctcagcggaagtcagctgataagaataattgcaaatgcaatgagcagagaaattgaccaatttaacaatgcaatgcttctcgataaaggcgatgtaagtgatgagcggatctgagaagcaatttgaaaagtgattaaaataaaaataagaaaaaacatttaatactaattggggatcggattagtaagcaaatgcaaaatttcatattttgcatttaatttattaaaaaattggttttacatggttttcactaataaattagaaataactttaaaatcccacaatctttggtcaaatccgacccttaatgataatcggcaatttaaaggaggaattgtggcggatgtcaattggacatcatttccactaattgttttttaggagtctgtgcggagagtcggctcttcggcttttgccggcgctgacgagaaggagcagttgcgcttcgttggattggtcctttggcatttggtgttccgcgactgtcccatcattgacccgacggcggacgaatttgtgttcatcgcaaaggtcgagccgagcattgacgccaccgacccaaatgtggcgatggcattctgtgccgaattggacagcgaattggcgcgaaaaagccaaccgaaggagcaaaaagaagagaaaaaagtggcggaaaaaatgcaagagaaaattgagaaggaattcgatctgtttgatagagtggaggacaaaatattaaaagacaccgcatt

SEQ ID NO: 14508 - DNA, 944 bp, Heterodera glycines
ggaggaaatatgggacggatatggcctctaataggcagaaaatgaactgatcagtgatcactttagaataattaaaatttatactttatagtggaaaaaaacaatgattaaatttttggttttaaattaattcggcctttttaatataaattttattgcaaaaatttattaaaatgaaaatcgcctccaaatttctatttcataattattgaaatttgaatgttcattaacaaattaatgtgatttggccaccgttttgcaaaacttttgctgacaattttcgtgatgcctttcaacaggtgccaaatcggacaatgaccaattgctcaacgaatttctctgctgaaatcatgcgtttttttttgtaattagttaattaactgacgaattaccgatttattttttgccaaatttggcattgttttgctattaaaattccagttttctgctttgccaatgttcaatgtgtagtttgtggcgttcgttttgactttgcattgtccaaattgctcctttcgttttaatctgttttcaaaatttaattttctaagtaattagcgaatataaataaagcaaagtttaaaatttaaatttaatttttcctcatattttggcaacctttccgccttatttgggcaatgattcgtcgccttttttcgacacggccgaaaatagaaacaaagcgcaacgaccacagtaaaaagaacagttaaaataattaacaacggaatttggtcagaacggtacaaattgttcaaaatgtcggcgactgtcaaaaatagaggaaattgtgcgagttatattatcattaattaattattataaattaattagtttgattttgcttacatttattggaatcgcagttgatttcatctcttcgataaagacaatttgaacgaccgttgcaaattaatgctaaattttattggaaatgtgtttaa

SEQ ID NO: 14509 - DNA, 1496 bp, Heterodera glycines
ttgctccttgcgattgcctcgtaacgctcgagcgatgacagctttcgccataatttctttcctctctttgcaagtttttgagtaaacaattaggcggacgcccttttttaaaaggaacaaagcaaaacaaaaaacgttgggctttatgtgattattttgctaattcgccaaaaggagttcaaaaaaaaattgcagaatttaacatgagtcaatgtttcactgaatttaagggcggttggttatcttttaattctgaataaataaccaacaacaaatagaatgaaatttatagcgaatcgagcaagcgaaaacagtaattaggagatatttttaaacatagataacagcattcgtatttttcccgaaattcaatatatataaattttattaattcagatttaatcaaattaaaagtttttttttttgctttctttttttcatttgcttatttaaaaattttggcgaatgaggagaccgcggtgcaggcagataaacaataaataccaccgacaaatatttttatttgaatagattcaactaaaattttttcaaaaattgccgataatctgaacaagacaaatacgaatactgttatttaaatttttttatcaatgagaatgatcaattagtcaatttatgaaggacttgcttcagtgggaagttgctgaacattctgttgctgatcgtccttagatggaaaaatttaaaatgtatttgattagttcaatatatgcctcattttgttgttgctttttctttgggagattcatttcctcaatgtctgcttgtttcaactttattacacttaagggtcgacgaatcattgaatttcggacaagtgataatttagcgtaatctaaaacataaaaaaatcaagtgtcgttttgggtgctccttctcaattggcgattcttttatccgacaaaatcaaaacttttcaaaatgaatttttggcgaaacgttctattctcgatatcgcaagaaactgctaaaaacagctgaaattctttaagatcagggaatacctaaacacagtcttttagattatgtgtgtgtgttttttccttctttaaataatttgtgcacaatgttttttgtgaaattctttttgtttttttttaaattttcctttatttaccacatgctaactttcctttttgtttagaaaggcataataaaaatgtctttaattaaattagttgtgaaaacgattgatgggaaagattccatcgttcgagtggatccgaaggttgttatttaactcaaattttttctacattagttggttttaattgttttattattagatgtcactcgaccaccttcgccatgcaatcgaagcagcaactgggatttccaaaaatgaccagcgactgatttttcgtggccgtattctcaaagatgaatcattatcactcgctgaccagggctttgttgatggactggcaattcacgtaaaggaaaaccaccacccgcttctacgaatggttcatcta

SEQ ID NO: 14510 - DNA, 2360 bp, Heterodera glycines
aatcattatcactcactgaccagggctttgttgatgcttcctaggttcacgttgtcacaaaaccaccacccgcttctactaatggttcatctacggaaagcagaagcagtgaaacgtcgcagagtcatcagcaacccgaagttacggtcgtaccgcaaataacgactcagaatctgattgtcggacaagtcgtcctcgaaaggacttccctcttcgacaacccaaatgttgcattggtaagaaatgtaatttactcgctttttgttgctaatctaatctttaaggatgccgtgaccaatgccttggaggagattcgtggggcttttcagctcgaaacagaatcttcgctaaacactaatatccaaaatggaagttttgctgtcaatgtgatcttacgcggaatgcgtgagcaaattgtcgatggaccggcgagagagcgcttcgaatcgcttagagttgaggtcaagaaactcgcgtggcttgtcgccttggttaaggtcaaatttcaattaaatgaaaatgacttagtttttgtacaccattaccaattgcaaattcgagttggaattcggtcgtttgatactcttttttttcaggctcaattcgttaacagaattgatgcgattttctctagccaggacgagctgtcacagcctgaggcgtaccaaacgatttgcgacattttacttgcgatgcattcatttgaccattttgatgaaaatgacctcaagagatttaccgaacgagacgaggaccaggagttgatcacgctcattagggaactcactgcttggcaattgccggacgacgaagcgcatcttcaaactctaaacagaaacactgttgtcaggtacggattgtgtcggtcaaattgctagaacagttctcttttccttattagtgtacgtttaatgactttaataacaatttttgtttttctacagacattgtctttcaatggatttgagtcggcttttggtctttttgagtttggtggatgcgaaaattaatgagcatttgatgagtcgtttcaatctcgtcctgtctcaccgacataatcttcaggttggcttaactgcccttgacattcttttgaccattgtttattgttagtcttcgtcttattctgctcgcttaatgaattgtttctcgtccgccgtctcgcggattcaacacgcacgagcgcacatttaccattcgatcagtgacattggagttcatgtggatgacaacggatttaatcgactctttccccaacttttacattacgaaagggcaacggaaccaccccaagcggacattacactgactttcattcgtcctggaggtaattgctgaacttaatgtttgtaattgcttttgctcatacaataaccactttgttattagcaactccttcacattcccaaatcccgagtgttgtctcccagccgccttcgcgtgattctccgcctcattccgattcgacgccgaatcccccttctcatagtcagcagaataatccgactgctcttaattcgttgctttccggctttatgtcttttgcacatcaatgtacacagttttctttctgattatctttccaggctttatgcttaattttcagtgcttggcggtgttcctgatcaaaatcatccacgacaccccaccatttcgccgcgtatgtcttctcgctccgtttccttcgccccgcggtcgtccgcttcgtccagatcaactaattccacgggtttgactggacaattccctcgaccctttcgtcacgtgcaagggtcccaaagacgttttccttttggtcttacaactttgaattggaatcagacaccacccagcgtaagtaatccatttattgtatcggcacttattagcttacttttgaggcacccaatgcgcttttcgttggtcctcggccaccctttgtttttcctattttcacaatcgatccgtttttgacttgttccagccgacgatatcgtgtatttgagagtgactcggtaggactaggactgtttttacgtcacaacgaaccccaaaatttatagcgccacaatgatttttggaatgaccccgaaactgcgcgtcttggcatttttcctccgtcgaattctgtcactgcttcctccaaccgaatgcaaaatgttcctccgtttgctttcaattcggcatctgatgacattttgttggatggaatgtctcacaaccaacgtggcaatgcgaatgctaacatgggacctcctcaaggggttggttctggctcttctgctgagaattccgactcataagcggataatcaaccttcaaatgagcaatgggaagcgaagggaagagcaaaagccaacttcttgcaatgtttttttttc

SEQ ID NO: 14511 - DNA, 2967 bp, Heterodera glycines
cccgaattgctttgatggaaatgccatgccaaaccgaacttttgtactttgtgatgctttctctttcctgcacaatgtcatcacacgttttcaggatgtaattcttaattgtgttaaatctctcccctaattatgctaattattttttgctttttcacacattgtaatcgacgtcaatgttgaacagtttggaattgattgacgcttcgtccatgaaatgctcattttccagcttctgtgtggccaataagctcgggtagcaaatggtcaatctgtttttcatgaattttattttaatttcacaaaatccttcctcaaattaaacccatttttgcattcgccgccactcggcgggaattggaattcgaatccgaatgacttctcctcctggtacggaaagcattggtccaaaacagccaccggcactttgaacacatcttttcggacaccggtaagacgaattctaataaatgaaaattaaaaaaaaataataccgtataataatactgtactacacttacgattccgtctttttttgcgaatggacgccaaaaaattgagcaaaaacgccaaagaattgagtgaaaatcagcaaagcaaatgaataaagtagcattttggcttcaaaatggcgagaaataattacaaaatgtttttctgttaaccatttatttttgttttaaaatatatttttacaaattccgctaataaatttatgtaaatgaatcgctaaacgatggaatgaaagcccaacgcccagtccaaatgaatgggataaaatgctccgatcaccaaccaccacactatcccattcataatgatgcgaatgggttgggattggggatggaaatgaaaatgaagtgatgagatgactcatcatttagttttttgttaaaaaataaatttatttatttttatcggttaatggagagaaattatagtacgaaaaaggacaaagtaaaatttcgaatatgaatattttgactacaggattttcatgaatcccgacttcctaatcatgcgaaaaatctcgagaatgaggcccggtaaaacgggcatttgaatcaagtaaattgcgaaaattcaaaaaatggatacattatggaaatattgttgctgaccagcgatgtaagttacaactgtaagggggggggggggaataccttatcaaacgaaggacggtaaattaaattttggcaccgaaacatcgctactcaaaaaaagagaattgtggctaaatttttaaacagcgttttaaccattttaacttagtttaggaatgccttttataatgaatttggaataattttctaaatttagggaattataaactcgaatttttaaactgagttttcaaacatcgctttttggctaatacacctatgcaaaagggacgggcaaaaccccgacctgtccattgaaaccgagtttggccgacaggaaccctgttttatacagtcattgcaaaagttttgggacgaaggcagtgcaacagcaaaattcaaattttctcgaaaaagacttttaacctctcttgttctgcgtgtttaagtcgtagacccatcattcaaaaggcaattcggtagagattagcagcgatctcaaaaaccccagagtattcatcattatggtgctgtgtcgaagtgcaaaaagtccgaatgagtggtgatcagatggggcgggtcatttcagtaccgaataatgattttaattaattaataatataactattttaatttattaattttatttgctggccctaattataatttagctttatatttaatatttcccaaacaaattacatttttgtgagagaaatacagtgccccaaaaaagtcttgactcaaacctgaaaaactatcttatagttcatttaaaaacttgaaataattcatgcttgcacaacttttggtgctgatcaaaaaagtctcttacaccaacttgatcagatcactcatcctagtgaccgggacacccaaaatacactgaaaatcggggaattttcgaaaaaatccctagggggctggaaaattttttctagagaaaatggacaagctgactggaaagagcacagaatttgctaccgaattgcttttggaatggtggttctacgatttgtatatggaaagttaggtgccaggccgttttcgtacggaccgttttcatacgaacacatgtttttggactataacttttttctttgccaaccaaatccaacattgtggtatcattcgaaagctcattagatgctcgattagcctgcaaaattccaaaaaatttcgtcgagttcaaaaaaagttcgagccaaaaaagtttgaaaatttggttttttgaattcttctggccataacttttttgaaccttaacgaaattttttaggctaatagaggatacatagggctatcgaatgacaccaacaatgttggatttggttggcatcattcaattataaatttaaatgataattagtcattagaataaatcttcggtactgaaatgacccgccccttctgatcaccactcattcggactttttgcacttcgccacattcggactttttgcacttcgactcaccacgatcattatgtgtaaaaaacaaaaaaaaaacaaagaaaaaaaagtgaaaaattttttcaaaatactacgctttgtaaatatcgccaacaatttttagtttgcttattaaaaaaataatatgatgaaatttatcggttttgacggcattcgagtagggctgccaaaaatatgtacaaaaatggtccaaatatgtacataacagggatgtgcctaggtttcgcttttcgcattattcgcattttttagcgtttcgcatttcgctttttggcgcgaaaagcgacttttacatccctaagaattggattaaattcccataaaatttttcaaaattttacctataaattggctaattttcagtgaaaacctgtttataaatgatcaaaatt

SEQ ID NO: 14512 - DNA, 1364 bp, Heterodera glycines
ttcataatgaatttttatgagtccaacaaaataaatacgcgttactttgagaggacaattcattaaaaaaactttaggttccgcattaataaagtttttaaattagacatagttatagcattttaacatatttttatttttttaaatccataacatagtactcaaacttcccgtgcccaaacttcatgtcgcctaagttttagaagtgaaaaggccaaatgaattaatgcaaaaacggtgaaaaaaacttttacactaaaaaataatttccgaattcaaattttgttttcatgcatttctcatcgagagaaaacagaataaaattgttaataaactaaaatccaatcctattataaagtaaggattaatgtaaaactaaagattgaaaaacgtcaaattttttgaaattaaaaacagagtcttctcctccgtccctcgggtgttctccgattttgcttaatttgaccgttattttttgccttttaattaactatttacgggagaaaggcgcagccttcgtctgatttattatttgcttaacatttaatgaatttcaaagaaaatgggccaccgcaacataacgcttacgcttcactcattcaaatgcgttttttcggtgccgctaatttttttgggttagtccaatgtttcgctcgatcaatggccaacgaagcgtaattggccaaaagagtcgcaaataaattgcaaatgctctcccaacacattgccagtgagaagcatcgccgccctaattaatcctcaatccatctgctgctgctgcttctgtcggcttttcttttccgctttttgtgttgaacttccgcccgtccgtcgtccgctgatggactaacgcaaaaaagggggtcaattttatagacattttttgtcttttgttttttattgccgtaaagtaaaaattgaaattctcaatttttgtaacttttttaagaccaaaaattgaatttttttaggattaatcaattagcatatttaagaagatgcattttctttctaaaaaattgtcgaaaagaatataaaatgcaaattatagtgctttaaattcaaaatttattattttttaaattaaaaaacttaaaatgtagaaattatttaaaaaatctgaatttcaaattcacgactaatagcgttaatttcagcttttttaaaaaactaatctttttttttaccggcggtccgtgggagaatttttataaagtcacatttgaacctttttaagttttaatcagattttgaaaaatattgcaagtttttctcttcatcaaaaatgtcgtttttgtggattttatagcaaaatgaaatttcttaaagtcaaaaagactcacaaagcagaactaaaaccaaaa

SEQ ID NO: 14513 - DNA, 1882 bp, Heterodera glycines
atctttgtagcttttgtgccaccatttatttcatagaaattaatgacttcgcgtgttgaacacctttttttgttgtaaaatgttgtcgcgtgccgcccatttaaatgggacgcggaatggcaattaaaaagcacaaattaaaaaaaaattggccattaatttttctttcttttaaaattcgcattcacggactttttttctcacagccattgaaaggtttatgatgagaaagaactttatgttcttaaaccaacaaattaagaaaaaaaattaatttattttcataaatgtactcttcattaaagtagaaacaatatttgtttctaatttacttattttttttattaatttaatgtcttttcattggcacttcgagtttaaaaaagaatgcgtcttgcaattttgtttcattattgttaaaatttaaatttttgcaattttttagcctttcaaattttcctacatttcctcctccttctcattcgctgttatgggtcaacaaatgccggcttcaacaaattccatggatgctgtgacagctgcttattacggtttggtgcaattttgtgacgaccccaaccaccgtagtctgacactgacactgacggccatcgctttgttcgtcatttacgcgattggcattctgtcccaattggttgtgctgccggcaaattggcgcctgtccgagcagcgctccgcttttctgcttctgcttcacattgtgagtgaacataatttttaacatttgagtgttgggaaatgaaatttgctgtttcagaatttttacagccaaaagccttaaccttagagttttggtattccaaaaaaaaagagattttttgaacgtgaacaaaagaatttaaaatttaaaaaataatttaattactgagttatagaaatcaatttgaaagagaaaatgaaagttaaatgacaatatttgcatgacgaatattggaatttgggacgtcacaactgaataacgaccgggatattcatctaaaaaagaccaattttatcaaaaaaaaaaaaaaaaattcaaaggacaattttcgtattttaaaatattatcgaaagttgttctaaatttccaaaaaaaaaacattttcccggcgatgcctatcgacaccgccggcctcaaaactctttatctctcttaagaaattgaatcaaaaccgcaaaaatttcctgcaaatctctagggaagagtcaaaaagatttgaaaataatattaataattaaataaataaatgccgcttctcttttttaaataaatcgaaattttaaatcattacaataattggtgttcatttttctttaagaatgtgttcgatctgatctggctgttcgagtacgtttggctttccctggaatatctgatcggcactcgtctcatcgtcaaattctctttggatgcctttctttttcgttttgtcaatttttgcattgacactttttacattgaattggcgttcaaccgatgcattgcttttctgttcccacgcctttacaacacaatttgctgcgaaaagtccgtccgttaattttgggaattcaaataaaaacttaagcattactaatttcaattaaaattccttttttaaaataaattttaaattaaatttttaaatagaataaataatgatttgttgaattattttaagaaaattattctcattaatttaaggaacatgaaaatctgtgtggcgctcacctacattttgtcaattgcatattcaatttacacaaattggttccaggagcgaaggccgttccattgtctggcacaattgggttatttggagccgatgggatccattccaaaagtgcgagaaattctcaaattttacttaaaaatttttgggatatttgttgaaacgcggcc

SEQ ID NO: 14514 - DNA, 981 bp, Heterodera glycines
aaaaaagtgccggattagcgggtttgaaattccagtctctagtttgacattatatgtatgtatcatattctattttttttcttttttagccataaattgactcttcttcaacaaaaatgtcctatcaaaatgtaagcttttcgtctttctccacgtcctacatatattcgaaaatcactttttagtatcctggactggccgaatcgccaccaccgtccgcaataaacaattcttgtactaaaaacgaaccattagattctgattttaatcggggcggtggcggatggaaaagacaatctcagaacgcgtcttccgactcgtgggcaccgaaggcgggcgcatacagtgaaaatggcagatttttgggtgagattgaaaaacaacgacaaaaactattggaaaaggcaaccttttttgaagaaatgagtcggcacaattcgaccgcctcttccgctgctttttaccgccaatcgaccgcaacttcgaccaacaattttcaggagcattactcacatggcagcagttcatcggcggtttattttcaagaggaatttcgtggtgcttcttccttttctttttcgtttttcaaaaaccctttaggcccttttcccaccgattcttccctctgcgcttttcctgccgatttccatccgcgcacaaaaagtcgttttgacgaaattgtggacgatggccaaggatccgtgccaatgtcttccgacaccgccgactttcgggcgagacgcatttgtggtgacgccgtcggcacagaaattcaaatgggtgaccaaatggcaatggttccgacacaatcgactccgatggaacagccaaattgtcatcagcagcatgacgacggttgtttgaattcaaatgacaattactgcaattgccttaaatgcgcatattttatgagtccatccccatttttgcgagggttttacacagatttattttttaagtgcctaaaaatggtgagcatct

SEQ ID NO: 14515 - DNA, 1380 bp, Heterodera glycines
acacaatgtgccatttgcagcagaatgagaggaaaatccgttggaaattgaagcgcaggcaatcggcacatttctttttcgacgcctttttcatgtgtcccttttcgtccagaattgtctgttggatttgcgtcaagagttggccttcgtcgactcgttagacccttccctgggccaatgtttgaccaactcgcggcgtttgctgatcagcgagtcgatgaaattggaggagtggcacaaccccgattgggtggaggttcgagcgggcggtgggtcaattccgtctcattgccagtcaagtttaagaagccataacttactaacaataagcaattaagcagcttaaaagctattgaaagacaccaattttgttggattcaatcagcaacttataaagttagaatctaattgtaagggctttctacagacggagttggcctttcccacggggggggggcaaccaaaaagcaaacgaatgaatttcaacaaatccgtcaggttgaccataatcgccccgtgaaactgtccaaacaggtcaattaaacagactcatttaccttttaattggtttttcaatgattaatgttttgtttttgcacaggttttgatccccaacttccgttacccttctgttaatttcatcgggcgcatcgtcggcttcaaaggcagcactctttcgcgcatttgccgaaaatacaaagtaaacaaccataaaacatttattgttttttatttgtcatatttttaaaaaatatttgtattaatgtaaattaggatgaaaaaatgttggtttccgcttcggttgtttcgcgtttcattcgcttttctctcttttagtgtttcatttccattttgggcgccaattcgaccaaagaccggcagcaagagattgaactgctccaatcgggcgactatcgttatgcgcattatgcaagcccgtaacgcgcacttcttttgtgaccaattccttcccatttccgttccgctcagattgcacattcgcatcgatgtaatcgcacccactcatttggcacacatgcgaatggccggcgtccttaacttcttccacaaattgctcgtcccggtaagaacgactttttcagattggcaaaagcaaaaagcacagatatctaagcttgaaattaatccagtttttttttgtaaatgtaattactcgccaaaaagtcggagcaggacaaaactcagccgccggaacttagccgagacataattcagccgtgaataaatttttaaaaaattttcaaaattagaaatttttcaagaaaaaaatcttagaaaattctatgaaaaaaaatttaaaaaaaattttcaggcgattttttcaaaatttaataactaattctaagaaatttcaaaaaa

SEQ ID NO: 14516 - DNA, 1397 bp, Heterodera glycines
  misc_feature (1301)..(1301): n is a, c, g, or t
  misc_feature (1356)..(1356): n is a, c, g, or t
gagcgtatttacacaccaaattttataattttggcccttgaagttggaccagacgaggccatgttcgtagaggatgacaaactgcggaaatttttttttaattttggaaatttccaaaattctcaggatttactgtattttccgatggacttttatgaattgacgagcccttggagttgatgataccttagaagcagcaaaaaaaaaaaatactaaaaacaagatgaatggcaaattcagtggtggaaaattggaaatttcccaaataaaataaaatcagcaaaatttgccaaaaaaaatcctcaaaaaatttcggtcgaattttcaaaaaagtgaaaatcaattggacgcagtgcaccaagcttatggaaatccaatgagttttggttcccgggaaatagcgaattccatgaaaatccgtgacgaggaaaatcacgacgaaatcccgggctaaaatcttgtcaagaacccggaccaaatcatggtaaaagtatgacagcaatggtaggaaaataatgaaatgaacttaaactgaaaacgatggatgaaaattaaaaattcacatgtgtcaggcgtccaaacacgtgcgcgaaaatcactccttaaattaaaaaaaaatatttaggtaaaaaaaaaaaaaattaaatttatacatttttaaatttaaattatattatatatataattattttatagataatttaaatatttagtttagtaataaaaaaaataaaatttgtaaaatatttaaattatttttattaataataagtttaaaattggatattcacacagaaaaatgttttaaaataaaaaaataagaaaaataaaaatatttttaatttttccttttaaattaaaatatttttaatttttcctaattaaaaattaaaaaataaaaataatcaaaatggtacccactttaatgttatgttggtggtgcacacatttaaatgcttaaaacttagtcgagggtcaagcctaaattaaattaaaaattaaaaaaccaaaaactttcaattttttaccaaatttcgctgtacattacgtccaattctgtgaagttagaaaaattaattgttgtttaataattcatggtaaatttaccaaaatcagcagtgatttccgaaattttggagataccctaagaaaatttaaatttaaagaaattgaaaacgaatttagaggaaaacacctgaacatgcaattcaatcgtcacattaacaccatccgcttcgggaagtaaactaaaaaatgttatttttaattaaaattcaatgctttggtaaaaatcggattanattgatcagaattacactaatggaattgccaagaatggtgctgaaattggaatanatcattgcttgccagattagtgattatatagcgtgatgcca

SEQ ID NO: 14517 - DNA, 3058 bp, Heterodera glycines
taactgtgccgcctgccccatgtactgcttgctgatcccttaatgtatgtcgtagtcgcgcaacaatgtttcaatgatgcttcccaggttgattgagttgcgcgtacaccgtgtcgggtcacttccgacgcccggcacaacgcttggcaccgctgcggtgagcgcggcattgcccattagcaacgccagctgcagaagcagcagcggaagcactagcgatggcacgaaacgaaacaaatcggtcgatagcggcggcaaatgccgaaacgaattgctggacagttgcgtagggagaaagaaactttttttggcacgacgtcggctggcacaacccgtggcaacagcagcggcacaacggtggcttgcgcaatccatggcaaaacaacaacaacaactgctggcacaacacatggcataacagtggttagaacaacaatttgtggcaccgcaattcttggtacaataatccacggcacaaccgttggcactttcagtgggtaaactacggcagctgctagtacatctgcttggcaagtggcaagcacaaacatgcgttgttgtagaacaggcggccgttgccatgggcgttgttgtactgctccaacatgcgcacatggtcgttgtcggaattgttgttgaacccatgctgttgttggtcccgtttttccgggttgataacaacgtcgtcgttaccgtagttgtcgcatttgtttcgcatgtactgcttgaccgtgttgttgtttttgtttctgttgtactgcttgaacttgatgacgaaggcgacaaagtgccatcattggtgccagtaatgtgtttggaatggacggaataatatcgctttccatgatgtttctgttgaactgttgctgttgaacacgacgacggcatggacgacgaacatgtacagcttggtgtcgacgaagacgggccatgaaagccattggggccaaaattggccattttaatgagaatgagaaaaaaaaataaataaaataggcaaattaatttaggaaaatctgaaaaaagtataaaattaagagtaatttgaaagaagaaaatttattttgtcatagtttcgacaaattgttgaaattttttcccaatcaaaatgcccacagggaaattcgtgggcaaatcaatagtataatttaaaagttaaataattttaaattttaatcttgaaaaaatttgtcatccattttcttttaaattggtatttggtcatatttttggtcaaattattggcatttttcccactatagaccaaataaggtcgttaatttgcatttgtctatgcttcaggttaacaacaattaaaatttagcattttgtggagaattttttgtcattttatttccgtaaaagaccaaacaaattgagtacccccgtcaccctcaaaataaagctgcaaaaactgctaaaaaattttggaattatatttttggcattttgtgccgtcgtcccccccccccccttttgcatcagtgagtgggtgggtgggtgggcccccccccctcccccctgctttgtgcagcgatccaaatggaccgaccaaatcggttttgacgacatttttgccgaattgaatttccgcttttcgtggtcaaagtgcccgcccagccgcccccgcgtgacacattcattcattccccccgtttccccctgtgtccctaccgctaggttatggctctcgataaactgggctggatgcttgagtgtcgatttgaaaaaaaattcatgtctttttggggctcggtatccagtcccgggacaattctcgagtcttgaagcaaatctcggtcgtggattaatttttggggctctatttcgactaagggcgagccagtctcgagtcccgggccaagtttatgaaaatcggaaacccgggggattgattcggttctgcaggtcccccggtccggtcttcatcattatcattatcatcagagggagaatattgccgagaacaggaaaggagcattttttcgaaacaatcttttcaaaaaggggatgaacgcgtcttcttcgagaatctcgagacggaagggtcccccgaggggatgtggggggggggggtgcatcagcagagacaatgaaaatgaatccggggggatttacacaacgcccgggtgagggcgggggacggggtgtgaagaaacaacggcacatgccgtgccgccacgccaccacacaaaatgccgacaacctccgccgcgccggggcggcggggataaagcacttgtcggaaatgaaagaaacaaaagggagatgaagccgagaacaaacgtcttacttttttcaccgcccagggcataatgggattaggggaaaaacgatgatgatgatgatgaggatgaggatgatattgatgctctcggttgggcagcaacggaataaacaaaaaaaaaagcgaaaaattttgaaaatttcggtggcgatgggtgctaaaagctttaatatgtgttcgagaggagtttagagggcccaagccctgctgctcaaaaaggctagagaatttttgttgggctcaagcgttactcgagaccaagactctcgaggtcacccacctccccccaaaaatgagaaaaaattcgaaatagtttcatggtgacaatggattaagcatttgtatattcaaattttcgagattttggaccgaggtccccccctggcccaaaaataattgaccgagaccgagagtctcgaaaactaaaatggtgataaataaacggataaataaaaaattgattgcattttttattgggaaggctaaaaataattcaaagacaacaaaaaaaaatttaaaaaatcgacggagttatgtaataaaattttgcttcataaaaaatgaagaaaacatctgctgctgattacagcagcagcaggtgtcccttccgagtaaatcaatgcaaaaaataataatttttaaaaataatttacaagtaaaaataatttttttaaatattttaaagagaaatatacataaattttcgactgactccttttcgggacagcataaacaatttctaacggatggtgaagagaagatgagaagcta

SEQ ID NO: 14518 - DNA, 1756 bp, Heterodera glycines
tttcgatggcaaaagcgaattaacaatttgtattttatcataatagacaaggacaaaggacctgaaccgaaactttatgtacagatggatgaaaaattttacaaatttgtgccatttccgttgcccgagcgtccgttgcccagcaaaatccgctttaaattccttaagattgagtaatttaaaattagcgcccacaataaaagcattcattccattttcagttacatcgatcacttcgtcatcgcttttcttcgttcaaatcaccaaatttttgacaaaagaggcaccaatttagagttgtggatttattccgcacacagctcggatgaccagccgatttgggatgtttttgttcgtgaaatgtggccaatttttgcatcaaacattcgccacttgcgctttatcgatggtgatggtttggacaatttgcgtcgtcgcacttcgccgacaattctcactgatctcaaactgttgaattcaattcattcatttggtctgttgcctgatgtcattggtgattattttgacgggccaaatgcaactgctggccaagcgttgtacaaatggttgcactctccgagaaaagatggccaacccaagcgtttgcgttgcgaagattttaacaaacatgtggattgattgggtcaacaaattcaaggaggtgtggccataatttcggcaaatcactgattttgattgcctctatttttgttttccagcgtttagcaatttctccgtgccaccatttcttctgtcagttacgaaattgattttgctgttcatgtgccgtcaatgcaaatggtgccatttgaattggtgaacgaatggacaaaggaaaagctgacattggccaaagaaaacgaaaatgaattggaggacaactgttggattatgaaacgatgcaaaattggggaggccgcggcggttcagcttcagaaagatgaaaattgtaacaatgtgttcttttaccttaatgccaataattgcattgggtgagcaattaaaaaagcatttttattttttaaataattaaaattgcgcttaattaaggccattgtctccgccaccaccagcaaaagaagaaggacgacgcgggataaagcatcacaaaggagccgtcttctgacaatgagtgacggacaaagcaacaaataaaaacaatgataagcagaagaaatgaattaattaagaatgaccgatcgatcatatttatcagtggtaataatgttttttatgtaaaaaacctcttgaatatataaataaaataagaaactgaaaatgttgaaaataaggctcaagtacagtttatgcgtccaatcaaattttcattaaatcgacgacgactgaatggcttcaactaaaaacacagaggcatgaagatttaaagcaaaatgttacaaaatatcgttttgctgtctgaaaatggaaaaaacaattattattgatcaaaaacaatcaaatttttctttacccatcggtgccctccgccgcgtgtcgcccattgtccgtcgccgtcgtacgaaaaatggccaccatttcggcatttccgctctcttccgcgaaatcctgtgcccgtttgcctgaaatgggcgaataaaacgctcgctagcacaacaatttggccacttccgctgctgctcaccttccatgttccgttggttaatgcccgcgccgatggccaccaaatgccgtgccatttcaatcttcccacacttcactgcccaccagggaggggtcctagggggggggggggggg

SEQ ID NO: 14519 - DNA, 1491 bp, Heterodera glycines
ctgcccacatcaaagcattgtgtccctccacgtcaacatgttgaaggtcggctccatgttcgatgaggaaacacgcaatcaaacgtaaaaacgggcaacattaaatcgtaggcactttgtaattgaacattttatcaacatcttctctttattggcacttcatttttctgctcaaacgttggacaccagttctgcgagcagtcctggccttagaatcgttgcaatttaatttaaataaacatttcttctgcttttacccaatatcgctctccttgatatcaatgtacagcaaagattcgatcattttgtttgcatcattctccaatgcatgaaatgtgtgatcgccattaatactaactggtcgccgtacaaccactgccttggtagagccaatgtgtaagccaagtacatttcctccaaataaactgcaagtcagccgctctttcgtgtgttcattatgcaagtcaaaaggctgcactccacgcggcactcctgtacatgaaatcaaatagttgaccggaatggcattcgaagaagtgaagaactggaaattagaaggttaaaaattgaaataaagcccaaatttttcggacccttttcaggctttgcatgagtgtcgtccaatgtttcgcgtgggcccagcgcaatgtcaaaactttgggatatccatccgagctcggtgtatacaaccatcggaacaaattttgatccattgtctcagtcaagtgatccggaggatttagtaaagcttcaacaggaggcggttgttccggcaaaatttgtaattcaatgatggcacgagattggtacactcgaatagcacattgtgcgaaacgtgatgacgtaattgcgtaaagtttttggcatttaatcggttgattttggtgacagaacacgaaattagtggccagatacgttgcgacataagaacccagcagcggaagtcatttgcacgaattttcagcgtcaaagttacgccttttttcattgtatgttgcataaactgcagaaagttgagtagttccacgtcaacgtgcctggtaaaaggaggtcttaagaaaatttataattgtgttcgtgagaccaaatgtaaagggcgtggaagccaatcacgccgcttggtggtgaacacgttgcaattggcacagtttggtcggtgcatcccatttttacaagttgcattttgagtttggttccatccataaccgtgactgttccattttgaatggccaattcgcccaatttccatttacgctgtttgaaatgactgtccaccattttgtcgaatcgtgaattgatcattgcaaattttgtcccaagttcagcacggctaatccaaaaaaatgcgtcaaaccaaacgtcgtttggacggagcttctgaaaattgaaaaagatgacaatttttactccatttgatgccacatacaaatcaggagttgtggtctatctatgaggggcataaaactgtaacagccacaacgacactgaaaa

SEQ ID NO: 14520 - DNA, 1012 bp, Heterodera glycines
aagtgagtttaatgccagtgtagctccatgccaactttgttgatatctccagggagctgaatgtgccgacggcgaatgctgcgatttggagcagtgcaagccgaaaggtcggtccaccgtttgtcgggaagaggccaatgagtgcgatttgcccgaatattgcgacggaacaaacccaatttgtcctcgtaagaacaaattgctgtaaaattgccaatttcttttccatttaagccgacttttttgtccaggatggccatacgtgtcccaaaaattcggaggtaaatttccgtgtaatcataaattatgccaaactcagttttgatgaataactaaaaatcttggttttgccttctccaaaagtgcatatttggcatggcgttgtgtattgattaattattttgtgttttgccaacatcaaaaaattgcaggatttttgctaccaaggcgtgtgtggcagtcgtgagcagcagtgccgcttcatttggggcccgaccgcgaagaattccatcgcggaatgctacgcgtacaacgaatacggctcattcagcggcaactgcggctacgaccaggccaaagaccaataccatcgctgcaagaaaaggtgcggggagggggcgtcacagaatttcgctaattgatgttgttggatgactattaattaattgtggtcgagagtctcgactttggcaatttgttgtcttttgtcagtgacgtcacttgtggtcggctgcagtgtcagcacgaaagtgagcggcccgtgtttggcgatccgtccacggtgtacgcggcgtacaattttgtgcgcgacgcggccggccacgacgtgcagtgccgcgtggtgcgcaccacaatgaccggcgtgggcaaaaagcgggcggtcgacccggggatggtgccaaatggggcgcgttgcggcaaggacaaagtcggtgggattggcaatcacggaattaacaaacaaaaaactaaaatataaatgccatcaatcaggcccgagccaggggggggg

SEQ ID NO: 14521 - DNA, 1727 bp, Heterodera glycines
  misc_feature (11)..(11): n is a, c, g, or t
cacatgcacgngcacagtttgaacgccgtttggggcgacgacgccgcgggggccggcggcgccctcgcgcgtgaagtaaaatatttaaaaaaacaactataattaattattatttttataattatcattaataatatttttaaggttctccgtgtggatgccaccaaaccgtacataataggcggagcacgcgcagcggtgctcaaagttgctgagagccaacaaaagcaggtgcaaacaacgctttggctagttaatcgaattacgatttttattgccattaattcctctcatattttaatggaaagtttcgattggaccaatgttttctcacaattattcgaattttgcaacggaggactcattcctcttatataaatacaagatgtgaaaatgccgttgtgaagccgcgatttaaattacagtttaatatagtgattaaaattacttagccctccaactttgggccatctccaacatcgaacgtccaatatttcaacaatgtcacggcattccaacaaatggcaacaaaaccagccaaaaagggaaataatggcacaaggggagggattgtgccatcgttggcggaacagcgctcgttggtcgcgcacccgggctatgacacgggcgggtctacttcctccgacgaacagcagccgacaagaacaacagtagcagaccaaagggcacaacaacaacaggaacagcaaacggtaattgttgcacaacaaccgtaccgtaatcccctaacaatggtaatagacaaaattacagtatgaccatcggcaccgatacggcgttgagactcctccgccaccgccgccgccccataaaaatgtacacaaaagcggagaaaaagtaaatggttaaggaaatgagcagcaacagaactaaccaaagagttcaggcagtacagcagaaacagccaaaaatgccaacgaaaccgccgacaatcaaagtgaaggaggaaaaaggaggggcagaagcgaagataaatgtgaaagcgatggcagcgaaattcgagaaaaaatgaaatgggttattcgatcgactctgatgtgatcctctccttaattctttaataccaaaattgcctttttgcatttgcaaattcttattttttgatatttctccgccccattttctttttaattaagcgattaccaaaatttctattcattttttgcaaattttcctataataaatgtgacgaatttattatggaaccttgagagatgtgcgggtaatagtttagtctgggaaccccattcttcaaaaaataaaaattttcaaaaatcgtgtaaaacaactttttatggggttttcgaggtcgctgatcacgaagctgatacccatttcgaccaattccgaaccccgggcctgaattttcacttcaaccacacaaaatttccaatttttcctcggcggcacttatcggcactccctactggcccaactcatccaatcaaatgacagttttcgggcaaggaagaagcattttgcgaaccacttttcagagaccgtttttgtacgagaacaacaggcaagaaactgattttaaaggggaggcgcgaacgccgtcccccacactcaaaaatttagctgtgggcctatcccagttcgggatcgccctgcgggtcagccccaaccgaaagtgcaatggtggagcctcgccacaggagacctgccttgatgatcgcaggaactccccagccaggtaagtttaa

SEQ ID NO: 14522 - DNA, 914 bp, Heterodera glycines
  misc_feature (845)..(845): n is a, c, g, or t
  misc_feature (854)..(858): n is a, c, g, or t
gggggatggaggggagatgaattgtttgtccatctttgcccatcttccgaccatcaaacatccatcaacggtccctctcgactatgggtcgtcgaaatttttatccatgaatttgagccaagaaaacattttttaattaatgattattttttaagttataattttttatcgattcaaattaaatttcctaaaaaatttccaacattatattttcaaattattttttgaaataaaattaaatttggctttaaaaatcgttgtcgaatttacacatttataataatataattctctttttttgatttgctataaattcccttcgttttttttaaattttccttcaaatttaacttccgattttatgcaaattttcccacttttcccatagttcttcttcttcttccttattttcatcatttgtcatttcctttgccatttttacaatttttgttttttaaaaattttattagcataaatttgtttcttttgtttcattaaatttaattcgttcatcgaaattttaattaagaaaatatacaaaaaatattatttttcatttattaaagtgcaagtttcataaaataacaaactgttcaattggcaattctcaataatttacctctcaaaatgaattcatcagcaaattggacaggtcattaggctatgcgaatgttaaaatacgagtaacaaatgtgatttagagaaataaaaccattaattaatcttttaggtccttataattaaataaaattttgtgataaatcatctctgaccatcaattgatctatattctgtaaaaatcaaaaaattaaatggtacggtcgtttcttttcaaaaggattcgncgtgttttnnnnnatactgaatcctcctccaagcattcaggtgtctttccccccctcccacttcggcgt

SEQ ID NO: 14523 - DNA, 3006 bp, Heterodera glycines
  misc_feature (2948)..(2948): n is a, c, g, or t
cttaattggtccctccgcccgatcaatcatttttttctgtaaatgcaataaactcagttcaaattccgcatcctattccaattttttatatctctttcgtacatatttttattaataaaaaaaataaattttttatcattttaaaatatttagtatttcatttttcatttaatatggttttcattgtattttccaattaaatttcgtcattttgataattaattacaaattattttataagaaaatttctctcttctcaaaaagtgcaaaacaattaaatgcatattttttgttccacataatttagatgaccttctgctaaaaaaataaaatgctctgccgacgaccacacaaaatttgcataataatcgcaattatttttctcgtttttgtgccgtattgtgccgccttttgtccgccgggctgtgagtgccgtgacgatcaatttttggtggcatgcaattcttcggcactgacctccattccgatactgtaagtgttgcttttggtactgttataattatacaaaaatattaaatttcttaaattattaattattataattcaatattttctttatattctttttaaaaaaatttatatgatttacaataaaagaaattccatatattattatctttatattgtaaaataatggatttttaaattcataaattaattaatattttattatgcaattgctcatttttttagcctcaatccgatgctgaaaacattggtcatcacaaactcaaatgggcttaaattggactctttttcaattgctctttatcaacgttggttttttacccatttttttattttattttatttattttttttataaaaattttgtatttttaattgcagaacttgaatctctggaacttagcaacaaccaaataacgcgaattccaagcaactttttgagccggttaacaaaattgcgaagtaaaattcaattaactgcgaattcatttttattaattgccgataattaagcacttaatttacgtggaaataaaatgaaaattattgatggagcgaccaaagaagcaaaaaatttggaagtaagtcaaatttgaaaaataattaatacaccataaaaatttattaaattaaatattattccaataaatataaataaaacattcaaaaatttaaatttcatctcaccttatagcatttggatttatcatcaaatcaaattgagcacattttgccaaattccttcgccaactttggcgctttgctgcatttgaacttgtcccacaaccacctccacgcaattgaccttaccacttttaacggccttaccaatttgacggacatggatttgagacagaatcgaatctcaaaattggaaaatgaccaatttggcactttgtctgaacttgccaatttggacctatctgggaatttaatttccgaagtccgtaattgtttttatttttaatattttatttatttgttcatttagctaatggccaagccgttttcttcacttgaaaagctgcgcgatttggatttaagctcaaatttgatttcatgtatggagaaggacgccttttcgggactgcagcgattggagtcattaaatttggcacgaaatttggtaattgctgagccaatttaatcgtttcaacataaaaaaattctataaaattagttcattttatttaaaaaattaaatttattagctaatcattattatattaccaaatttttagtaaattaaccccgtcgccggatcggttcagttcattagccaaatttgagcccgtaatgcactcactcccttcccccggggcttcatttgtttgttttgagtgccaccgataagccaaatcccatgtgtcaatcttaggctttctcttctcaatgacttttatttgcacaaattttaaccaaatttattactgtttatgcggctatttcagctgatgaaacaaaagaaaaatgtatttaaaatttgttgaaaaattatattttacataggcactttcttcttaaaataattcgttataactccgtccaaaagcaccaaatttgaaatctcctaatccttcattagctctaattttctctattatctcacaaaatataaaagttgattggctttgatcaaaactttaaggattttcttttgtagaaaaacaccgtggcgaatttaagaaaaatcatttgatagatatgtaacatagtaacattagttatttttaaagttatcaacaccgacctccgaggttatcgatggttgtcgccgaaatgcaaattgggaaaacctaattggcttaaggaaattggatttgtcaggaaatgcttgggccgaggtgacttattaaaataaaattaaaagttttcattctttggaatgtgtgccagatcccagcaagaaccttcgatggtggcttatgggaattgagggagttgcacctggaacagatgaaccaattacgggagattagggtaacttacgatttaatagttttcaaaatgagttaataattttaggcaaatgctttcgtcggattgccaaaattgggcagtctttttttgaccaattcaacttttttgtcatacattgatccaaaatcatttattggcgctaattcattggagcaattggatttggccaactgtcaactttcgacaattgaccaaaacttgctgaattggtcaatgctgaagaaagttggactaagtggtaaaagatttattgtataaaaattgaaagaaaatttacaataattttcaaaagattgctttattatttatttataatatttaaaattaaattaattttcatgatgaacattgattaatttagttactatgaattttttttttaaactttccccaccgttcaggaaatcgttggaattgcgactgcgaattggtcgcatttttgccaaagattttggaacttcatcatcattctgcagtantttctgatgtcctttgtgccagccctgaagaatttcgggatctgaacattctcttcgt

SEQ ID NO: 14524 - DNA, 2871 bp, Heterodera glycines
taacgcccattttgatgttttttgactaacgctccatcactaacctgctgcacaatttaaccattcatctttaagggcaccaccgatttagtttagataaattttcagcttttgtccatggcctataaactaataataactatgtataaacgataaaattggaatatatgaatattccaaaagtcaccaatcgtacaaaattgagctcgatagcataactttttactgaacaaaaaattaaaaaaaaaattccagtggactgaaatttttttctaaaacctatgtatgacaaatactcactaaaattagcaagtaaattaggttagattctgttcagggaaggtttgaaaaaattcaaattgaaaaatgttcattttggcaacttgttttctgctgtgcatttggaattttgttttctaaaagcgattgtttgtctatttcagtggggtaatgatcgaaattttggccacacggaccaatcaacaaattgctgatctgagaaatgtttatgatacggaactggctattagtgacccacaatatcggcttcttgaggcttacatcaaagaaaaaaccagtgggccattccaacacttacttgtctcgttgcttaatgagtcaagagatgagacacacgcgagtgatgaggaaatggcaaaaaaagtatgctaattatactttaattacaaataatgccttaattaattggaaattgaagcaaaaataataatttatttcaaataaatataaataaattttatatttaacattttaccaatttattaacaggaagcacaacaactcttcgaattaagacggaaaggtgaaattttgtccgaaaccgcataaaaacattaaaaattttcccgactgcgtttgtcggcatcgctccaaaagttctgtttaaaaaaaggaattttaattcaaaaatgtttatcaaatcgaaaatttaatttttccaacgggcacctgttggcacggcgaatggcaacaaatttgaacaaatttgttatcaaacattatcaaaatatcatctgaatgataataatttaattaaaatatttaaattttacatattattattgaataaatatagtttttaaacggttaaacataatcgttttttgactccctcgcccactggttttttagattgaatgttcaggttttgaaaatttaagacttcaagattttcgattggtaattacgaaggatttttttccatcctttactagaatttaagattttttttaggattagcagcgaagagtccttgggtcagcaaaaatgctgctgaattcaacagagtgtttgctaaaggaagcttcagccaagtaaaaaaatatttcgcaaatttcaaatttaccatgattaatgaatgtaatttaattagaaatatatattaaagataaattttatttagctgcgaaaattattcgattattacaaacaaatagttgttcagcatcaaaaacaaaaaagacattataaagaggaatatgataaatctggtaaatacgacattgaggctgccatcacaaatgagttttccggaattgacaaggatgggtaagggataattgagaatgagtccgtttttctaagcttttgccgcctattggcacatttttatatatttttattgaatgtattaccgtaattatttaccttttgcatttattatataacgacagacataagctgaagctttcttattatttaagttatttggcattgatcaaatatgtccgtgacggcccaaaatattttgcagatttattgcacgaatccatcactggtaattttttgccaaaaatgcccagcgacttgactcgtgttctggtttcacgatctgaaattgatctggctgagataaaggtgactgatttaattgaactatttgtaattaaaaggcataaatggtataacaaataagtttttatattaaattgttaaataatatatataaaaaaaaattattatttatcataaaaagtaatgaatagggtcgcgatccacacacccctaagattcgacctaaaaattttcaaaaccactcctaagaaatgaaaaaaattttatttttaggtacctatttttggttttttgcacttaaaaatcccagtcctactcatttgcaactgcaactagtgaataaaaattatttttgcttaattttggctgaaaattaagtcactatttgtcactatttcgcactttttgtcactgttttgtcactattttgacatttttataactattttagttaactatttttgggatttttcgtcactaaaatttacagccctattaatgagcactaaagaattacgaaaaatttaaaaagctataacaaaaaacatgaatcgaaaactgaattttgaccctatttcaaccttaactaaaattttttgaaattgaataggataatcgagaaaccttgtgctactgaataatatcaacaatgtttagagtgcaaagattaaaaaaattaaattttattttagtaaaaatttttttaaaactttaaaaataaatgtgaataataacaaattactgttaaaaagaacgaaatttcattgaaatttttgccaaatgtctatgatttgtcctctgttttatcaagttctcttcgggtatctggaacaccgcacttttgtgagacaattcgaaaaattgtcgaacatttaaaactccaatttttgtcttaatggcaattagttacaatcattattaatttttatacttgcccatattttccacgaaaatcctttgatgagtacagtttcgcttttacgttcacccaaaagggagccggaaaatccgacaccggaaaatctgacattggaatatccgacacaagcggaaatc

SEQ ID NO: 14525 - DNA, 1186 bp, Heterodera glycines
  misc_feature (37)..(37): n is a, c, g, or t
tgtcataaatgccacccaaaatgccaaaaatgagggnaagcagcaagaaaagtgcaaaggggcagaaggctcttctgctgggccaattggcagtccgcccggcagctgaaaaccaagttggtcagcagaagcagggttgatcatcagtttcagtgaattcgtcagtagttgatttcgtcagtgaacttaattgtctgaatgatgggtcggtcatgtttataatatggatgaaatatcgcaaattaaggacaaaatatggacaaaaacgctaaaatatatacaaaaaatatgaaaacttggacataaaatttctgggaattagtttgattttttgaaaaaatttcgtaaacccataaaatctttttagaaaaaaaaatcattttaataaaggaattatagaatttcataatttgccctcctatttatatttacaaaaattattgaactttgaaaaaaaatgcaaaaaatagtaataaatttttaaacaaaattcattttacacgaatgttatccatgaaaaattttgcgcactttttagtattttttcaaaatttttcggttttatttttttccaaaaacttcccatctttaggggctatttttgaattttttgcatgaaaaaatatggaaaaaatggaaataaaaacccatcctaaaagcatcaaaccaaggtaaaaatactatttacaattatttttacgccgtgtgtaaaaaaacatatggaaatccatacaaatccggaccctattattacaaatgtttactttgcaaaccaacaaattatttaagttcactgacataacctaacattgcgaaataacatgttaccatgatgggtgatgagaccaagctgtagaattatgccaatgtgaaggatgggttatttcgtaaaaagtgccacataaaaaattgttgtgttataactgatttttagggcgtgattttcatatattttgaacatcaatttctgcctaaaaaccaactaaatattattttgtttaatttttgaagctttagaaagaatgcgtatttatttcgagtttggaaaaaattcaaattttcaaaaatttacccctaacaaataaggtgcgaaaaaaaatttggtttacaaaaattgtaaaaaaatatatgtacaaaattcctatttaaaaatgaaatgcagttacctatgaatagtttttttttc

SEQ ID NO: 14526 - DNA, 3777 bp, Heterodera glycines
  misc_feature (18)..(18): n is a, c, g, or t
  misc_feature (23)..(23): n is a, c, g, or t
attttgatccatactggnaattntggatattttttgagacgaattcttacaagaattttataaaaaaacattttctatttttatttacacgtattcctatttctttagcaattaataatcagatttattcttgctaatttgtggtattatcgcgtcaaaaaaagcatttttattgcatttttgtaaaaagtttctgaattttacataaaaatgcaaaaattttctgagcccgggaaatttatgcaaatttttgaaaattcaagacgcacttcagagttggacaatgttagtggaataaagggtaaaactagataatacccctccctttttggaaaaagtttttttttcttttcaaaaatcatgaaaacatgtttccaaggggttttctggtccgcttatcacgaatctggcatccatttcaactaattccaaccttggacccgaattcaaacaaaagtcgaaatttcagagttttcgaatttctcatttttagtctaaaattgtttaaacattttttaattgaagctttgatggcttttagattgtttccttattttaaaccgatttagaaaactcgaaaaatctaccatctaaagtattaccgaataaagcctaaataaataaatttgtgagaattttatttccagaaattctgaaaatttgcgatttttcagaaaaaattcagaacgccgttttgaaagggaattttcacaatgtaaatactagaaaatccgaaattttgattacaagaggtattttattttatttttttatcacttttttgaagaaagtttaaaaatgaaattcattgcgattcgggaacaaagggaggtgcacatattttcgaatggaaaatttttttcaccaaaatcttctaaaataggtctttaggggtattttaaggctatagaattgaagaatcattctgaggggggagcgttaggtctggatccgggtgaagtaaatgatttttctatattatttttccatgtttattaaaacatttaaacgaatttcatttagaattaattaatttttataaaatagaaaaagaaattattttttcgaaaaaataaaaattctatttaccccccgggcagataaatagagacggggagattatttttcaacctacttcgaaaggggtagataattggagacgggcatataattagagaaaatacggtatattttgatttcgggctattgttcttatttgttttgatttcgaaaattcatttggttttaaaaaatcaccaaatcatcagaattttttcttcaatggcaaatttttcaatttttatcctttcgttccgttcatttttgacaactttgaaacaggattttaaaactttaaatcaatttttcgcactgtccttccgtctgtccgttacaattaattaactagttgttcgaattaattatttactaaatgaggaagtaatttttgtgcttttaatcatttttacgatcattttggagtttgtaatcacaacacagaaattattattcattattaaacatttaataatggcaagggcaaaggcttctcccccattttcttccgccaaagtcaaagtgattccccccgccgcccatcgtttggcaataaaagggcaaatggaagagaatgggaggggggggggagggggaggagaagcactaaaacattattagaggtgtttttaaagagacaaaacaatgtttacggacagaataccaacagaaagaaacagcgaaagcgcacacaaaatgcattttatccgatcaaaatcagcttactgattgataatgaagttgcatttgaatacacattttaaccaatgaataacccaatcgatggcacgtcgtttaatggcgaaaaaatacagtatttaatttatggcttatagacttgggcccggcttcctaaagggtcgatctctttgaaagcttcaaaaaagttaaatcattaaaaaagttgtttatacatttttttaattttcaaaaatttaaaaatttttcgcaacaatttcaacctcaccattttcgccatttgtacgagttcttatgacacaatttcttttggggtttttcgccactaaaaatccgggcataattatgaaaaataaaaatgtaattaaaaaattgccgttcagattattgttaattgattattgcttttgccttccaaatgcttagaaagcttttttatctcataatggtggcactcaccggaacagttcagtcaaaacttcaaaataaattaaattttgattattagggggacgggggctttttcaatcatttttaaaattcgataaatggccaggtgcagcagacaatgcccggcaacgccgtgctcgcgttcaccactccgtcgacgcccgtggccaatcagacgctgatcaaagtggccatgttggtggcccaaaatgacacggactacggcctgccgcggaaaaacgcggcactgcgagattctggcggcgcaattccaatggcattggaacagttgtgggcggacgaaatccttccaaaaagcatcaatttttcgtcagttaaatattttaaaataaaaaaattgaacaaattcacagatttcaatggcattatgggaattgcaacgaggcgtcggcattgggccgaatttacaaatatgtgaaggaattcgatgccgacgcaatcatcgcaacgccgtgcatggacggtgaaagaaacaataaatttaataaaaaataattaaacatatttaaatttataaataataaataaaataattaaaaaacattattttgttgtcacagtgcccccaatgcttggccatttggcttccaatttcaacttgccaatgatggtttggggacagagcatggcgtcgatgtgagttcataaaaaaacccttctccaaattggcttaacactcaattgcatttcgctctgttttagcctcgcctcctccaacaatttgacttacccaactctgctgaacattgtgccaaattacaaatagtgagttgactcatccctttgttttacggcatttccttctttagcatggcttccggccttgtcagtcttatgcaatatttcaattggactcgctttggctttgtgcttcaaagtgacatcaacggagtcagcggaggttaacgcactgaaaaggcaaaacaaaaatttccatgtgaataattataatttaggctgtaatttattcgcccgcgacatcgatgtactgtaaaaccgtattcaattgaccgtttctctttttttggatttaaaaaatacatttcatatatttagaaagcggtgggtgaacagtcgacggtcagtatcaatttcaaggcacgcattttcaacacccaaacgtccgatttgagcacaattgtcaatggactgcgcaaaagggcacggagtgagtgggggggggggataaaaagggatttgttgggataggacaagtgaaataaaaagggattttaaaaacggatcgggatttgaattaaatgaaatgaaataaacccaaaatgtaaaaacacattccgatatgtcagtcattttgctttgcttcgacgacgtcactcagttgcgaaccttcgcactttctttgtttgatggaggactgaaaacaaaggtgcgtgggatgccaaattacgcgaattaatgatttaatcgatcattaaggattatttgtacatcatcccggataatgacctgatcctttcatgtttgatcaattaataaaataattgattcatttatttgttctttgtatgcatatttagtcaatttgtcgcg

SEQ ID NO: 14527 - DNA, 1873 bp, Heterodera glycines
  misc_feature (1786)..(1786): n is a, c, g, or t
  misc_feature (1824)..(1824): n is a, c, g, or t
  misc_feature (1840)..(1840): n is a, c, g, or t
ttttattcgaacgaaagaatcaacaaaagcatttcggagaaaatgatggcatcaaatcaaattccaaatgtgtgagatcggccatttctcaaattaaattatttttcaatgctttcatccgcttcttcttccgctggcagcgacaatggcctaaaattatttatattttttcgacaatcaaaaattgcttttgctgctcacccaatgcaatgaattccatcccacaaatcaaatcggatcttgttcaaattggcacccgaataattggcatatcgcagctcaaatctgatatagttcaaattagcacccgaattttcacgttttcccacttaactggcgccgtcgccgtctccccaattgggcaccgttgcaacagccaattatacaggcaattatagcctaattcatcgctatgtttcaatgtcagcttttctttcgtccgtccattcactaattcaaatggttcaatttgcattgtgtccacaagaaaaaacagttgaattgtgtaactgacagaagtggtggcatggcgaaatttctaaacacaaaaattggtaaaataaaaacaaattgacggaaattctggcgagacacacctctttgaagttgttgacccattccagctttggtggaccaaaataattattgcgatacaattgcttcggttgaccatctttgctcggagtgtgcaaccatttggtcaaagcttggccagcagttgcatttggcccatcatcagcaattccatcggggaatagagcaccagaatcaattgaattcaattgatcaacatcagtgagaattgtcggtgaaatgcggcgacgcaatttgtccaaatcatcgccatcgtgaaagccaaaatgacgaatgcttttcgcaaaaattggccaaatttgacggtccaaaacatcccaaattcgctggtcacaatattcaatatacaattccaaattggtgccacttctgtcccaaattggcttgttggaacggagaaatgtgagcacagaatggtcaatgtaactgaaaaggggaaaaatgaagattggttttctgtatattttttgatttactgaatctgaaggtccttaaaacggattttgatgggcagcggacggtccggcaatggaaatgccacgcatttgtcatcggtccatacagacagtttcgcttttggttcttcgtccttgcgaatttcgattgctttccaaattgtgaattcgctttttccatcgaaatgtttgtccaccaaaacatcgaaacggtcggaaagcaatgccattttgaggccgagttcaggacggtcaaaagatgggagaatgtccatccaaacgtcgccacaaatccaactgaaacataagaaaattgggtaaaacgaaattgtaatttttcaaaagaaattgcttaccgtctgttcattttttcgctattctgcatcaaaaatgtcttttcgacctttttatatacctactaaaataaaagtgagagatttgaaaacggatgaacggatggggggagaaaaatgcccgaacaataatccgatttgatgtattttcattaaactgagtaccgaggtcccggttttgaccgggaccgggaccagtcccgggtcttggattagtacttattggcacctacctatgtactcgaaatcgaccctcatgcaagaaaatttaaaatttgccgattttcaagattaactacatattttcgaaatttttcgtctctaatatcgcaattataacttttttttttgttgaccaaatccaataaagttggtatcattcgnaagctcttaacaagctctatcggctttccaaaaacatnaagatttaccgacatngtaaaaagtataaattaaaatatgcaaattctg

SEQ ID NO: 14528 - DNA, 1451 bp, Heterodera glycines
tgtttcatttcggggggggggggggggatctggaatcttggaattttctgggtcccaaaattctggattttttaataaattaaaatttcttaaattttttgcttttaatcgctgtttttgtggcgctgttttcctaaaaaaaatgaccgatcatttttcagttacgacgaattggattgatttgatgatactttgttttttgctctttgggcgtacgatataaaagtgagttttgaaaattttgattttttgttaaattccgaggttcgcaaacttaatttttaatttaatttaattactaaggttttcaataagatattaagtgtacatatgttttattcgaacgaaacaattaacaaaagcatttcgtagagaaaaagagagcatcaaatccgtttcctattggcgagatcgatcatttctcaaattataattatttttcattgctttcgtccgcttctttttatgggaccaatgatgtgaacgattaccgacggcgccagttaaatttgaagaccgcgtaggcattgctttcctatcgttttgatgttttggtggacgcgcattttgatggaaaaaacgaattggtaatttggagaattatcagaattgacaaggacgaaggaccaaagccgaaattatctgtgcggattgacggcggcacttttgtggaatttccgttccccgaccaaccgctgcccaacaaaattcgctttaagaagcttcggataaagcaattttatacttttgtatattaaagcattttttatatttcttcaattacattgaccattccgtcattgaatttctccatgccaacaagcaaatttgggacagaagtggcaccaatttggagttggatgagtggtatgccaccgacgaacagcatttttgggatatttttgtccgtgatatttggccaatttttcctacaaacattcgtcatttgggctttcctaatgccaatcatttggacaattggggagacggcggcggttcagaaacagcagcagaagaaggacgaaaattcggatgccaatttgaacaaagtgttcttccgtctttacgatgacattgggtgagcagaaaggaggccttttttgtatgaaacacggatagggaaacggtatcccatgtacagtactttcccagaatattggcagggccatgggttctgctaagacagaacttcagtccttgttttgtcttttttgctctggtccatcccgaaaacccttctggtccgggttttttcaataattacgggctgtacttgcgaaaaagttatccgattcaaattgcgcttaatttaggccgctgtctccgccaggtcaaagccatgaaaaagtgttctctttttccgggtccagtgatcagcggaagaagaaaaagtgatcattttgggaaatggccgatcattatcgagttatgatgaattggattgattgatg

SEQ ID NO: 14529 - DNA, 1014 bp, Heterodera glycines
ctgcattttccgccatttttaatttccccggacatttcccatttaggattttgccatttttattttttctcggcattccctttggcattttccacgagtttttacttttcccggcattccctttggcattttccaccgtttttggcattcccaatttggcgttttccaccttttttaacctttctggcattcccaatttggcattttccacaatttgcacctgtccccaaatgtgttcagccaaaactcctccgcctgccgttttgtgattcgaaatttgttgcccacaaatttgccctccggaaactgggacttcagctcggagagcatatgcgcgaagatcagcgagtttttggtgaggtggcgccgtccgctggtgccctcgtcgaagatttggtcgcggtacgttttgaacagtttgaccgtctgtttgcatttcagcgtcaaattggagaggaacagacgcaagtacaaattgtcctcaaataattttggtaaatcaaactcaaattttgttgttttcaacaaatggggccaaaaacattaacaatttatatggaatttttttttaaaatatggataaaacccatataaaacttccaattcaatttttttttatatactaaatttgccaaattaaatttttatttaaaatttggttaattttttaaattttctaaagctgacccttagggtgatttatttatgaattttatgggcaaaaacatttaaaaaaaagattttaaaaatcgattttctctttttcaacctgcaaaatgttgggctcatttgcaaaaatgctgttcaacagattgtaaatgtcgggcagaatgtccaggatgaacggcggcgagttcttcaagttcagccggggctgctggcacagccgaatcaccgtctccatggcacgatagcatttgtccacggtgcgtcggtccttcacagcagcggggcataattatttttttgaattattttgggaaggaattttgaattttgccattggcccctaaa

SEQ ID NO: 14530 - DNA, 2153 bp, Heterodera glycines
agataatctttaaaaaatttttggagcaagattaagtgcgcacattaatagctgcaggggaaataagaagcagcggtttttgttggggatggaaaatgaaagctaaaatcccaagggattttcggatggataacggcggaagggagggatttgggacaaaactgctgttgctgctggtggtggtggagcaacatttgcaagtctcctcgatcatttaaaagatgattaaatcccaccaattgaatgaatgctcttcgctaatccctcgtccgttggtgtcccaaaaatggacaccaatcaaacagaaattggaaaagccatccccaattgtacagcaaatgtcaagaaatgatttaatttctttctcttttaaatctgtctttttccaaaatttgtacaacattttttccttattcaacgccgcacattaaattttgcagcacaaaaatttcatttcccaaattttctctatctttctctgtgtatgtgcagctgcatcagcaacagcaacaggcaacaggtgtacgcgcaccgaaacatgcctatatttagcaaaaaaatggaggggagggaatgggaaattggatgattattccattcattgagcacaaaagaccaaagaatgggtggagcatgaggaggaggaggaggagagggatgaggatgaggaggatgatgagggagaagaagaggacgaagagggaagcggaggatgaggaagtggaagatgagaaggggggaggaagaaaagcggatgagaaggcgggagaagaaaatggaggtgaagaggacgagggggagaaagaaagaggatgaggaggaaagaggagtgaggaagtggaagatgagaagggggaagaagaaaagaggatgaaggggggagaagaaaatgagggggagaaagaaagaggatgaggaggaaagaggagtgaggaagtggaagatgagaagggggaagaagaaaagaggatgaaggggggagaagaaaatgagggggagaaagaaagaggatgaggaggggagggtgtctggaggacggacggacgacggcataaaaaaaagattttgagcagtagcagcagcagggagtgatgggagatgatggaggacacatttgttgtatgtgtgtttgtgcaccagaccagggttgtggcgaatcgaaaaatgcaaatgcgaaatacaaaatacgaaaaaaagaatataaaatttttttttaatttgcaatttgtaacagattttgtcagtaaaatgagcaaattttgcaattttgagacaattattattttcattttaggatttttggatcctcgggatatgccaaaatacgaaaacgaaacgctctaaaacacgaaaagcgaaacgatgaaacaacccgggtgtgtacataaatctgcacatttctgttctgtcatacagtcatggtcatatttggatgctgatcaaaaaaggtagcaacaccaagttgatcagatcactccttcatggtgatctgatcagcccattttggctgggaacgagggtaaatttcaaaaaaaatttctagggggttgggaagtctttatatgtaaaccatgagtctgttccattaatagattcccatgattggtacacagttgtctttggacaactgggactcttttgtggccaaatagaccaacaagttagtcaaatgtgatgggatgcacacagaatcggacaacgcaatgcctaagcgagaaaagagcgaagcaaattttcgatgggatagacaaaattgtaaaacattccaaacccaccgaattttactctattttattatttttatggacctgctccgctttcggtatacattgccaagttcagtccacatcgcttgtaccgggaactcttcccgcaggattataccgaaatgatcgcctctgcccctcccaagaaaatgattatgggttttgccgaattgcactttttgctcttcagtaatcaatcaaaatgcatttatcagcagctgttataaataaattgtttttaggcttaatttctagaaaaaaacaaccagcctttccctgttggtacttacgtacgaaacaattgccaattacgaccaaaaagcatttgaagcatctgtcaatgaatacgtaaataaggaaaaatattttggcaatcataaaaatgaa

SEQ ID NO: 14531 - DNA, 912 bp, Heterodera glycines
ttttcggtttttaagggtatagtttttttaattttcaaaaagttgaatcctttaggggggggtattttttcgttatttcgccatttttcttgtgaaaatttcccaaaaaatgaccaaagtatgctttaaaaatccaaaaagggcaaaatatgcatttattttcgaaaacccccaaaaatatgcttttatatgaactttattttttttcttcttcctgccaaattgattatataaataatgtattttaaattttattaaaggcgtcgtcaaacagtttaagtcaaattaatttttatccaattatatgataagtccgttttgtattcataaaaactttattaaatacacgtaataaaccatccctttgcttgtcactgcgacacattcagaaccagttggttggcgcccagtcgaccccacccattcttttgtgcttttcgtttttattacatttttgttaaataaattttgggcaaaacgccaaaatagttttttttttcgaaaatttttaggctctatcatctcagtcattagtagggctgctaattttatgtaaatacattttttttttcctggcttctccatgctctatttagtaggaaaaacactttctttttgtgtttgcgaacaaaagttgagacttttatttacatatttcggggttttatacatatttggtacatattttggactttttcttacatattttcattttttttcacatattttgaggattttttacggaaatttttgaaaatccttaaaaaaatccaaaatttcggcaaattttcatttttttatatatattttgaagaatttttgaaaatttttttagtaatttcttgtgaaaaaataaaaactttttttaaaaaatataccctaaaaataccaaaaataattattaaaatgtta

SEQ ID NO: 14532 - DNA, 3683 bp, Heterodera glycines
  misc_feature (675)..(675): n is a, c, g, or t
  misc_feature (1076)..(1076): n is a, c, g, or t
  misc_feature (1280)..(1281): n is a, c, g, or t
tacaaaaaaaggattaaccgtgtgtaaattttgaattaacgctataaaaaaacgcaattaggctatttggcgttatgtataactttgtctaataagaatactgtagaaggagatagcgagttttatattcatttttactagagttgagcgggtatcgataattgtaaaagaaacggaaccgggactgaccggaatggaaaaacggaaccggggaccgggacaaaaatttttcccccgaccggggaccggtcccgctcccggcgaaaaccggaaatttcccttgttaaaaaattttggcccacttttttaattttaaaaaattattttttttttttccccccgggccgggtttttttctttaaaaaaggtttttgataaaaaaaaaattggagggggggggaaaaatttttttttttccccccccgtttttttatccccaaaatccaaatgaaaacccccaaatttaaaaaattgcccacaaaaggggggggggggcccatttttcctttttttaagaggcccccccccccgggaaaaattctgaaaataaaaaaaaattttttttttttattacccctctttttttcccccccctttttttctccaaaatttttttaaaaaaaaaaaagggaagaaaagaagagaggggggggcccgcgccgaaaaaaaacacgnaatatatttttttttttttttttaaaattttttttttaaaaaaaagacaaaaaaaaaaaaaaatttttgttttttgtgttgttctttttgggggggaaaaaaaaaaggaaaaaaaattttttttatttttatttttttttattttttttttaaaaaaaaaaaaaaaaaaaaaaataatcccccgctgccggggggggcccccccccaaaaaaaaaaaaaaaaaaaaaaaaaaacccccccccccccccccccccccccggcgcgccgccccgccaagcattaatttttatttatattttttttttttttaaaaaaaaaaaaaaaaggggggggggggggggggtctcccccccccccccccccccccccccccccccgccgcgggggggcagtttttgtanttataatgataaaccgaaaaatggggtttgcgcttcgcggccctgcacggttttcctggcatttcttatgacacacattttttatattctaatgtcttttgttttctgtcattcttaaacaccactcagcatctcatcactggagtcaagttacggcatacaatcactggactcattctcggcattccgacactgtgactcatnntacggcatccaatgaccaggactcaattctccggcattacaatcactgggactcaattctccggcattccgacactgtgactcaatttaacggcattcaaatgaccaggactcaattctacggcattacaatcactgggactcaattctccggcattccgacactgtgactcaattttacggcattcaaatgaccgggactcaattctccggcattccaatcactggaactcaatccaccagaattccaatcacttttttaagtaaattgtttaatggcaggctgcaaattttttccgtaatgatctgtttttctttgattaaaattccactttctttttacctttaggttttaatcattagtgtatttctcttatttattgtatttagaggttatagttaaaataattgttttcattttaaatattttcaattctctaattaagaatattaaactattaataacgaatgataatgcctacagctttttttgtttgtatttcattataataaattcacgtttagtacataatacttgaaaaagaatatagtattgtatattattttcctcaataattcgaagaagttttcattttagtcttaaataatttctaaattgatatgatccatttttctcgtactgtgcgttttattggtgtcgagattgatttataaattatttattaatgaccgtgcattttatatatttaagagcaaaagattaatgtaaaaatttacaactataaaatcatcaaatgaattctaaataattaaataagtttttagtaaaaatattgagtatttttacaaaatttattatttataaaataattcatataataacagcaatcgaattgatctccgaaatgactattcaatatactaacacgcgtacaaatcttgaaaattttaatgtgggtaattttgaaaataaaataaaaaatcaaatgtaaacaaaaaatcaaaattaaaattcaattgagcaagatatataaacaaaaaaggacaaaaaaatttgaaataaatttattcctgaaatttatgtattaaaaataatttcataaattatgaatttcaaccatcttcattaaaagtcatccaaaataacgatcttaactcggatataggtgaattaattaatttatttatctaatctaatttttaaagaattattaataaagcataaactttcataaaattttgtgaatttaatcagggcgaccactgtacttattctaagatttgcgcttatttagcgtgatgagacatttgcgccgcgccatttgcgccgcacagcaaaagtggacacttgcgccgctcagcaaagtcgatacttgcgccgcgccatttgcgccgcagacagttgcgccgcggatatttgcgccgctccatttgcgccgcgacatttgcgccgcccagcaaaaattgacttttgcgccgcgctgtcaaaaatattatattcataaaaattccactattatcaataagttttactaaaactataagccatcgacaaaaataactaattgaaaattcgaaaaaattactagtcaaaaagattgacattcaattttttaaccattaaaatcaaatggcgcggcgcaaaagtcggctaactgattaattaatgcataaaccaaatatgatacaaattcactagctcaaaacttatttcacatcttcaacattcttaaaaactagggtttctccccgacccctgggggggggcaaaaaaattttggagttttgggaggccggcggttccgataggcgccgccgaaagtttttcggaattttaggaatttttaattaactttattaagaaaattgtacaaatttaaaaattttcaagagttcccaattccctgagttagtgtcggggggtcgggggataaaaagtcggaggtagggggctcggggtcggggagcaaccctattataaacccccaaaataggtgccaaaaatggaaatgagataaatattttaaaaatcaaaaatgtagtcaagtaaataaataaataaataaattttgaatatgaatttttgataaaattttccatttctcaggggtgtatttttcgtttttattgcatttttgttaataacttttttcaaaatagcagaaaatattttacaaaaaattcttcaaaatgaaaaagagcacaaaaaagcaataaatttattattattattaacaggttatatcgctccgatttaattcggtttttttcggtttttcataaaagtcggtcggttgtttcgggttttgattatttcggtcggtcggtttcggttaaaaacccgaaaaaaaccgaaccgaaaaaaaccgaaaaagtcaaaaatttctcggtcggttttttcggtcaaaaaccgaaaccgaaaaaaaccgaccggtccgatct

SEQ ID NO: 14533 - DNA, 2628 bp, Heterodera glycines
  misc_feature (83)..(83): n is a, c, g, or t
  misc_feature (2604)..(2604): n is a, c, g, or t
tctagagtcagacgccatttgagggacaatttacatttgcgcattcattgtggaccaaattacccgcgggaagcgccgatcgntcgctttaccactaaaatcaacatgaacggagtgaatcagcagaacggagtggtgggttttggaaaagtcgttggtcattggcattttgaaggtcgacaaacgcgtggttccgtcacttcgtcagtggaacccttcttatcatataaagactgtgctcgaggacatacggaggttggcctgtgacattaatattcttaattgttctatgtaccattatttcaattcgtcgaaaaggtaatactggaaaacctggactacgtaaaaaatctcattaaaacaccaatccgcggggttttttggggggcttctgatcacaaatatgacatcagatttgcaaaattaatttccgaataattattgacaaggtgataaatgctcatctaattcaacaaattatcgagtgctgctagacgtaaatatttatataattcaaacttcgaaaatcggattttaaaacaatgataaaatcaacgattttgaaaattttatatcatatttgtaaacagaagcaacgaagcccccgaattggtcgtttcataacagaaaaaaaacattatttttttgtggagtcaagattctccaatattaccggtaaaaatcattcgacttacaattaatttattgttagtctataatttaatttccaaataattttttttttgttctttataggcacttgatgactgccaaagagaattcgaagctttcccagcccgccgaaggttcgtcgtactgatgggttgcactccgttccttcaaacgaatattccttccatcggtttttgccccaatttgtcgtggtatttcgttataatttgagtccttcgaatttagctcctcctttttgttcgttcgtttgttttgtctcttcactataactgattttaaaataaaaactcccagacattttatgacaaatgaatatttagctccgaagtttctttttgaagctttgcttattttaccacgtttctatattacctaatttatttttactttgtttttttctgccgtttttctaatggtaagaaattcggccctttcttttcttcacttcctttgttttgtcaggagctttattttgaaattctgcgcaagaagcaacatttgctggtgcaggcgcgggagaattggacagcgaaagatctgaaaagagtggtggagggcattctgaaggtggtaccaatttccactcataaaatatggtctcgttaatcaaaggaatagtcaggaactgtattgggttttgagggaagttggtgattaatcattaatgacacgcttttcaggtgccacccgagaaacagtctctgtacaagccgaccaatgagcagcggacggaatgggaggcaatggacgagaagcaaacgttgcacgaattgggattcacaatgaaaaatgcgcgagcggatggtaaaactgccgatttatgcggtaaagtcgttcctttgtaggcccggctgtgttggcgttggttttgccaggtttactcacaacctgacttagaactgtttttaagttcatggcttattgacagaggatggcaaaagtcccgacatagtgccaatgacagtcgcaccgccggtgcccgaagcaatggcacagaacaaacagtccgaagttgaaatggtcgaggagtgacgacaccactaacattttagagggcagtgattttctcagttgacttcgccaaattttattggaaaataaataataccgaaagccattaaacaccttttactgattaaattaattattgtcacacgacaaatttgagtgtgataaaagcaggaaaattgacgagatcattcacaaaaattgctggttggaattgggcttcatttcgtctaagtattcgagtgtcaatttgcacaatcctctaaaaataaaaggtgatgaaagttaattatgcattggattgcctcagtgcatcaatttcagtgggtccggcaaatcgaaaaaattctctgtcgaaacttttattctcccggtgattgttttttgctcttttcttccttttgtcttctgttttatttttcgaagagtggatggtaacagcaattcggtgcctatcgtagtcgagctcgggagacaaaaggaacccgcgttgtcgcccttaaatgtgggccaaatttcttccaaatatttttctcactttggatatgattagttgcttttctgttaatcagaatcggaaaagcatttggggatgcccagtttaagtttggcccccagtgacgagtggtcacattttgggaaatgttcggctgtttcacagtttgcatctgaagggctctttcattaggttattttagccatttcgctaaagttcttgatttcttaattcacctctctcagcgtcccacaaacaaaacggccaaatttgagaattgctgctccaaacttttcgatttcgcttttatttgggctttgtcggaaatgccatttgatacattcataaaatttggtgaacaaacggaacaaagaatcggctaagaaggaaacacgctccaagctgtnaatgctgaaagagaaagggaaagt

SEQ ID NO: 14534 - DNA, 2108 bp, Heterodera glycines
tgcatttttagtttttacatatttttttcctgagctcccagtgatctgaaaagcacgaaaaccatggttaagctaatttctaatttttagaaccttttttaagtttatattttttagaacctaaaaattttcgaaaaaaccttttatctatttggcgttttgcccaaaatataggtaaaaatgcaaaaaaaaaaaaaaaatcccccccccctacgaatcgaaccctaaaatttccgaggctgggccctagactggttccttcttaaaataccatcacggcccggctgattttaaaatttcagtttcctcattatcttaagcatttatttttgctatttcttttttttcatattgaaatttcacaagaactgtgcttctattgatttacgtacctttttatgatggacgaggacatggaagaagtcgaaattgtttttgctcaacgattggccagcggtgaaccaacggcacgacaaagggccatgaaacacttgcgaacgcacataagagaaaggacgaaaactgatgcaaagggtgcactttcttccacttccaacactttttgttgacattcccttttcttttcttaggcttttcctctgtttcgttagcgcgactttgcaaagggttgcattatgcgctttggatgcaggacaaaatgactttgcaggaggaacttgcggatgaaatctgcgctctttgcaactattttcgcaccgacgagcaactgcttgaatttgtcgttgttctgttcactacgctttctaaggaatggccgcacatcgaccggtggcgaatggacaaatttctcatggttatcgcaatttcttatggctgatctgtcacttattccgctggtttatattcagttggtccgtcgtttggttcgcactttgttccgtcaattgtcctcccaccgctgggacccgccattgtgtgaccaatttttgcaaatgtttcgctcttcgctgctcagtgccaattcgcctttatgcgagtctttgaaattccattgcgcgtccgtttggttggacgaattggacacagcggcaacagcgaaagtgacgccgagcgaagggaacgccggcaaaaattgcgaagcctttccattggatgaacagcgctcgttggactttgtttggccttatgttcaactgttgcaggagcaaatttcgtgggaaataaacaaattggtgttaaatggaaatattgccaattaattcagtgactcttttttccgcacaatttgttccgacattttcgatgcgatactttgcgattttgagcaacgaaaagcggagaaaatggacgaacattgcgacgagaaacagcaaaatgtaacagtggaagaagaagaaaaggtggacaaagcatttggggctgaagtttccgaaattaatgccaaacattggaaaatttacagaagaaaactgaagaaaaatcgtcgtcttttgaatttgactacaagcgaattggggaattactttttgaggttggaaaacaacagaaagtgccaagtcggaggaggaagcgaatttacgcattgtgtaagaagtaagtgaacgaagcaaaagaggggaagggacaaaaccgggaaaatttgaaattgattgcaatatcttttttttctggaattcaacaaatttttgttttcaataacacataggttttcaaaaaaacaagctaacaataaaacaattttttaattcatgaaatttttgaaaaacaaaaattttttttttgctaagacgttttttccggccacgttttgggttgtgcccgggggggggggggtatgtaccccgggtagccttccccctgggaccgtccttgctgtggtgtaagtggtcgcctcttcgttaaatctttatttcttctgaatgaaataaattagattatgttcctataataaatttttgggttgcaaattaagtgcgaattcatgttttttgtcactttatcccatgaaactcaaaatgtatttacagattcgaatgtgcggcccaaggcgatgaccctttcccggtgccaaatttggagggcgtgaaaatacgtaagaaaaagcgacgccgaaaaaacagcagctcttgacaagtcgccattgttat

SEQ ID NO: 14535 - DNA, 3142 bp, Heterodera glycines
  misc_feature (3062)..(3062): n is a, c, g, or t
aaatcccaataattgccttactttaatccctttccatcgcattcggcatttccccagaatcagatattaacctcgatgtaaaggctttggaggaatgcatttaatgctttgaggtcgtctatgtaaataaaagtcacgttttataattacgttgatcaagcgaaaaccgtatgattctaattcagcaatgagcatgtggccaatctcgtgggcagctatcttagaaattaaaaacgtaattaaaaaaggtggcacgaaaactaacctccgaaagcgcgtgtcgtttatgacgataaggaggaaacacgttctatgttctccaaactcatcctccgtagctgtacacatgccgattgaaagtaaaagcccaaccaaaaggagagttgaaataggcgcagaccgaggccaaagtcttcccggaggagattctcatttttcttttgaaataaaatgccaatataaaccataggatttctatggcgcttgcgttgattcgactcagtaaaattacgccaattaattcccagaaaattccagagtcgagagtgtcgatcagggatgttgcaaagagaaaaataaaaagcgaaatcaaaataaaaagcgaaaaggcgaaagcgaaatgcccaaaaaaagcgaaaaggcgaaagtttttcccaaaaaaatgccattgtttatttcaaaaacccaatctttaggggtgtacatcaggaatgggccgaggtttcgcttttcgcatcctcttcagaaaggggggataattagagattgggggataaatagagaaggggggattatttttcgacagaattattttgtgtaaaatttttgaaattttttgaccatgtcgccaaaaaatgtcatcgagtcaaagaaaaatcattttttattgcattttttaaaagaaattctgttttttctagtcttttaactatctataattatggttgtaaattatatggattaacatattttttctacgcatatgctatgaagaaaggggcttaaaaataacatttctgcgttaaaatttttcgatttggtgaaggtttttagtccatataaatccatattttgggcttgccactataaaaaacattttggaagttggccactaaaatagtttttttttgccacaaatttagcattttgccacctatttttcactattccgacattttttggaaaattccttaacaaaaatgcaataacaccaaaaaatacactgtgttaatttaaaataaagacaccctgttttttgggagtttgaccacttcccatgaaccgatcgagctgaatttttaactgtacgtagcaattctgaaaatattaagattctgaaagtgagaaaccgaaatgatgacggaaaaaagttttacgattttttttcaaaaatggggtgttaatttaaaatagaaaaatttttttaggtaactattttgggttttttggtcttaaaaatcccagtcctactcatttgcaactgcaaaatttcgggtgaggtagttcttggagggggtattatgtcattatggacttttcgccactatctttgccactattttggcatttgtagtacttttactgtcgattttgtttgtttttgaaaaaaattgacggcatataattttctgaaaattctatttatccccctggaggataaatggagactgggggattatttttcaaacccctcctagactgggggataattggagattgggggataattagagcaaatacggtatattacccatttatcattttacaaaaaaaaaacggaagcaaaaaatataaaaaaaaaaaaaatcaaatttcttttatttttcatttaaaatttgaaaaaatacagaattcaaagcttttaaaattatttcatttcggctcccggacaatccgacagtggacaatccgacagtgaggacaatccgacagaagtggacaatccgacagtggacaatccgacagtaaatttctattttaaaaaatattttcaagtcattagaacggattatttcctaaaaatatctcaatcaaaaaaattattaaaaggaaatgactagttactatttaaaataggttatttcgcgtcctttaaatgtccctgcaaagtttggtgcgcttctgatcagtttctgaaaaaaagttaagcctaaacattttggcctgtttaaaaaggaattaaaaatttttattcttcaccatttttcataatatacgcctaagagggcctttaacacgtaaataaaataaatgaatgaatgatttgaagaggtaaacggaatggtcaagactttggcaaacatttttatcagcaaaaatgctctcatttctcatcactttggttttatgggtcactccacatttacttttgcatatttatttatttatggttgtatggatcacttatctttaattattttttattttattgtacttttgttaccagcataccaaactaactttttttaatttggtaacaaattaaagctaaattgatttgattgagatatttttaggaaataatccgttctaatgacttgaaaatattttttaaaatagaaatttactgtcggattgtccactgtcggattgtccacttctgtcggattgtcctcactgtcggattgtccaactgtcggattgtccactgtcggattgtccagtcacgtttcatttctcttccgaaaatttgaatcgatcgatcaattttgcctcaggcaattccattcaccggaaatgatcagctgcgtcatcagcctcagaatggcaccgttggcacatcagctggtcttggaaatccatcagcaatgtttttctacgcattggacgacgatcagcggccaaatgacagcaatcaacaacagcagatgatcagccgatggtttgaaattgatgaacaaacgggacagatcagtgccatcagtgcgccaccgattggcattgatcagcagcgcaaaaccgtcaaatttggggtaattaatcaatggatgagtctttctctctctatctctctctgatcggtaagccaggcttctctgattagtgattttcactgacaaggncagaccttttgatttgcaagcccagtttttttgatccgcccaaaattgaatcataattcgtcatttttcaatgccctaat

SEQ ID NO: 14536 - DNA, 3955 bp, Heterodera glycines
ccaaactttgctctttttaacaccatatcaccttttaacgattgatatatttttgaaaatccgaaaaataaaaagcaaattaatttttaatttgcattttaatttcaaaatttttgattcagtagacatttttgtcgtatttgtattattaatgtacaattagcaaaacatttacgccaacaatataaaattcatggtttttaattaaaaaaattaattaattaattataattttgctaattaattgccccccccccccaatttccttcagacacttatgtcacaagcgttggaaatggtaaagttgattatgtgtggttactgtttaggtaggcattaggcgagaacaaagaagccgctgctgtcattgtcaaatcgaatttgtccaatcgttccgaagtcgaaaaggcggaaacgaaaataacaaagaatttgaaaaacggattcaaaattcacagtaaattaaaggggtcgtaaaatatgtgttttttgtacaaaaattcgcgatgaattttcttataaatttagttaattaagaaaacatgaaatcattctttggccttgaatgccgtttattagtctagaaaattatgaataaatttcttttttacataaaaaatcgaaattttgtttgggtttacattttttaaaccttagttttttatttttcataattttggtacatttatcgacattgaattaatctactaattatgttgtttctgtggaaaatgttgataaattatggttttcgaagaaggtgtcgaaatttacaaatgtacccgcactaatataaattaattttaaattatatttttaattttgctaaatattgacccattttttagacagttattttacaaaggtcggagatggtcacattgaatttgtgtggttactgttgaaggattcgtcgggcaaaaatgaaagtgccggtgccgtaattttgaagtcttctctttccgagagtgtcgaatatcaaaaaattattttcaaaaaagagactgagcttcaaaagactcaaaatgctttaacggacaatttgataaaaggatacaaaattcacagtaatctttttttaaaaatatattttttatataattattgtattaatttaattaattgttcgcccaactctttcagaaacttttaccaatcgcgtggggaatggcaaaattgactatgtgtgggtaatggtgaaggactaagaatttctttttagaaattttgataaatttatatatttcgcgctttttcttacataaaatccccattcctaaaaatatcattttgatccaattccatataaacttgttaccattagaattacttgaatttgttaaatttagtttaatttaatttgtcgagcgaaccaaaggcacatagtgcttttacatggtgccaaaaagaaaataaacaaataaaactgataaaatttaaaaaacatgaaatgaataccgaaataaaaggaaacccaaaagtttaagacgattttttaaatcattttacttttttttgtcattttttcaaaacaagttccagagttcttgtgaatcgaaaaataaaataagaaatgcgaaacacggaaatgaaagctctaaaaacacgaaagtgcgaaaatacgaaacgcgaaattttttgcaataaatttttcaaccacaaaaaattttcggaatcaatttattttcatctttgccgtattatttttcctaattttttggtggagggtggtcggcggtccgacaggcggcgcaggggaaattttttttgaaaattagagtgcaatttattaacaaattttgtctataaagtgagcaaagtttgcaattttatgtcaattttttaaattttgggttttaggcccgtgggataaattaattttttcaaaaaacttttactctgttaaaatacgaaacgcgaaacatgaaatgatcaacatccctgatatgtttgttatctatttcggtttttggtccccaaaaatcatatccctactctaaaaattggtttcctaatttgatgctgaatctcccatttttttgctgttggaatttttgatttttttgagcattttgccaatgttttccatgtgcttttttgcgctattggcattctgttggattgcatctgtcaaagctttctttttggccctgccatgttttagatggaccaaattttgggagatttctcgcccaatttcttcatattttcgcaatttcgtttcaattttcagctgaaaatcggccaattcaaataacaatttggtcgatttgactccggcattttctaatttcttctcattgatcagcacttccaattctggcaccaaatcatttttcactgcttcaatttgcttagccaatcctttcaaaaataattttgtgggcttaaatacaatttcaacaaattttaaagcaaaaattaagacacaaaaacacttgaaaatttcatttttttcatataaactattcatttcgttacatgaaatttaaatttgttttatttaaaaagtaataaaatttatttacttttttttggctttttttgcagacttttgatcatttctgcaaaatctgggcaatgtttggtccaaattaacatcgcaaatttgttcaaattcggcaaattttgcacaaaattcgcccatttgtccctcaataacattcattttgtccattaattcaatgttctgctccattttgtcttcttttcgtttttctttaatttttgttgtaactttttttggtgattccttaatttttgccattatttttttagataaaatgtctttgttttcgttcgttttgcttgtcgtcgttttgtcctcctttttttgcattgccaatttattaatgccattgcccaattcttttttgagagtgccgatttcttcttcaaacactttcatttggcacaatttttgccatttttcacttgtttttgcaatgaatagtgatgacaaacttttaaataatttttttgaaatttaatttcttaatttttaacttataaaatgtgtggaaactattaaattttgaaatcattaaattaattttattttttatttttacgctcgggttggtccccgagccgatgcggggaaattacaaatgtcgtgattgcaccccaattcgatgagagtgtctttaaatgggctcccgaaaaattgaaaatgttttctattaacctgcaaaattttcaaacgctttgttatgattcaagaaagttatgactaaaaatgtccaaaaaaaaacatggttttttgaatttttgcagaaaaatagaaaacattaaaactatcgaatgacatcaaagttttaaaatttgattcattttgtacgaagttattaataattttctgtcaacaaatttcaatttgatggttttttgtttcaacaataagattttttgttcgcgtttttctcggctttatgaaaagaaattggaatttaacgatttttttttggaattttgcaggataataaaaaactttaaggctatcaagttaaatcaagaatataaaatttgttgcattttaggctaatccattttgatggtttttgagtaacgacccggcaccacaaaatttgaccgggaatttcatctccaatttttctccccaagagtcggggacagcagccctaatttacggctgtacattaattacccttccgttttgtctaaattcaaaaatgtgctggcagcgattcgcctttcatccggcactttgccaatcatttcgttcaaattttttatctcattgtccaaaacgtgtttttcctatccaactttcttgattttggcgtcaatttctgctttttctcccattgatcgctttctcctttgtacttttgacgatttctaatatttaaagtaaattgttcttttgcctttttcagttcgattgtttgcgaaccaattttatgacaaatttgctctaagtgattcaaatcat

SEQ ID NO: 14537 - DNA, 2064 bp, Heterodera glycines
cccccccccccaagttcctccaattttttgggaaaaaaggttgtgtgaaaagtgaaaagaaaaaaaaagtcgtagaaaaattcttgagctttttttcaatttcgtaaattttggcctctggggggggagggggggtatttcgtaaaggcaatttctgacccccccccctctctccatgtatgttccttcgtgtagtttcatactgtttcaaagatgaaattaaattatccgaggcgtgagtgcgttatgtcagtttaattcagcaaatgcaagcccaccacaatttcggtagcgcaaaagttcagtgcatccgcgactccttccgccacgggcggtgcttcaacccattgcagaaatttggccgcattttttgctgtccttcggcccgtccaattgcaaaaagacatccgccgcgcctcggcaaaacgttcgtacacttcggcctccatttgcctcgtccgcaattccattcgtcgcattcgctccattttcgtcgcgttcagcgactgttcgtcgatgtcagccaaaagatagtccatcacatcaatgagacgcactgcaacgatcactttggaagtgctgaatggaaaagcgacaaagtaaaaagataaacggataaatgccactcaaagtccgtccgacccattcgaattcgaagaaaaagccggaacatttattgtaaggtattttgtactttttctaatacctactatatgtcccaatttatttttgtcagcatattaatctatgccattttcccaaatatttttaattttgctactttttcaatttcattaagtcgtccaatgaattttggatgttgagagacgatgaacttgacaacggcagaatgtcttctgaatcatcaattttttgttcttcttcacgaaacatcgctggcataaggtcaaccagctaaacgaaaaaactaagaaacaaaagcaaaaataattaatacccgcatgtatccaatcagttttcggatcagcaacggatggcgcctttcttataaaaaatgaatttaccgaaataccaaaaatggcaaaacctgaatgcgaacataaactcaggaaagccgacagaagggctgctaaaagagttgaatttttggtaaaacataatgagaaaatcaaataaattgtaactgtcgttcaatcgaaagtttatgggccttgtcgaggagcattttcagttgtttgcaaagcaaatcgagcataaattcctggcaaatgttcaaaggctcgtcggaatcgccgtatacaaacatcatccgactaaaaaggcattgcttaggaaaaacaacaaaaagagacgcttttacctgacaatcaaatgcaagggatagtcctcctgctgttctttccattgttgattatgcaaatcgcttgttgaagggattcccatgtccattaaagaaggaaaagaaagcacacaaaaatgcttaaatttattttagtaattttttttaaatttattcacaattaattttgtgccaaaagaaaaaacgacgcaaagaaccaattcgaaaattcattttctgacgaagaatggttccacactatgggtcaagcacactgtgcagagaaaagcctagtactatctcgtcgttttctttttctttgtaatttctctcactttggcgtactatctcttcggttttaatcatgtaaaaaacaacattcacttcgctctatagaacttttttttcgccttacagattttctttaaattttgcatatcgatagagaaaaaaattctgaatcgattaataaggaaatttaatacaaaaataaggctcactcaaaagttatttggtgaaaaattttgcgaatttctttttctctctttttggtgtactattttcatgtctctaacacatgaaaaatagaaattcacaaattataataatcttgattgtaaaggtacaaaaacactatgcatttagaatcaataagaaatgattaattttagcatttttgttagaaacggcggcctaggacttgagttataacgtgataaaaatttgaaactccaacaacttttttctgagatgtcaaattgctt

SEQ ID NO: 14538 - DNA, 1607 bp, Heterodera glycines
  misc_feature (24)..(24): n is a, c, g, or t
agtcccaaaagcattccaaatttntgatttataaaaatacacaactttttttataaacaattggcccatttgtaaaacctccgcttcgttattttagtcataaataaatattgcacatttttatcacatttaaatgtctctgtcagtgttggaccaaattaagcagcattcgaccattgtggccgacactggcgacttccacggtcatacaattgccatttattggaattggacatccagccaaaacaaaacattccctccctttttagcaatcgaagtgttcaaaccgacggatgccaccacaaatccttcattaattctcgccgctgcaaaaattgaaaaatacaaggaattgatcttaaaggcagtaaaatatgcgaaagaaagggcggcggggcaatcgaaggaggcggtgatagaattggcgagcaacaaactttttgtgcttttcggcaaggaaattctgaacattgtgccgggtcgagtgagcacagaagtcgacgcgcggttcgcctccattaaaacgacaaaattacctaattaatcttcccattttaatgggcagactttcctttgacaaagaaggctcaatagccaaagcattgagtctgatcaaactttacgaagaggagggcattgagaaggagcgcattctgatcaaactcagctcaacttgggagggcattgaggcagcgaagttggtgccattggaaattgaaatttttagtttaataattaaaatttaacatttccaagggttctcgaatcccaacacggcattcattgcaacatgactttgctgttcaacttttaccaagccgtcgcttgtgctcaagctaaagtcacgcttatttcgccttttgttggtctgtttgtacataattatgttgttttgataaatggcaaatttaggtcgtattttggattggttcgttaagaattccgacaaaaaagagttcgaccgaattactgaccccggtgtgcaaagtgtgaagcgcattttcaattattacaagaaattcggacacaaaacgcaagtgatggccgcctcatttcggaacacggaggaaataaaaggactggtcggatgcgatcttatgacgataaggtaaaagtggtgaagacgaccctaaaagttttaaaatttttatatttctattttgcctttcacggaattaggcattttcggttttagtgcattttaggagtctaaccatttaaagctttttaatacagtcaattttttttcttctaaatgaaatgctgggtttttatctatctctaattatttattacattcattctttttgcaaaaaacgaatttgattgaaaacaggtctaattaatttatcgtttgtcattgttttcttaagccccgctttgttgggtgaattagccaaagattctgaggcggttggaccgatgatgaccgtggaaaatgcaaagaaatgcgaattggagcagattgaggtggacgagaaaatattccgctggcagatgaacgaagacgcaatggcggacgaaaagctcgcggatggaattcgccgctttgccgtcgatgctattaaactcgaagagttgattcgatcgaacctttgaattaaaaa

SEQ ID NO: 14539 - DNA, 648 bp, Heterodera glycines
ctgccaattataaatgaattaaaattttcatggggaaaattttttgataaaaaggaaactctgagaaataaacgaaaattggctgagatttgagacggtgggaaaagccaaaaaagaaaaggaaaagggtggagaaagacagaaaaaagttatcgaaagaaattaatttaaagtctaaaattcccatgaatgcatccgcccaatttgagtaaattgaattatttccaattatttcgccaataaatcgcattggcactcaaagaatgccgtggacgattcgctccatcgaagcgggctttcagccgacagaaagccgagctttgccagccgcagttcggtttgcctttgcctgctgtgtttgctgtgttcgctcattcagcgctttaccaaaatttttcatttttcaaagtgcgccttaacaaaatttactgcggaggcaataaaaataaaaataaataaatgaaaggcgaagggacaattaaattgaatttgggaagcgaagcgaacgaatgaatgacacggcggacaaaagggggctaatattcgggggggggggggggggagacaacacactgtgccgaacaacaacggcacacagaagtggcacaacggaacctccgccctcgcctaccccggccattatgccac

SEQ ID NO: 14540 - DNA, 1272 bp, Heterodera glycines
taatattgatcatcatttttacctacgcttagcttattatctaattttaaaaaatactacagcagtacgctctaaatggatatagtatgtatgtcaaggatgttaattgtggaggtttcccagaaagtttctgatttatttcaattttatttaaaaacatcctgtcccacatcttgtcggcgaatcgtcgtcggcgaatagtcatgtacccaaatgaacggagcgaaagacggaagggaaattgccaaaactgaaggcaaactcagccatttatttggccatggaattgtcgaaaagtgtaaataaaaatcttaggagagacaaaagaattggaaaattgaaaatggaagcaatagaaaagaaagacattattatttctaattttacttcaaaaaaatatatttgtaaagcaaattaaatgaaaaagcccattggattaatttaagaaataaaaaaataataaaatttgccacgtgaaaagaaacggcgaatcccacagggcaataaattacatcttcaaaagtaattccgaatctgaagaaaagaaaaaggcaaaggcatggaaatggcaaatgcaagaagaaaagaaaactttccaaaagaattcatttaaaaattaaattacgtttgcaaaattataaactatttattgaagaaagaattccgccgtatcgttggcaccgccggaaaaatttcgtaaatatttgaagaaagtgatacaattttcagaaaaagtgtgtgaaaagctgcgatcagtgttttatttaataaaattatttgtttaatttttcatttgtcgcttttcctctcattttgttaggctttctccgccaataaacttgcgatgtgcgccgattcgattgaagcttttctctgctctgaccatgacttttggatgcgattcacctgacaatgttttgtttcgccccattcactcattcgttaattaacttacattttgttaattcatcaattttcaattaatttattattaatatattttgtttacacctgtctaagccgtgcctttttctcgcacatgtaaaaacagaaaagcatcggaataactgtcaaaatgcccagcggaccgaccaaagctgcctaagtgttttaaactgctgaacattaatcatttaattgttttgtttttgtgcctttgtgttgtaaaatctgtacacatcctccacttttaatgtctcacaaaagtcgccgctgtacggctgagggcactgacaccgctgcttaattcgaactcctttttaattggaaatt

SEQ ID NO: 14541 - DNA, 1747 bp, Heterodera glycines
aagaatgaattgaaaaagggcaattcattaattaattattggctaattaattgttttttacatttgtgatttgatttaaatcaattaattcttatttgtaacttaataattaattttaaatattatttgcaaattaagttataatttaatctgaatttgttctttcaatttgaattcaatttaaaaaatgtattattattcttcttattaataattaattatttaaaaaaagttaattactaatttatattaattatcaatttataatttaaataaataataaatattattatatctcatttaaaaaaaaatttataattagagatgggatttttaggtgctaaaaatcccaaaataggtgctaaaaaagtgcaaaataggtgctaaaaacccccaaaaatgtcaaaataggtgcgcaaataggtgttaaaaattgaaaaaatccagtgtttttatattgactaattttttatcaatttcgcccgcacaattgcaattggttaagaaaataaataaataaattttggagacgaatttttgagaaaatttttcatttcttagtggaatattttctgaaatttggtcaatttttaggagtatatttttaaaattttttgtgatcgattcttaggggtgtattttcgtttttattgcatttttgctatgggaaaatgccaaaataggtgctattgaccgaaaatccagttttaggtaattttaggtgctaaaaagtcgctctaaatcgaaaattgttcggagaaaatgctatttttaggcttctctcatcatagctaagccacaaaaaataggtaaaaacctaaaaatcccatctctatttataaggcggtagactaatttgtaagacgaaaattgttaatttgtatccaattaacaagcaaagcatgcccaggaagctacttactgcccaatttccatatataatttggtttcgaaacggaaaatttaattcaaatttatgtcaaacaagaaaacaaaaaaacaatgaatcaaaatattgaatagccgagatccaagaatggatagacgatgtcaccattcagtcaacttcctccattctcgaggcctcctcttcggcaccagcaattttctccgcaattgtcggctcgcccgaagtgctcggctgttgctcggccggctcctcctcgtcggggatgtcaagtccaagtttcaccattcggtaaattcgcgacgcatgctgttgcgggtcctccaatgaaaagccggaggtgagcagagaagtttcgtacagcagcacaacgaggtcctttgcagttttgtcgtcctgctccttctcaacacggtcgcgcaaagacctaaaaacgaaaaactgtcaaaaaattacatcatgatctcaatttcatcttgaatgcgctcacttgatgattgaatggtcagggttaatctccaggttctttttggacgccatgtatcccattgtggaggagtcacgcaatgcctgggccttcatgatccgttccatgttggcagaccatccgtactctccggtcaccatgggaacacggagaagagaccaaacggtttgagacagaaaacttttggactttcttgtaccagatgtcctaaagaataaattaagctcccgaactaaaattaaagacaaagtacttgccttaatgactttgcacagcttctcgaacttgaactttgtccctctcaaatttcttcttctcctccctcctctctgggagatcaagggcctccttgg

SEQ ID NO: 14542 - DNA, 1692 bp, Heterodera glycines
acaatgccggcagcgagcgcagacgcggcgtccaactcggacgcctgctgcaacgccttctcctcctttttgcgcgcattttctaacagttggcgacgctcgcgccattcgctggtgatccgaatctatggacaaattgacaaaattgcatttgaaaaattaaaggggcagaggtttaaagcaaagggaaatgaaaagagacacgcgagggacaaaaaaaatatttaataaaaaaaaattgaaaatgacataaaaatttttaatgacgccgtcagcgaaattttgtacatttcgcaattttttggtaccgcaacttaaagttttcaaatcttagaattagaaattttgtatgtaatttgattataaaaatgtttctatttttactctaagttccaatttttttgtttaaaaataatgtatttacaaagcgtgttgcggacaacgattgccaccaaattggcaggaaaacgggccgacggatggctgcctcgtagagcatcaacagatccctacaaaatgctcatttaaatatagaaaatattatatatttttgtgattttttttgttttttttttactttttttaaaaaatgtaagtgccaattgaaaacatagaaaaacaaaaaattcaaaaaatcggcacacctcaacgagtcaatggtccgaacagcagccaaccgtcgcaggaagttgcccttttcaccgtccaacacccatccgcggtgcatcaatgcgtccgggatgcggtcgacaagccgtcgcaggttcagctgcacacagcgcagcatgtcctccgcggtgccgtggtggtcaaagcggcctttgggcaaatgccactgaaaaaacaaaaaattggcacagaatggcataatgttgtctattaattaaattttgtcgcactaccctcactcatcgtcctatcattttgctcgaaaaatttgaaaaatggaaatttttgaaaattcaaaatcgaaggtttcctgccatgtagtcgacgagttttttcgctttttttttgcttttcaacccattttttgtggagcacttttctttaaaaaaaagaaagaaaatggcccagcggtgcttataggcaccgctgagaaaatttgttgatttaaacgaattaaattttttttcaaaaactcccccctcctccgattaagaagcctctcccccccccccattccgctgaccgttcacctaaaaaaggtatgaacaattttctctataaaaagaatgttaattcaattttaaatttttctgcgtgaccccaaaagggctcaccgaaaattcgccctgctcggtgatggagaagcggctgctcatgtacttgcgcttgtcccgctccattttgcgcgccgcagcgcttcggcacaggtccgggttggcactgtagtggttcacatattgcaaatagacaccgtcggagaagcccagacgaaagccgcggttcagccggcggttgagctcctcgagcaggtcaatctgtgaaaacagctatttcaattcaatttttaaagaaatggatgatttcaattaaaattcttgtaacaaattttatgaaaatttcaatttacttatttatttttttaaatttcctgaaaattaaaaacatagtcatggatttatttacttttttatatcatcatataagaaaacaaaatattatatgcaaatttttagtatttttaat

SEQ ID NO: 14543 - DNA, 1134 bp, Heterodera glycines
atacataaattcggcacaacggacagcgccagttcgggtcgtcctctgccgccacgggagttgctggtgctgttgttacggcaacaccgcctccagcaccacctccgccgttcgatgttgccgtcgtcggatcagaggcggaggacggcaccgtttgtggatttggtggtggtgcttgtggttggggtggcggtgtcggtccgggcaccaagtccgcgtcacagtgcacgtggtagaccgcctcgcactcggcgcatgccaacagtttgccgaagccaccgcccgctttgccacagctgcggcactgctcgtcatgcttaaaaatggacaattaaatttgtattttgaggaattgccaaaggattaaatattaaataaacaaaccacggttttgtgcgttccgcccacaatgcgtttgatcaaatcgaattggaagaagcgttcgcacatccatttcagcacacgtaaccgcttgtccagctccacaaatgggtagttgctgtgctgcaaaatgtgcaacacatcgacggggaaatgggcgtcactttccacgtaatggcgcaacaccttaagggaaaaggagttcgtttgttcatgtttcgttacttttctgcattttggagtacaattaaagtttgcggaagcaaaaagttttttaagtccttaaatcacatttttgagtgcctagacgcctaaaatatgtccaatttagactccatcattatggtttttatcacaaaaaaatagatttaaaaatcacatttagcaaaaaaaagcaattcaaatgtaaaaataacctcggcaaaactcatcgagtccatcagttggatgagaatgttgacggaaacggtggtctctgtggccgcgaaaattgtgtgttcgctgtcctcctcgcgaaaaaacaggcgcagaaaggcgagatggatttcgcagagcaaaagggactgaaatgggcggagaaacggaatttaatttaaattttttaaataaaatgttggcacctgttttggggaacgtattgcggcacaaaagtcttcaaaaaggaagggcgacagttggagaacggacccgtaatttaacagcacttcgtaaacctgcaaagaatcaaagtttttgaaatgttaaaaagtatta

SEQ ID NO: 14544 - DNA, 2358 bp, Heterodera glycines
  misc_feature (2236)..(2236): n is a, c, g, or t
  misc_feature (2270)..(2270): n is a, c, g, or t
taaaaagtagacatataaataaaaatgtaccctaatacattataggaatttaagccccctagcccgcattgtttcaaaattataaaattttcaaaaaacttttaagaaaattgcaaacttttaaaatttaaaatttagccgattttttcaaatatatgaattactaataatttcttaaaaagtgccccattcaaaagcgcacacctgtccatgttttggcacaccattccacaaacgaagtgcggaccagcccttcaacagcaacggtggcactctgttcggccagcaacagttcgttggagtcggccacctgggagtaggcgcccgcttgggtaccgaaaatctgaaaccgaaaatttttcctctaaattaggcaccactgacgagcagcgctaggaaaaactgacattttcacagatttcggccaaaagctattttttcaaaaatttttcgctttttcatctaaagcaggcctggatcaacctcgctctatctcttcgaccccttcttgcattctattctctctctctctcttcctttctctctctctctgtctttgtctccctatctctctctttactttattggcctttccaggacgctctctttcttttctctatatctctcgctcgtcactctatccacctcacccattctttttccttgtgtttcatttatctctctattccctcccccttcttccctttggccacacttacgcttcgtttcggcgtgtacaaactctggtggatgaacgggtccagcaacagtcgccgttttgcgttgtccatctccggatgctttttgttcaacgatgtctgttgctgttgttgttgttgtgctgctgatggtgttgaggatgcactgcttgttgtcgttgcctgctgctgttgttgatcatcattttctgcaaacaaatcaataggatttttttaatccccaaaaatctttattttgaaaatatccgaaaaaactaaattttccgagggtagctcgtccccacccccgtcccatgaaacccagtttcttgctaattgtaagcgattggcatagatgtgccggtagagttgcgtttttggcattgaaaaccgggcatttatatttttgaaattatccagattaatattttcactcaaatttgggccaatttcttaacaattaacgtgtcccgacatttgcggtccaacatttgcgtttttgtccaaaatcgggttcaagattaagtttttcaatccctgatcgcctaaacagctttaaaataagcgattgaaagtaattgtatacgattatttgatcttcaaagaattcttgaaaaaataataaaattttcaaacaacagaattaatgatcataatgaaccaaaagactgtgctttcttaattttaatgctaattaggctatcagggcttaaaaaaaattcaactttgagtccgactttggacataggcgcaaatgtcggggctccacaattaaaataggcggatatttgtaacgaatggttttttacgctttttactttgaaatactggcgaaaaattgccattttctaaaaaattttagcctatttttgagtttttacagtcataatgtccccatttgtctgtcaatggcattgtgccgtgtcacaaaccttcttcagctgttgttattgttgtaccagggcactgtggtgtccctattgttatggcggtggctgcggcaccggaagaagtggaggttggcggtgtacgcattggactcggcgcgcaccgccgtgccaacatcatcgccaccgggtcggtggtggcagttgaactgttgccggtgggcggttcctcagctgaaaaacaaaacaaaataggggtgtaaaattgcgcgcgatgttcaagctttaattggatgagaaaagctcccccctcgcccttgaattttttttaatttataaacggaaattttccaaaaaaaaatcctagaaatttgtttttataagaaattttctttatttaatgtcaaataaaaactaccacagaagggcataagccacttacacctcgattaaagacactaattcatcataaattttgaaaaaatttttttttagtttattcttgaaatttcccaaaaaattttataactaagatttttagaaaaatctctaattgtaagtttaggaatgaaaaaaaacttttccagggaaacgaattttcaaataaaaaaacactaatttttcgaaacatttaaggctgggtgggaaggngaaggaacacgcggatagaaatttcctggtcctncgtcttttttttactcaatattcaatactcttaccaatgggcgttggcgggttggatgtgttgctgctactgctccaactcgtctggg

SEQ ID NO: 14545 - DNA, 1823 bp, Heterodera glycines
  misc_feature (1805)..(1805): n is a, c, g, or t
ccattattaattcggaattccctgaaaaagtgggagagccaaatttgggaaatttttaatttatttttttaaaaatataataatgaaattgggaattttaaaaatatttccaaaaattgggtatcaccattattttaaaaaattggttgggtacctatcatcaattaggaattccgaaaaaagtgggagaaactaaatttggggattttttaatttttaaatatttatattagttttaacattactttcaatggcaaaattttttcttaaattcccattaaactgttaaaaactgattaattattaatgagttacacccccccccccacgtgcgtcgtaaggggggcggctgtaaaggaaggggggtcgtcgtggggtgggtcgtaccgaaggtggaaaaagttaaaacgcatacaaaattcaaaaaaaaaaaaaaaaaaaatttccggcggcgcctatcggcaccgcccccaccccttccacaaaagttttttggaaaaaacgcgccgaaaaaaaagtgatctgaatagcaaaaaaaaggtcgccggggaaaaataggggccgacgtaagaaaaattggtcctggcgcaccccccctgcgccaaacgtccgacgtatgggggtctgattggcgcaccccttgttcatgtatggattagggggaaagttagacctgacttccaaggattttcatttgttagcaggtctaaaaactagatttcttgaaaaaccaatccaaaaaaaccattatgacaatttaggggggattggaaacggcagagattgtcgtttctcggagcgggacaaccaaccccatctagctgtaagcagactttaatttttgaaaaatttttacgcgcttttttcatgtgcccgacttttccaaccaaaataaataaattgtgtttttaaattttaaaaatcaaaattccaaaaaaacgaccttctcgggatgcgagtgggactggtgctgtttttgtacgtcggccggcgatatttgttggctgcccgacgcaccactgttcatcatgatgggtccgttcacagaaattggacgaccacccgtgctatgtttcaattcgagcgcctcaaaatgagaaaaaatatttatatttggatctgctccggtataaaatcggataaattaattgaaaaataaaaaatttgtaaaaaaaataatttaaaatatctctctgtaaaaattaatttttcacgaaatttccttttttaatgaaatttcttttaacaaatttaatttcctaaaaaacatttaaattattgccttatccctggactccttgatttttgaggacagctcgaaaatgtagcggatgatctgctcgcccatcgtcgcaactccgtcaaacgggtccagcccaaggcgcagaacacacagccaaatgcgttcaaacggtccgatgaacgtcttggactcgagcgaccggatgtgggaaagcacgcggaatctgagaaaaatttttttatctaaagaaattccaaattaaatggtaagattaacggcataacgccaatttggcagagaatagcctcaagaaagttgcaatttacataattatgtgccatttttttaattattgtgcgtaaatcactttaagattagctgaagaataatcttattttgtgaaaaattaatatttacataaattctctacataatttgctttaaaataaaaaacagttttccgggttttaaaacggttttcccggttgaaaatctcgtcgaaaagctcagacgtttttcatgtgaaaacctcgtccaaatgatcaacttgatttttctttanaaatctcatgaaaaactc

SEQ ID NO: 14546 - DNA, 1354 bp, Heterodera glycines
  misc_feature (1352)..(1352): n is a, c, g, or t
gaaaatctcttaaaatgaatgtaaaatctacaaaagttcgccaccggcccctaaaagccttattctctttaaaaaattggctcagaatcccaaaattttggtctttttgggctaaatctgttaacaaattgcattaaaaattataaaatttttcacggcggcacctatcggcactgccgggctcccccccccccccccatttgctgcccaaaatttttttgaaaaaagcgcgccccaaaaaagtgctttgaaaacaaacaaaaaggtcgttgggcaatggtggttttgcggtttctgcgtaaaataaatttaaaaatttaagaagcattttttctaagatagaaaaatgcgctgattaagaatctgagctcggattttgcaaaatcattgatttttgtctatgatttctcatcaatagggacgtgaattttagtgaagaaaaaaaaacttgcacaaatcgccaagcataattttctaactcagctcattgttttcagaagagtttgaaattttgcattaaaatactttggtataaggtctagcaccttgccaaattttagaattttttatgcactcagagatttttaagaaaatccgctttctttccgatgaatttagggttaagaatacgttatcacgattccgagctctgattctgcaaaatcaatgttttttgtctatgatttttcatcaaatataattaaaaataagccgcggccaagcgggctcgaacaccagacccccatctcatatgaccctaatttgtaaggccagttttaaatttcaaaaaatcataaaaaattaaaaacttgagtctccagatattcaatagctcattcgaaggctcttatctgttcatggctcataaaataatttatggccgaacagatctgaacccctttgaaatacttaaaccttctaaacgctttaacattcccttttatagacttaactcgaaatataaattaggcaaaaaatttataccttttgcggggcgggtaactaaaatttggaaccaactcgataaaaaccttattgaaataaactcattaaatcaatttaaaaataaaattaaaactatttcatttctgtaagattgaccggaaaaataaaagtcgaattattaattcattaaacaaaaagtgatttggtcattatttttatttttttttattgacctcacattatattttattttttggcggcgatctcgttttaaattgtttatgcgctttcttgaggatattttaattaatgttttgtcctcaatgtaagcggatttttcccttttgtggactttttctttattgacaaataaataaataaaaataaaaaaaaactaatttccttanaa

SEQ ID NO: 14547 - DNA, 2027 bp, Heterodera glycines
tttataatcaaagttgcacaaattttgaaaaagtcccggtcttggcgggaccccggcccaaaaactgggaccgggagtcacggttcattttccaagtcccggtcccgaccatttcaaaattcggggttctattgattaacagaaaagttgaccatttaaaccaacagtccatgcgaatgtgtctttttttatgcacctcaaaaccaagcctataaaaaccaagcaaaacattaaaaacatataaattatcgtctaattagtgtctaatcggtgccgttgtgtgtctctctctgttatccttcgctgcttttcccttattcgcttttctgtgcgtcgtccgatggcggcacgcgacgacgaagcatacgcaccgtctcaccgaaacagaaccaaagggcgtgcagcatgccgggcacccagaggaagaagctgcagcaaaaatggggaaaaatatcgaaaaagcaatcctattaaatacatgtaatatgtgctaccgatggaccgacacattttctatacaatggcattaaaagttactgaaagatttactattgcaaattttcattttttgtgcctccgtcgacgcttaactttaagaagtcatcatctttttatttttagtcaaatccaataaatttaaaattttcccttttgtgggttgcgattgcttattgttagaaagaaaattgttttttttcaaaaagaccatagcttttgatagataccaaattcatataacttatggctttgctcagatgcagttgacctcctcacccgccccctcaccacagaatgacgttgtacgccgcctgcacagtgaacgcgttgccgtcgcggcgatagcttcggaaaagcacagcgacaggctgaaacaaaacgcatttcgactcaattcaaatgatgccctctccccatttgaccattaccggcatgaggaaacagcaccaaacctaaaaatagaaaaacagagtttttggggaaaatggggaaattcattccgaagatttatttgattttttaaattggtgcgttactttcggtttgaacagaggccaaaacaaaaaaggtggtccatttttcggcttactcaaccgacaaaaaaaaagttcggccgcaaccgccgaatttgccaacattttttgcaaggataaatttgaccgcagtttgtggggttaatttctgatgcgcacgtgtcaaaggttacaatttatagaaatcctagcgcctaaatccacagcgaaatgatggcattttatttgccaacccaaaaaagggggagggagcggaagtgtttgtaaattacgaaaacaccattttattactgaccatcctcccttaaaagtatgaaattgactgaaaaaggtcgtaccatgacagccaggaaggcgggggtggccaagcagaagttgggcgtgccggcagcgaatgccaaacattttgaggcgtgggcgacggcggcaaacaaagagtcgagcgctttgatgccgttgtcctcagcgatgttttcactggttttgctggtttcctccgccattttggatgaacaaaattgaagacgaaaaggcacagtcaatggaaagtcaaaaagaaaggctaaaaaggaagaattagggattttcggattcttggaacaacagatacatccaatgaatgctcaaatcctcaaataccatacataaatcacacacaaaagggaatcttggccgggattacgcaaaatcccgagcgggatcctgttccgaccagggctttattacatagagagtttggcgctatttaaaaagaggtacttttttaaatgtttttgcacttttttttggtcgaattttttaaaatttttttataaataataattagggagtagaatcatatgcacatgcatatttttttcctggactgtgggaggcctgaaacgcatgaaaaacatgtttttagcctggtttgaagcttctaggatgactttccatatgcatatttcgcgatttatgtgcatatttgtgcatattttggcatttcgtgcatatttt

SEQ ID NO: 14548 - DNA, 1086 bp, Heterodera glycines
agaacaattacgtatctagaccagaaaaagagatctttttccaaaattttcacgatcaaatgcgctgagaaaaaaattccagattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaatta

SEQ ID NO: 14549 - DNA, 331 bp, Heterodera glycines
  misc_feature (29)..(29): n is a, c, g, or t
agataatcgaagtgaacagcgacaattcntgaagatagccttctacaaaaaccgacaaaaacgtttgcgagccatgttgatgtagattgaaaatggcgctttggcactgctcgactgtcgcaccattcggcgaaagttgcgctttttcgaggagacatgcatcacgcaatttctggaacagaatgaaatgttgaaaaatatttcccatttttctgctatgccatctctttttctttagcactgatcgtaccgctcgtttcgcggacaatttggctcaagtggatttgtcacttttcagactgagtctttgccacagtgatgctcatccaaa

SEQ ID NO: 14550 - DNA, 1836 bp, Heterodera glycines
tttgagcccgggcaatttaggctaatttttgaaaattcataactcgcttcagggttggacaatgttagtggataaaggttaaaaaataaagaaaaatcaggagaatttatttgttttatttgggttttcgaattaaataggaaaaaaattttccagaaattctggaaattttcaatttttcagaaaaaattcaacactcgattctgaaaaggagttttcataaattaaaaaactaaaaaaccgcaatttttagcattaaaagagatattttattttatatttttatctcctagaaattttttcgaaaaataaaaaattccatttatccccccggggggataaatggagacgggggattattgttcaacctcctcagaaaggggggaataaatggagatcagattctttcgtccatggaaaattaggctgaatctttgttatttagccagcaaattattgtgtatcttgtgatttttttttcatttccggttagcttcttcctaaatgcctatgtttgttcaagcgtttcatggatttcttcgatgatttaatccctctaccttcagtggaacaaatttctaaattaattgacgacgcatctcattacaccaacgaaatgctttattcaatttttgccggttggattggcgcaaatgctgctgttaaggtgtttgaatgatgaagatgaaaacgattaccaacttattttttaaatattcgacaatgcctcattcattttttcatatatttagtcaaaaagtcgcgtggccatcgatcgttcgacaattggcccctttcaatgtgggcctggtctttgcactcgaatggccggcatttcgggcggaattgctgtcgcaatgaatgcgtacggcgcacactttggtgaattcaaaattaaaaaaaaacgctaaaaagaactttttgcgttttcagagagatggattaattctaatttgtgtttttttagttctcgccaatgccgacattaatgatgaacgaaaaagagccatgacttatgcgatcaaccatcacttcatcaactgcattggaatggcgttggccggcgtcggtgcccattatccgacgctgacctcgaggtctttacaaaaatctcattaacgatttttaagccgatcatttctattactaggtcgtatcataaaaaagggcccttatccaaaatgacttccattaagaccatattatctcttaaaaaaaaataatccgcagccaagcggattcgaaccccagaccctcgtctcatgacccctaagggccagtaattaaatttcaaaaaatcatataaaactttaaatttgtcttcttcataaatttaatagttcattcgaaagctctttttgagctctacaatatctgtgtatgagttttaacgcccgatttattttattaaaatttttgaaaaaaaatcaagtacttgatgaaaaacatagataaagtcaatgattttgcaaatctgagctcacattcgtaatcagcacattttttcaccctagaaaaaaccaataaaatttttgaattcatttttcgtcgggaccgccatttctaagggattaccggtctcctttggtttgtatcccccttttgggtcaaattttttcaaaaattttaaattattattttattgtcgcaattgctttttagattaatggaaaagcttaaagattttactcttgatgatttattcaaagttttggctctacaagacaaagaattcgaagaatggctcagagaacttaagcttctctacacaccactcgtttttgtgactgtggcaacgaaatgagctacaaatgaattaaagaccggaatcaaccg

SEQ ID NO: 14551 - DNA, 2936 bp, Heterodera glycines
  misc_feature (6)..(6): n is a, c, g, or t
cccccnccccccactccttcacatcctttctgatccgtttctcaccattgatccgatcaatccttcgccttttaaatattttctcttccaaaccacacagacaattcttccttcgcctacgaataattaactttattttaattgcttttaagttaatttaacgcatctttccttccgaacgcattttggaattctctcgtggatttgactcacttcgctttcgtcctttcccttccaattttgtccgctgccatttgtttaatcagcctaatgtggcctttcacttccattttttaaccgtttcagcaaaagcatttgaaaacaaatttgacatttccatccttcgaattccaatcgatggttttcaattgcgttcgtccaaataatttcatttcttttcattatgaaaggtgtccgttctttcgttcgtctttaattgaaatcaaaacgggttgaacacattaccattaattgcttctcttcttttgtttcgtgtttaggcggattttgggctctcttctgcgtgtccaattcttttatttttggctccaatttgtccgccgtttcttctctttgcccgggcgtccgccccccgcccccccccccgcccaagaaaaagtcggtgaaaaaattggatattgtcaagcggaaagaaactgaaaggagtttcctccgagagaaatgagcaattttccccacgggatttcttctttccatgtgccacccaatgtttgtctcggccccttacattctcttccgtccgttcttacttttagccctgttttcgggaatctgtccctaatattttgtctgttctttatcgttttatttcgtacgtttgttttaagtttaattatcattttatcataattgtaatttccgttttctctgatgaattatttcgctttcagctgatttttgccggtgaatataccaaagcgatgaacaaagactggcacggtgaccacttctgttgttggcaatgcgacagccaactgacaggccaacggtacattctgcgagacgaccacccgtactgtatcaaatgctacgaagagatattcgccaatgtgtgcgacgagtgccaaaaacacattggcatcgattccaaagtgaatctgctcacactttgtttagggggtccagcggttggtctttcctttcgtgtgacacccccacccccgagagtttttattatttattacagtcatcaaaaaatgagaaaagtcacgatgacattattttgctcttttgcagaaaaatccttttatgggttttaggcaaaaagggaattttaaaaaggagaggcccgacaaacgcctgcgtgtaaatattaacaattttacaaaccccacactatactttaaaaaaattgtttttttttttaatttttcgaaagatacggagaccggtaaccccaaaacacagccgccgaaaaaaaagttttctttaaaaattctatgagaaaaaaatttttcaagaaattttcggcgatttttttttgaaaattttttcttatagaattttcaaagaaaaatttttctaagatttttttcttgaaaaattctgtttgaaatttttttttaatttattcccggctgtgtttcggcggctgtgttttgtcctgttccatacggagacggacgttccctaaccacattttaaatagattattttctcaaatatttagaggagcggaggggggggggagggatatgtacctcatttgccaactcaaaaatgcagttatttgtaaaaaccaaagttttaacattctaaggatctgtcctacaaagacaaacattggcacgaagactgtttcctctgctcaatgtgcaaagtttcacttgtggacaaaccatttggcagcaaaaatgagcggatcttttgctcaaattgttatgaccaagcatttgccacgcgatgcgacggatgcggggaaatattcaaagcaggtgacaactgatgaaatggccggaagatattcccaatgttttgataaaactgacaatgagaaagaagccccttttccacagggatgaagaaaatggagtacaaagggaagcaatggcacgacaaatgcttctgttgtgcccactgcaaaacgcccattggcacacggagtttcatccccaaaaacgaggaggtgtactgtgccccctgttatgaggagaaatttgccactcgctgttgcaaatgtaaaaaggtgcctttttgtgtggcctttgggcggggggaaggggaaaggcacttgtgaaacatcaattaattatataaaatccaccaaattaatgtctcgttacaaatcgttactttatcttgccaacaattccttgtctctctctccaagaattaacccgtaaaatgaatgaatgaccaatgattgcgtggcgttccaatggctgtgcctttaaggtgataagcaccggcggagtcacttacaaaaatgagccgtggcatcgtgagtgcttttgctgtaccaattgcaacacctccttggccggccagcggtttacttccaaagaggagaagccgtactgtgcggattgctacggcgaattgttcgccaagcgatgttccgcctgtgtaaagcccatcaccggtaaatgaatgggatgattcgccttagttgacaattttctgttctctccaggaattggtggagcaaaattcatctcatttgaagaccgacattggcataatgactggtgaatttagaatttttttggttttaaaatcggtcagcttatggtgtttgaagaaatcattgcttttagcttcgtatgcagccaatgcaccgccagtttggtgggcaaaggattcatcacagatggggcggacattctttgtgcggaatgtgcaaaagcaaggcttatggcggcgagcagctgaatatccatctccggagacacttttattttgccccacccccatca

SEQ ID NO: 14552 - DNA, 4298 bp, Heterodera glycines
  misc_feature (4180)..(4180): n is a, c, g, or t
tgagcagagaacagcagctaaatgcaacggccgcgcttaacccaaaggaagccgcacttaagctggtagcgaaacgaaagccgtttttcgttggggggacccattggcatctgtccagttccccgacactttgttgtatccgaatataggggggatgtgtttgtgtagtgtaggggtggcgcaattctttggggcctgtgggcacgtgggactatgccgacaatgcttgcttattcatttaaaaatttcacccagccctgataaatgtccctactgtagagtgagcaccacattttacatgcagcactaaaacaactttcattggctgtgtacgtgtggtgctgctcaccctacagtatcccccctccccctctacaaaaaaatttttcactccattgtattaatatttgcgcgttatattcacaattgtttattgatgagagaaaaaaataagcaaaattaaatttgatcgagtaaatgtgcaacaacaaaacaaaaacaaatgagaatcaattttttggtggtggtggagggtacgggcaaaaaggcatgaaagggaccatcggcatcatcatcatcatacacgggaatggtgccatttgagggaaattgttgttgttgtagttgaacgggggcgctgtcattggacccgggaatgtgaatggctgctgcgcgctgtttcctcctcctcctccattggctctccactgagcgtactgacgatatccggcacgacgtttcgccgctccacaacgattatgaaaaaaaaatggaaattagccaagtttaagccaaatttagcccctaaaacctgaacttgtgagcccccaaaaccagggcccaccctgtgggtgagcccctaaaaccagggtccaccctgtgggtgagcccccaaaacaagggcccaccctgtgggtgagaccctaaatccaggtctctgaaccactaaaaccagggcccacccaatgggtgagcccagcacaccgggcccacagcaaatgcgtgagccctgtaatcggtgcccacgcaatgggtgagcccaaaacaaaaacaaacaaaataagcgaaacaaacactcacccgctttcgtctcggctctccattttcctcaccgccgtcggacaaatccaccaccacctcagttgtcggtgcttcctgaaacaaaaaaaaaatgaattttgaaaaaaaaaattttaaatattcaacagtacctcattacgactttgttcggcatcggtgggtgctcgtcgtttgtcaccggtgttcgtcgccgccgccgcctttagggattggggtaaaatttagaaattaattcataaaaatctacccccccacatttttttttgcactggtccggtggcgcgctgctttgccaccggctttgaaaattttcaaatttccctcccctcctaataacagaccgttttgcctccaccggtcgatttcgtcgtcgtcactgccggtgcactgaccaccacaattccagcgctccctccgtcgggctctgccaccaacacatgaaaaatttaaatttaataaaaaatgtttttttttcattaaattttcttacttgcccattttccgcattgggcgctgtttcgccgcctccaatttcattgctccctccatcggtcactgcctccaaaacatcaacgtccggcacatgaaaatggaaaaaaagtgattatttaatggggaaaaatttagaaaatttttcttacttgtccattggccgctgtctcgccgccgccaatttcatcaacatccggcacatgaaaatagaaaaaagaattattaaatggggaaaaaaatttgaaaaaatttttacttgctggccatttgtcgttgtgcccccaatttcattgtcccagcaacgcgcgctcaacacatgaaaatttatttgaatttaattattaaatttaaaaagaaattcataccccccgttcaataccagatggagtaacatactaaacaaaatttatttttatttattttttttgaaaaacaggtaaaaaattttacatttttcataaggtcagtggccacatttgccgctgccgtctgaggtgggatggtgccccacccgaccttttagcaaattgacgtttcatttttaataaaaaattggaaaacaaatctaaaattacaataaatatttgcttaaattgttttggggagttgggtgtttggcgtcgctaaagtgaatgaatgaatgccattcattcgtcccccccctgccctcttcggtccaatgacctttcccagttagagagcgtatgggcaaaagaagcagagaaaacgacgccttattggcgtggtcatctccaccgaaaaatgaccccccccccattcgcttatccgcaccccaattttctctgtctgtctaacacttcacaatttgctctctctctatccgctctttctcccttgccccacaatctgtctctttctctcttcctcccttgccccacaatctctctctcctctatctctctctctctcttgcgcccttcccaccctcttccccctctcctccatctctcactcttttcttttctctgccccacagcactgtctgcgccccgcgccgccaccaaatgatcattaatcaccgccatcgctgaccaaaagtttttttgccaaaaagttttacatcacctcttcacatccccccgtaggcactgtctcgtgcggtaaacccccgcgcggcgcggcggcacatcaaaggctaaacggtcattaatcattttcacgcctgacgacgataggcgtggggtaactactcccgtatattttttaattaattttatgaattgaacttttattttcctaacgagttgaaatgggtggaaatgaatgtttcttttcagaaccaacagcagcactagaacagaaaagactggctgatggactgctgcacaacaaaatttagctctaatctatccaaattatctcactttatcgcattccatggaaaaggattataataaatcactttatctgccgatgttttcccaaatcataaaaggacaaaaattttaaaaagaacaaagccaatttgagacagacagatatgaccagtgtacaggaatgaacaagcattcaaattatttattttatttttatttttgataaaattgcattttatacatttttcattaaaatattatagaaaaataaagcttacagttttttaatttttggcatgcataaatatttagttttatctatagtttttgtaaattttttcctgagatcccaggcctaaaacgcacgaaaaacaagtttttggggagggttgttaagctacttttcgagttcttagcaccattttctaggttttttatttagcctaaaaacttttgaaaaagcctatttttcctattttggcgttttgcccaaaatttattaacaaaaaactccgaagatttattttcaaaaacaccccaagaaattaaaaattttttcaaaaattcatctccaatttttttttgacaagcttttttgtttttaaaaattatgtatctcgatactgttttggctttattttgttgcttttttgaataaaaatttgtcatttttcacccataaatttaaggcttctattgaatgataccatgaaatattaattgattgaatttgagttaagctatgcatttatgtgtgttacacattttttttgttaactttgttacattttggggtttttagaacctaaaaactaacaatttaacgaacgaatccgaaagaattattttgcggaacgcactttgaaccgagttatgggcccgggactgaagtggccaaatggcttcaggactgaaccgtccagtgaattaaaacgcatgaatcaccaaaaatatagaaattaattaggtggccgaacgtttcttcactaaacttttcgtcactgaacctttcgtcactgaaacaaaataaagaatttaaaaggaaaaaaattaaattttttaaaatatacctatataagaggggtgtgacttgtctcagaaaagacgagagcgagtttggcgagaggagagagtccccaaaaacacgagagttggcgaaaggcgagaggacgagaggcgagagttttcaatttttttctgtagccttattttttaatttaaaaaacttcaaaatcgtatattaaattagggttacgggcccgggtatttgngcaataccgggtcagggtatttgccggtccagaaaagccgggtcagggccctagcttttaaacccgagtcaggtcctgaaaaatcccaaaaaatctaaaattttttcatgagaataaa

SEQ ID NO: 14553 - DNA, 3381 bp, Heterodera glycines
ccgtaaatttaaatcgaattttttaaatttttctatgtcgtcctagttgccaaatgtcctgaacaccccccccccgtttcggaacagttaaaaaactaaaataaatttcctgtcaaataaaataataataattaaacaatttttccattgatttttttgtaaataattttaaaaaatagcatagcaaataacactaaagaaaaaatgtttttgcatttttcagtgaatgctgctgaagcaaatgaactgcttgaagatgacgatgatagggctgcaacttcatcttctgcgccatcactaccaaaggcaacagcaacaacaacatcattagtgaagccatatacaacatcggacccatttggcagccgcagaccaccaatttcatcaaccataaagtcattgttggcaaaatttgagccgtcagcagcaaagccaaccgacccatcattcgccagtgccaaaccaaatggacttggaacgaaggtaaatttttttgagagatatttttaatatgaaattcaaaaaatgaaaatgtttttcaaaattttatgataaatttctaagtttgtttttttattttttttcgggttatacgccctgttccctgcttcttttttcggcatccaaaatgaaggaaatcagggaaacttttttcaaattttctccccaaagttcactgttttttctcaatgccatcattgttgaaggcttccataaaaccggacccatcattcgtcggtgatgcttccgccgtgccattctcatcctcggccgtatcaccgacaattagcggtgccaccaccaccggcacggattcctccgccacggccgttggtgttgaacaacaaccagtgcatgctgacgatggtgatggacggcttggtgatgaagaggttgatgaagttgcagaggaggtccggcttgagttggagcaggacgcgctggtggtgttcacggacatttgttgctgggacttgcacatgcgcttcttcctggacaaggagggcaaattcaccagccgcaagtgctgcaaccgatcggagtgagtttgagttgttgtttattgtacatttggttttttattggtaacgaaaaaataataaatgcataggtaataatcaacagaatttgaaaaactatgactaattaaaaattgccgtcgatttttttaaatttcaaacttagaaattttttaaagaaaataaattgaggaatttttctacctttttcgaaattttttttcatgttttctttaaaaaaattttctaagatttgaaaattaacaaaaaaaaaaaaaattcagcggctagattttaccccgtccccataaatttgatcatcggcagcggcacgggggtgaaatggacagagaaattttttggaaatttgatagtaattttggcaaaaaattttcatcataaaattttgaaaaaacgctgtaaaagtgaaaattggctacataattataagatttttttcgaaaaattagcaaatttcatgctttaatccgaagcaaatatttggctaaaattcacccccccccccctttttttcttagtttgccgtccaattatgccaatgcgccgccggagccgggcagttgggcacacattttgtacacggaggacagtccgcggagcgttcggcacattgtaattcgtcaaattcgcccgctgtgccccgacagcactccgccgagcgcgctgggcgccacgctgcggtttgccatgcaaacggtgtgcccggataatacgcgtgtgtgggacgcctttttgacgctgcccgtccgggcgtgcagcgtgcaacaactgttggacaaggtggagggcagcagagagacggcgccgcaagcgatggcgattggacgtgggggcgacgctggcagccattcgggaattggtgcggaacaacaacaacagcagcaggtgttacattgttgcttggcagtttaatgagggctgttgagcccgaaaatttggaaaaaaataatgaaaatttcaacaacaaaaaaactgatggaaaacgccgcgggcgacgaaacgacttgggtgggaggggtgaaatgggggtgcactacgtttcccactcccccttccggttcagttccctgtatcaattccctccctctctcatagcgtccctccccccccccctcgaaaaatttttaaaaaatttcaaatttgtattttctttttaaaccctaaatttttataaaaatttttcaagcacttttgaataaaaaatttttagagacttagtaattcattataaaagttagataatcaaagaaaaaaaaattattgcggcaaacaatattgggagggggaatgaactgcttcagtgaaatggacccatttcaatattaaaaaaattagtcctttcgatggcggccaatttttccgcttttatctcccaacaatttcagcgagttcaacgcggcgatgaacaggttgaacaagttgtgcagcaacaaaaaacgcctgttgttgttgtcgattcgcgcgtgtcgccggtgcagcggaaaccaagccgtacggtgtttaatgagtccaacgaaattgtggacaatgagcagcagcagccatacccgtggcaacaacgacggcaaaacgccaacagcagcagcagttgcagcgacgtgcgcgactcggtctcattgtcagccggtgacaacgaggccgacgacgattttggcgaggatgacgttgatcacacggtcgaggtgtgcggggcgatgttatggatgggaccgagcggatattattggcattttatgttgtgtgccaatcattgggttcggaatggcacctcgaccgttggacaactttaatttttatatgaaaattaataaaacatacaacagggacagtcccagggtttcgactttgagaagatcccgatttactcttatgacgcaaaattaaatttactaacttaaaaatttttcaagaaaaaaaatataagaaaattcaaacgaaaattttcgaaaaattgcaatttttttatttctcgggggggggggggggtaaacggcagaggtaaattatatttttttacatatattatattttgtgctgctcttttttcacggggccgtaatttactaataaatgtttaatcaataacaatttttcatttgtattagaatgccggggctgcggctaccgatgaacaacaacaaccacctgctgctgccgacgacgacgccaaggaggacgacggctggggcaaaatgagtccaacccaatgggagaacgtggactacgaccgcccgtacattccgcccgttttgtcgtcgcccaacgcgtcggtcacggaatggcaaggaggacgggacgggaaaactgtacatttatgtattggaaaatatgtgtccccccc

SEQ ID NO: 14554 - DNA, 2810 bp, Heterodera glycines
catttaataataaataaaccatcataaattcaatttatttctgcccacagattactgccgaaattgaccaaaatgatggaccacttgttgaagagaagaaaaataaaaaaaacgatgaaaaggaagaaaaaagaagagaaacaaaggatgaggaagtaagtgagaagagcagcgacagagaggaggaagaacaggaagaggggggcggagaggacgaactcttttcagaggatgaacgaattgacgaagttggggaagatcaagacgtcgcagagggagggacaaaggcgacactcaaagggacgggaaatgacaacggcactctaatgcgagaccaaagtgatgatgatgaggaggaggaagagggcgaaattgtggaggaaggggcggaggatgccaatgagtggtgagtgataaatagaatagtacaaaatggacgattatattgaaacaccagtcataggtccattagaataacaaaaaatgaaattaagcaacggtaaaatcgcaaaacgccgagtggatgaagagcacgatgacgaagaaattgatggcgcgagtgacgaacaggaagaggatgaaatggaagacaatgttgatgaaaaggaggagggagaagagagcgggtttctatttcttttatacatgcaaatttaaataataaaaggcattttccatttgcagttacgaggaagacattgaggacccaaaagtggtgcagcaaaaacgcgggaaattgccaaagtcagccgtggacgacaaattcttcaatttggctgaaatgaatgcatttttggactccgaagacaaaaaagaggaggataaaatgcgacagcgaagtgtcagaaatttgggacaaatcgaaaacgctgaagaggttggtgatagtggtttaatgaatttgttgatttgccctgcatggattaattcatatctctgcagttgttcaaatttccagcgtctttaatccaagtatttagttggagcaactaatcagtgcacatgagcagtccaacttgcagccgcgtgagtgggcgctgtcaggtgaagcaaaggcggaagaacggccgaaggacgcgctgttggagcagtatgtggacgcggactaccgaatggccgcaccaccgacaattgacgcagaaaagatggcacagcttgagggaatcatcaccaaacggatcaaagacggggtaaaaagggacattttagcagagtaatttcttgcccaaaatcaaaaaattgtttcagtttttttttctttcaaaaatacgtctctttcaaaagtgaatgcgtcttttttaccttttcagttgtttgacgacgtcgttcgcaaagtgcgcgtcaacgaatcgcttcagcccgcagcgccctatcgaaacgctactgttaatggcacaacggagcaaaaagtgcgcaagtcattggcggaggtgtacggcgacaaattatctgctgggctaaacgacgaacacgaacttggaggagaggggaaaaaggcaaacgtttaaattttcaaaaacgctttgatgaatgaaaaatttgaaaaaattgcacacgttaattaatcatattaaaagttatcatttctttaggaagaggaacagtccaaattggacccggcggttgaagagatcaaaagcgacttggacactctttttctgaagttggacgcgctcagtcattttcaatttcgaccccagccaatccaagaggaagtgaaaattgtcaataacatgccgagcttgcacttggaggtccctttttcattttttaaagagcaactttatgggcctgagaagggtagcgaaatcgggagtaccttttcaacaagcagcatttgatccttccgattagtgtttatctgaagaaattgggtatacttttcccggcatgaaccaataactcttcagcttacaattagtgcaagtcatttaaaatcctattaaaggaagttggaccccaagcagcggttggaccagaggtgaatttgttggcaccggaggaagtgaagcgacgcgtgaaaagtgcgccgaaagggacagatgaacgaacggagacggaccgaaagcggcagagacggcagaagaagaagaagcaacggtgagtgaatttggaggaacgtttgtgcaaggaaagtcattcggaacgtgtccagacatttgcacttgtctaaaatcgggttcaaatctgagtttttcaattcctaatgtgcaaatgtctggggtgaaaaagcccgaggcgcaaatgtggggtaaccattcggaaaagccttcaaacgcaatagaataagaaatgtttaaaaacttaaaagtgaaagtttccaaatcatttttgccttttcttacaaggcaaccgcaatacaatacagccgttccttaatgctttttttagcattttggcctccatcggcgcaatgaatggtgaagggaccgacggcggagaaacggcggaacgggtgaaaacgaagaaaaaagttcgacgggtgaaaatggattttgctgagcaaattaacaaattggtacaaaatgaaggcgaacaacagttgaagaaaaagaagaagcgaaaaatagtggaggaaaacggcgaggaaaagaagtcgaaaaagatgaagaagaagaagagcaaagttggaggagaaaaggaatgaaagagagagaaggacggacaaaggaaagaccagcggatttgcccattgtctcgttgtttcttgttgatcttattttttgagtttattcttaatttttgtttgacctgttcattgatctgatgtttatttttacaattttataaaaataaaaaattacattggt

SEQ ID NO: 14555 - DNA, 1060 bp, Heterodera glycines
ccaaagtgaattaaaaaagtcaaaacaaacctcaaaagaataattcaaggaaaaaatggaaacaataaataaaagcaaagcaaagtcaacgaaaaaacaaacttctagaaaaatacagaaaaattttcgcaattatttttaaaaattttttattcatttaaagaaaagcaaagaaaagaaaaatctgccaagtgaattaagaaaagtcaaacaaacctcaaaaaaatgcaataaaaagaaaagccaagcaaatgtcaacgaaaaaacacaaaattatggaaaaaatacagaaaaatttacgtaaattcataaaatttttttaatcatttaaagctaagtaaagaaaagaaaaacagtaatggaaaaataaaatgaaaagaaaaaatgtgtgtgaaagtcaaagaaaagaataattaagaaaagttaaataaacctcaaggaaaaacacaaaaatgcaaataataaagaaaaggcaagcgaatgccaaggaaaaaacaaaaatagagaaatggaaaaccaagagtacaaaatcatcccgatttgaaaattaaggaaaattaaaaacaacaagtaaaaaaagtctgtatggcgtatgctttttttctttttgatcatttaatcgtgctttttttttgcgcaggccaagcagttctgtgttgagtgcgagcatccggttgaccggcgcacgcatccgctgggctgccgcgctgtgtgtggcctgtgcatgcgctacgatgagctgcgcttcccatgccggcgccaggacggcgacggcagcagtggcacgttctgccaacagtgccgcttcgtgttcccgaacgcggactgctttgaggcgcaccgccggcgcgtggatgttccgccggcaccgcctccggacgtcgccgccgccgctgctgtgcctcactgtggtgaggaagcaacgggtggagacggtgacgacgcggtttctttagctgttgctgttggagctgccgttgcaccagcgtttgcggaccgccgtcgcgggcggtcccaccgttcaatgtgtgaggagcggcgcctgtgtgagtggtgcaat

SEQ ID NO: 14556 - DNA, 2293 bp, Heterodera glycines
  misc_feature (76)..(77): n is a, c, g, or t
tgcggcttgcttacgcagacgaggcagaggcggtacacggcgctggcgacgaggcgggcgcaatggatgcagtcanncagcagcagcagcagctgcccgaactgttgaagcacgtgccggtgttggtgtgcgccgaggtgatctgcgagcgctgcatcgcctacggggtggacattgagcgtgagccgttgcgccgcgcgccccagtgccagtgcggtgtcccgtggcgtggtgcgaaccggcgccggtggtgctctcgcatcggcgaggaacagtttgacgacgacacctgtggaccagcgacagcacaacaacaacaacaacaaatgccgccggatggattgaacccgcggcggctgcgcttcttctgcgacggcgagccgggcaccggacgtggcgcaatggcccaatttgtggactttttgctccacaccggccccaaagggacgcgcaccgtgatgttggcgcacaacggggtaagagcagcgagggggtgggggtggcaaccgattagtagtgaaaaaataacattttttcagggtcgttatgacgttcacctgttgctggaggagttgcagcggcggggcgagcggccgaagaaggcggtccagcacgggctgcgcgtctacatgctggagctgcgcgggactcaccagcgccagctgatctgcaaagactcgctgaacttcttccacgcagcgctcgccaccctgccacgcacctttgggctgcacggggtgctggacaagccgttttcccataccatcacattcgggagcagaatctggatgttgaactgccggccggcactctaccaccaccagcggcctacgacccggaccggatgcgtgccgcgcagcgtgacgacttcatggcctggtacgagcgcgagctgcaccggcccggacggcaaccgtttgtgctccgccgtgagctgttgcgctactgctggaacggttagttgttgttgttgtcgctgtcggggagtgctgaagtggtggaaaaaaatgccgagcatacagatgtccgtatcctgcgtgccgcctgccttcgcttccgggagttggtgggcgagtgtgcggacggcatggagcccttcctggccgccacgaccattgccagcctgtccatggcggtgttccgccaacaccatctgcgcccgcacacaatggtccacacgccggagggcggcttcctgcgcgggcgtcgcgcgtcggccgagtcgcgccgcttcttcgccctgctcgccgccatgcgtcctgacttgggcccgttgcgcaccgcccgctggtcagtcggagagatggtgatggacaacagcagctagggcggcgacgacgatggtttccgcctcgactgtgtggcctacagacggccaccgttgcgtcccctctgcatcgagttcaacggctgctacatgcacggtgagtgttgatgatggtgttgttgttgttgtcaattgcggcaattttttcccaattacgccattgtcttcaggctgtcgtgaatgctatccggagcgtcagatggtgttggccggtgggcggagcgcggagttgttgtgggctcgcacccaacagcgggcatgggagctcgccgagctgcacgggatgcaggtgcaatcggtgtgggagtgccagtttcggcgcatgctgtgcaaaagcccgcggatgcgcaagctgtacaaggagcgctgtgtggacgtgccggtgccgctggatttgcgcaagcacgccctgtttggtggccgcgtggagcccttctggctgctgtacagttgcgcgccagacgaggaaattgtgtacattgacattgtgagttttttatttattttttcttcaaaaatgttcatttttgttttgtcaaggtgtctttgtacccattctgcatgaagacgcggccgtttcccatcggcacggcacgtgtgtggaccggtgagcagctgtggcagcagcagccgcaaacggctggaggccagcccgacactgattgtggtttgtataatttataattttataaccatgactaatttctgccccaattttctacagctggcccaccaccaccggctctccaaccacccgcactgccatggtgccggccggaggacaacctcttccgcggcttcctcttctgccgtgtgctgccacccagtgcggacgagctgggcgaccgcgagccgcttctgccctatcgcacccaggcagacggacgactcaccttcggcctgtgcgcacgttgcgctgagctccgacagcagcgcacctgtcgtcacacggagcgtgagcgcgcg

SEQ ID NO: 14557 - DNA, 4894 bp, Heterodera glycines
aggcaattttgtttcgttatttttaagaggggaattttcgcgtttttagttttaaaaaagagccaatatatcgaaatcgttgtttagggtctaaaccacttaaaaatttattttcacgattgtaagggtatttctttatttcatattcaagttttttagaggtttctataaatttttctctagttttttcttttttaatgtctttccaaagttgccgtcgataaatcataatttttttaatatggtctgggaaattatgtttagaatttgatcctgttaatggaacatatttcgatattaaaaaatgcaaaaatgctgcgaatttgttataaatttggtcaatttctatacagtccgaaaaaaaggtaacccaatcagtagaagagagcatggcatttatttccaagtaactagcttttttaaagttagtgtttaaattttttacaaggaaaaacatttagtcttaaatcaaattttatagtgttgtgatcactaagtgagaatggggggccaattgaaatgtcttttatgagaaatttattatttgttaaaattaaatccacaaaattgcattccctggtgggttatttaatcatttgatcaagtcgtaaaccttcaacaaaaccaaggaaattactttcataatttgttaaattatttaggatagagaaagggccattttggttccagtgaatattagtaaaattaaaatctccaagaatgacaaaattttctgtcgagactgctagtgaggaaattaattctagaagttgcataaaattttcgaatgtttcggtagttacaggcctataaaccaaaataagacggatttttgattcggaaatgggcgaaaaaacatcaatacaaagtatatcagaattttgtatattttgagtttttataatttcaaacggtatttcattagaaatgacaaacgctacccctcctccttttttattctttctatcttttcttattaaagagaaaggaaaattttctaaaatttgcgagtcgtttattttattattcaaccaactttcggttatcgcgataattttatacctattttctaaaagtaaaagcttaaactcattcattttgttcactaaacttcttgagttaaaataaagacaattgagaaaattttgtgacctcaaaagttttttcccatgttgcctccacgccgcgtcgtcaccatttcattctttttgctttcttcataattcatccgcctctgttcacgaatctcccgctcagccgccaattcttctttcgtcagagagggcctgacgagaagtcgctgccaaccaacatgctgcttcagttccgtccggttgcgcccccattgtgccaatgcaaaacgttggaacgtcgtcgctggcaagacaactttgcccatttcgcttctcatcaatccgccgccccattctatacaccatctgcgggcaaacctccacatccaaagcgtccaacacttccgcaactgtttccgcgtcctctttggcgcgttctgacggcttttcagccacagcctccggcaggccaatcaaaacgaggcttcgtttgcgttctttttcctccgcactggaattgtcgttattgttgctgttgattttgcgctcaatttcgttgaggcgttcagcaatggcgttgaattgttctgccatttgcgttgccaaagtgttgttgttgttgtttgataataacgtttcaattgaagacagtcgaagtaaaatagttttaatatcggttgccattataatctttattggacaattccttgtctatctttttttctctaattttttgtctccttttggcgtactatctaatatttctattattaggaataacaacattcacttcgctctatagaacttctaatgcatccaattgtgacattacaattcgaaagggcatggaggacgaggaaaaaattggagcaaaagcgaaactatttatgcaaatcaaggacaataaggacaaatttgtggaatttccgatgccggaccatccgttgccaaacaaaatccgatttatggaccttatgattatgtaatttggacaatttgcgtcgtcacatttcaccgacacttcttactgatcttgatcaattgaattcaatcaactccggttatctgtgccccgatggaattgctgacgatgggccaaatgcaactgctggccaagctttggccaaatggctgcacactccgacaaaaaatggccaaccgaagcgattgtatcgcatcgctattatgcatccaaaaagtcttttcgacctctttatatacctaccaaaataaaagtgagagatttgaaaacggatgaacggatgggggggagattaaaatgatttgttggccaaaataatggccataacgcattaatttatgcgtatataaagagagagtaatggggaagggtgttttgctgattttgttcaatacatacataatttacacggcttccttatttttgtaaatgcatatatttttttcctggattctccgtatcctaattcaaaattgattgagctgataccgtccgtatatctctaattatccccccggatgattattgttcaacctccttagatagggaggggggggggggctaattagagataataggtaaagtgaattagagtgaaaaaacaatatttttacaaatctccgtctgttttattctgtttcaaaattgttttttgttctttttgctttatcatttttcctaattgtctctgttttaagttaacaacagattttttgccttttgtgacaaaaaaaaaaacaatcgaaaaagggaaaagtgtgctaattgagccaccaaaatgaatcgacggtaaggaaatttttgaaaaattaaaatttttgtctacccaatttttttccttgtttcagttggatttgtggcgacgtttggatggacattctgccatcttttgaccgtccccaactcggactcaaaatggcactgatttccgaccgtttcgactttttagtggacaaacattttgatggaaaaacggaattgacaatttggagaagaatcaaaattgtaaaggacgaaggaccaaaagcgaaactgtctgtggcgatcgatggcaaatttgtgggatttccatttcctgaccatccgttgcccaacaaaatccgttttaagaaccttcagatttagtaaatcaaaaaatatacagaaaaccaatcttcattttttcactttatcagctacattgaccattctgtgctcgcatttctccgttccaacaagcaaatttgggacagaagtggcaccaaattggaagtgtttgtgccgttatatatgaccgacgtcaagctcatttgggatgtttttacccgcgaaatttggccactttttgcgagaaacattcggcatttgagctttcataatgccgatgctttggacaattggcgtcgtcgcacttcgccaacatttctcactgatcttgatgaattggtttctatcgattctgttggtctgttccccgatggaattgctgacgacgggccaaatgcaactgctggccaagctttggccaaatggcttcacacgccgagcaaaaatggccaaccaaagcgattgcatcgcaataatttgttgggtccactgaatctcgaatggctcaacaacttcaaagaggtgtgtctagccatattttctataaattgttttttccaattttttgtttagacatttcgccgtgccaccacttctgtcagttacaatattcaattttatcttcgtgtggaaccaatgccaactgctggccaaaaataatggccataactagggcgggaaccgcccaactcgccgcggggccaactcgccgcggccaactcgccgcggccaactcgccacgccttgttttttggctatctcgccgccagatttttcgttaaaaaaatgcattaaaagcaaaaattctttaacagttaattgtattcaatgtgttatatttcagcaaagtttctctccaatttaatatgcttcaaattgaaagttaacgcaggaaggaaaaattgcagaacgatatattcctctgtattttccacaaatttaaagagcaatcatgtcggtcattggtcccgaatttttttttttctgggaattctttaacaagtttctttgggtattttgaggcgctgagcactagagaccggcgcgggacgggatcccgcgcgggattttgcgggatccccttcgcgcttcccccttgttttttttcttcgccgttcactcaacccgcgccatcccgtccctgaggaagtgtagtgtaccagacctctgcaggggcatccgcaccatgacaattgccagatttcgactgaggactccattacatttaataaagaacaccgaccagtaatgcgagttggattggcctttgtccgatggttaattgccttctggtgagaattatatgtgatatgtttcttaaattctgtccatttttttgtattaatcatcatttcgggctttgttccccacatttcttctcctatttaaatgcttctcacttctcctgttcttcacttcaccatttccattgacttcactgttctgcattggaataaagcgcacttctctaaccgtctactcgctcattattcccccactctttggctggtcccccgtgttttccgcccattcgtctctccgcccgccgcccttcttagccctttcgttgccccctcgtggtcatcccccctcccggtcgttgtccatcccctttgtgcgacaagtggtgccgttagagattcataatgtcttctgcacgatgccggatggctgcacttatccgtcttccccagcacatcacctcagccgagaacttgctggatgaagacgatcctgatgcccaatcattcga

SEQ ID NO: 14558 - DNA, 4289 bp, Heterodera glycines
  misc_feature (30)..(30): n is a, c, g, or t
gattggggcgatcggccccatggctccctnactaggggtccattgggaaatggcggagggtccgagacccttcccgctgtttgttggtgtcccccgttttacgtgggggactgatcgagggctctgccctccaacctttggagggagcccttaccggtgggcgatcgcggcccgccttatcggcggtgatctccccttcctcgggggagtcgcggcgtgtgtttgatgtgccggggcggctcgctgccgccgttcgctccttttgaggaggaacataaagggggcaggcctttgccccgcggcgatggccagagagttggcacgccgaacatgtcggcatgcgttttgacgacgactcctccttcgcttccgcgtcgatgaaatcgcggacggaaaagttccgtccgctttttgcgtcccgttccggtgttgctgcggcgatgttgaacaattccaccgcctttttgcgcggtggtggcggcgggggcggctcttccgatgtgtcgctgccgtatgatgaacaggaagaagaagaagaagaagaagaggaagccattttgatgggcttcggcattttggaaaaggcaagtgatggtgggacatggcaaatccatgcccttaaataggttttgctaccattgaaggggcggagctcttcgatcagatttgctttctgatcgtgggaaagtggccatgggaacagcattcgtgaaaatccccattggttttcacgtgccatgttcgccgcttcaagcggctgatggcaagtccttgtcgaagggaattcctttccctccgccaaattgcagaggcacaaagccacggccacaatgaaaaggccgttctgccaacggcgcattggacggttggggaccgcccttcgtgggcgattctcaaagctgccgtccggtgaattggggcggccatagtccatggctcgctctccgcgttggagaggcgcttggcggccattgttttccgccatttcgccaacattcggattgcctcttcggaggccaatggcctcgaagaaccgtcgagacgggggtcccctgtttggcccctcttggtcattgggagcctcttccaatgccaaatatgctcttattcggggaagacgagggggctcagcctccctctgatcagctccgatttggaatcggacattgaccatgtcgattgggaagtaatcgacatggattccttgttggctattgctgaagcctccatactcttggaggcatggcaaattcgggtccacctggaacccgcgccgtcggaaatgttcctggacagtccgtcccggaaacattcgcgtgttagccggtccaaaacgcgaaaacccgtcgaaatagacattcgcgaatggaccgaggtgtgccgcaaaaagcgtggcaccggtgcgcagttctcggcggaggtgttcctccgcgtcacggcgaatgctagccgtctcataccattgttggccgtggtgtcgctcaacccatgagttcaggcgctcggtgtgttcacggggcgatggttcccgttggggaggagcatgggctccccaatcatctcgctgatcgtccatttggcgattttggccactgttttcagggaccattgggagctggggcccccaatcctggtcgaaccaccaggggcctctttggtcttcggcccagggcggaggagcattgtcagccccgggttgaggagcattgtttgctctctgtccgttctcggcttcgtattggccgatgatgtcgatgacgaggcggtcattaatgaccacttcgtttgtgggtcggctgattgttggtgccgagaaaaaaggtggccgttctcggaacggaatcggcatggttttgctgaggcgctgggtgttgtttggagcttgatgatggcgaaggaatgaaattgtcatcaaatttccttcttttatatcagtttttggcgatcgattacggtaatcgattttttgatggaggggtactgtattcacctccgcttccctgaatgaaaattcggggtcggggattcttaattccccgcatgaaacggggaaagaatccccttttcgaggttcccatccgaaggatcctccggccgccaaaaagagaatggcagccacggaaaaagttgtggcgttgttgggtcgcggagcttggttcatgagcaaccaagcaaatgttctccataacttgtacacaggagagaagtgtacaacgaaaatgatgatcacaatgccgatcatcaagacaatgaagaaaattaggcctgttttaaggccaaacagagcttgaaaagtggacttccagtcgaaactgaagtcagcccagcctgagttgctggcctcttcgaggctttcggagactcgggctccgaattctgactgttgtcggagtgggatgtaatggagttgtcccaccaaggagaacttggttctcccagccaagcacatgacttggcatgtcgtgcttatttcggcatgctggaatgggagcacgacagtgtggtccgttatgttcgggccacatttgctcgtgaaatgcgaaccatcttcgcattgaatgtcggccaatgtttggccaatgtcagtgtggcacgagtaggagagctgagctcccgtcgcacatttgtagcagccagagatgtgctttggtgtgattgtgcacaaactctggtgcatttccaaggacatttgaaggctgtccatttgaatgttcatttggaccggactatatccggttatggcgaatattcgccttccgtgattccgcagttcgtaatggcggaatgagagcggaagtctccgctgagggtcttccattagaccctcgagattggcgacgcgacaatggcacgagactgtcccgtctgtgtgatcgggaagacagcccgtgcatgcgtcaattcccagagtacaattgaaagcttgggcggctttcaagtctgtacaatggaaagagtccgtgattttctcacggacaatggcgacacttcgcccttcaatcaggaagtcagcgttcagtaggggagccggtgcttggctcactcctattgttgaaatgctgatgttgtgccatttgagcacacggcctggaagaagcacagtttcgactgtcgcacttcttccagtggtagagtcgaggcgaagttgaatatggatgccaaactcccaagagttgcatccgatgacttcgttaatggccgatgagcgtggtttggcaaaccacttgtagaagagacatgaactggctgctaggagacattggtttccccaaaaagccgtgctgtcgatgcagaaactgttcccggggaacgtttcggtctccctcagctctcggatggctgtggagggtgggacttttgtgcaaaagtcaccgacacatgagccagccgacggacatcttttgctggccacggaagcgatctcgtatgatcgtttccaagccttggtgtatgcttggcattcgagagagagccccttcaagatcacttgaagggttcccaaaatgagaccatcatcggtcttcattgacaggacattcggttgtcctaccgggagaagcgcaagggttacgcttcccttgacttggcacattttcgttgtgccgttgttgagacagctctctgatttggccattatggccactgtctcaattcccccgtgtacaaacggaagagatgccatgacaagcattgtcatttggctaactcggccactggcccagtttcttgttgctggcctgggccggcgtattcgtcggtgaggatagaggaggttttcctcctcttcactcaacacccatgtctcttttcgcggcttgaataagcgcgcgaacaagactgagaaaatccaaaaaaggattctcagtcctgccatggcgtatcccaccatggaacacatggtgaagatgaagcacaggaggcttagggacaggcctcctgccagcattgccgcaatgacgggctggcatgttggattcacaagttgtgtgaaacaaaagtagcagtcgatgagatcacattcatcgactgccgggcaggtcgtgtttgatgtgaaggtgtgctgtgagtcagtccaaaatctggcctcacagtgatgattgttgagtaggacttcgattggtagttcgaagttcaaggcccttgcagaactatgcagctttctgcacagcatatttcgaacttttggatttcgggtggcactgtcacaacgattcctatggtgtaacaagtgaggccacactcatcacatttcccgaaagggaaaccacttgcaaatggaaatgcaagtg

SEQ ID NO: 14559 - DNA, 4044 bp, Heterodera glycines
  misc_feature (289)..(289): n is a, c, g, or t
gaaaatttaaaaactgtataggcaattttcgtaacaaatagcactcaaatgccaaaattgttcccggcggcgcctatcggcaccgccggacctccattttccactatttttacaagttttttgccttaaaacggccaaaatagggtcatttttagtgcaaaaagtgcagtttttacccagcagcgggacaaaaaagttttttattggttaaatatcaaaaaaagaaggtttaaaggttttcagttgaagagcaaaaaaaaaaaaaaagtctcgagtcgggtcccccccncccccccccgaaaattttttctagataccccctacctatatcggggatgtgatgtgttttcggattgctaatattttggtcttggaattctgttttcaaattttgcatgtatggcgaagtggcttttgtaagacgacagtaaaggaacaaagtgcaggggttcaagtcctctccacgtcattaattttttatataatttttggaaaaataaataattaaattaacaaatggctattttgaagcttttttgaggcttcaaaaaaaattttttaaactcataaactaacagaacaattcaaaaaataacaaataaattgatgcaaaattttcatggagtatatacccaactcccaacggtctaaaatttccaatttctattttaaaaaaaatcccgaaaaatcctgcgaccgtcactgaatccagcataaacaaatccccaaaaagcacatactccggcgtgttgcccttgctggactggatgagttcgatgagcgggtttttgtccgtcgatttgttcaaaaggtcgcccccgtggttgaacaacgttttcatgcacaacggattgaccgcccgcagtgcgaccattgacggcgtttcgcccgcattgttccgcgagttgatcaacgccttgcccgcctcttgttcaagcagtgtctccaacatttgggtggaaaccagggcagcatagtgaagctgaaaatggaaaatatgggaaatttgtttgaaaaaccaaaaaaattttgaggatgtgctgccattcccaccaatgttaccaaatttaaaaagtaaatcaaaaattcgattttacaaaaaaataaatatcgaaaacattttaaaatttctatataaaaatattaaaagttccaatttccaagtgttgcctatcggcggcaccggaagacctccagttttactttttaaacatgtacaaaatttaaattgaaaaaaatttttttttgtttgtttacttcaagttattcaaaaaaagcgtaaatttttaagattttttactaaaaaaatttcgaagagattacgaaaactaaaaaatcaatttttaaaagaattcatggaggagaaacggcattggacagagggcagtgttgtgcccctaaacaaacagccttttatattgcaaaaaaaaatttttttttgttcgacgcaccgcattgttcccaacggggtcacgcgcggtcagatcagccccatgcttgagcaaaaagcggacaatggagtcctggttggtctggacggccaacatcagcgggaagaggccttccggggagcaagccacttggaccaagtcggtgacggagtagtcaaaccgttccaggtaggccagcccgtcgtccgtgaaaatgtccacgcgttggcacaaaattgcaatgtgcgccatgcgccacagcggatgctccttcatctgaaaaaaaattatgggaaattttgttggaaaaaaatttatggccttgacctgcataaaaaaaattttttttttttgggagggtctaacgtgtccgacacttttgcggcccgacatttgcgtctttgtccaaaatctggttcaaaactaaatttttttcaatccatgatcgcctaaacagctttaaataagcgattgaaagtgattgtacccgatcattttatattcaaaaaatttttgaaaaaataataaattttcaaacagaaaattattgatcataatgaactataaaaccgggttttcttaattttaatgctgattaggctatcagggcttgaaaaaaatcaactttgagtccgattttggacataggcgcaaatgtctgggccgcaaatgtcggggctccgggtctaacccgaacaatttagtttatcgttgcctcaaaaaacagttactgagtttctaaaactttttttgctgaacttttttttgagttttatgaaaatttactcaacatttttaaaaattttctcatgctatatctgacaaattttgtcagagaatttgctcccagagggtttcgaggcttaagcccagtttcataaaaaaatctttaaaaattttaaacaattccgccagtaaagtaggatttgttaaactgatccctattattagttaaatttattttttatacataccacaaatgtgacgtcccagatcagttttcgcaaatcctttttctggtctacaaaaaaaaaatattttttttttgaatttttgaaaaattctctgccacctgacgtccgaaacagcacacggcactcctcgtagcgacgacaaaaatccaatgcctcctcgacaatgttcgaccttgtagagaataagtcagaaaattataaaaaaatttgctgtttatttcctcataaaatttataatttaatgacgaattttgaggggtttcgtgtaattgcaatcaaaaaaaaaaaagtttttgaaattccatctccatcaaaatgggaaggcaaaatcataaattttgaagtaccattttcataaaagtacaaaattcattgaaaaaaattacatattttcgaggggtccacagaaaacttgaaaatttttcgtattttggggggattatacaaaaaaaaaattcaaaaccgaaaaatggtgaatgttcgccgccgtccgccactctcttccaccgtgtacaccacgtggttcatcaacgctttggtggacgggtctttgtctttgatggacccttggacgaccatcagcggcgagctacacgccattggcggcagcggtgtcctccaccgcggggaacacaatgcaataaaaggcgagcaaatcggagcggaagacgacaacctcaaaggggtcgcttgagagggagaaacaatatagaaaccggaaattacggggggaaattggtataattgtggaaaattaagggcataaataccccaagagagagaggggttggggaggactggaaaaaatttaattgaaaaaatcggggtgattttttttaaatttacatatttgatgggcatcgaaagacttaacttgaccaaaaatcagtttttttaaatttagcaaatcaattattggtgaaaccagtcatctaataaaatgtcaaaaatttccaggagcatcgaccaaaaaaaacgacagaaaaatttttcgccgtcaaaaaacaccatcggacgaaatcacggcagaatgatggctaggcttataattagttcacaaaattcgaaatttacaggcttattcaaaaaaccctatctccaaacctcggaatccagtagtcttcgccgaaaacgcgctcctttgcgtttgaccaaagttcgttgattttgaccgacacttgagtgagtgagaaaaacctggaaaacagagggagtgcatttaaaattagattttcaagccatccctaaactggggattggaatgatgaaaaaccccaaaatttgttgtgttattcaattgtggaccgcatttttccgggtactcgggaaagacaaattgaacactcgcgattttcaaaaaaaaaacttttttattttgcgccgacatcacgaaaattctctgattactaaaaaaacttatcctaaaaaactgattattgctctttttggcaaaaaactgcaaaaaggtaaactaattttagcattcaaaaatttttttgtaatttggatttcaacgatgacccagccctgtggtgtccacccgatcaccttgatcgtccgaagtcggccccaccactcttttgcgcttctgccgtttcttataagtccgactcgccaccacttcctccatcggattttcg

SEQ ID NO: 14560 - DNA, 1693 bp, Heterodera glycines
tttatttaactttattgttaaaattatttatttatctccccctagtttttgcattgttatttccaacttggcaataattttggaaattaacattttcattcattcattgatatgtatatatttttgtattcataatgtataatttttagccttataagttgttaaagaaattaagaaattaagaaattattattatttttattatttaaaataaatgtcgactttaaatcttcattttgcttactttcttctcattgttgtgtttttgcttgtggactattcattggcaacgagaaagaaaaataagaacaaaggtgaggcaattatgctaattataatattattatccattgcattcatttataatttccattcaaagttcgctcactatttaatttaaatgggaccggacctgaaaaaatttgtaaatgggaatttcgcgtttttctttttcggcaaagcaaacgcttggcattccaccgaggccgatggacaaataagcggagccgacaaacaattgggctacacaattcgggattctcccaattcagtaataccgttttttaaaaaataaattttgattaatttaaatgttttgcaggaggcgtcacattcactaaaagtgtacacgagaagaggaaaacaattaagcaaatcaaacgacgcagaaaggacgacgcccactgtcggagaacaacaaatgccattgtcagccgacgcagcggaagaaaacggcacaaattcacagggaacggcgcaggaagagaaactgcaaaaaattgtcgacaaattggagacgaatcagaaagaaatgcagaggaacattgaggaaatgttgaaggaacatttgacaaaaatggaggcgaaagttgacgaggtgaaaaatgaaaattaaaaattgataaaaaaaagatattgtaaaggctatttttaattgagaaaagaaatcctaaaatagatatggttaaggctttttatataaaatgttaaaaggtacgaaaagtgaaggaagagacactgcagcaaatagtggtcaagatggaggcgtatcagaacaaattgcagcgaagcattgatcaactaattgggggacaaaagggaaatggtgggcaattagcaattgctcacgtttatttaactatgttaataatgcatttagtaatcagtagagaaacattacatcttaatgattattcttttggaattagggttaaccattggtaaccgatgggatgtcaacgcacgcgaaaatggcatcgagctaagtgggcacaatgaattggttgtggaacataatggactaaggagcggtaccatttcatctaaagcacattaaaggtataattcaacaattttaattttttaggttttcgctccgtttgtgccaaaaacccaatcccaaaaagtggcattttttacttcgaaattaaggatttaaatacattctcgtcattgttagttgcttatttgcgtcattattggaaatgcttttctttttgcagtgcagccgttggattagcgccgaaacttttgccattgggcgaacgcgcccgtttattacgacggtataaacaccgacagacacaacgacagctatgaatttgataggcttataccgtcattcatcactgattcgcctcctctcccgctttacaaacattttccaatgcttaatcctggcgatgtgatccgg

SEQ ID NO: 14561 - DNA, 1178 bp, Heterodera glycines
attttgagtggttttgggaagtgttcgagcatttgcattcttctaagttcatgtaaagtgaaaattttgtttgatttttaccttggaaagaaaatataattaatatttttaaaagtcctaattgaaaacaatgcccaacaatgaaaaaaaaaattgaatttggagggtggatagagcacccaagggttattagaaaaatgtttattttctgctaaatgagcacaaatgccgagttatgacgtgccaaagttttcgttttcgattttttaccagtcgccattggtgtaagttatggaattgcttatgttgctgcaaagaatcgcatgatataaataaatttaaaaatatttttttggagagtaaattagttaattggcaaattcgcttctaatttaaaaacttgagagtccgaagtttgttttaataaagctcaaaacctttttcctccgtaatgaaaatccctgcccataataaatgattaaaatattgaaaaaaaagatttcttcttttcactggtcaaatcatttttaataatagagaattgaataattatggtggaagtgaaatttaaaggagaagaaaaagaggaagagaatacagccaattcgtaaataaaagaaacagacagaaaaagacacaaatcacacaataattaatcatgctaatttacaaaaaaaaaaaaatccacgcaataaaatcatcaaaaataaatttattttcattttttatttttcaaaaagcaatgggatgaaattttgattgattttctggttagaaaaaaaaattcctaatttaaatttgttaaataaaatccgagaatgtctctctctgctcgtcgtttgtcgcttcattcattcattttgtttttccaattttcgttttgcaattcgtccagcggcaaaagcgtgcggcgaaatttagccaaaacttcggccgatttggtcaccaaagcaacggatttgatcagctcaaattcctccccaattcgtttcagatgcttttgcgcgctttggagcagcaatttgacacgtaaaacaaagtgagacaagcacaacagcacaacctaaagctaaaatttttaaagtttgctctaaaaaactataaaatgatgtgggctcagggtgtgacacataaatatataggcaaaaaaaaaatattccaggactctagaggtcccc

SEQ ID NO: 14562 - DNA, 1079 bp, Heterodera glycines
atgataccttccgtataattattgctcattatcactcattatttgcccacctgttcctctgagatgggtttgccttccagcaatgccatttgcataatttcatgcaaattcgccatttggtcatgcttcaacactttttccgtaaaaatttgttgaattggccctgcaatgtttgacaattgcccagaaaaatgcaatttttttgccgcttcttttctgatgatggaaagcgctgggtttagaaacacaagtttcatgtcgactcttataaaataacggcgcaacgaggaaaaagcgaccaaatctgaagcagataatgggaggcaaatgatacagaaaatgggccgagtaattaagagagtgaattggcagggtaattaaggcgctaatgaggggaaaacgaagaaaagcaacaataggcagactaaatgaatcacacaatgaattaccatcgaccaagcattgccattttcaagctaattgccaacgatttactgaccctttgtgatatcccacacatgatttagataggctattgccaactccaaagccccaaaaaagtccgtaattattttcaatggcggcaacgaatttcgttttgcttttgtcaaataaataaattcctttttcacgtaggtgccaagcttaattggtgatgttttagtaatttgtggtgcttttcataatttttgatgattttccacctgatattccaccacacttttcactccttcgccaattttatccgccccctcggcaatgttcgctttcaaagaagaatctttttctctctcggtggttttcttattcgccaattctgcgtttttctccctaaatccctgctccaattcgtcaatatgttctctaatttcatccatctctgccatttccttggcaaatttcactgtttcttttcgcccttcgatttctctcaaaatggccaacaatttgtcactttggccttttgtcggattgtcttgcaaatgggccatgaactgcttaaacttcgcgaaatatgcttcgatgggttccttctgagacgggcgttcctcctcattttccatcaatgcattgataat

SEQ ID NO: 14563 - DNA, 2775 bp, Heterodera glycines
  misc_feature (2703)..(2703): n is a, c, g, or t
attgtcagaggcagtgcctggccgaaaaaatagacacacttttttaaaaaagctaaaaaaaattgaaaatttaaataatttaaaagtgaaaaaaaaataaagtaatttaaataggcatattttaaaaaagcctatttttttgccttttcacaagagaatttattaaaaaaggcaaaattcgccttaaattaataaggtgaaagtttgaaaatgtttattaaaaaatttcaggatgaaatacaattaaaataattaaaaagaaaaaaaataaatttatttttctaaataaataaaaaacattgtcagaggcagtgcctgcctaaaaaatagacaaaattttttcaaaaaagccaaaaaaaattgaaaatttaaataaatttaaaagtgaaaaaagtaaaaaagcttacaacaccttcgattcccaggacgtctccgttccaagtactaagaaggcccaacgttgcttaacttgccagatcggacgggatggcgtgctttcaacgtggtatggtcgtaagcgaaaggacagcaattaaagtcatttaaataggcatatttaaaagagcctatttttttgccttttcacaagagaatttattaaaaaaggcaaaattcgccttaaattaataaggtgaaagtttgaaaatgtttattaaaaaatttcaggatgaaatacaattaaaataatcaaaaagaaaaaagaaaaaaaataaatttatttttctaaataaataaaaaacattgtcagaggcagtgcctgccgaaaaaatagacaaaattttttcaaaaagctaaaaaaaattgaaaatttaaataatttaaaagtgaaaaaaattaaagtaatttaaataggcatattttaaaaaagcctatttttttgccttttcacaagagaatttattaaaaaaggcaaaattcgccttaaattaatgaggtgaaagtttgaaaatgtttattaaaaaatttcaggatgaaatacaattaaaataatcaaaaagaaaaaaaataaatttatttttctaaataaataaaaaacattgtcagaggcagtgcctgccgaaaaaaaagacaaaaaattttttgaaaaaagccaaaaaaattgaaaatttaaataaatttaaaagtgaaaaaaattaaagtaatttaaataggcatattttaaaaaagcctatttttttgccttttcacaagagaatttattaaaaaaggcaaaattcgccttaaattaataaggtgaaagtttgaaaatgtttattaaaaaaatttcaggatgaaatacaattaaaataattaaaaagaaaaaaaataaatttatttttctaaataaataaaaaacattgtcagaggcagtgcctgcctaaaaaatagacaaaattttttcaaaaaagccaaaaaaaattgaaaatttaaataaatttaaaagtgaaaaaagtaaaaaagcttagaacaccttcgattcccaggacgtctccgttccaagtactaagaaggcccaacgttgcttaacttgccagatcggacgggatggcgtgctttcaacgtggtatggtcgtaagcgaaaggacagcaattaaagtcatttaaataggcatatttaaaagagcctatttttttgccttttcacaatagaatttattaaaaaaggcaaaattcgccttaaattaataaggtgaaagtttgaaaatgtttattaaaaaatttcaggatgaaatacaattaaaataatcaaaaagaaaaaaaataaatttatttttctaaataaataaaaaacattgtcagaggcagtgcctgccgaaaaaatacacaaaattttttcaaaaaagccaaaaaaaattgaaaatttaaataaatttaaaagtgaaaaaaattaaagtaatttaaataggcatattttaaaaaagcctatttttttgccttttcacaagagaatttattaaaaaaggcaaaattcgccttaaattaatgaggtgaaagtttgaaaatgtttattaaaaaatttcaggatgaaatacaattaaaataatcaaaaagaaaaaaaataaattaatttttctaaataaataaaaaacattgtcagaggcagtgcctgccgaaaaaaaagacaaaaattttttgaaaaaagccaaaaaaattgaaaatttaaataaatttaaaagtgaaaaaaggaaaaaagcttacaacaccttcgattcccaggacgtctccgttccaagtactaagaaggcccaacgttgcttaacttgccagatcggacgggatggcgtgctttcaacgtggtatggtcgtaagcgaaaggacagcaattaaagtaatttaaataggcatatttaaaaaagcctatttttttgccttttcacaagagaatttattaaaaaaggcaaaattcgccttaaattaataaggtgaaagtttgaaaatgtttattaaaaaatttcaggatgaaatacaattaaaataattaaaaagaaaaaaaataaatttatttttctaaataaataaaaaacattgtcagaggcagtgcctgccgaaaaaatagacaaaattttttcaaaaaagccaaaaaaaattgaaaatttaaataaatttaaaagtgaaaaaagtaaaaagcttccaacaccttcgattccaggacgtctccgttccaagtactaagaaggccccacgttgcttaacttgccagatcggacgggatggcgtgctttncacgtggtatggtcgtaagcgaaagacagcaataaagtcatttaataggcatatttaaagagcctatttttt

SEQ ID NO: 14564 - DNA, 1402 bp, Heterodera glycines
  misc_feature (51)..(51): n is a, c, g, or t
gaagcatatttgattgtaaagcagattccatcggccgactgacgccttaancagcaaatcactgcactctgaaggcaaaaaccaccaaatgcttggctttgtgatcagaagcagcggacggcgcgagaaggccgaaagtcgagcgatggtcagtaagaaacgcttttttcgttaattgattgatttgactaccttctttatactctccctcctctttttaaggcttgtgccccgcttcttcgatggactcccaatgcttacactaatggtgagttgtaaaatgatggtttaattgatacattagtgaatgaaaaactaaagaaaattgcttcccaatgcaggagtgtgctatttgctcaattccgaacttaacaacaccgttgtgatcaacccgtgcgattcgttgccgaaaaaagatagggtcggcacttaatacaaatgttctgctgatcagtcacgctctagaaattgcctaattagtctctatttagcataatgactacggtgcgtgtgaacaaggcttttccggtttcgttgacaatgtgatgaatgctcatactttctcctcattctcttacatcgcatttcaataattttccatcattttcagcacatcattttgactggtctcccgggggcacggaaatggacaggcggagttttcggtaatttttatcagtccatatttctatccatgcctgtttgtaccattgggaataattgtgtgacattttcatcagctcgatacgaattcactgattccgatggttttactgatttggtggaccggcggacgatggacgtgagcaaagaacagcgggggatcatcaacgttttgacttcgcacgactatttgggatactccgtccgttatgggcgcttcggcttttggtatgagcacaccgaggcgggcgaggaggccgccaatttcacggtggtcagtggcgcgactcggtacaatcagacgggtcagtcgacgatcaaatgttgcgattttcttggcattttcattttgcctttttcgcaggtgccgtcgtctttttgccattctggcgacatgttcaggcggagaatcagcgacagttgggcctttccgacgacttctttctgttagccggccatcagcttggctccgggttcggctccgctttggaagtgctcgatttgaatgccgacggcttcgacgaccttttggtcggcgctccctttgaatttcacctccgctccgatggcgcgtcgggtggtgccgtttacgtattttattccgcgggtgtgcgtcgacagaagggggacagtgcgcgagtgtttcgcgccccaaagattctcagagggaccggtgcccattcccaatttggcgctgcgctgacgcgactcggaaatgtcgacaatgacgcggaaggga

SEQ ID NO: 14565 - DNA, 2180 bp, Heterodera glycines
  misc_feature (87)..(87): n is a, c, g, or t
  misc_feature (123)..(123): n is a, c, g, or t
gtttttctttgttcacttctctccggccctttgcctcggaatgattcgtctcgccttttttctcgccatttcgctgataataaacanccagcaggcctttctgtgccgacttcaagcccatcncaatgccaaaggtgttatgccacgagcattgttcgtacccaatggcgcggcaacgacggaatggcgttgtgggcggagtgcactcggaggaggggaggaaaagcagacacacgacatttatgtgccggtaaattcattggcatttacatcaatgccactgacaaatggctgagtgttcacaatcagaagggcaaccaagactggacaaactcattacgtttcaatttgactgtgtccgtctccccaaacggcgcactcgtgcaacagtcgttcccgctgcccataatcaacagaaaacaacgcagtcacttcttcgaaatcgcatttgacaagaaatgcggtgaggacaatgaatgccattccgagttggcactacaagcagccattctcgacataacgtgagcataccggggatggaaatgcagaaaaacattgggacaaactcaggaggcgcgaagacggcatttacattgccaaggtgacggagcgcgactcgctggtgattcgttttttggtggagaatcgtaaggagcgcgcatttctggccaaattatttgtggaatataacggagtgaggggaagtacatttcgatggaaaatgagttgtcaaaattaaggacgaattggacgaacctcacctcacgcaaagggactaccaaaaagagactccaaagttggacatcgaacggaggaacgaaggattggtggttgttggactcggaaacccaatggaagcgggaagaaaggtccgatcagacggagacgtttgttgccaagtcgtttctctttcagcttagctttgacttggcgtttaaactcgtccgtggaagttccgaacgaatcagcgcctcactgaactttcgcgcactgatcaattcgtccagtgttgaggaggaaacggcgaacaatgaatggagtgccgaagtccaactgatcaaagaagccgacctccagctgggctagtgccttcctttcttggagcccttttatcaattccttccgctttcagaaggcgcttctcggccgtccatcgtccgcttcagtaaaggcaaccgattggtcactgacgaagtggacatcggtcctcaagtggtgcacgtgtacacaataaccaaccacggccctttctacgcacgaaatgtgagcctgaagatcaactggccgttacagctgatgagcggggaccctttgtccccgcgtcaaattgcctccggcagttgggcactttacacacttgaagagccattgatacgtcataatggccaaatccgacggtgtgcagcaccaccacaattacatggacaaaagtccatcaatccgttgggcgtgtacaacgacgaaaccctcaaattggattatcaaatgacgagtcgacggcaaagaccgaaaagggcccccaatcagcggacagttggaacaaacgccgaaggcgggacattctctgccacggcaccgctgacatcgattttcgacaacggacgcattcgacggaaggaaatcgaggaaagttcaggcgccaaagttcgtattgccgacattgtgagttgatttacgagtggcgaaaaaggcacactttccccccagaattgcaaggatggttctgctttgtgtgtaccgttacagtgccatttcgacgttagtttttaagcgttttaaatgatttgttggtttggattgatgaatattcagtacattggacgcaatgattcaattctaatcgaaatacgagcccgactttggaacttcactttctccgccgtacgttgcgactgaatatcaagcaaacattcctacgattccctcacaatcaaaggattaccgtgccatcgattacatcgccatctcttccgaaggtttcatcgaagtcgaccccaaccaaggcattctcgaggacgtgaccaacaacttcgcgcgagtgaccaccgacgcgtacccggacagacctcagcaggagggccaaattcgcgtgtggatgctcctgttggcctgtctgattgggctcgcactgctcggtctcctggtggtgtgctgcaaaatgttgggcttttttcagcgca

SEQ ID NO: 14566 - DNA, 3170 bp, Heterodera glycines
ttataagttgaatgcactaaaaaatgccaaatatgcactaaaagtcccccaaagaagccctaaaaacccgaaaaatgcccaaacatgcactaaaacatgcctataaactgcaaaaaatgcttttaaccctcaaaaaatgccaaaaattgtgtataaattaagaattgcttttaaaacaccaaaacaagggctaaggagcatttttttagacaattgcaaaaatatttaatttccaaatttataatatatgctaaaacaaaattacatttttatacacataaatttttttcccaaaagttctgacaaaaatttaatttttttcgatttctaagggtgtatttttaaaaaaattccaaaaagtcgatcgttaggggtgtatttttcgcttttttcgcatttttcttatgaaaatttaccaaaaatgaccgaaatatgctctcaaaacgcaaaaatggacaaatatatatttattctcgaaaaccccctaaatatgcttttatgtgcactaaaaaccttcaccaaatcaaaaaattttattgcagaaatgctatttttgagcccctttcttcatagcatatgcgcagaaaaaatatgcaaaatcatacaacttataaccctaatcataactatttaattggccaaaattcagttaatggtggtcaaaatgcgatttatgcaattactaggattaaatcatctgaaacaaagacatgtctttggcgacccttccaattccaattaagattggatgctaatgctttttttaattttcagcccgatggactcgttatcaccagtgtttaaaataattatttacttatggaaaagccattaatcctatattttcaaattgaacatgtaaattagtaaaaaaaaattttgtttttattttgcacataaaatatgcactaaaagtcccccaaataagccctaaaaacccgaaaaatgcccaaatatgcactaaaacatgccttaataaactgcaaaaatggcttttaaccctcaaaaaatgccaaaaattgtgtataaattaagaattgcttttaaaacaccaaaacaagggctaaggagcatttttttagacaattgcaaaaatatttaatttccaaatttataatatatgctaaaacaaaattacatttttatatacataaatttttttcccaaaagttctgacagtttaatttttttcgatttttaagggtgtatggacaaatatatatttattctcgaaaactccctaaatatgcttttatatgcactaaaaaccttcaccaaatcaaaaaatttttgatttccggctcctttacagccgagaaaaaatgaaaaaatttttcaagttattagtccaaatttacagaaaatttgctaattttactgaatattttgccaattttatttgattttggactgaattcttaaaaacatttatattagaattttaaaaaatatgcataaaataataaattttatcattttatgctgttttaaaaatgaaaaacaaaatttgaaagtgggggggggcgcctcacaaaattgggtcgtcgtcgcacagaagcagcgggcgaagatgcggtgggtgttgacgttgaaatagaataggtattggagaacagtggtgaaagtgatgaactcaaccaaataggcagaaggttgaaattagtgaggaatttgcggagatttgttgcttttatattgccttttttggaatgaatttctttaagtgaattcacctctataaaaggcgttgaattttgcaaaaactttcattgccttaccctaattaattaactattataattctctctatatcgtcgtcgccgtcaacctcaatttgaggtgttttcactccattcataattttttaatctccgtttttcttacagcagtcatcacgatgtccgggagaagtggccgcagtgggaaacgccgacaggacggaccgggccgcccctcacgttcacgtcagcagcagcacacccagcgcggcgttcagtctgcatatcaaggtccacgagagccgccggagcaaccaacagtccgaggctgggaggacacgcacgacttcagctcagccctgaaaatcttcgtcaacgagacaacgcgacgcaacgtgaaggagctggtcaacgaatacacggagctgaacgccatgccacggccggagacttcgccggaattcacacggtcagtttggctgtttcgattttcaaacacaaataaaataggtaatttctttacagccacatggactgcaaccgctaccgggacgtcatctgcgccgagcagggccgcgtgcgactcgacaacggacgatacatccacgccaactggatcacggcccttggcgaacagcgcttcatctgcacacaaggcccgctcgagacgacctgcgccgacttctggacaatgatcgtgcaggagaacatcgaaagcattgtgatgctctgcgacaccgtcgaacaaaacaagaccaagtgccaccagtactggccgacaccggacaaaaaggtgggtttttccattttttccccttgcagcaattgcacttcgccaacaagacgatcaccgtgcacttcatcgaagagactgcgctggagccggacctctacaggacaaagctggcggtgctctttcccaacggctccatgcgcgtccatcacttccactggcgccggtggcccgaccgcggtgtgccccagaacgacttggcgcctcttcgtttgctgttccacgtgcagcagtttcggcgctcggtggtccaccgttcagcgggtgagtttgtgccaagttggaaagtaaaaattcaataaatttcccatttttaggaatcggacggaccggaacactcggtggcgctgcacatcgcctacgatactctgcagcgtggacatcgactcaacatcctctcgttggcgcgcaacctccgtcagcatcgggcccagagtgtgcagacgccggaccaatacctctacatatacttcgtgatgttgcggtgggttttttgtttgagattgtgtgtctaaataatcatcccctcccccatttagttatgctctcaacatctcggcgaagctcaacattgacgaacgtgcactgacgacattcctgcggagatgaacgagagaatgacgcgaacctgatcttctgtgtattcgtgatcgtatttg

SEQ ID NO: 14567 - DNA, 4072 bp, Heterodera glycines
  misc_feature (2124)..(2124): n is a, c, g, or t
ttcaggctggtttcgcgggcgatgacgcgccccgtgcggtgttcccgtcaattgtgggtcgtccccgtcaccagggcgtcatggtcggcatgggacagaaggactcgtacgtgggagacgaggcgcagtccaaacgtggtattctgacgctgaagtacccgattgaacacggcatcgtcaccaactgggacgacatggagaagatctggcaccacaccttctacaacgagctgtaagtgtgctgtgagaatttgttggtgccttttttgtgattctccacgacggtgaaatttaaagtttagtggttggggtgggtcaaaaaaattcgggaatagtccgaaaccgtggcttgtgtcatgtttgatcacgaatttatttcgccttgtttcggacttcgggcgcaaatccgaacaacaaaaaccgttacctgtcgagacgttcccgtgatttttcataaaatattaaaaaatgcaacccaaaaatatggcaaaatttcgctcccgtccttttgcaggcgtgtcgcgcccgaggagcatccggtgttgctcacagaggctccgctgaacccgaaggctaacagagagaaggtcagccagtcgccatcggtcgaccaatggtcaaaccgcacggcccgtccccctgttcagatgacccaaattatgttcgagacgttcaacacgccggccatgtacgtggccattcaggccgtgctgtcgctgtacgcctctggccgtaccaccggtatcgtgttggactccggcgacggtatggcagccaaatcattggcataatgccattgctaatatccctgtacaggtgtcacccacaccgtgccaatctacgagggttacgcgctgccccatgctattctccgcctggacttggccggccgtgacctcactgactacctgatgaagatcctcactgagcgtggttactccttcacgaccaccgccgagcgtgagattgtccgtgacatcaaggagaagctgtgctacgtggccctcgacttcgagcaggtcggactttggccaatgccgtgccaaaattatcagtccgtccgccttcaggaaatggccaccgccgcttcgtcctcatcgctggagaagagctatgagctgcccgacggccaagtgatcactgttggaaacgagcgcttccgttgccctgaggcgttgttccaggtacgtatttggctggatcggccgaaatgtagccggcctataatgtcgtcgcaaaaaaattcaaggccttgagcacttttccggaagcagttttttggcaggaagagcaaaaacaaaaatttttttccgtattccccatcaaaaaaaattttctttctatgggcctggccctgaagtggggaacaggagggcaggggacacactgcttccagcataagtagagactggactgaatatgcaaaacgcggtgcattactttctgttctctatgtaattgtcacccccccccccccgagatttaaaaaaaaattttttcttgaaatccgttgaactttgaacaaaagtatttttgggctgggggcgagtcgtttctcagtgctctgtggaaatcgttgccaccatggcaacacactgattgtatgaatacacaactcctttccagccatctttcctcggcatggagtcggctggcatccacgagacgtcgtacaactccatcatgaagtgcgacattgacatccgcaaagacttgtacgcgaacacggtgctgtccggcggctcgaccatgtacccgggcattgcggaccgtatgcagaaggagatcaccgcgctggcgccgtccacgatgaagatcaaaatcattgcgccgccggagcgcaaatattcggtgtggatcggcggctccatcctcgcctcgctctccactttccagcagatgtacgtttgggttggccgtttttgttgtcgggtttggctgagcaatcaaactgcttctccccccccccccctccgcattcaattccacgcacctccgcatttgcatttttttttgcacggtaatctcttggatagtcttgtcgccattttttgggtttgtgtaacatcagactgtcttggctcttcttagaaaactcacggaaagtgccgcagggaacttttntaaacgatttaattttgtcccaacttacgagtgtatcaattttggtttacaattaaactcattttccctttttaagtgattcattttttggatggctgtagccttttaaaattggcttattattactttttccaaaactgttttatgcaattaatcattgcgcgttttctcaggtggatcagcaaatccgagtacgacgagtcgggcccgtccattgtgcaccgcaagtgcttctgattgagcggcggcccgcagggagccgaaagaaggaggaaaatgttgccgataaaatttgatttctttttttttttgctgtttgtcatggcgtatttaatttaaaatgataatatatagaggcggatttaattttatgaattgcttgtggataattaggaaaatcttattccttggcgggtgaggagtttgacagtgatttgatttttttaaatttgaggcaggcgggtaatacctctgcatgtccctcctattttctgaaaataaattttttagaaaatctaaaacgcctttcctgggttttcagggtctgattgattgacacccattctagtgattcgaaaacccaaacccgacttcaaacaaagaggaactcaaattagaaactgcacagaatgacctttttaggcgttgcgttgcaatagtaagagactaactatagcggtacttttccgctatgccgccaccccataagtcatgatccctacaatggaaagcacttttctgggcgtaaagttttaggcgccgttcaagttaattaattggaagcaaagcattattatttttttgctgacaaattatggaaaatgcaacgaataacacattctcctgaaaggaatttatttctgtaaaataaatgtaaaatttgataaagaaaaaatggtgagaagagtaaaaaaaaaattgagaaatcattgaaaaaaataataaagatctgacgtgtatttgtgaatgtttgtgagtgccaattgacattaagttttcggactataacttttttatttgttaaccaaatccaataatcttggtatcattcgaaagcttaacatgtttagaagatatttctaagctattgcttcgcgattagacaattaccaaaaaagttataacatgaaattgcaaaaaagtcgaaaattttgaggttttttcctaataacttttttagaagctaaaatttttgtttgttttttgtaaggctaatagagcttgtgaatggctttcgaatgataccaataggggcgttaaaacgaacatttcgaatcccgaacccgaattcgaacaaaaactcaaaaatccaatttccgacaaaattcacatttattgcccaaatcaatttaaatgcacgaaatttgtaatgaatgagattaaaaacaatagatttatggatttcgttcacaggggtacataacacttacttgagaccaaaagttaaaaaatacatcattataatccccaaagtgctttcgccacagaaagtaaagttcaacacaatcaaatacagcaaagtcccaaaatatgcaaattttttaaaattggcgtaataatcttgtgatagacaagcagatggtagtgtgtatgaatgttttctttgtgatgtgaagtttttgggtctgtatcgttttggcgccgccgttttggcgccagcccaagttttcggactataacttttttatttgttaaccaaatccaataatcttggtatcattcgaaagcttaacatgtttagaaaatatttctaagctattgcttcgcgattagacaattaccaaaaaagttataacatgaaattgcaaaaaagtcgaaaattttgaggttttttcctaataacttttttagaagctaaaatttttgattgttttttgtaaggctaatagagcttgtgaatggcattcaaaagataccaagattgttagatctggtcaacaagaaaaaa

SEQ ID NO: 14568 - DNA, 2865 bp, Heterodera glycines
  misc_feature (77)..(77): n is a, c, g, or t
  misc_feature (2856)..(2856): n is a, c, g, or t
cataaagcactgcccattgcaatgtctccgttcaattcgtgaaattcgcccagtgtaaatgaagctcaacatcactntaaatgcttctgcttcaacgtcaggcacctccataacctgacaattagctgattgaaaattaatggtgtaattagcatgactaattgaaataattaacaaaaattattaatcttttttttaccgttttcgccttgttctttcttcgcgtcaaaacggaaccattgcctcaaatacatcggaagctaacatcaaaattaatttatgggctgagagaagcttaagaagagagagataaaaaataaataatttaagtatttccaattaattaaaatattattcaaagttatgattaaaaaaagaattttctcaattcagtaatagccactaaatactcaaaaaatgaacaatttaattaataaacaagaagaactcgcctctttttcttctccatcccccaccaaaaagtgcacatccgcgtactctcccgtgctcagcatcatctttagcccagcaatcaccgattttgacattataaattgaaatatttgctaaattgtgatacataagatgatgataattatgtcagcttttattgattcctcgtgagataacacaaaaaaaacacaacgcttcatccgatccataaattccccgacgataggaatcgcccccactttggcgccggccaggcattttatgtaaaaaaatttgacgcacttaacaaatcgatattttatcggggatacatagagttagcaaagttcaatcaaaacaaaaatatatggcaacaattgtgtcagaagagggcaatgttttgctgtttctctttcgccctgccaccgcatctttagcccctttttcagaaaaaaaagttgaccaaatcaatgaaaatataaatcaaacaatgtttttcaaaaaactgaaaaatcgatgtgtattttaaataaattttattttttgagcccggtgtttctgagtttgaaaaattttcgatcgaagcccttacggccccggtaaattggacacaaatggaaatttggagaccggaaaattggaccttattggatataaaataaattaaaaataaataaacaaaaattttggttttgctaaaagattttattttagtctgcacatccctgtgtttttataagcgtaataaaatggcaataaataaggtttttattattgtaacatcaggagaagaaagccaccataacattaataagtagggatcggatttttagtgataaaaaatcccaaaataattaactaaatagtagaaaaaaattccaaaacagtggcaaaaatagtggcgaaaaagttccaaatttaggggtgtaattttttaaatagctgttttttaatttgaaaataatttaaaattaaggaaaaagattttattcactgattgcagttacaaaatattttcttagaaaatattgaacaagaaaaaaaatttgggggaagaatttttgtgaaatttttccaattcttagggatgtatttttgaaaatttttaggtcgattcttaggggtgtatttttgaaaattttttaggtcgattcttggggtgtatttttcgtttttattgcattttttgggaaattttccaaaaatgccaaaatagtggcaaaaataatgacgaaacgccaaaatagtggcaaaaaattattttagtggctaacttccgaaatagttttttttagtggcgaagctccaaaatagtgattcctagtgatgaatagtggcactaaaaacgaaaaattttcgaaaaagaatgtgtttttcgtgcatttctcgtcgagttaaagccgcagaaaaaatagttaaaaaactaagaatccgatccctactaataatattcaacagttttaaagtacaatttctttttatgtaaatcatttattaaagcacaattaatcattttattttgcttagaagtaccatacgcaaaaagcgataaatactgtattaaatagtttaaccaaaaatgaagcacattttaattttatgaatccactgacgaaaatattcactgccgaattggaactgacgaaaaaaatggaaaacagtgaacaatcttttgcactgccgcgtctcataagatgtcagcaatttcgtttcgctttcgttttagtagaaaataaatttggacgaaaaaagcaaaaatatttacactcctaactgtggcaaaaacacataattcgggcaaaattttgtaaaaacccggcaattttttaatccattttttgaagaaaaaaaaacattcaaccccaattcatcagtaggacacagattcttaggtttttactcaaatttctgcggctttgtttcggtgagaaatgcacgaaaaacacatttttagctcggaaaatcttctctttaacgctcctatccctccctaggaatccctatttcgggtgttcgaccctaaaataaatttggccactattttggcattgcgccattattttcgcgggcccctttcggcatttttggaaaatttcttaccaaaaatgcaataaaaatgtaccttataagaaggaccggcctcttgaaaattttcaaaaaatggaaaaattaacaaaaaaaattttaatttttggacaaaaacaatataaatttcgcaaaaatacagtattgacttaaaaatgaaaaaataagccgaaaatcgaattttcttcaagaaaaactgctttttttcaaataaaaatgaaattacattcagccctgagagattttgacaaaattgcgaacatttttagatgcaaaaattttttaacatcattaaattctgtggatacaatagaatttttgctatataaatttacaaantatatttct

SEQ ID NO: 14569 - DNA, 1831 bp, Heterodera glycines
  misc_feature (1397)..(1397): n is a, c, g, or t
  misc_feature (1438)..(1438): n is a, c, g, or t
  misc_feature (1500)..(1501): n is a, c, g, or t
ataatttacacgatggggaccaataaaagtggacgcatcgtttttggtagttgccaaagcgttaaaagcagtggtggacatttttggccactatttgttggcccttaattaagacaattagccaaattttccgaaggtgaccatttctgcgggccatgaaaacatcgacaccgtggaatgtgccagaaggtggtcactaatcacttccgctcagttccccacctctacaaattaggggcatccgaatgggctttggcggtgccattctcactgaagcaacagccgaaacggcgatggcacttttacttacggtttcacgccgccttgtccataacttttttttaattcgaccaaataaaataatgttgatattaatcaataggtctaaaagttctttattagcctgcaaaatttcaaaaaattatattaggttttaaaaaagatatggcgcgctgcgccaaaatggccaggaaaatgcaattttttgaggttttttggccataacttttttgcttctcagctaaattttttgaaactttgcaggttaataggcactatcaagccacttaaaatcataccaagattatttaattttgctgtgaaatcaaaatgatatagtcttgcgccaaaatggcctgcgccaaagtggccggttcccgttgaaaaataaaattagcagccctatcaatcaatcaacccgaaatgtttggtttgtgttttattttgtacaggaggagcaaataaaaaacaaaaaataataaaaaaacaaagagaaagtgccaatttgacatttattcactgcttataaagcatcagtgatgatcatttgttctgtttgtgtgagtttcattcactcttttgccattctttttcacgggttttgcggtcgaaggcgcttagaaaggagaaaagaaaacaaatttatgataaaaaattattgaaaatgaataaaaattaaaaaaacttatatatgaatggaaagaatgcgcaatgaatggccaaggaaaaacatttgggaaaaaagggcaatcgaaaaagccgaaacattgcgcaaatcaatcgaaaacggagatgaaattgcaacagaaaaagggaatgagaaaagagcgcaacaaaaagcaaaatttggatgaaaaagctaaccttagggcatttgcgagtgataattaattaataaccgtttcagtgaatgtgcgaacaacgggcaaacaaaagaaaagtttaattggttaatcaatgggttgagcagaagaaaaacaaaaagtgctgtgatcctaagacatttggtacgaccgatggaattgttggttaattagttgatcagcagacgaaagaatcccctcgggggatgccacccgttttccgttcacttctccaccgaccggtgccgattctgnctcacgagtcggggtgtgtgagacgattgtgttcgaccgangtcccagcgcttcctgcgcaccgccaccgtcgtccatgggctttttccgatcgcactgcttnnggtgtgtgctgcgcgctgttttgtccagccgggctaactccgcaaaaggccagtcgtgtcgcttccttctgaatgaatgcatcccattctgttgattatgattacaggccccaaaaagtcgaggaggggggggttttttttcccccccccccccccccttttttccctccataaccccccaatttcctttttttttttccttccccctctttttatcaaaaacccaaaaaccaccaccttttttttttttcccccccccccccccccccccccaaaaaaaaaaaaaaaaaaaacatattttttttttccccccccccccccccccccccc

SEQ ID NO: 14570 - DNA, 1409 bp, Heterodera glycines
tgttttctaattttcaaaaaaaattccaggcctctacctatacttggaagggctgcagaaattggcaacttttcagtaccaactttgcccagttcagtccccgttgaataactcattaggctttgacctgagcgcagggtggccagcggacttattgtagagctttaaaagcccgatttttccagattttaaaatttcgaaaattttcaaaatttttcgagctaggcctagaaaacggttttcgggtttttgaattttaggaatttttaacgaattttcccagaaaaacggagaccacttccaaaacatagtttttcgagctctatcgactggtattttttttggaaaaatttcgattttttcccggaaatagaaaaattttttggcctcagcgggacatttgagtcccgggcccataactcgtcaggggttgaccatagcgaaaaagaaccacaatcccacagcaggtccacgacaattgttggtcattggtgcgacataaacccgaagggtcagtcagctaaccacattggtgcgacataaacccgaagggtcagtcagctaaccacattggtgcgacataaacccgaagggtcagtcagcgaaccatattggtgcgacacatgccccgaggggccagtcagcgaaccgtattggtgcgacacatgccccgaggggccagtcagcgaaccgctttggtgcgacacgtgcctcgaagggccagtcagcgaaccgctttggtgcgacacatgcccctaagggccagtcagcgaaccgctttggtgcgacacatgccccgaggggccagtcagcgaaccgtattggtgcgacacgtgcctcaaagggccagtcagcgaaccacatggtgcgacaaatgccccgaagggccagtcagcgaaccgctttggtgcgacacgtgcctcaaagggccagtcagcgaaccacatggtgcgacacatgccccgaggggccagtcagcgaaccgctttggtgcgacacatgccccgaagggccagtcagcgaaccgctttggtgcgacacatgccccgaagggccagtcagcgaaccatattggtgcgacacatgccccgaggggccagtcagcgaaccgtattggtgcgacacgtgcctcgaagggccagtcagcgaaccatatttgcaaaaaatcaaatataaatgtcaatattgggaattaataaaggacagaacaattaaaaatgccaagaatttgcaaaaattattatttttttaatttggcagttttaattgttcttgattattctaggaaagaacttaaggcgtacctctgctatattatatttattatctattccatcctcagatttgggacagaaaaactattcctatatatagcaaggtataatttaaaataaatagaactctgaaaa

SEQ ID NO: 14571 - DNA, 1578 bp, Heterodera glycines
  misc_feature (36)..(36): n is a, c, g, or t
ggtcgatcagaaattgcggatttctgtcaaaaaatnaataatgcaaaaatggaatcaaaaatgaacaatcaatcatacatgtgagtgatcatttgatggagcaaatccttattctccataaacaattcgggtgccgattctgtaggggaagaaaattatcattaaaatgccatggaaaattccggcacacctttaacaactttggcgaacagttcggcctcttcgcccggcactccgtaccaaattttgcgctccccccaatggttgtagttgatggaatacagcataaaatgtagaaggcggataattaaattccaccaaacagacatagaatttttggcaataaaaattgttggcaaaggtatgaaaaaaaaaatccagaaaatctcgagcattttcaattgcttcaattcggcgtagaaatgcgggttaactatgcccatgcccaaaaacacagtcttataattagaatcagggggcgtacccggattcggaatcccgaaaattctataattttttgggacagttagaaattcgctgtatctaaaatttttggagcattttgaactgtttcaattcggcgtagacaaattattttgccgtaaaacaataaggaattcgagggcatattcggattctaaatcccaaaaatgccacaattttttggccacaaagccaccaaacagcagacacagaccagtggtcctcgacgtgccaacaaaaggtggagaacagcatgccaatgtacacccatgggatgatcatgccggagatgtcggtggtcatgtggcacagcacactctcgcgcaccttcggcaaattgtgcaaattccacggatggttggcgtactgttggcggtcctgcgcgtccgccgcaacaccgcgcaccgacgcgtcctcacggcgcggaaaaccgctgccgactttgctcgaaatgctgcgcaacaaattgggggaggcgtgagcacatgtgtaaaatatatacggcattacaccaatgtttggcatggcaacaatttcccgtcaggaaattcttggtctttcccgtccccggaaaatcgcatttgtcgggcaataatgcaaatacatacacataatccatttagaaaaatttgtaaaaaaagaggatttcaaaaaaaaaatccaaaaaagttttgaatggaaaagccgggggagagggtttgaatattgggattagggtcagaaatttgtcaagaattttagtagttttttcaatcgaattgtcaaaatttcccaaaattcactctctccttgaaaaaatgccaattcatccaaataaattgttggttagagttttaaggcacaaattccctagagtcctgaattgttgggagaaattcggaaaattaattttttttttttcataagttggggaattccaagacaaaaaaaaaactcagaggtccgccccgtacttcacttgaacacccttgtcaatgtcgatcacattgcgccaaaattccctttccacgcggtccggtgggacctcctgaatgggaaacggtacagaaatttaacaaaaaattaaaaaaacaggcaacttacgcgtggctcctg

SEQ ID NO: 14572 - DNA, 905 bp, Heterodera glycines
  misc_feature (24)..(24): n is a, c, g, or t
tcaggcgacaaaatttatgaattnagtggctaattaccgtcaaataattaattataaatgagctaattgattaaagactgacaaagacaatgaccaagcaactgtattttttagaaaatattctccattgcttaggtcattgttctggtgcaaattggtcactcaaaaaaggcgctgtctccccaaaatggacaattcgaattgtccggcgttgtccaatttggccaagtgttgcggacggagccctttcccttctttgtgactgataatccgttggccaactgttgtcccgagagggatttgctgctgctgcccttttccaggcatagtttggcttattctcctgatcaccttcatttactctttattcgtttgctaaattcactggaattttcccagcaattccctgtgcccttttcagcggcacaaccggcacttccaaaggcgtgatgatcagtcatgccaattggggaacaatgatgtccattgtggtggaccatttcggccggtacattcacccgcacatcgcaccgccgttccgcgcccgggacgaggccgaattgttgctgctgcccttcttccactgtttcggtttcactcagctgaacatggctttgctgaacgggtccaccggcgttgtgctcagcaaattcgagcagaattccttttgccgagtggtggagcagtacagggcaagagaaaaagcaaatgcaaaaaacaaaaaacaaaatttgaaatgccatccgtaacgccaaagaaaaaactggcagtcaacaaactcagggccttaattgcggaccataaacgtgccgtctaaacatggcgaagacgacagatcagtaaaccaattaagggagagattaacatttccccatttccttgtgccgtccattctccccctcccc

SEQ ID NO: 14573 - DNA, 1976 bp, Heterodera glycines
cgggtgagtgatcagtatctggctggttgtgggtgatcagaccgtaattcgttggtgtgctgatcataggtgacatcgtgttggtggacaagtacggcttcatcactgtggtggaccgactaaaagagctgatcaaagtgaacggattgcaagtgagcaaccactaatcagctgatcacctcacttttgcttctgcttatggtcgctccttctgagttggaggatttgcttctctcccaccccaaattgcaagactgtgccgtcattggcgtgccggacaaagtctccggcgaattgccacgggcatttgtcgtgccaaagaatggggcgaaagtgaacgaattggaaattcagcaatttgtcaaaggttgcggaattacaagctgatcaaaaagacgaacattagccaattcagaaagaatggcgtattataagcagctgaaaggcggtgttgaatttgtggcggaagtgccgaaaagcccagcggggaaaattctaaggagaattttgagagaaaaaatgacaaaaggaaacggacgacaaaaggccaaaatttgacctaattaaaccaattaaggacctaattaatacaatttgtcgtttcattttaataaaatggctgtttgccctttcattgtttgcttttgctttttttaacaacaattgccaattcgcttttttttctcccatttttcaaatttcgcccccccggcgaatttcacaaattcatttccgtcttctgtctccttatatatgcattgcgcaatgccactatttcctataatttatttgctttttcgtgctctccccccccccccccaatttccaattttaaggcattcattgcctttctttttcattgattttataaaattaaatcaatttgccatctttattttaaaggtgtatgcttatgacatttgattcaaatattctcttaaaatgcaatattcgatatataattgccctttaataattattttcattataagacactgatcactcattcgttttcattctgttcggtttcatttgatcactgatcagtcccatgcccttaagccttaaattctctttgcctgcgggcaatgcgcttcaaatgcaaaggcggccttttgctgctcacttttctcgtgggctttgccggcggcgatttggcccacaacccaatttataagccaggtaaaaaacgaaatgaacagcgaagagacaaacatttgctttttattcgcttccatttttgtttccgatttattttttcagataaaaatgacgcggttgtttttcatggacaaatttgggaggaaaacgaagtgaaagagtaccaaatggaggcggaagtgttggacgagcaacagccgataaaagaacctaaaataatttgggcgacggataaattgggcgacagacactttcggatgacttttaaattcgccggagggacgggcaaaaggcaaattgacaagctaaagttggaactgttcacaaggtaaagccaagggaaggcaaaagagtgccatggaaatttactgtttcagcagaacagtgacatcgttcagagaaaagaatggccgagttgaaaaggtgaaaaagaaaaagggagacactgaaaaatgagagtacggtaggagaagggacagacaaaccaaaggggtacggtggaggaggggaacggagagagagagagagagagatgggggaacaacggaaggatacggtaggaagatgagaaggggaccggcgggcgaccgaaatgggccaattccgtcacggccaattcagccccgtgtctatcatcattggggaggggggctaaaattgtaaaaaatcgaataattaaaaaataacttttcctctgctggaggtgacaaaaagccactttaggacatcaaacacactttccttctgcacaacgtcgactcgaacaaacatttcgcgttggatttggacagagaaaaagcgtggaccatttagga

SEQ ID NO: 14574 - DNA, 1012 bp, Heterodera glycines
  misc_feature (968)..(968): n is a, c, g, or t
atcaaaatgatgcacacgggaaaaggtgggaaaggcaaagaaaggcacaaaaggcattgtgggttcagaactgtcggattacgaagtgttgagcaatggaaatggctttttcgagatcgaagtgtacggtgagcacaaagggacggtggaaatacgatatgtgagcgtttggggaggaggcgaaggcgaagacggcactttagggaaaagacgcgcagcacaccgaaggctttctggaagagttagacactctgtacaaagcggcctttcccgaccatcccgaacatgaccatttccacgggttgagcacaaaagcggaccaggaaaggcaccgcaaaatactgcacttgcactacaaggactacggaccgtacatgttcgtttatgtgagttgggcgacggaatagcagggcaaaactgactaaaatggacaaacaatactgtacatacagtatgttgttttgtaccatctttccaacttcttcagcacatttacgggctcgtgctcaaactggactccaaacaaattccccaagtgattatggacacggaacggtgcgccgactgcccttaccttcagttggaatacgcaagtgaccaggagcacgacgttcacaaggcaaaagggagggaagggagatgaatgcggatcaactggtgagctttaagcgattcaaagccgaaattgaccacaatttggacacgggagagttccgcataaccattcggaatgggtacggattggacccggagaggaagaggcgcatggacaagaactacgggaagctgaacatcatcgtggtcagctccacccttgtgaacggaacaagactgttcagacaattctgatgggggctaattaaagggggtgggaggcaatggcaatttgggaatgccaatgattggaagaagccttgagccaaattttgacgaatcccttaaccgaaacacacccgggttttccgctnaattgtatcgttgttgctgttcgttgttttcaggcggtgaataa

SEQ ID NO: 14575 - DNA, 1411 bp, Heterodera glycines
gtgaagatttaaatctttaatccattaaaatcatcttttaccgttttttgcagtttgttccttagtttccaatgtcaccgatatggccaaatttgtcgtcaaaaatggcacaagcattaataaagttagaaaattgaatttgttcattttctattaaaattaatgctctttaataacttaattattattttttactttccacattacgattaaactgattttttttttttttttactacgcatactctatcattccaacaaatcttattaagaactgaaccaaactcgaaaattttgcataaatttgatgccgaaaatgagagtattctgcagatttttcgaaagtaaaatttaagcaattttttcagaaatttctaaaagaaattttccaggcttttgggttttttgcattttttaaaatattaattgggacggtatgcttagcaaaaaaaaaactcggttttattaatctatttgaatgtaaaaagcattgcttaatttattaaacaatatatataattataatgaaaaaaaatgatttctaatggcctaaataaatatattccccaaatagctaatacaactgacatttacgtagaagctaaatgccatttttgggatgggggaggggggtgggcatgccaatatttgccatgtctttcacagtggatatatgatattgattgattatccatatgattagcataagcatacgaaatagctaaatttattttaaaaaatggtttcataaaaatgtgaagtaaataaagttttgtctagaaattttgttaatttttaagtcttaaaatgggtcggtcggtctatgaaaattaaaaatttgaaaatgaggccgaaagcagaaggctaagctaaaacaaaagagttctattgaaaagcttattattagggggccctagcttagacacaataaattcaaattaaacttttatatttttaaatatgtttgaagttatatagacacaaaaaatgttttgtacataaaaattgcatctctatttaaagggaaaaattcttattttttcggaatcagacacttaagtggtaggccgaatttcggaataagtaaaattatgtagaaaacgcaattccggactacgcaaattttttggctccggaaattaatataactggaattgagcatcttgcgaatccgcgaatttatgctagtagaaggcggaatttccggacccgttttgtggatttcgaaaatttattataaggcgggttgcgctttccggaattttgtgatagtagaaggcggaatttccgggtccgtatatagaggaagaaattgtggcttccggaaatatatgatagtagaaggcggaatttccggacccgtattgatagatccctggaaatttatgctagtagaaggcgaaatttccgc

SEQ ID NO: 14576 - DNA, 1911 bp, Heterodera glycines
tgtcattttgaattaccgcaaaaggaattgctcattggctcgattgagcatcttttaaaaaaaacaagaaataatacaaaaacaaagaaaatataaaaaaataaatgttttgtggtttgtccaattaaatgtattataaaaaatatttttaaatatttaaattgttttatataaatatggaggcgcaaatgtggaggcgcaaatgagcactgagcactcaccaagtcggctaaccatataatacacatttttattagttcttaacgtttttcaaatccatacatcgcttatcaattatttttaaatttaaaatatttatatatatatatatatttctttttaaaaattaatccacaaatgccgccacctcatccggtgttggcccagaaatgattgcaggcatcccagcaccaggtggagatacatttcgctgatgcttcatatcaaattcattgtcagagtcggctggttcggtaggggcaaaagagtcatcaaactaaataaattaacaaaactaagagcgtatttaaaataaaaatatattcaattttgaatgataaatatagaaaatatgtaaacaaaaatttaagaaaaactacggaataaaaattttaaaaaattaatttttcgttaaaaaatatttaatgtctataatttaaaaaaataaaattccttgttttcttctttttttttttgttagttgtaggtttgacatttgtagcggggtgtaacgaattcagagattttttgggccggaatttcggatgccagaaatttcttagactccagaatttttattatacatattttgccattttactttcattgacttttaatcttttgccatatgtattttaaaatgaattaaatataaaaattcatgaaataatgatatgtattcgcaccgagtcggtcctctgcacaccgcgtccgcgtcgtttgcttccgctgctgcttgcgccgctgcgctgcgacaccgccacgctgatttcgctgctgaagctgttccgggcgccgccggtgctcgtcgcttgtgtgtcactgtcgcgctcgttgtcaccgcagttgctgcacaccggcgttggcatgccggtgccgttcacttcaattgtcagatggttctcacgcacgtcgcacccgcggaaccagcgcaaagggtccgcacactgacgtatctccgccgcagtcatttgcatgctcaacagggccatgttgcgcagaaagttttgtcccgggtccgctgcgaatagcagacgcgtgcgcttctccagctcgtcattcagcgcgtcgaatcctgttaattgacgaggccgttagacaacaggacggttgtgggcgggggatatgagaggtacgattaccccacatttggccccggacatttgcaccctgaacatttgcgcccagacatttggccccggacatttgcgcctatgtccaaaattgggttcaaacttaagttttctccatccctgatagcctaaacagcatcatatatcaattaatcaaacagaagaatgaatgctccataaacttaagatacatccccctcccccaagaccctccacattagaaatttttaagggaagatggtatttttgtgctgaaaattttcaatttttacttatttgtaccccctccaagacctccattaccaaaatttcaaaaaatgtcgataaatttctccaacaatgcacaaaattagcatttttgatgaagatttttaaacaagcgcgtcgccaaaaaagtgaaggaaaaaaagctcgtcgcccgggggcgatctccccctcccccaagccgaaatcctgggaccgtcctgatagataagtggggatgggttcaaaaaaatccgcaattccggcctctaaaagtttgccagattcaatctggcaatgccttcaaacttttggc

SEQ ID NO: 14577 - DNA, 3154 bp, Heterodera glycines
  misc_feature (3147)..(3148): n is a, c, g, or t
acaaagtgcttaaataaggacaaagcttacaaataagaacatttaaaatttgtaagatttgaaccctcaaaataaggacaaatcttacaaataaggacaaagggtaaccctggtttagtgtataaaaatccggtctctataatttattaaacccaatttaaaaataattatttgcaattaatatactgtgattcgggtttagccatgcgatttttgctaattatccctgctcaattatttcaggtacgcttcatttctgagctgaaaaagttgcaggagccgtcgctgatgaacagtgtgttagagaattttaccggtaattgtccaactacagtaatcacacagtgttttttaaggtcatgaaatgtttgcgaaattgagcgaattttctgtttacaaaaaagttcttgctgaaaatcaaatctttgttttacctctctttgaaatttacttaatatgacattgtttttatttttatttcaactaaaggtttttcaattttctgttgttctaaatttctcatttttaattaatattttctatattttataaatatttaatttaaattgttttaaaaaaatttttaattaaaaaaaaattcagttcttcaaattgtcactgataaacaaagcaacgacacattgatggtcatcgcgttcatgttcggaatacgagaggagtaagcttgtttaaaagtttgatttcaaaaaaatttacagtatcgttttagtcaactcaattacagtttccttacggtgtcactaaaacatgggtgggggaacgtattccagcttttttagcgcaagaatttcatgattttttctccagaaatttttttattgtaaaatatgtaaaattctcgggtctcaaaaattttaaaaattagaaatatttgcactttttaattaagtgctaacattcgcgacgacggtgaaggagacgatgaaatattcaccaacatttatcggataacagaatagggcttctcactgatcaccacattcactgaccagatcagactggacaaccaaaacaggagaaggaggagcaattgggctgctgttggtcagtaaattttttcgcctgtggtaataattgtgtcgagactgacgagattcgtcctccaaaaaacaactgactaaacaattaactactctgcttgctcatcgagattgtcgaacccaacacaaaattgggacacattgtcaaaatttacatgatattttttctttcgtgcctgtgtttttacattgaagaagaccggatagggtagatcagtagcagcatccttattttgggatttgcgactttaaagtcatttgcccaacatttggcggcacagattttgatccgccattttcggtttaattcgccgtttccatccaatttcaaatgtttccattaagccacccatatacatagaaacgatgttggcattaataaatgaaccggaacaatcccggtcaaaaattcttgatctgtgaaaccaagcgaggtggttacaagtcgaattagagccctcctccagaaaaaatatggatggcaataaaaatgtataaaaaaaacggctggactcgcctattccggtctttatgtataacccatatcctcatcctcctctacagctaattatgtgtatggaactccatcaattagtgctagtaattcaattcaattcattttgttctttgctccgggtgtgtacgcggggggttttgatgttgttcgaaatttattcaaatttctcgagccaaaaaattgttttttggccgattctcgagcatcattaacgaatttttgtgtggagatgcctctcccttttttatatgcatttgcctttttgtgttgtttcattattactattattattaattttattttttattctctcagttcaaaaatttcatgcattcgctctcagtccacttttttttcttctctttcttccaaaatgttgtgtaaaaagtgccattttttgtatcatcattttttttattaattattattactttttaattatttttattattttcaaatccatttcaacatttcgtgctgctcttttcattcatattttctttttttcatatgattattttctgcgaactctaatcctcaacaccattttaattttataaattaaataatttaaaaataaatttaaattaaatggaaattgcaaaaaattattattttttatttaaatcataaaaatattagtaactcctaatgagcaacaatatgaacaaacaggtgagaaaaatcaaattgggacaaaacaataagaatccctttgtggttgcggaattgggcgaattgctattgcaacgatcacctaaattttaaatattttactgatcaatttgttcaaaaacaaataacatatagaagagggttccatgcgtccaaactttgtttgtttgtttttttcgtttttgggctcttaaatttcagcataaaaatagaattctatttttattttagtgagggttgtttccattagtgagttttttaattcaattaatttggtacagtaatggattgacaatttttaagccagacaggtggcaaagcgggtcgtttccgtctgattgtgagccaattttttcgggtcaaacttttttccaaattggccaattttcacaaatttaaagctctcaattagagccattaaaaatgaaaactaaaaaaaaagttattaaaaagaacaattcaccaatataataatgccaaattttatggaccaaaaaatttggcttacaatcagaacagacggaaggaaggaactgattgacccacaccaccggcggcgggtggccccggttccacgaccctccggtaaagttacaataccaattattttcataccataacatgtgcacaactgcaagtccccggtgatcgcaatttcgagttgtcttggttggttgaagagcctctcgcgaggcaaatgtcggcatttgtccacctgtttttttttaaattttcctgacaagtttccatttccacataaacaacacctggtttagccggtagatttgggcggccgtttggttaaagccatgtcgcagaattcgatccccacagcctcgaatatacttaaagcccacaaaaatgcctttcaaaatttaaatttttacaagaccnntgcagg

SEQ ID NO: 14578 - DNA, 2118 bp, Heterodera glycines
  misc_feature (2058)..(2058): n is a, c, g, or t
atgcactcaacttcgaaattcaattggagaatgttcaaaaagatgccaagacgatggatatcttcgtcgacgatgtgcgcgaagcactcattgcatgggcagatttactgcgcaagctgcctgcattggaacgcgatccggcagaagcagaattcaacaaattctagaaaaaagagaatcaacgacaaagtcaacgaagcagcactgaaactgtgcgacctaatcggcacaaaacattagagcatccatttccaccggattacggtagccccccatatctatgggaggggtgcaggccaactgagcgccagccatttgagcgccgccaagtgagcgcgggccttttcagtacagaaaccaaaacctattgcatgttttttttgcgaccccgtacctattacaggggtcgcgacttttaagtaaaagaaaatccgaatttttaaagaaaaaccgaaaaatattattataaatacaagtgcttactaaataatgaacatcttgcgaatggacaataaattaaaaggaactttgcataactatcaaaaataaagacgctgtaattaaattggcaatattcttcctatttggtcgaatgcatccattaaaagacggaaattgatgaaccacagagatattaactttgacaaataattttataagatcaataactattaaaaaggcaataaaaataaagataaaagtcattagaacaaaaattgaaacgggaaaaaagcaacaaaagaaaaggaatggacaaatttaaaaaatacacaatgtttatttttgaccccaaatgctgattttattattgtccaattgctgattttgaaattttgcagttcaaaaacaagtgtataagtttcaaatttaatttgtacctaatcgataaatattaaaaacgttgttttccttgctgaaaactttctgaatttggaataaatccacgagagctcaatttgtcaactcccaaccccgaaaattgttatatgtgcaaaaagaatttttgttaaatagtttgaattttcgaacttaaacatcaaatgatagttcggtattttaactaaatttttattaaacattttgaagttatattagggaggaagtgtttaaataatgacatttattttagtgccgtaatcgtgtgcatatatttatatatatcatttcttctatattttttgtaaagtgatacgaatagttatagaattgaattattaaatttttttacatttacttacagtgatggtatgtacttattcaaatttcttcattaggttttatttccaagaatatttaattcattcatttcttttccttaataactcaaaactaaggcttttttgttttgtggtataaattaaattaaatcgaatattaaattaaaattttttaaatattttctcagttttattcaactttttttcttgttcatgtgaaaatattgagatataaattgtgtgattaattttctttaatattttatccgtcaaaaataaataattgtatctcttcataaacttttatttaatgttgctattgtatttctttaggttatcattattttattcttgaaatttttcaaatttcttcttaatttagtgttctctcaatacattctttgccctttaatttcagtggtgataggattttatttgttcaaaaaataaatttgtccctagtatcatggaaattctgacgaactaatcagccctgttttcaaattaatggtaccaattttacgaatttgtttaaattgctattaaactaattcaatgctgatattttatacggtttaaattttattataattttcaacaatatttaactaggtaatattgagtgagcggaaagtctttacatagttgtcaaatgagaatatcttcgacatttaattattttttttttttgcttctattttgagttcagcggtaccgataaatttcactttaaccgttaccggtactataaaaacgttaattttcttaggtctatttttgtacaattgagcacctttttaacataattttaaaggcacgcttcttttttttaaacttcttnggaggagcgaactccggcgcgtgatgcgacatttacggcgcccagtcaaagcgacttttg

SEQ ID NO: 14579 - DNA, 1848 bp, Heterodera glycines
gcataagccatgagaaatttcacgcattaattatgtctcacgtgataaaatgttggcgccgcaaaagtcggcgccgaacttgtcgattttttaaatttgctttatttagattaagtgtttaaaatttacttacctgtaaatattttcaacttgatcttcgtccctggatgatttgttgttgttcaaattaaatttaaaaacacaaatacataggagaatttgaaaatttaaaatacttgtaataagaaattttgttagcgtattaatgataaaattgatctataaaaaaattttcattatagcagagaaaagaattatttattatttaagtttaaaatttattattacgattttgttgttagattaatatatttaaggggaatttactatgataaatttataatttatttgatttttaatgtaattttaatacagaaaattatttaataaacagatcaataaattcaaaattttaaattacctttttcaaaatttataatataagttaattttcatgaaaatttgttagtttgtattgaaatgcatttatgttatatttaaacccaaaaatttacgaggacaaccagaaaaaaaagtcagaagaagaacgaggaattttatttagtgaaattttattatttaaaaaataaattaaataaagaattaacagaaataaacaataaattgattagaaaacaaaaataaacaattcacaaaaaaacgtttttgtaatgcagtaattttccaattatttcttttaaatattatttaattgtatttttattaaatagaggaaaaaataaaaatatcaattaaatccttattaattatgctataatatataattttaattaagatttactaaaccaaagaaaataataaaatattgaaggattaaaatattttattttatttgataagatgtcaaaacgaaattccataattgatagatcatgaaataatcacataagtgaaaatatgaagaataaagaaatattattaaacaattttgtgactgaaatataaattgaaaagcaaaaaaaaaaaaacttaaaatgcattgatataaattgatatatttttttatctgttgttaaaattatttttacaagagcaataaaatatataataatattaaatttattttaaaatgttctattacttaattatattttgaaattaattttgattcaaaaattattaaatttaaattaaaaaataaacacatttcaatatttacttgcatataattcatttaaaaagtttaatttacacaaaattatttaagtaataaatgcatctgttaaataatttaaattctaatgaaattatgaacaatctttttctaaaatttgtacctaattttatttatccatttatttattatttcagaaattagaaagcaacaacaattgaaattttactgaattttgaaagttctcattttttctttttcgataattaatttttataatttaaaaatttttatgcatgcaatatttaatgatattttagtataatttcaatgatatatttaaggcctttatgattgttttatcttcctatttaaagagataaagcaccttaggataacagaatttagcagaaatattttcctttatttttttctgtttttcatcctttagttttttctacaaaatatacaattaataattatgaatataaaattttctatattctttaattaggatttttgtctttaaattaataaacttattaaatattttaattgaattatttaaataaggcttataaattatttagaaattaatgttctagtcctttaacgacaaattttgttttttctgaatattatgagattgcatt

SEQ ID NO: 14580 - DNA, 3106 bp, Heterodera glycines
  misc_feature (2955)..(2955): n is a, c, g, or t
  misc_feature (3020)..(3020): n is a, c, g, or t
  misc_feature (3074)..(3074): n is a, c, g, or t
  misc_feature (3084)..(3084): n is a, c, g, or t
aaaaggaggaagaggggagacgacgagagggaggagcgagtgggggaagcacaacaaaacacagccaacgccaattctacacacttaaaaatttattcattcattcattattgaagcaccagccagccagcccttttatgggcaaatgatgatgaacttggcacaataatacacccaattggcaattaagttaggccatttcaagtgagcaaaagtgaagttggcgactgacttggccattttatcaagtgaccaaaagtgaagtcatggccaaatgccaagagcggtgatttaatgggggcaaaaaaaatggagaccatttttgttcgataaatttattcgattttgacaaaaaaaaagggtaaaccgtaaaggataggatatttttcaagaatttacacatttctagagtttttaacaaaaataatttgaaggaatttttaaacaatcggcagatgtcatagaaaaagctctctcttccaagttgaacgcattttatgtatgctgattagccaaaggagaccagaacaattcacatgaattttcaaatggatcaaagccacttgtcctgcagctaattaacgactctgccgaccaccaattagcctcacaaattaacacttacagcagacccctgctgccctcccttttccccattttttaatcaacagagcagcaccagcagacgcgcagaacgcaccggggcgaataaatagagcacccattcggaaccgaccagcagcaaacacagcatgactcaactaccaccgtggtgagtcgaagtgtcaaaagtatcgatgtgggcgaagtgtcaaaagtatcgatgatgggtgatcgaaagaggcgggtcatttcagtacagaaaattaatttaaataattaaattaaattcatttataattgaataacaatcttttaataataaatatatttgtctctattttagtatacacgacccttcaaaaaaacgagaccatcaaataatttgacaaatttaatgcaatccaacttttttacaagcatctaaattaagcatacatggtatcatttgatagccctaagtgtcctctattttcctgtaaaatttcaaacgatttggttgagcttcaaagaagttgtagccaaaaatatttaaggaattttaagcgcagcttgggtcgtttatttaaggatgaaatcacagcctaatttaagaataattttagttttttttttaataattaaagtgccaaaactttccggtgcccaatctttccactgtgaatccttaaatgtcgcccattgtcttgcaccagtttttttgtaaatatttttggtcccactgatttaaatttatataatttagagcacatttaattctctataacgaacctaattattaacttttaatggagcatggatatttcggcacgttgttcttaataccaatataatgcctgtttttagttaaactcatgaaatcaaattacattaaaggattttatacatggattataattttatataaattaataaagccttcattttttgctgacgtaagttgcttttgccacttttgcaaatgtcacatgatgttccatgcaaaattggcagttctttctttttacaaatatcattttgaaaataaaattattatttttattatttttctttaaaaatgattcaaaatgcttttattttttcttttatttgctttttcaacaaaatattttttgccgaaaatgtcaaaccggccatcaatctgatcaaatattcggctatcatttctccgccgggtttttataaaattgcaatttgggacagatttgaaaagaaaaaagcacaacaatgcaaaaatctttttgaagaagttgaacaagaagtaagaaattaaaagcatttttataaatattcaattttggctaactttgccctgaaactttgagagtgatttttcattatgccaatattctgccaattcgggaatagtaattcataaattaaatattaaatattttaaatgaaaaattctttcagtaattttcaaagtttcaatttcaaaaaacgattattttcaaaatattttctttttttcatgggccaattgtccgaattttgaaattttgtgctttttctcccaatttaattgtctaaatttttacttttaatagttcaatggtaaatttcatgctgttcgtcgcttcaagtattatgatggcattgaattagaatattttgctgaatgttttgaaaactttttcattgctcagaccaatgaagacggtgaatttgatgtgaatttaaggggtaacattggagaaacaatctttttccaaatatttccactctataataataaggtaattaattagaaaatattaaatgtaattaaaatatgacattgatactaatattcaaaacatatttatagctaaacgaagtgaaatttgcatattttgttaatttctttaaattaaattttcattaattccttcttcaggctccaatccgttccgattctttcccctccacttttctccaaagcatacacagaaaacccgattggaggttatgtgtgcattttgagcaacatttttattttctaattcataaggaaaaaaagactaaaatcggcacaatgttggacaattggcagagaagtgccaatgccaacccatcggatgaagaagcctttttcctcaaggcatgtttacaggaaatagcgtcaagaattgttgacacattcaccaagggcatcaagctgaccaataatgaaatcagcatccagcgcaaatattggagtgcatttcaacagatgaaagggcatggaattttggccggaaaattggcacaaattgatggaatgccaaagttaatgaaagatttatgcagatttacggttgctgattatgaggcgaactccgccgatggattcgaatttaatgacaaattatttgccttggctttcttttgtgncgaattataaaaaatggcaatgaaaacatgagagcatattggagagaaatgagcttgtgaagttngaaaaaagtggagaggaaaatgaacaaatgtagacttatttattgtatcacttnttattttttngtggaatgggattaattagttt

SEQ ID NO: 14581 - DNA, 1338 bp, Heterodera glycines
gaaaaagcgtgaagcgtatatgaaatatgcccaagatggtgtgccgctgaaagattttgccggattttggacgcttggcatggacatagtgccatgggatgaagatattttgcgactgttcatcattcgtgattgcaaatgcaccatggaagcatgggtaggcaaaaaagccgaataatttgtagaagcattcgtgtcgtatcactcataagtcaaccaaattaggtgttgttaataagcatatccaccaaagatccggcaatatttgctaacggaaaaccaaaatatattcaaaaagttttgcccaaaattttcatatttcttagttctagagtgctgctggtgatgccaaagcattgatggcaaaattatttttttgtttttcaaaaaattaaatgtaatttaattaatttgagtattatgtatacttcatgaaaaaaatataattttttgattatttgtacaaaaagtttatccgaccgtcggattctgagcccgaagagcccgaaataccgacgcaagggccttacggttgccatgaggaaaaggaaaaacaaaaagccatcgatctgcgcgacaaaattaaagctgagaaaatgatatacatacgccttttgaccagcgcaagaactgaacacatcagattaacactgcttggaaatgacgcgggtaaatgaaaattggcacttttgtggaactttttttaaaatcagagggcgtttcttacataaagaaatcgcgaattttttaattataaaattttgaaattatatatgtataaatataacgaatactctattccctcaaacaaattcaagaatataaaatttgttataaaagatttttatcggaaatttacgcccgggagtctgaggggccagggggaatgatttttttaaatacgtcacttttatttggagcaccgataaaaatgtaaactggaaacttttcttatcaagggatgtcgctttaagaaggtcttaactgaattcgtggtgttattgggggtccatgatcaccgatctgaaatttcggaaccttcttgatcacggattccagaccctaaatacactgggggtggaatattattgttaatttttaaaaatgctgatttttcttttatataaaaagattttcaaaataaatttgtttttgtgtcttgtgaaataattttttatctttataattgtaacttacctaacaaataagctatttttgttattttatttttttgaaaattatgagtttttcaacaccccgtttcttcaagataaatttgggccgctgatgaaattcagttatgttcgcaaggaaagcaatacgccatgaatcagaagt

SEQ ID NO: 14582 - DNA, 1275 bp, Heterodera glycines
agttgtttgccgttgttgcgacggcccagcaaaaggactggttgcacttgcgttgcttcacagaaaaggacaaccgcatgttgggcaagttcggcagagaaaaattgctgctccgcaaacctaagacaaaaataattaatgattgtcggttactaatggattcgagttttttaaactgacttaagttttcagagtcgcgctacttcgaccatttacaattttagagaaataaaaaaatctaaatattgcacacactgataagccactcccctgtggagtgcctttgcctttattactcattgataaggccgtgtgcttctgacggtgggatcaagtggaagtcaatggccgaagtgccgccaacttcaatgagttcatggccagaatcgaagcgtgatttgttcgctgcagccaccgcgtccaacttttcgatggacaaaaatgtcactttgagcgggtcaccaacgagcgtgcaatcggacggcaaattctccttgttttcatcgcacaattcgtcgtcctccactttggctgtcattgccatggcacgaaagcgttcgtacgctttggcagccgtcgcttcatatccctaagatgggaaaattatacaaattcaattgaagcgtgatcacggtggaatttaaacgggatttggagagggggagggggctaaaaaactcggtcggtaaaacggtgtctttgcgtcccggtactcccaccccggccacatttccaactctcggtcacatttttcccaaaattcatgaaggcaaaagtatttccatgattgctgttgttgttattgcattttatgtgcctatttgagttttgtgagtccaatgaaaattttgtttcccggggtgggggtccccctgaatgaccaccaccaatcattgggaagtctcataaaaatgaaagcaatgtgtagggtaacacatccaacaaacttcagcctccggcaaatcaatgacgatcactttgccacgcaatgtaatgttcataacaaagcgggaccaattccgaatcaatcagccgaactctgtagcgacccttctaaaataccaatgttttagtgaaaaccttttgaaaagcattttataccaaaagcgtaacatcatcagcattagtcaattgtgcaatatttatcattttattgtttctgaaaaagaaaaatgaagcaagaaaacaattagagaatctgtctctgttacaataatttacgcgttcaatcaatgacttttgtctgtctttgacccagaattaatggtactagtt

SEQ ID NO: 14583 - DNA, 1127 bp, Heterodera glycines
atcatcgcacgacgcttcacctggtcaatcatgcgctgcaccaatcccaatccttcctgttcagttaggtctaaaaatcaaataaaataacgccatcaatataaatttaaaaaataaacctgtacggtagaaactgtccatgatggagtaagcaaatgcaccaggaaagccgtagaagatgaaattctaaaaatgtgaaattttctaccacaaaaaactccgtagtttgaaaggggtttctacttggggaggaatatttgtcgcaagataatcaatcatggtgagatacgctttcttgtccgttgaatcaaagccgccgatgattgcattgacgcgccacatgtcctccgagcgcaaattgtctgccatgttttttcgcagccaatggtgcacctccttgggccgtaattcataacctatgtgatcaatcagaagttattaaagccgatgaatggaaggttctagtcggttttatgcgtcacatgacagattatgcgtcccatgaatgaccatacccagtttcttaggcataacttttttcttacttggtcaatacctatattcttggtattaaacaaaagcttaaggtctatagaagcttttgtataactttatttttagctaaatgcaatagacaaaaaaattatgctcggaaaagctgaatttcgtttttttcattgtaatttcttttttaatgccagtatttgctcttttcttgcatttataaaatctcgagacttttgtctttcgcttggtatatgacatgggacgcataaaaccgactagaaccaatttttttttcatttctacgtagtatcaggggggcttttcgggccgactcgttgtcactattttttgatgcaataaaaaccctagaaatcctgcgaaaggctttttgtccaaaaaattggatgaaacaaaaaaatgtacaccatttcgacgactgtacagctcgcagtttgcctttgcccagtttgcgaacgagtccacgtcaccggcctcgccaaagcacaccatggaagtcaaagggcccaacttgtactctttttggtgtgcttaacaagtggagaaatagaaatcaataaacaaaacaatttctttaatcaacccatgggttattattattg

SEQ ID NO: 14584 - DNA, 904 bp, Heterodera glycines
ttttgatgtgcagtccgttcggcaatgcaccattggtgcccaaatcctgcaagttttgcagaccacccatgcactggtaatctcacgcatccgatcagcacgataattgaaaaagaccaatgtgtcattgtctgaaattgtaaattgtgattgaaaatgaatgactaacaataagcatctttagagccggtacagcaaaaaggctgagcacaaaaaaaaatttttttttcggcgttttgcttttttgggtggagggagcaatatttattttctaaaaaattggtatacccttttgggtttatttatttatttcctatttatttttgaaaatagtacaattacatattttcatggtcgttgatcatgaatatgttcgttttttcaaacaaataattctccatattattttttgcttgaaaaaaatctaccccccccccaaaattccaaatggataaaaacagcaatttttcatacctttcacacgcgcttcgtccgaaaacacgatgggcgtcaggaattcgtcagtctgttggtttgcgtagcgctcgttcaccaattgtacagcattcgccggttcgcacttttcgccctctccggcaaccaatgcctcgtaggcaaccttaaggaaaaatgcaagtccaaaaacgatgtttttttcgaaaatgagtgccttaattcgctcccatcggttgtcacggtccatggcataataacgaccaacaatggttgccaattcgccatagttttcggcacttaagaagtcaagcagttgttgcaagaagccggctaaaaatgcgggagtataaataaaaacagatttgtaaaatgagtttatttaacctccactggttggcgatgtatcacggccgtcgccaaaaaagtggacaaaaacttggagcacttt

SEQ ID NO: 14585 - DNA, 3200 bp, Heterodera glycines
tattattttcaaatatgggacccgaccccaaaacctgctgctgggaaaacacaaattgcggattggcctttgaaataagttgcaagagtcggtaacaagaagaatccgctaagctgttgttgaaccataaacaacacaaagttgccgatagcgcattagtgagcaacgacataaaattggtggaagactgatcagtggaagaaccatcggccttaaaaacaataatctgttaaaaatagcccacaaaacataactgtctcttccgaatgattgcaaacaaaaaatttgacaaattgttcacaagaagccaaacattgaatgatagcactgaagtaacaagtgtttccgtggttgatcagtccttaattcacacattcattttctttctcgtcaaatacgctcacctttaagacaaggaacttgtgaactccgagaatgttgtttcagcattaactccccatcattagcagcggatttttctctgaatgaatgctgtgcatcactcgtcgttggccgtggttgtaagggctttaacgaattatgcattggtcgagaaaaaggcgaaggcgttggaggaagcgtcgacgtggaaaatttcgtcgacgttgagccaatcttggtaggaaattgatacattgatgcagacggaagccttggacgtatgtcggaagtcgaaatatccgagaaacgttgcatcagttcagcgaactgtggtggttcatccgactcgcaatcagtacttgtcaccccgtttttgcgcctgtcgtgattaaattgagaagacggcatgttatttgtggctggtattggtgcataatcagttgtccctccatttcggtaactgaacgactgacgccgtgggaaagcggacgaaatgattgaattagaacgacgacgctcataaggatctgacgatgaagacgaggaagggagtccaccattaacctaaaggcaataaaaggcacttcaaacgcaacgcaaatttcacagcagaaactgcacttaacaaaacgaacatttagcgttgaggaaaagcgtttgctgtcaatcggctcgacggaataatcccttttatgtgtgggattagagaagccaagatgcttcttaaagaaagaacgtaatatttttaaggccgatgtcttgttctttctcgcctcgtcagcattaatctgtaccggaataactcggcctccgttctgttgctggtaatcaaaaaaaccttctagaaaaaaacaaaaatggaatggttatcttttgaatgatattttaatagtaatggatcgaccttttaaccgttgtccataagtcgatttggtgtcgtacccatcaatttttccagaatatgacgaggaataatttcttggtggcactgatggagatctcccagatgttcttctctaaattaattttaaattttataacaaaaatattttcccactctgttctccaaaaatttgttagacaacgaaggctggacagaatttgagtccgagtaacaattaacagagtttgcggtgccattagatccattaatcctcgtcgataatggtggtgaaaaatgtgtattcgtcctgggatttttattatcatcagagtcgttttttggaaatttctcaagagtatatgcaagaggtcgacgatatggcgaaggaagacgttgctttctcaagaatttgtcgacttcattggattgaataagataaggacgaacactgcgacttcttggctccatgatggcacctcattcaaatagcaccagcagaaaatcataaaacaaacattcacagaaaaacactgaaataaaattaaacatttttcatgtttattattacgataagaaaagggactataaaaaacgcaaaggaatctccaaaaatgcgggggaggaaacggagacaaagaaagaatattgattgattatggaggaaggactaaagagattagagtgtggaaagtgattgatgtgatgcgactgatgagcaaaactatttccaagcacgaatacacatagagatgggaaagatggaaagcatggcagaaaaatgagtgaaggagagggggataaaaataaattcaccaattgcagttgaaaacttgggtaatcaacggacaaacagccaaataatttggaaaatatgatttgaaaatctggccatatgcattttttttttttggttccccaggtggaatttagaattttaaaagcttaatatgcattatgtacatattttttgggtcaaaagtagagttgagcgggaccgggacatggacacggacaactaagtacaactgagtaccaaggtcccggttttgaccagttttgaccgggaccgggaaattcccggcttttttcccggttttcccagccaaaaagtcccggttttcctcccaaaaagtcccggtcccggtcttgcccaaatttcccggtcccgctcaactctagtcaaaaggtcgggatgtaaaaatctctgtttcgagaccaagactatcgagctgcagaagtggaccgatcttgtcgagtcttgctgtgtttctttagattgtaaaccaaaaaatggccccatggcacgccctgttagagaaatatgagcgcgcattggccacaatggaatccgaggaacgcgaactgagccgaattaagcaggcaaatggaggggggaagtaaagcttacaataatgaaagcattcacaggtctgaggcctatgtgagcccaatatggcatactcaaacacaaaaatttatccctaaaaaaaagttttggccaaatgaccccggagcatttaattgtaatgaaattggatttaaagttgcagataattgagaagaaaattgagatgcaccaaaagaagttgaagaagctgatgctgaaggtggtcggaaacgcaacttttgtgagcaaaaagcgcaattagcgtaattaattgctaacttatgcattccttttgagcaggagtgcaaattccgttgaaagtggtggatgataatgaaggaagcggactcatcttaatcatttaatttatttatttcatttttattatattttcttcattttgtttttcaatgattgcaaaaatgacaaaaaataataatccatttttctgaaaatacactgtcaggccatagaaaagtttggttttaaatatcatccatccatcataagatagaagaagtgctacattaaaactttttaaaaccaaat

SEQ ID NO: 14586 - DNA, 3581 bp, Heterodera glycines
agaaaaaagttattccagaagttctggaaattctcgatttttcagaaaaaaatttgtagctgccttctgaaaaactattcgggaaaagtaaaatactacaaaaatccgcaatttttttctctataatataaattttattttacatttttatcacatttttaaaaaaagatataaaaataaaactgattttgtgattcggggccgaagggggtggacaggatttttgagtggaaaattttttttcacaaaattcttccaaaaatatgtctttaggggttatttgggccgctgatcacgaatacgtaatcagattttacttttgacatcgttaagacctcagaatccctgtgtgattggggattctgaggcatcattttgaggggggggcaggttcgaatccggacggtgtaacattatttttttgtgcatttttacgttattttcaatgattttaattaatttaaaatattttgttgagttaataaataaaaaattatatttaatttaatttttttttgataaataaattttataagtttaaatttcacagttgtacctctttgatcactgttgtacctcttttaatcacagttgtacctcttctgatctctgttgtacctcttctaatcacttttgtacctcttttaatcacagttgtacctcttcatcacatttgtacctcttcaatctctgttgcacctcttctaatcactgttgtacctcttttatcacttttgtacctcttcatcacatttgtacctcttctattcactgttgcacctcttctaatcacttttctatcactttttcactgttgtacctcttctattcactgttgtacctcttcaaatcactgttgtgtctttcccttccgtggttgcacttgtacctcttctcatctctgttgtacctcttctcatctctgttgtacctcttctaatcacttttgtatctgttctaaaatttaaaaaacggcgcgaagcggccgttcgaggccgcaaattggcctaaaaaggccacaaaaagggtgcgaatcgcccgtctgagtccatcaaaatttaataacgggcgcgaagcgcccgtccgactcaacacaatttaaaaaacggccgcgaagcggccgaaaagcacaacaaaaattagaaacgggcgcgaagcgcccgtctgaggccgcgaagcagcctaaaaatcaccgaatttaaaaaacgggtgcgtagcgcccgtctgaggccgcgaagcggcctaaaaatcgctgataattttttaaaaattccaaatcttttcacaacccgatagctaatctaggagcgaagctcaagaagcgcgaagcgctttatcccagctaaatagccgacggttcacgcacccgctagtttttcccttatagagtgaaccaggggcccagtgaaagcgccggggccgctttcaacaccggggccagcatacatataaagcattcctaatggtggtgattttcccgaattcgcaaaaaaaaattcacttagattctaagcctgtacgaaaatgccaagcaccgatcttgagtccggcattatagatcttgccaatttgcacgtaggtgatctctacacatataaacaatatttcctagcgtgttagttttcaaaaattcgctcaaaaacctccctgaatccctgcatagcccactgagccggattcagaaaaacagggcagaaaacatgcacatttttaataagcctgatatccctttttcgactacttcccgaacccggaccctaatctatcctatatcattttaaagagcagagtctgtagatgtgcagaataccatttgtttttcgattcgatcaattctaacgcacactcaagccctagatttcccttataaggagaacaccacactttacatccctgccacccctcccggccctcggaccaattcgcaccggttgtgatcctgcaaaaatcgttaagaaaatactgaaaattgtttttatttttatataaagttttacgcgctttttaatttgaccattttttcaaataggtaaataatttaaaccattttttcaaataatctttttttctatttaaattacaaatgtaattaaatcgattcattatctaataccaatatgatgtttcttacgtcatattatattaataaaaaatttgtatgaataatataatttatgaaaaatgaaaaatgattattttagtattatacaaaacgcgaattataggattacaatttttcttgataatttgcattaaatcattttcataaatttatttcccattaattttttttatagaaaaatgaaaacgaaaattttctatatttttttgtcattgcttttgctattctctctgatacaacgaaatgagtcgacaaacccaaagcatttgaaatttgttggaagaaatgggaaatcagtcgaaaatgggcatgaacagaaagaacaaagtcaaaaaattggtaattaattatgggtaattagcgggtggaaggaattcaaattttattaaaaacccacaagaaaaatgaataaatttaataaaaaaaatttataaaaagttaaaacattgttcctatatttgtgttcaaaaaagaaaagattattttattattcaccggagttcactcaaagtttaataatcgttttaaattttaaattatgcaaaaaagaaaatttaaaaaccaattattttaatgccttttcagaggatccatcaaattctgatgacgccatcgttgatgctaatgagcaagttgaggcgaataatgaagaaatgaaaaagaacagaaaaggaaaggtagcgaaatttgtttaaaatatttacattttaaattttaatttaggcaattattgaaatgataatgtcgcctaaattttcgaaaattgttggaagaaaaggaaaacctatcgaaccaccacaaacaaaagatgttgatgaacaaagagttaaaaagggtaaaatatttaagtataaataatttttgatattaaatccataattatcacaaataaaattgcatttttaccaggaacgaaaataaaaataaaaacaataatttttagaaagaattaaacaaaatgttgcttcatctcctaagagattagaaaaaagtcatgaagaaagcggcgacaaaaaggagaacagagtaaataaggctcgaagaaaaaattaaaattttaaaatttaggcaattcataaagaaattatttcacctaaaattttgaatgttttaaaattgaaagggaaatcaaaacattcacaggagcagcagacagatcaaaatcagaagaaaagtaattgaattaatattattatgagaaaaaggcatagtttctgatctatttagttagcgatgatataattaataataataacttaattatagtatatttattaataaatagacactaaaatatttcagaaggaattgttgaacaaaatgatattgccgaattattttatttaaaaaggaattgttgaacaaaatgatattgccgaagcgttgaaaagtccaaaaaaccaaagtgaatttttgagagcacctgataatcattccgacaaaagtcatcttatgagaa

SEQ ID NO: 14587 - DNA, 3186 bp, Heterodera glycines
aattattttttgcaatgcataaatatggcttatttttaaaatttgcatttcttaaaatttttttagggcgtgtcattcatcgaatggcccaccgaagcgctggcccaaaaagaagtggggacagacagaattaagtttattatttccattggaatattttatgtttaagatcaatgatctgtacccattaacacgggatacaaaggtaattgttttaatattaattgtattttatgattattagggatggaaaaaatgcttataaattttatgaggtttgaaaaagctggtttcttatatttacgttttaaaaacacacgaatatttgtttgtaaaaaaaactttaaaaaaatctgctttcaaacttcttgaaatttgtgcatataatggaatttccaaatgatcagattatgcttggcccaatgtggcctgattaccattgtggctttcctgatttcttggaccctttgccgaacaccacagattggtgggtggacgaatttgtgcgtttccacaatgaagtaagttttttaattaactaattaaatgttttttaattttacatttttatcattttattccaacattatttaacattcattaaattttctgaaaaataaattaaggtacaatttgatggaatttggattgatatgaacgaaccgtaaggaaatcaaattaaaatgaagaattcaaaaataaatttgttttaattgaaaaaagtacataaatttattacatagaaattttttaaattttgcatatttttcaagctccgtctttggcacaaatgagaaacatccatggtactttgacacgcaacctgcatttgccggcaagccaccaattgcgccgctgatgtgccaagagccgaacaacaaattggactacccaccgtatcgcacatggaatgcatacaaatgggactcgaagaatacggtaagtagagaatttgcctgacttgaaccaaaatatgatccacctttgggttgcctcaaaaattttggtcctttgatggagatttttcttgattttttttgagtctaactcaattaatttgtttttcttatctcatagcaaaaatttagtttggacactcaaaagatggcaatattttattttattttttaatctcgttagtgagctctaatggtgtaatttagaaaatgcaaaattttatttcattattaattttatttatttatacaatttgcttttatgaattttttaaggatttttaatttaacttggcatattttgtattcaccctaaaataatgtcaataagttttagattagaagctttttttaaaaaaactcaatgttgttaataaattttttagaagagaacgctgaacgaaaaaacattatgcatgattggaaaaagtgggcgccgcaactggacaatgtacgatacggtaaatgatcaaattaataattaatattttaatttttaattatttcttaattggtccagcattctctctacggctggtcagaaatggtcgccacacaaaaagcgttgcgcgtctcaactggcaaacgcggctcactcacttctcgttcaacatttccagtatgcactggaaaataattaaacacattaatataggatatattttgcagatatgtctttttgctaatttcctatttgtaaaacgcacgaaaaacaatttttttaaatttcaaatgctagcttttttgttcttgcattttgaaattttggtcactaatgcccggtctggattttctgaaagtttcttaatataacgtataaaatgaaaatacccctaaaaattttgcaaaaaatactctcttaaaagtgaccttgaaaaaaatatatatttttttaaacacacccgttaaaaactggaaatttttcacaaaaattcacctcctaaattttttctctcaatttagaattttatgaaattgatttaatttcttccgtagttttttttatcatcattgccattttcagaaaatatttgaattaacaaacagcaaatattttaatttctaagttcaaagctagcgcaaattttaacaaagatttttgaaaatatattacaaatttctatattataaatatgcttttaaattaacaataaagataaattaattcctcaattttcagtcatctggccattacggtggccattggcttggtgacaaccaatcccgatggcctgatctccggctgtcaataatcggggtcatggagttcaacatgtttggcatcccacaagttggcgccgatgtttgcgggttcatcggagactcaaatgaagtgagaaaaataggataaagcttatgttatatatattttttaatgattttaattaaacaaatttttattaaggaactttgtcttcgatggcaacagcttggagctttccattcttattaccggtcgaaataattaaatttaacaataataataatttaaataatctattttattgttcccattttagcaatcacaatgatgttaattcaaaagttagccaagatccggcacagtggaaatccgtggcaacagcaacacgcggttatttgaaaatggggttgctccccgtccttcagggagagaaaattcggggatcggggaggacattccccgtcaaaaaatgccgggtatggcttgagaatttcaaaaataccggagagcaacgctttttcgggaaggaaattttcataaaaaaatacgaattttatcgacgacattcgcaatcctccgaatcgggtcggggagcattcctaatttggggaaataatgtttaacatttaattcttttaataattgtttagttgcgaacttattccgatatcgtcatcttccttatttgtataggtaaaaaaagaaaaatatatataaaaatattttataaaatatttttaaaataaatactaaaaaggtaaaatctaggaatacaactaactaaaaatattaatacagtatctcgtcatatatctgccatatttgaatgggaatttataaggttgatgatattcataaatccgcgctctcataatgtgtcagcctagaaatacgggccctcccatgccggaggaggttcgttgattctagttctttttcagcagctcgtccattaatattttgaattttttaattaaggagccgttcgccaccgtcggtgaccgactttggaagaggcaaaggccg

SEQ ID NO: 14588 - DNA, 1101 bp, Heterodera glycines
ctctaaattttgctctaaggcaatttttcgctagaaccatacccctgacgagttatgggcccgggactcaaatgtcccgctgaggccaaaatttttttctttccgggaaaaaatcgaaatttttctaaaaataccaccaatcgatagagctcaaaaaacgatgttttggaagtggtctccgttttcccgggaaaaatcgttaaaaaatcttaaaattcaaaaaccaaaaaatcgttttttaggcctagctcgaaaatttttgaaaattttcgaaattttaaaatttctaaaaatcgagctcattgagctctacaataagtctgctggccacccccctcttagagcaaacccctacgagctattcgcctggtactgaagtgtccaaatcaggtgttcctcacgttgcctaacctacaggtcaggcctttgatctgatcaaaaaatttttgctggcaaagttgtaggccacagttggggcatttcgcttttggagttcactaagccataaatgcaaaatgaaaaattttcgtaacagtgagactgttagcaaagacattttcagcgtcgctgggactcagttgtccctcggagaaaaaaacctatagttttcccgaattctcctcaaaaagttgtaagacccttccaccactttcagaccccggccggccttcggccggccggaattagtttttgaaacgaaactcaaaacctatataacatatatataaacaaaggaaaaaatgataataaaaattttttagtgtgaaatgccatacagccaccaaaaccagcacaattctaaatgcaaatggaagtgtcacaactgccagcgtgttggatcggacttcaggggaaattgcattgactccaacgataattttttcgagacctgcctgggatgttcaaaagtaaagcaatgaatccgttgtatttttaaatgaattattttagacattcaaatgccgaaagtgctacgaacaccactgtaaactgtcacaatgtaaaatcaagcgcgggactgaagtgacaaccatcgaaaaatcgatctgcaagagtttgaaaaagtgtgtcgactgcggaataatctaccaaactcgggta

SEQ ID NO: 14589 - DNA, 1577 bp, Heterodera glycines
ggctgacgagaccttcgcatgggcacgttcgagttctacacccccgaagtggagccgcctacgtgtggacgaccccctgacggccttcaccaagtggctcctgcactttgaagctgatgtcctcggccttgaccctgcggagaagcgccgcaaacggaagcgtgcgaatggagacaacaacaacaaggcccggaatcctgctgcaaatgccttcatcgacatggaagcggaagacgacgacagcgatgacaacgatgcagaaaacaactacatgcttggctatgatgaggagggagagaaaccacgctccgtcaccacatatgccttcgcccacgcaggtaaacaaattttaacaaaaataaaaggaaaatttatcgatttttaagggtcacgttacgatcacgtgctgatctacggcgagatgctgcgcatgggtgtgcgtcccgaactcgtgcgccatgggaatcagctgctggagatgaaggcccgcaagaggggagccatcacaacgacaatcttccgggacaggtaaactgtgttaaaataatataaaataatcgattatttttcagttacaaactgattcccatcaagctggcttcctttgtgaagacgttcggcttggaaatagagggagtggacaacaagaaatacttcccgcacaagttcaacaaagtaaaaaaatcaataaataaaaccaaaaacaatcaataattaaggctgcaaattatggtgttgtgctggacactcttccgccgcttgaggactactaccccggcggacacttccctgaggagcgaaagaagctgaagcagtggtacgaggagaaccgcaacacgccgtttgacctgcgcgaagtcatcgcggactactgtaaagcaggtaaaaatcggtaaaatcttgaaaaatatgcaaattttcttcagatgtccaaattctcgcccatggaatggtcaaaatgcggcagttgttcgccgctgcaactagccaggagctgaccgactccatcaccatcccgtccgcctgcatgaagttcttcgtggtcttgtcgcacgtcggcaaagagagggtggccatcatcccccaccttggctacgagaagcgtgggaagcagagtgctatcgcccgaaaatacctctagtggcgtgccgaggaggagctgcgcgaaaatggatggacccttcgccacgtggaaagcccaggcggcgaatacaagcacggcaacttcttcctggacggcatgctggagcggatcggcgaggacaaaaacttggcgatcgaagtgaacgggtaaagaaacacttgcaaacttatgctaatttttctccgttcaggtgttattggcacgcgtgcccgcactgttttcccgaggacgactcaattgttggcggcggagagacggccggtgccattcgagcgagggatgagaagaggatccggcaaattgcgcgtgacttcgaggtggagatcgtgtgggagtgccagctcggacgaatgctggaagtggaccctccgatgaaggcattcttcgacaacacgcccgactccggccccaatgactccatgatgcctttttc

SEQ ID NO: 14590 - DNA, 1239 bp, Heterodera glycines
cggtcatccaaaggtcatccaaatggacaaggacgtctattggactacgaaggaacacattttggacgacgacggcgtgaaaatggagggcatcatcaagtgcttcgttgtcccgcctcggcactgcctctacgacattccggtcatcccaatgcggcgcaacaacagaactctcttcccactctgccggaagtgcgcggagatgtacccaaagggtctgtcgattctgggtacaactgccctcactttgaggacgctgagaggggtaaagttgactgtatttgccaatgaattttaaattttccttcgcaggattctcaacgaccatcccgcacatcgagctcgaggcggcgctgcgatccggctacagagttacccatgtctaccgtgcgtacgtctggccgctgtattgtgaatggagtaacggcctcttccactcctacctcaacaaattcctgcgcatcaaatttgagggtaagtagtaaattgatcaatcaatcaaccaatcaataatatttagccagcggtttccctgctgactgtgccgctgatgagattgacgaggaggatagggagcgcagaaaggagcaatacatcaacaacccctggaagggctgtacggtgcggctcgacgccaacaacatcaagccaaatcccggcatgcggtacctttcgaagctgtgcctcaactcgctgtggggccgctttgccttgcgcaatcggattacgaagacggaaatcatcgattgccacgccgaccttgcgaagcttctgaacgacgtcaaaaccgacatcagcagcatcgaccaactgacggagaaattctggatggtgtgctacaaggcgaaagatgagcacgtggtggagcacgacaccagcaacgtcgccattgccctatggactacggcagcggcccatgtgcacttgctcaactcactgcaattggtctacaggcaggaaaatctagttcagcgctacgacacgcgcattttatacatggtaagagtgtgacaataaaatattcataataaaatattcttttttcaggacaccgacagtatcttccatgacttcaagactgcactgggggacccgctgaagggaggcaaccaacttggggagctcgcggacgagtaccccagccataccatcgtcgagtttatctgtggtaaggactttggccaaaataatttgaataaatttcatcgattttcagctggaccccaggcctacgctctt

SEQ ID NO: 14591 - DNA, 590 bp, Heterodera glycines
taatccctcgcaaagtggggcttatttaaaaagagaaacaaaattcggaggcttttaataaaatttatgaattttattgttttttatttttgattattaatattttcaaataaattggtgaattttgttttttccattttcagagcactttgctaatgtattaatatttaaggaacagatttttatgagtttaaatcaatggttattgatgcgacttcgctgttttaatttggttggatttttttcattaaaatttcgtttttttttcattttattttgttgattttaaacgtctatcaaacaattagtgagtgagccattaaaaattattttcaactctcttaccttcttttttagtaattgaagcatacaaagcagaaaatgccagtgccattttgttgatttgccaaggcagatcagaaatcctttgaagaagtaattaattaattaattaacgagttaagaggtctcttgcaattgcccaacctgtgcacacttcttggccaaatgttctggcattgtttcgtactgtgatgcgactcccccgcgcccccaaatgccatcaagcattcgagcaacttttcgcgccg

SEQ ID NO: 14592 - DNA, 3681 bp, Heterodera glycines
gttgagtcccgttgattggaatgttggtgggttgagtccctttgattggaatgttggtgggttgagtcccagtgattgaaatgctggagagttgagtcccgttgattggaatgttggtgggttgagtcccagtgattgaatgctggagagttgagtcccagtgattgaatgctggagagttgagtcccagtgattgaaatgctggagggttgagtcccgttgattggaatgttggtgggttgagtccctttgattggaatgttggtgggttgagtcccagtgattgaaatgctggagagttgagtcccgttgattggaatgttggtgggttgagtcccagtgattgaaatgctggagagttgagtcccgttgattggaatgttggtgggttgagtcccagtgattgaaatgctggagagttgagtcccgttgattggaatgttggtgggttgagtcccagtgattaaatgatggtggattggcgcagaaaattgtggggggggccgaatgccccagtacgaggccgcgaaagcggccgagcgagtacctttggcgcaaaaaattgttggggggctttgccatcacgagtgaaaataaaattatatgctgatgatgttaaattgtatatatgttataaagcaagagcagatacagaaattatgcataaagcattgcataatttatcagaatgggcaaataaatggcaaatcagagtctcaattaaaaaaacttttgtacttcatttggggaataaaaaccccaaagaaatatataaaattgatggaaatataataaatgttgtggatacaattagggatttaggcataaatattgataataaattgcaattttccaatcatgtcacgcaaataataaagaatgcatatttacgtatgcgttctttatttcgggttattaaatcaaaatcttctaggatttggattattttgtataaaacttatgttagaccgttattggaatatgctcctgaggtttggaatccatctctgctaaaaaatattaaaaaaattgaaaaatgtcaaaaatatttcaccaaaagagttctttttaaatgcagccttccacccattccataccaacaaagattagaataccttcaactgccgacacttgaaagcaggcgaaagctgtctgatctgttcatggctcataaaataatttatggccgaacagatcttaatccctttgaaatattcaaaccttctgaacgctttaacattcccttttatagacttaactcgaaatataaattaggcaaaaaatttataccttttgcggggcgggtaactaaaatttggaaccaactcgataaaaggctcattgaaataaactcattaaatcaatttaaaaataaaattaaaactatctctattcccgtaaaatagaccggaaaaattaaagtcgaatttttaatccattcaaactaaaagtgatttggtcgctatttatttatttgtattgatttcatattatattttattttttggcggcgatctcgtttttaattgttttgcgctttcttgaggacattttttaaattaatgttttgtcctcaatgtaagcggatttttcccttttgtggactttttctttattgacaataaacaaactttgcgggagtaatccctgcggggtcacatcccgcaaaaagtttgagttccaaacccgcaacatgattcgaaaatttgaaatttaaggcaggggtgcgatctgttctgagttgtcagaaatgttctgattttggggtagcgaccaaaatttgttttgatttcttaaaatccttcagaattttgtaattttatggcgtaatgtcaggctacatgacatttcgcctactcgacatttcgcctactaagccaaaaacattcatttcgcctactaacccaaaaccggacatttcgcctactgtcatttcgcctactattcatttcgcctactgacatttcgcctactattcatttcgcctaccaaaccaaaaacattcatttcgcctactaagccagaaacattcatttcgcctaatggaaatacataatgccaaagagaaaataaaaaaagagaatatacaatatctacctataatgtttttgcatcaaataaatcattcatttcatttttatgtcatttcaaattttcttcaaaaacaaagaaatttcagattctaataagaaatgccaactgttcgcgaaatacttgagagtctgcaaaagcgagtaaaaaagcctcgcattgctacaaatgaagacagcgtactgaatgttgagaggacagacgcagaacaacaaattgaaggcacttcaaccaggaacaatttgggcgtcgcttcgagtgatgacgaagaaaattgtgagcccgttcaattcaaacgtgaagaaacaatccggggagctctttgtctttggtatcaaggtgttaatagtttttttttgatttttatttctttattttcaggctttcgatttatcaaaaacagaaaagatggtagctggttcaggtgcgaacagcgcaattgtccagcgacagccaaattggacgacaacgatttgatgacaggcattttgggcgcaaaaggacatcaccatggttgcgcaccatcgcgttatgatgcagagacgaaacgaaatcagatgaagcgcctgatcaaggaggagccaaaaacgaaaccatgtcaaatccgcgctcaaattcggactgacatcgacgatgaagtcttcgaattgctcggcaccaatgaagcgctcgaccaaatggcgaacaggtagacaaaattcagagaaaataatgatgcaatatttagaacaaagaacaaattcgttaggtggtgtcaactgtgccgacccactgaacatacaaattccgcctggtcttttgataaagaatgatgagtctgtcctcatttatgacagccgtgaagtgaggactggacaatctgatggttgacaacgaagcaccgattcaataggacatccgttcactaaacattcaagcgcttctgacaacgtaccgaggagttacattcaaaaatgggacgaatggctgacactgccggtgtgctactcggaactgagccgtgacgccattttgcacttcaccgtttgggaggtgggcaacacaattgagccggtgagtgaaatgtcttatatttaaaacattcttccgtccgctattttcccaaaaaataactgcatcggacaatgagacaatcttttattctgattctttcgattcataccatctttatagaactagttttttagactttactccagcataaatggcataaatttatgaagacaacaaatttaaaattcatataaacacacaaattctgtgtcgagtaacatatgaatacgaaaaaacctcatttatggatacgtctcggattgcgaatgatttgcattttcaggtgctggtcgcccaatgtgccaagcctttgttctctaaacatgccattttccgcaacggtctcatcgatttgactttggactttgttgccaatgcggcgacaacggacaaacagcagagacggcccgccgtacaactccaagcagcacacagcaaaagtccgtcgaagggaatggcgacggaaaacgcccggccggcggaacagtcggtagaagccgacgacagcacgccgctgcatcagcacaactaagcaca

SEQ ID NO: 14593 - DNA, 3809 bp, Heterodera glycines
  misc_feature (3742)..(3742): n is a, c, g, or t
  misc_feature (3752)..(3752): n is a, c, g, or t
  misc_feature (3758)..(3758): n is a, c, g, or t
tcgcatcgcatgcacttcctccgatttgaactgttgttgctttagacgaatcagaaggaatcgaaggtgccggcacacgttttgatgatgtgaatggcaccacttttgctttacccgtaatcgtcacaatttgtttcggtttggcgaagacttcgcccgccggcgattttgctgcgtttcccccttcagtcgaactctccataagcggggccaaacttggcctgacttgcggagaccggccccgtgccggagggcacattccctcgctaaagaagtgccgaaaagtgaaatcgatgaaattcggtcccaatggctttccgccgccgtacgccgcgcattttaatcggtcgtttccatttccatttgttctgatcaattcctcgttctccacttcaaaggtgtcaaagtttgacgtgtcctcgggattctgcactcgtggcacatattcggggaaagtgttgcgcaaattggcaaaatcgatgccctgcgggaagggagtgaatgctctttccattttggcactgctaattcgcaatttgcaatgcccaccttgaaccacgggtgtgctttgatgtccttggccccgttgcgatgtcccagtcggttctcctggtcacagcacaatttggccacacaatccacgcactgtttggacaaacgcacacccatcgcgtttcgcaagtccaaaaagcgtctccaatgcactatcataaattgcgtttccgccgggtcgtcgcgctgcgacaaaaacggcggtcgtccgtagaccatttcgtagagaataacgccgacactccaccagtcgcacaattgggtatgccctgaacaactttgtcatgatggaccatcctacttaaacatcaaaagcatccgctgaatgtccattccccccttttttgacattttttccgtttttctcaccaattttctgcaccacttcgggtgccatgtaattgcccgtgccgaccaccgaatgcgctctgtccctcttccggtggtgccgcatctccaacactttgacgcgctggtccaacccagggggcaacgagaaggagtcgtcccggacatggccaatgggtgctccgtttgattgttcgtcgtagactacgtaatgccttttgtcatgggtccatctgagtccggtgcaaagtccaaaatcagtcagtttaatatggccactccggtcgatcagaatgttatccggctaaacgatttaaatgcatttgaaactttgaaatcaaataatttgcacttttatgtcacgatgaataaagccaagggaatggacatattccacggccaaagtcaactcggcaatgtaaaatctgtaatgtttggcgttaaacattcaaagaagtgaatttagtctgaattgcctggcgagactttcggggaaaatgcccatgttaatctgaaaatgatctgtgtgtagagagggcagtttgggtggaccaaccagaagttgcatcatatcgcctccggggacgtattccatgatgaaataacttatgtaagcaaatggggaataaaagcgaaaaatgaattaataattttacaggttttcggtgtcttgaaatgagaagaacaatctgaaagcaaaaaataaaatacacaacacataagtgaaatttgataaacggagatggtcaaagtcagtgtcagtggccaaatcaattggaaaacgttcaatccgacaaatgaatcccacgtttttggccattccatgcccaattagccaattgttggcccatctccgctctttcatttgccacttgcttcacaatccatgggctgttagcttccgacaaaatgtctctctccgctttgacgtgcgccgcctgctgcttttggatgacgtccgctttgaccagtgttttcatcgcatacacttggttgtcgctgtccttcttccgcaccaaagtgacctttgccaaatgtttctctcatttcctaattatccgctaatgaccctcccccttggccaatctgctcgaattaccttcccaaaagcaccgattccaatgtgtctgatcagttcaaacatttcccggttcattttttgccttctcaaccgaatgtatttggactccttttggcgcagcaatcgcaacatcctcgtctgtaattggtgccaaattcggcattttcttggcactttcgtcccaccttcaccggctctgccagtccggccagttccatctcgcggatcagttgcatttcgcgctgattccgctctttgtactgctgcgttagcttttcgatgtgttgctccatgaagaagctttagcaaaggaaattatttacgacagtttaaaattaatgccttttttgaaatgctaccgaaacattggcgcgcgacaactgaaagaaagcggcaaaacaattaatagccaacaaaaaagggaacagaaaaacacacggcttaacagcacggtcgtaagtgttgtttttcagttttttggcgaccgattcgggcaacggcgaaacgcaccgattgatggcattggagcggggggaaacggcggaggaagcggcaaactgctgaaaaaggcgaagaaatgggggaaattggcggaagggaatgaatgacctaattatgcataattagccaactatgagggagagttaattggaccatttccgatgtcccgtgaattttcagaaattctccccttttcagaccaaaaatccatcccaacaattattttaccttattagagatgaattggctataatcgggtgcagatttattggccacacggcacaaggggacttgaggatcgacaaaaatgcgttggacgagttggggcgcattttgatgtggtcgggaaggagaggaggaagagggggcacagacgggaaaagcagtgacacagtgctgctgaaaagtgaactttggcattattttcagaaggattgactttctctctctctttttctctctattctgtgcgctaactgtctcgctttataacttcccttgccttttttttccttaatcccccttgtctctcgccacctttttatccctcgccgtctctttcatttgctcctctttctcttgcggtctgtccatcgtcgtcgttttgcattccgttcgctcacttcggttccgttcaattcgcgtcactatcccttgcggcggattccgtcgtctgttggcaacggcatagtgatcagtttgaccaatggaatgtgcagccaaaacatcggcgggtccaaaagatttgctctgtcgcctaaggggaagaatagcaatacttaattagctttttgttggcttaacagagcggcggaattggcatgtgccaacgatttcctcggggttagctgaggcggcgatttccattccgataattgtgctgcaggtgatgccatttccgtccttcgctgccgaagggtcgtcggtgagagggcattttgagtgtaagcgctgcgcgggaaagggtcagcagggggcagagaatgttcgcctttggccggggaatgtctgtcttggccagccgagaattttggcacagatttgtgctggttttggtcggacgattcgttcacaaagacaagcgaccgagaaggagtcaattgggcgcattttggcactttgttggcgttgtgttgtttctgttggttttgctgctgtctgactaatttcttcagcagggaaaaggaacgctgtacggtaggcagaagcaaataaataatacggtggcattgacctgcttaacggaggaaaaaggttcgnccgcctcggncagcgnccgaaagtgccctaaagagcgcgtaataagcactttcctggaaatattaaa

SEQ ID NO: 14594 - DNA, 2263 bp, Heterodera glycines
gaatttttaaaattctcattattgccataaaattgattttaaaaaagctaaaagtagtcacaaatcattgaaacatcaaaaatgatcattttgttcagattctaacataaaacaaattttcaaaattcgaattttcggtttttgttcgaatttgggttcggaataggcccaaataattgccatattcgcgatcagcaacctcgaaaacccccgggtacttttctctacccatgtactaattttttttaacaggttcaacatacgttctaaaggcgaaacaacgattttaactcaatttcctacttttgttaccaataatactgctttttgttcatcaatttctaaacaactcacaacgtcagagttgaactcaactccaacgtctccttttccacaaaaacaagcacaaacgctgcagaaacaaccttgcccaagtggtttttcccaccatcgtcgcgtttctgttgtcccatccaattcatcgcccgctttccatcggcactgtccgcctggctcggcctcggcttcttcggcctcctccttcgctactgtttcacacacaactgtggctaacgctcgattaaaaccgctgactacgccttccgctgcgccattgttttctccatttggcgtaaatgagctcaacaacaatgattgtcttttatacaataaaaaaaacaagcagcaaccaaatcaaaggcatttggtgcccttctcctcaagctcactgtccacgtcaaacaatcagcaggacagtggggaagtccgtctcaaactttggtaggctaaaaataaacaacggatcctaaaactcgaagcatttaaatttgggaatgggaagatacggtcaaggaaagaatattcaatccaatcgacaggtacgacatggacgaagtgcacccctttgtcaactaccggcccctctatttgaatctcgtccgctctctgaacgttgatcctcacgcatgctctttaatctcactcatccaatgtttacctgtgtgccttagcctgtgtctttgtttttgataattatgattaaggtcgacctggaaaacctcgctaagccattgatgaaaatatttgtccattccaaccaaattcgtcaattctttcgtgcaatttgcatggattatgtcaaaagttgcaagtaatccacgccaagcctaattaatttaaagcattcaattttcatttagcgatgtgaatactctgtttcgcagccaatctttggcttccaaagtcatgtacgaaatgatgaaatttgttggtcaaagttatttattcaattcgctgaagccactcattgacttggtccgtttggattactcgtcaatgggattgctgattgtatttcagatttttgctgagagaaagtgctgtgagatcgacccatcaaaactcaaaacgggtgattccctcgatcaaaattttgtacgttatttacttaagattggttagattatatttgcaagcctactaacccatttcctggaaattcttcttcaaaacctatgtactaattgaaaatcatatcataaaaaataaatcctttttatacaaaaatagtttttaaaaagtccgaaacaattttacgtgataattttcttgacttaatcaatttaaaaatttataataaaaaaaatcgacttgggaaagaatttaatagcacattttaaagcggaccatatatctttcttattgattttttattttcactaacaatttttgaaaaaaaagacaaaaaagatttacctaggtcaattttttaatccagcgtttgagaagaagccggaatgggcgagtgctccgtattatcatgtcaataactgacgtaaaagattaggaaaattttctattaatatttttgaaaaataaacttacttataaaaagttaatatgagtttaaaaaatttttctattaagatttttgaaaaataaacttacttataaaaagttaaatgaagtttttattccaaaatagtaaatgaaaatatgggtgaaccattcttcatgattatcccttttaagatagttgaaaggttttccgtcctttttgaaaaaaactcgaagaaatttggatttaaattatttttttcatctaggtttagttaatgacatcacccacattcctagttcgtgttgcccagttgtccctttccgtggctggaataagcgtgctcccccccccccctccgcttaatgtgtggctataatttagcacatttgtttttatttagcgtagcattacgacttatgctga

SEQ ID NO: 14595 - DNA, 2100 bp, Heterodera glycines
  misc_feature (23)..(23): n is a, c, g, or t
  misc_feature (56)..(56): n is a, c, g, or t
  misc_feature (75)..(75): n is a, c, g, or t
  misc_feature (1327)..(1327): n is a, c, g, or t
acgccgtaccagtacaattccancataaaagggcggcgggccaagcaaactttatnttccaatgttttaccaatntaatttataggatgtcgaagtttcacgtacgctggtgcttgtctcaaaagtccttcagcgaatttccaattgcgttgtttccgcacatccgttgaccaacaaagagcaatggttgacgccggtccttcaacgcttctcagacagggacaaaatcgcgatgatacaatttttggacaaaatctccaaaaatgatgccgaagacaatagccagtcctcggaactgaatttcgctaacaatgaaaacatttcgccagcatccagctcattttgcgaagcgacagtacttaaatcggggtattcatagaaaaatgcgaatttttcaaggaaatcgactaaatttaggtatttgattgaacgaaggtgcagccccgtcaaaaagcgttccttcaaaagtctaatgcattcgaagcgtcgctttgtccttctgaccgaggcgtcgcttatatggcacaaaagtgcaaaggacggcactgcgtcgagcacttcctcggtgatgtcgaacagtttgacggtgagcggcgacttcaacgcgggcgccgaacaacagaaaagtcaaattgcgctgtctgaagtcactgctgtcggcgtccttccggacgcaaaaaatgcattcagagtcagtacgatgaacacggaggtccattttcaggcgaacagcgaagcggaattaaacgaatggtaaggggagcattttctaattagatgattagcaaaatgaaacggaaaaaattatattcggcgtttttaccggagtgtgattttaaaatagcgatatgtcccaaccatacgctaaaaggggtgggatcaaaaggtgggtgacgcctaatttaaggggtccggcgtcctaggtttatatgagacaggggtttggggttcgaatccgcttggctgcggattattttttacgatacattaggaaaacccgtggacaaaaacattgattttgcaaatcttagctcatattcgtgatcagcgcattttttaccccgaattaattgtaaagaattttttttaataataaaaattttggaaaaaatcaagtacttgatgaaaagtcatagacaaaatcaatgattttgccaaatctgagttcaattcgtaatcagcacccttttttacctcaggaaagataagacttcgttatcacacgtataatacgaaatttattaagaaatatttttcttttaggattatactgatccagaaacaacaacgccgtcagctgatggttaagaaccggtccatcctgacntcacaagttcagcagcaaatgtgcgctgaaattgacttggaacgggagttacacgtcgtttacacaaatttggcgactcacatggacacactttgtgatcacaattggtgctgtcgcttcgaatgcgcacggtgcgacggtgggaagtgaactcggaatgagtgcacggattcgaggacggatcgctggaattcgatgggaggaagcggccttattaattattgtttttttattgtaccgattcggcatcagaaatattttgattcaggaaatcagaacagaacttctatctcgttcttttttgtaaatgctcttttatctgtccctccttcgtttgtcctctcaaatacattatgataacctctctaccttcacaaccattcaaacaattttgtcacttggatttcatttaaactgtaatctttgtttgttattatttatatttgttgtaaaaatgattgattgattgacttaatgaaaaaaaactccttttttcagttaagaaaaagaggtgtcacatgttgtgatgttaattaggtgattttaatatcaaatatagttatagtttctgttgtttttttgtattgaaattggaacttaatgttagcagtttaaagggtcacatgctcgatgccgacgttgactcccaagtcaattaagatttacaacacaataaataacttatatttttgctaattaagaaattgcgcatcatcgaatggcaacacttgaacttgctcaagttttatcctgatggtttgcttttcgttttt

SEQ ID NO: 14596 - DNA, 4897 bp, Heterodera glycines
atgaaaggttcagtttagtaattatggtcaattgaaaagtgtcaatggcatggtcagtgtcactctacgcgtggaaaaggcagtggcggcgtcgtcgaaaatcggcatcggtaacggcactttctcaatgacgaattggcattcagtttctgtacggcatcgttctccagaacagactccacgacctgcaaaatgaaactttagccttgcaaatgaattccattgtttaccatttcatttctgcgacggttttccgaagcatcggtcagaaattccgccgaggttttgaagtccgcaccagcttttttctcaccagtctgaaaacttgcagccaatttaaatagaaagtccgtgttaagattatccatgcaaaagcacccaatgttatgcgcccccatacacctaaaaatgtcatggtctcaatttaagggaaatttgattattttcctaacagatcgtatcaaattgttcggctccgccggcctcctttcttttctgtttgaaaattgagcgcaaaaatttttggccttcaaagtcatcgccggaccataccctatccaaggcgaaattctgaaaccatcccagggcggcagattggagaagtaacaaatataattacaagtaaaaggctatttgtataagaaatgctgtaaatgacacattttcctgggaggcgtcactttccccctgctgcgtgttcatttcctcgtcagggtcggccagacatccagtgaaactgcgtgcgaggccattcagcagaaaacgaagactgagcgacgacgaatgcgcgaggaagtcggacgaatggtcggcgtaatagcgatgttcaatgccaatgccaccactccgattgtgtcgctcttttagtgcagttgcgaggtcgtaattcttaacggaccctgaagaacgaggagaaatgacattggtaattgcaaggcaactgtatcggtggtcaattggcgagtgtttgaggcctccactcaattggctgtctaagcgcgagtccatcggagtcgaacgacgcgtcaagcgagtgggacggatgcaacggacgggcggctcgggaatcacaccgtcgttgtagttgatggcgagccatttgcggattgctttagtaatgaaaaagaagttacgaatgatgcgcatcacagagccaaccagaaactgaaacgaacgaatacagacactgacaatgtaatatcatttgaatattcacaccatttgtggaaagtcaatgggagcggagaccaagtcgtacccaacgatagcagaaacgcaaatgagcactcgctggacaaacaccagtccaaggtcgaaggcacaatagctcagattggactaacaataagaactatcgcaattggaagactcaaaagtaaatccaccttagtcccgccacttgacatggagtattttccactatctgagttacgggtgctcatagtgactgccaataatatgaccaaagagaggaagaaagaatttctaaaaaagcaaaagttgtttttcaattaaaaatagacaattggaatttggattttttatttttaaaagatttttattttttaaaatatcaaatttgcgtaatgaaaaagagcgttatttttgaatttaaattttttgcacaaaatgacaaatttgcatatgaaacagcgttatttttgaatttaaataaatctaagtgctatgctgatggaaaattttttctatcaaaaatccagagttatgatcgaaaatttccaaaataagcatatcgctgatcaattgcatatttttttaggcggggagggggatgatctaatcttacataattctattcgatttttttaatctttagactattatataatgttcgaaaaaaagccgagaacttgcatttctgaacgtcgatctctcagcaatctcacaaatgtcatttataatgatgggaaaaaaagcaatgccaaaggctccgctgaaattaccaggaaggacttacacaaaaatttcgcggacgacttcgttttgatgcgcaaaaatttagaattgcttaaacaaaagtggaagggaagagaagatacctttgtcttgccaaaattatcgctgaatgaatccaagaatgttaaactcaaaaaatcagaaggttgtctcttttaagaaattaaaaaaaatgtaatttcatagatttagaaaatattttttggcaaaagcaatgtcccatcaatgtaattgacgcagcccgaacaattaaaacgcattgcctgggtggtcaccatgccgttcaccgcaatatgtttccaaaaagtttcttaatttgattattaaaacgttttgttggcttaggagtccgcggagctttctgttatttgtgtggattaaatgatggtgttgaactgaaaaaatgctcaatggccggctgttcaactcgctttcatttgttatgcgctcgcaacagcacactcggagggtacacatacaaattcatggaacgccggtcggaacgtgtcggattgttttgctcacgacaccattgcaccgcttgcttttcggaccacaacagaacgcgttgttttgcaggtttttcaacgtttttcagtgggaaaaacataatttttaacccattcttccaattgattaatgcgctgaaaaagacaacagaactgaatacaatttctatttgatttctcttttaggggcatctctgatcacctgcgatcagtgtgaattggcttggcatcgtgactgtgttccgagtatgggttgagaaattgttacaaaatatatttaagaatttgtcttttcaacaggtggttgctccattgactctaaaaatgaaatcacctgtcctcggcatgtcgcttttcccgattttcccgcctttcatttaagacattgcgcctattgccaacaaaaacccgaatcgccaggtttcacagttacactaaccttgaacttgactaacactttttcagatgaactagttaaatgtacagtttgctttcggtcagcacatttgaaatgttacaatgaatcaaaactgacggcgacaaatgacgagggaatggggcaaaagccggtgatttgccattggtgtgagaccttcgattttgtgcgttatggtaagaaatgcgaacgaacctccgaaatcatttcaatgttaatttttctcaaggtgattatgcaatggggcgtttttcaagacagtaagcaaaattgaagaagcaaattaaaattgaattcatcacttttaagttggtggtacccttgccaaacagtgtcaaatgatgaatttccacaaaagaacaaccctttgttgggttctgtcgggtatttgtgtgtcaaatggtgggttttttatgaaccaatgaataaattgtaagttaaattttgaaacttttcaggttaccgtataaagggaaaatactttacaatcttttgtcacataatcggtatgtttgtggaatttgttgtgtaatggtctcttcctcttccttggcaatagaattgttgtaatgactgatcatgattacttttttgtgagcgaggcacaaacatcggacattttcaggggtttcctttgcttacggcaattattattatcattttttttttgttttttagagtggcgagaagcgcaaaatttcatggtacggaacaacccactgaacagaccactcaaaagtgatcaaattcccgagaaagggattagcaatgggcagcggatggtcaagcacctccaggtaatcctaatcaagcaaaaattaacaaaggattcgcaatcccggcctcgttctaccaacgattagcgtcccagtggcatggaaattgtcaaaacgatcggataatttctcacaatcagacaaatctgaccactttcaaggggactatgttaaaactgatttttttcctcgttacctttcccttttataatctttcactatgaaaatgaggcgcatcccttgttaataatgcaatatcattcttaaaaacaccaattatgttggtttacacttaattgtttagcgtaatcactattcaaaagcggagctgaaaactcaaagtgaccgtctgttggtgcccgacttttgcaattgtccgaatggttctgaccgatgtgggccgtccaccaattgcatcaatcgatcgcttctgcaagaatgtccgaagggttgcggagaagacttcaaccttggctgtgccaacagacgcataagcgagggaaacaattgcatcaaaatcgagataaagttcttcccgggcaaaggttacggggcaattgctaaggagaaagtgccatctgtgagttttttttcatcgaattcggcatttttatttcttatgaagcgaatagttctacattctcactgttcgtccttattcagggtggctttgtcggtgaatatgtcggggaagtgattagcaatgaggagggaaggcgccgagttgagaaaattgccgagttacaatcgcacgaggctcaatattacgtgatggagttggacgaacgacggtccatcgatgcgcaattttacggcaacgatatgcggtccatttcccaaattctgtgctttttacatttaatttctttcagttatgtgaaccattcctgcagccccaactgtgtgatccagcaaatccaaagcgattttgacttgcatttggttttggtcgccaacaaagagatttccatcggggaggaactgtcctttgattacaatatgcaggcgaacggacgttccgtgccgaattgccattgcggggcgccgaaatgcacgggagtactttcggcagaaaaaaatggcaaacagagaataagtgagtgggtttattttttaaaattggcatttatgtagcaaagagccctagcaaataaaaaaacggggaaggggggactgcagattttgaattattcaaattt

SEQ ID NO: 14597 - DNA, 3459 bp, Heterodera glycines
  misc_feature (2330)..(2330): n is a, c, g, or t
ctatgaaagtgtttttatctgattttaagttctcgggccttccatatgattatattttaattattttcttaagttctttccgcgatcttttatcccttgagtcatcccatcgattaatttcgttggagatgttgttgaaaaagaaattgcgctttttaaaatttatttaatttatgattttgcctccgcatattaaaatttgaatttattcgtaatgaattttatttcttggcaaaatcctttttgtttggtttaatctttaatcagattcggaatctacacatgtaaaaaaatgaaatattttaaaaaattaagttttttgaataaaaacccgtgatttgcaacaattttaccgcggcgatctcttcaaatttttatcgccataaacgatctcggcatttttccatgctcaacacggaaaaaacttatttgacaagatgtgatggcgcaaagtttttttaatgagatcaatcgagcagataaatttgttgcttccaaattattcataactaagctataatagcaaaaaattttcatcattcatccctaattgaatatcttcaagattaaatttcttggaaaatatgcccttttaaattaaaaaattttgaattcaaataatattattatgccattgcattgaacccagaagggatcaaaagttaagcgcttatccacaaaattaaatgtctttatttttaaagttttatttttgcgattgggtatttattggcaaatttatcaaatgcaacaaaaaaaagggtgaagtagagacctttttaatagggattttaacaaatttaatacaaaacgtaaaattttaaagaaataggctttttcttacatttatgggcaaaatgccgaatttaaggacattttggaaataaggacatcttcaattttccaagacataatgccagatccaagagcctccttttaatccaaggacagatacgacccctcttttagcatttttcattgcttctaaactacctcaatcagcgcccataacatgggaaaagtctcaaaaaaatgcttgctaattgtaaaatcttttttatgaaaaacggttccgccattcaatagagcaaaaatgctctattaaatttgccttttgaaaggtgtgttgactcatctaagctacagcttgaatcacttttttaatacctttcctactgtaattgccaattattaagaattaatttaatggattttattttttaactaaatttcggtaccaaaaagtatttacaattgttttggtgctcacgattaaaattcaattatttattactcgaaaattttaattggtttaaaatttaaaattctctcaacggctcctttgacatcataaattatcatttgtttaaaaatgcattcaaaaaatattataaaaaccaatttaataattttcaaaaaataattaataattcctctcgtaaaatatttttatttataatttaattaagttttgcttttcgtgaacctaattgaatttttataagaaaatttattcagcattgaaatttaaaaatatatatttgtgtgggaatttaaaaaacttccttactggcgaaaaccccaaaataattcttcttcataaaataaaaatgccattgaactaatgggttaggaattatatgaaaatccatattttattttcatgaaaactgcgggaggcctaaaacgcacgaaaaacatgtttttagcttggtttgcagcttctagctggagttcattatctattttttccatatttcgcaatttatgtctacatttccatatttttccatattttggcactttgtccgtgttttatgtccatattttggttttcccataaacctctattagaatggcccccatcagttaaattgcgcttctgactactcctgatgatcagaaattttccgaaaaatcattttgaaaatttttagtttaaaataaacttacttaaaaataggtaaatttgtttgaaaaatatgcaaaaaaagagaggaaaatttcggctttttgatccttttcagagctttttttccttataaacgacttttatacggtattcagccattttacatgaatttgaaggaattttggaaaatttacctctcaattcggaaaatttatgttcaatttttgcaatattatgtctatatttcgcgatttttggtcctaacccacataattcccaaccctaaatagcatacttaaaaacgcataaaaatacttaatattgatattaaaattaataatttaattttcagcaatgcgaaatttgcgtgttccaattttacttatgctattgagcacagtgattattttcatattanaatttttattgcatgaaaatatgccgacaaaaataacaattaaccctgttgcgggaaattttatgcaacgaaggattttgttttttgatagtgacgtagactccccaaagttgctgcttggaatgaacacccaagtaaaaatatgaatatttgagtcgaatcataacacatatttcttggcacaaaaaattataaaattaagccattgccaacaaaaagtcactttggcatatttaatgaggagacagtatttgtagaaatgatgacaagcaataattaaaaagaaactttaataaattcaattagtcgataatcatatttattgagttccaatcaattaaaaacaaggattaatgagtattcaatcaattaaaaagaaactttaataaattcttagtcgataataatatttattgagttccaatcaattaaaaacaaggattaatgagtattcaatcaattaaaaagaaactttaataaattcttagtcgataataatatttattgagttccaatcaattaaaaacaaagtttaatgagttttcatattcctttggcagtcattttgattcaattttgcaaactatttaacaattaagccattgccaacaaaaagccactttggtacatttaatgaagactgggacagaatttgtggaagtgatggccagcagcaatgtgtgagaaagtttgatggcaaattccagcgcaatgttgtgtgtttttgttataaaaaataattaaaaaataattatgcattgttaaattataacttaaattaaattaattaaatatattttaattcaattttagtttattccgtcgcttaaattggccggctgtttaattgcaaaaaattcaaatgttttcttggaggcgttgttttgctacttaacaaacatgaacaaaattaacacgacaaatatcgattacgaacttttcaatttgtttgtttttaactatttataattaaacgtgacttagagagaatggcattatttttttttaaattttagaccgagaattagaatgatgttttgttatgttgagtcaccgaattatgctgaatcgccaatgtaagaggtattttgatttgcaatttgtacttttggcgttgcgtctgtctctg

SEQ ID NO: 14598 - DNA, 1332 bp, Heterodera glycines
atcgaggcaaggggatgataggcttggccgttcatttttctttggcaaaacacaattaaaaaaaacattttaaagtcaattgaaaattgatgcctaatttacttgtttatatattttttaataattttaaaattttatttaatttgtttttaactccgtttatttatatttttaaaattgatttagcaggtaaatctggcaaaagtttccgcgattccccagactttgcgtctatgtccaaaatcgggttcaaactcaagttttttcaatcactgatagcctaatcagcattatataaatgatagaaagtgattgtgtctaataatttgctagttattttaattttaaaagtcatcaattattcaaacagctgatcagggcgagaaaaatccgactttggacataggcgcaagtgcccgaggcgcaaatctctgggcactgttgctgcaaatgtgggaggcaaaaaaatggggcgccatttgcaagtctttgatttgtgacccaacggccgcctaaagcgccgtagggcactttcaccatttttaaaaataatatttttcgtatctgagttaaattttattattattgcagagcaccattgtatagatctgatgccactggtggacgacaatattgcaatggctgtgggccaaatttgacatgttttgtcatgacggaatatgaaaaaatgttaaaccattcgtcgtccaatctttcatttgcggccacggcggaggactcgcatttttttccacaaaattggtatgtaatttggctaaggtgtcacgcaggaaaggccctggattttgatagaagacttataacaaatattcaaataaacttcatgaaaatataaaaagtcttggacacgtgagtcggtgaatcttcggtctccattctttacattgagatgccaaattacaggttcacccccgaaaaaaccatatgcaaaattaatgcttttttgaccaaaaagcgtcaattatttgatatttttgggggaaatttaaaaaatgttaatctgtaggattcctgttttcctttaaaaaaatagagtattacctttctccctgttaataaacatgtgttccttctgttggggccaaaatgtatcgaaaatcccgaaaaataatttatattcatttttatttttaggctatgcccgttccagagaatcaatttcactttaatcaaatataaaagtttgacaaaaactgaggatgaaaaaaatttcacagaccaattcgtggcatttttggccaatattccaagcctaagccatgaaacgattgaattcgtccgagcccaagcgggtttgaagcttggccatca

SEQ ID NO: 14599 - DNA, 2663 bp, Heterodera glycines
  misc_feature (2659)..(2659): n is a, c, g, or t
gggttttttgactctattgcagtcatccacgaccattaaaaaaagaagagcacaaaataggcaactttcatgggcaattgtgtagaattgtggtcccgacgaaaaataaatctaaaatttttatttttataaagttgtcaaattattttatggtcgtatctttttttaggtcgtgtgaaatgtacataaaatagagccggttttttggcttcctgcgatttacacgtccataaattcacaactggtctaacccttctctgtacataatgataaatatattttcagtcttatcattgtcatcctctttagtatacatatagcaatatttcaatgttgcataatagtgaacggaaccctctctacaaatactcataccaaattccgggccaggaacgttcatacacttattcggtaccggccgaagagtttcaacaaaaggttcattttgttaattcttttctcaatcgcaattaagttactatgctcgatgggaaaattttttttattatatttcacaaaaactaaaaagagttatttttattgacaggagcatgacaaagtgacaaatgggtactttcccaccaacggaagtgctgaagcggtgcttcctcatcattttgaacacagcgttaaattggacgatttgatttgtgttcgctgcaacgaaggctttactctaaatgagcaaattgtcaattcgggaggccaagtgtggcacgccgaatgttttgtgtaagtgccttttatggccgatattaccatgccttgttcacaattagaggaagattttgaaaatgtatttacccaagacaattaaaaatagtttatactttttctggcttttcatactgccggattatggagtttggttttttgtggtttttgcttttgagaaaatttttcgatttcggaattttcatgggggaagttgtacactctcagaatctgaattaattatctgttctttcagttgcgtccaatgctttcagccattttctgacggaatttattttgaattcgaaggacggaaatactgtgagcacgacttccatgtactgtatgcaccgtgctgcaataaatgcagtaagacccaatttatattcaattttgggaaatgcgatatactcaaatagcaaaatgtttaatatatcaatagatttcttggcgagagtattgcttaatgccatttttgatttactattgtcacttaaattaattttaagatgttttgtcattccatttaatcttttattcattttactgtgtccattcccaaaacatttttaactgaaataggaggggtgggttggacttcgtattggttggacaaaaataagctctgtagggaaaggtggtcggagacgaggcgtaagagagaggcgacttgtttttttttcctcaaaaattcacatatcgaagctccaattccgtaacatttgaatgttactgcgtcttaaaatgatgcccttcggttgtttaagtagtttatatattttttaatttcaaacattatttaacagacgaatttataatcggaagagtgatcaaagcgatgaacgccaattggcaccctgaatgcttcacttgtgaactgtgcaacaaacaattggcggacatcggctttttgcgaaatgctggcaggtcgtctccgtactgacatcaaatacgagcttgttttgtccgtttagggcactttgtcgcgaatgtaatgaggcggaaaaggctgcaggcactggcaaatacgtgtgccacaaatgcagggcaataattgaagacggaaaccacattaaattccgcggggacagttaccacccttaccatttcaaatgcaaacgatgcgacaacgaactgacggacgacgcgcgagagatcggcggagcactttactgcttgagatgccacgatttggtagaaaaaagcatttaaaggaataccttggaggagttaattccatgtgcttttacagatgggaattccaatttgtggtgcttgtcaccggcccatcgaggaaagagtggtgaccgcgctgggaaagcaatggcacgttgaggtcagtttcagaatgcctctttctgtgcaacgtcttttagcactttgtctgtgccgtgtgcgaaaagcctttcctcggccacaaacactacgaaaggaaagggttggcctattgcgagcaacacttccatttggtcaccagcaacgcactgaaacttaacacttttctgtttagttgtacggccatctctgcttcaaatgtggcaatccttgtgggggagaagttttccaagcgcttggcaagacttggtgtgtcaaatgtttttcgtgctctctctgcgacaaaaaaatggaccaaaagtgagcattttctttcctcttaatcttaatgtgtcggaaaccaaattcttgatttatttcatgaattattctcaggacgaaattctacgagtttgacatgaagccaacgtgcaaaaaatgttatgatcggttccctactgaactaaagaaacggatcagcgacaatttgaaggagagggaagcagaaacactgcgacggagatcagcaagtcccgcacaaccacagaaatcaaaatcacccggactgaaatgaagaggaaagaagcccatcccacaaatacgaatctgagtgtctgtccccaccatcaanagaa

SEQ ID NO: 14600 - DNA, 705 bp, Heterodera glycines
caccccagagaaaagcaatataaaatttttaactttattttccggcgggacctccaattctgcagtattttttcccctgatacagtggaaccatgtttattacaaatgttttagaggtctttgaacgcgatgacttccattttgactcgaattcctatcttaattccaacaaaaagttggaaattcgaattttcggtttttaggtattttttcattttttaacatattataaaatttcggattttatttttgttgtaattctggttaggagtaaggatttagcctgctaatgggtgctataaccttttgaaacggactttgcgcataggcgaaatttgtccgagccttaaaatcatttcccgcaatttctgtgagtaccacccaaaaacttattattattattattttgtaatggcggacgaagctgaggttgatgaagaacttatcgatgttctcagagaaacagacctcgtcaagtttcaaccaatgatggtttttgacaaacaacttaccaggattgaacactttcgggatgttactgacttcgagcttatggttagtttgtcgtaaaaatatggtctgttcttcgattcaaacaatcccaaaaaatgataaactttgttaaagtgtcttatttgagatgattttgcattgcttttagtcctacggtctttcggagccggcagtgcgacgtcttcgtaatgc

SEQ ID NO: 14601 - DNA, 2624 bp, Heterodera glycines
  misc_feature (10)..(10): n is a, c, g, or t
tactatatantctttgaaaaccattaaaaagaaaattcgcggctatagtatataatacagtaatatgcacatatttattcagtccgggtttacacttggacatttgctaagtgtagtttacacgagagcattcaaagacggacacgtggacatatgtcgagcacgaaaaatgtaaataaataattaaaaattatttgtttgttaaaatttatagaaaaatatttatggacaattcgaaaaagggctattatattgacgatgaggatgcttcggcatttcaaccgttttccggttcatcttcaaatttgataaacacccaacacctgccttcttcttctcttctgccaaattcttcatcttcaattcctcctcctttaaatttcattcccacttcctcccttacacaattggcatcccttccgccaaattcttcatcttcaattccttcccattcaaatgccattcccacttcctcccttacacaattggcatcccttccgccaaattcttcatcttcaattccttcccattcaaatgccattcccacttcctcccttacacaattggcatcccttccgccaaattcttcatcttcaattccttcccattcaaatgccattcccacttcctcccttacacaattggcctccattccgccaaattcgtcaccttcaattcatccacagttaaatcccaatgccggtccctccattacacaattggcctccattccgccaaattcgtcaccttcaattcctccacagttaaatcccaatcccggtccctccattgcacaattttcttccattccgccaaattcgtcaccttcatttcctccacatttaaatcctattcccacttcatctcctacacaactgtcttccgttctgccaaattcatccactcaagccgcattacttccgtccgattttatggagcctacgagtatctttatcattgactatcaactttataaaaagtatcgcttccttttagcggaaaacccactattttctgacatatcggacgcttccgcttacttacaaatcgacgagcgcgattatgggaatgaacaatcggcatctgcacaagttttacgttcaatcttagacgtatgtttgttctattacactttcaaaaacaattttttctgattaagacgaaaaattccaacttaatttgattctcacattaaacatttgagaatcatgaagtttcatgaaaataaaaaaatatgggaattttatacatactttagtttttatttaactttaattcattttcattgctagttaaatttattctgcaaattatcttcataaaacaattatttagctccgtccaacatcatccacggcgtcatcgcaaacaagttcgacaacaagccggaattttcgggaccatatgaggaaactgtacacagaactgggcgaaacaaatcgagatgaacgggatcgcgcaatgaaagctttagagttcaaaaataaacaaatcgaaactaggtcggaggatggacaaagaagaagatcaaaaggatcaacctccgaagatgataagaaaaaaagcgtattttgcaatatctgaaatttagacatgattatcagtgcgatttttgcgacaaacttcatcaaaattataaaaaatgattttttgaaataaaatggaaatgttaacctaaaatggataagacttctacagtggcggcaataagcaatagaaataatataaaatttattaatttttaaataaaaaaacgaaaaaaatatgaatttcattttttgtgttagttgttgacagattttttttttgaaaatttaataatcatataaaaattttttagtaaaatgatttttcaaatattttcactatcttaaggggccaaaaaagtcaattgaactgatggccatagtgattttttgaaaacatccatgcatatgggtataagtcgcgaaaaatggaaaaaaatacttattcaagttcatcttagttctaaagtctcgaattgtatagagtgtaaaagacaccaaaaaatagcataaaaaggcacgaaaaagatacaaaatatttttaatcaatgagcagagtaaaaatatcgaaatgtaaagtaaaataaatgctcatttttatttttgaaaaaattttgtccttaatttatcaacaaaaaaatgtgtgaaaataaattattttccaaaaaataatttttccttttccctccattcttcccatttgaaagagtaatgatcggtaacatcattcttgtctttttcttctttctctttctttcggattgctgcgcttctctcttcacactttcttccttcgtcctccattctttgctcccatcgctctctgtctctttctcgttcctctttttgttgctcccaaacatgttgccgcctcagcatgtcactgtgccagtcgccccgctcttgccgtctttcttccgcttccctcctccgttcttcacacctgagacgcacttcttcctgccatctcctctcgcgttcatcccactccaccatttcttcttcggtcagagcaaaaacgacttggtcgtcgttttgagcagcgttttgcgccataataaaatttgaaagaattttactaaaaaattaaaaattaaa

SEQ ID NO: 14602 - DNA, 1519 bp, Heterodera glycines
aaattagtgaatgaccttcaaactttgcaaaactttttggtctttgtgcaagtacggctcaaatattacactaaaaatcatgcgattctattagtaacgaaaatgtttcatttttgcgattttattagatatgccgaaataatgaataaaaaatttctctttttctttccgtacgatatgggctaaaaaatatttccttttcgggtttaaacaaatgtttaatagctgttaatcgtattttattgtataacatttttatgtcaaatcgattattttgcacttgtttttggaattcatctatcttcttaaaattggtatctgacatattctctgcttcttgacatttaaatatatttatttctttgaggccaatttctaatttttgcatagctaaggcttggtttatatattcatgcataataagccctggtaatttttgaattttttcaagcatttctaagaatgtaaaatataaattttcgattccaggtgcactaaatgccgctatgtagaaatttttcacccgtttaaaaaacatatttgcaaaaatttcgagattatttgatcgtttaactatttttccagaaattttccaatttctcgtaattttgttttttataaaattaatttcttggtctattgtcgacatctgggattatagttacttctagtgttatgacatcatccaaaggatagaaaagcgaatataattcttcttttaatatgacatgttggaacaaagcctcggctgtgttttcgctagggcatctaagagggcaataaaatgattcaaaaccaaaggaaagcttcagaatgcttttgaattttccctgttcatttttataaatttcttcgattattgatgcgagtattagtttaaaattttcctccgcattaattaggaaaggatttttaaaataaaatttggttttatattttgtaaatccaaattttaagtcctcatgacataatgactcaattacagaacacccttccattttggctgttgcccttttagtttttttgttcttatataccaacgtgctcccaaacaattgttttgagcctattttcataatttaacatttggctctgaacccttcgggactcgaaatgtaatctccgggcttccattaacgaattttgcgcttgttcctcgaattttgttgcctggtcaaaagttttgcatctctcgaactcgcgccatgcagattcagcctttacagactccaaattaatttggtcctcgattttgaaaatttcccaaattgaatcggacattttaagatataattcccgaacaccgttagcataaggagctttttctctagattttattgcctgattaagtgtttcgcgagaagacttggcaaaatcgccaacttcttctgctaacgccgctgcatccctccatgctctctctgtctctttttttgcagcttccaccaaaatggtattagctttttctgatttttcagaattcatttttttatttttcatttattaaatttttctttta

SEQ ID NO: 14603 - DNA, 1738 bp, Heterodera glycines
tcattttcttttgctgttctcaaaaacatttcttctcccaaattgtttcttccaattgccaatggtatttctattaattttcaatatttttccaatttctttttcactcattttcgggttttctctttttatttgccaataaattttcattttttccatgttttctttttccgttattattttccggctaattccaaattgcttcttccattttctaattactgaatggctaactccaattttcttactgatttcttcataatttttgtcccattcttttttcgaatattttcttcctttttgtttgtattcgtttgtcatttcaataaattttcgaacaatttcaaatttttgttcctcactaattgatttgaatttatataattttaattctttgatccattcataaacatacatattggcgatttgttcccaattttttcgctatttttctttcaattttttcccattcttttcttgggtattttcttcctttttgcttagttttctcttttattttataaaattttccaattatttctcttcttttctgttcttcgtttcttttttcttcccatttttctccaaatatttcttcaaaagatttttgttccaattttttcttttctgatccgatatgatcagttaggatgatcaaaaataaaattaaacagaataatgggcacaatttcatatgcattcttttaaaatattacgaattttttcaaataaaatgcacaatttggcagaatttgtttaatgttttgaatatattattaaaattgttaataatccataaatttgatgacgttaattagaaaaattttcgcctgttttgtaaaatgttatccaaaaagcaacaaaataaatgccaggtaattgcgataaataatttttaaaatcacaagttaatgtcatgaaaaaaacattttggagatggaaaggacggacatttgcggacggacacttgcggacggacatttgcggacggacacttgcggacggacacttgcggacggacacttgcggacggacatttgcggacggacatttgcggacggacatttgcggacggacatttgcggacggacacttgcggacggacacttgcggacggacacttgcggacggacacttgcggacggacacttgcggacggacatttgcggacggacatttgcggacggacatttgcggacggacacttgcggacggacacttgcggacggacacttgcggacggacacttgcggacggacacttgcggacggacacttgcggacggacacttgcggacggacacttgcggacggacacttgcggacggacatttgcggacggacacttgcggacggacacttgcggacggacacttgcggacggacatttgcggacggacacttgcggacggacatttgcggacggacacttgcggacggacacttgcggacggacatttgcggacggacatttgcggacggacatttgcggacggacatttgcggacggacacttgcggacggacacttgcggacggacatttgcggacggacacttgcggacggacatttgcggacggacacttgcggacggacatttgcggacggacacttgcggacggacagttgtggacagacacttactgacgtacacttgcgtacggacacttgtggacgcatacatgcggacggagatttgcggacagacatgcgcggacggccacttggtgacggacact

SEQ ID NO: 14604 - DNA, 822 bp, Heterodera glycines
tccgcaaatgtccgtaaggccaatttgttaattagatttaataattaaaaataataatcaaatgaaaaaaaaatcggtaaaataaagtgcgggcatatggtagcgaacccataatgaacaccacaacaccaatctgcagtttttaaaactttgattagcccatttattttttttaccgaaaaagtcattcttaagggtgtaaatattttcctttttcgtccaaatttgattggacgaaaacgaaactcaaaaagtaccgaaaatgtagtgacgaaacgaaaacgaaaaaagttcgtgcagccctgagtctcattcttctccgaatatttcatcaaaatttggtcggattttgcccgattcaatttcaaaagcaaagaaaattatttttattataaatattaaaatagcacaaattcatggaatatttataaaataaatataaaatacaaatttactgctttttgagggttggggaagagaattattttcatttatttcttatcgatgatcattagtgcaaatgagcgtgctgagacgatgcgaagacaaaataatcaaattaattattatcgggtgttaatgaatttaagggattatattttgtaagattcaattttatccatgtaacatccgttcgttaggccataaacaagccgtatcaactatgatttattcaattctctaattttcctggtcaagaataaccttgaagtaaaataaaattttcattttttaaaatttttagcaatattataattttaaaaatacttccatataattgatgagtatgataattatacgaatttagcaaatcgcataatt

SEQ ID NO: 14605 - DNA, 3584 bp, Heterodera glycines
gtggtgaaaataagtgatagacaataggaaataggtgaaatgtctaggcttaggtggtgaaaagcaaacagtgagacattcatgataagtgatgaaaaccaaaaaaataattaagtgttagtacatattgcttagaatgcattttcgtcgcctgtaaatacaatgtgatatagagtgcgcggtataaacaattcgctgaattttggctgggtagcccaaagtcattagaaagttaaacccaaatgttatttggaatgatccgggagatataccatatgatggacttttgaaagttaaagtcataccgccgaaaaggttgcggtaccctttattgccttttcatgccataggttatttatttttatgccaaatcgatttaatgtttaggatggttttttactttttccgacttgtggagagtgtgcacgtaagtctaaccaggaatttgttagggtagaatgtttcaagaagtacagacactcagcagaaggacggggtttagttgggttttcacttctattgtactccgaaaagcgttagaactcggctacaaaataacgaaattttatcgagcatacaattatgagaattttgacacaaatcttttcaaaaattatgtaagaatgtttttgaaaattaaaatcgaatcgtcgggctggccggataatacgactactgaaaagcaaaaaacgagttttttgagtatgcacaagcgtaaatatgatatagagcttgatcctaataatataaataaaaatccaggattacgtttaatagcaaaattggtgagaatcaaattcatttaaatatgtatgtaaaatcttagggcctaaactccttatggggtaaattttcaatgagaaactccctttgtcagaccaaagtgattaatagttcgactgagtggtataatcttttgcttgatgattctatagaactttctagcccaataataataaatgatgagatgattcgtgtgatctatagaaagaaggatagttttatcaaagaacacggagtctcgaacataatcatttctctatggtgtaaggataattcgacgcatttccctcatttaattattccttattggccattatcaattcaatcacatttatccattttcacacgtttttccttttctcattgtaatgtttctccgcccattctcttcgcatttctccttccccagtgatcagtcagtcagtaatgatggaacagacttcaattattattccgatttctcgcttcgtataaatccaacaacgaatgaataaagacatctttaacagtcaatgagtcgtttgggggttcggggcttggtcaaaggcgccttggcttttccccattccctcccaaactccatccgggataaacggtacatagttggtctgggggcgtgcgcatccctcactggtagcaccggatggttcccattttgggaaacgacgacccatcattgacgacgaagctgagaattgggtaagccggcagaagtttgtgggagatctccctggcctgagggctagaaacaaagacgtgtacacgcaagtaaagaagtctgacattttaaatttctgtccgggctagtcgaagactaaagggactttaaaaaagagaaaagatgtgagaaaatctgtccgggctagtcgtaaactaaagggacattaaaaacgaagagaaaataggtgagaacatttgtccgggctagcgaaaagctaaagggattttaaaaatgcaaaaaaaagaagaacgaaatttgcccgggctagtctaaatgctaaaggggctgactgcatcgaaaattgacaaatttgacaattatttgtaggagagagagagaataagaaaagagagtgaaggaagccaaaaataactaaaaaaaagtcctggtagcaaacgaataaggaccaatttataaaaatatctgaacgattgagaagcaaaaaaagagagagagagagagagaagaagtgagacaaaaaaaaatagaacaatttttttttgaggagagcaaaaaggcccgggctgataaccaatcaaggggcactattttagctaattaaaaagagggaccaattaaaaaaatgaaaattaggccctatcattttgcttacagtatgagatacagtttttacaagttccaaagttcattttatctctttgttttctctcgtttctcacgccataagaatattcacgtaatcacgtgccgccgcatttttcattgggcgagatcattcactttaaacatttttgcggcgcctgagaattgttaattgctcttgataggcggagtttaaacggagatggaacagataagcccattcctggaaggcgttcgcgtccattcgattacccgctatcattcattaattttttttctctctcaattaatgcataatgggattaccaaacaaatttttttttagcaaaataaaacaaaatcttattacgaactgaacgacttcgaatgtctacatcagggggctcgtcaaatgagttcccctttggtacatcccaagccttcgggcaggaaacaaagatgtttttgagtggaaaggatgatgagtcctcgatttcggctattgataggaaactttggcaaggaaagaccacgataaaaatctctgatttagaaaaagctcaaaatgatatggggaaattagaagatggagtgaacagagcttttcgctgcctgaatcgttccttgaaccaaaaagtcaattgggtgaaagatgtcgtggccaatacaaatgccaattttgagactctgaaagtccaattcgagaccctaaccgaaagagttgatatgttggaacaagacagtgatgggacgaattcaggtgggactgttagcattactaatttgaatagagcgtcgcgtgcgccgtttgtgacgccaatgggcaatgcacagcccaaccaagttgtaccgaaccaagtgccaattcatcaattatcaagcgaagacgaagatgacgggccgactctttttggcctgaacatgctctcgagcggacccacagtggggtcaggtttggaaatgttttgtgaggagtctgtttttgcatttgacgattgggctgaacgtttcaaggattacctgtccgtgtcaggcaaggcttacactgaacgagaaaaagtcacaagactcaaattggctctgagggacactcctcgggcactgtttaaggaattattgccagcacaaacggacactcttgactcagcattgagtgaacttcgacagaaattggactcccctcagcgtcgggaaattgcgaaacgaactttatcgctgtgcaaacaaagggaggatgagacagtggcgcaatttctgagacgcctaactcctttggtggatgcgacaaattcgtcattaaccggtgacattcgtaaagagaaaatttgcgaggaatttttggatagattgaagcctaacattagttttctgatccgtctggtgggtttgtcacgagcaaaagacttggacctggtaagagcacaggcagaggagctggaagctttactgttgataaacaaaggtgatgaagcatcacgcctctctcaggcagtccatg

SEQ ID NO: 14606 - DNA, 1603 bp, Heterodera glycines
tccacattaactttaaatacatttgcatgattctcttttttctaattccaactgctcatttccatttttgttgttcatttccttcgtccaaatgatgatatttgcattgttttgcttgtgttgtcgtacttttttgctggacaaacacacactctcttctcttcctgcgcattgccaaagtttccccccccccctctcctcctccctcttctcgagagtgcttcgcccaattctcgagaccggcgatcggacggaggataaatggacaccggcggagagagaagaaacggacggaagggacgacaaaaaggaagagaagagaaaaaggcattgtctcctcctccgtccgccccttttcttggttaaaaatatttcattttatttgttttgttttgtcgtcacatttttcgcgcatttttttcttttgcgattttggcgtattattgaaaaaactttgaattatttgtcatttttgctcaaattttttgttcctctcatcagcaaaatatttagtgggagagcgccggaatttgtttacatttattccattgtttggcttcaatggtttttgtccccgtgccttatattaattagttgcgaggtgtgcaaatcgtaaatgaatctcataatattttcacgtattaacaatgtgttgattttaatcaccattttaattaattaaatgtttgctttatttatttataattattttatttaattcgttttaaaatgcctttcttttccgccgctttttcctttttgcccgtttttctcttttccgcttctcttttggtcagtttatcaactgtttcgcttttgctcattcttcagttccttttcctcagttcgcttttgcttcggcttctgctgcgtcaccgccgcaccaaaagcagccccaattttcgcccgcaatgtccaaatttgcgcccaccgccagcggaggagtcgcgggaggagcgcaacaacagttcatgacggcaccgcagtgccgatgcaaagacttggacgaatgttcaaaggaaattgagaaattggtggccaaatgcaaaacggagtcagtatttgtggccaattagcacgaattaattttaaaatgccaaaaaatctttgctatcgattttttaattttttaaattgattattttaggccaaaatgcgaggcgcatttgaagaaaattggaaactctcaaaaaattcgtcaatgccttgcggacgagcaaaaggacatggaaaagttggaacaatgcgtggagaaagcggtcggaccaattgggtaaaaatattttaaaaattatattaaaataagaataaataaacaattcggtttttgagatgcacaaacgatgaacacccaaagaatttgaccattccaatcattccggaaatgagcgaagaaaacggccaaatgccaaacactgccagcggcgggcgacggcggcgaagtgcgggcactgtacccgcactcccagctacggtatcttaaagtttttaaatgtttggcgcgttgattcattgcgcaaaaagtgccaaatgggtgttccctaaaaagtgccgccattgttattttttcgagaaattttttgatttactaaatcactcacaa

SEQ ID NO: 14607 - DNA, 2780 bp, Heterodera glycines
tttagcaagaggacgggcacgccccgcctgagcttatcttctttttctttcgcgacgattccctccctttcactgcctaccgtagggattatctgatgtgcgtggaccaatgcgcggtaaaaggcgcttcgccggacgcgccgccgacactgagtgcgacgcgggagggcaacatgaactgtgcctttagactgaagtacggtgttcataattgaaaactgtgcctttagacttcactgctatatgattttatatgtacaataatatttaatttaacaaccagcctaaactaaatggttttttctcaaaaaaatatttaaattattctaaaatttttttttttgcttacatgtgcgctaatgcctcctaatgagcggcaggaaaaggcatttggcgattgtgagcaaaaactgggtctgacagcacaaaagcgactaaaaaagtaagtggtttttttgtcattttacatagagaatgacaaaatcaaattttctcatttcttttactttttgttggtaaaaaatcatggtattgtaaattaaataagaacgctatttaaaaatggaaagtatttcgctttaacttttggcttttatgaagttaaaaataatagaaaagataatgctataacatttttaaaattttttttttaactgacaaaatcactgggaaccacaaaaacctttctaaattaataatttcaggtcctgcgaatgtctgaaggcgtccggaataaaaattgtgtgcccaaaataagaaagaacgaagaaatgaaaaaaagccagccagactgatgagagattataattggaaatatttattgtcgtgaatcatttaaaatattatattgctattgtaaataacgggaaattgaataaattgttttataaaataatcgaactgaaataaaaattaatataaggggagacaaaaagggacaaaagggggaactgtcataaagcacaagggacttaatgaataagaaaaagcggaaacattctgagaatggtggtggctctttcggagcaaataaaaatcatttgaaaaatgggaaagacaaatttttaatgataattatcggtagagcccgtaaaatctccatttgcgctgcacagtcaaaagtacattaacattacttcttatccaagctataaaaaatactaatcaaaaaatatgaaaaaattttactaatttaaaagataaccatctaatttttgtttttaatcaataacttccatgcacagttttgaatgagcggcgtaagaatccgttttattgaacgggcgcaatgcgtggcgcaagaatcgcgacataaaatgtcgcgtctaaaagcggccaatcataaagcgagggttctcaattattatcagagtggaaaatcaattctcaagtgaacaaaatgcaaaaaaataaatttatatagtttagcaaatcatcaagtgattaagcatcgactgcgccttcagcggtggtctttttgcacttggccattgtaatcgcattgtaagggtcgatgcgctttcctcttgaaccggtgacgggcgcgataatggcgggcactagacagaattccaaaaaattaattgaatataaagaaaatccttacaaatttgttttggcatttctataaaattctttcattattaaaaatttacatttcaaaattaagcgatgttttaatgtttttggacttcaaaaggcagcagatgtgatagtttttacatcgaccaacggacgagaaaaatgaagaacggcggcagcagaaagaaaggccgccggacaaagggacaaaggtcatccgcacgcccaatccacttattaggggatatgctttaggttcgcggctctgctgaagggtgcatcacatttgaccttcaatcacaaaatttggtcctatttggataaaatctgttaacaaatgccactcaaatgttcaaaaaattttcccggcggcgccttagacgcctccggacccatttgttccccaaaagattttggaaaaagcacaccgcaaaaaaatcagtttttgaaaaagcaaaaaaatgtaatcaagttcgacgttcagacccgttcgcaaattggcgctgaccccccccccccccccccagacccattagcaaaaatttaggttgattccacatggtaaaggccaacttggacccactcttgctggcgctaacctttgaattaaattaataaagtgaaaaaaagaaaatttacgagcatttaaaaagaaaaattgacgtgatacctacgagataaagactgaacaggaagagggccaaactgtttcggagatggaatgatttggggaaaagtgattcaggaagggggacaaattcgaaagaggggggggggggggggggaatgtctgatattcaaaaggaaatctgagacatttcagatatttttgcgccggaatttcggattttgatgaaaatttttgaaagtccagtaatttaatatttttttaataccaaaaatgaaaagtgctaaaaatattttgaataatataaaatatgccatttaattatttgtacggagtaatgacaaaccaatgaaaaattcaggaatttttaaaatagtaacaaacaatgtttaatttatttactccaaaatttaaattccttaacattaatagattttatgtgaaaacttttttattatttaaaaaagtttgggttgttttttttggaaaatcatatcttggtgatatgtgtgatcactaaccattgtcgtggatggtaagggtgaatgcaaatccccgggattctccaccc

SEQ ID NO: 14608 - DNA, 1005 bp, Heterodera glycines
ccaaattttctttggataaagcaagccgcaaaaaagggtgtaactgtcccaaaaaaaattccaaaataatataaaattacataattattttgaaaatcattaaaaaaattttcaaataaatatataaaaacagtgtgaaatcactagggcataaaattatatgcacatgccggaacccgtcagttgggcccccaagtttgggcctcagcatgttatttctggctataacttttttctttgttaaccaaacccaacattgttgttatcattcgaaagctctttatatgcttctactaaccttacaaaaattgaaaagatttaataaatagcctgtaaaatttgtgtagaaaaaaaggcgactcattttttgaattctgttttttattggccattaagactaagttcttacgagtaaattattatggcagtgaatcgagccaatatttgcagttctctagtaaaattatttgtatcttttttaagaaaatgaaagtctaagaaggtttctcttgtaaaaacacagaattgattggccaaacagtacaaaaaggccaaaaatggagggaattttttaaatttttctgaattgatcactatcactttttctaatcccttagtttgtaaatttcaattttcggagattttcatttgatggcttttatataacgcccttttgaggttttttataatgactcagcaccaccagaaacaacaaaaaaatgaaactctgacacatacgcttgacacattcgagacactggaatgtaaaaaataaaaaaatgtactatcagataattgaaattttcaaactaagtgattagaaaaagtgatcaattacatgcttaaaaacggtcagaatcaatgtaaaaaggttagaaatgggttgacaaaaaatagaattagtggtgcgcttcagggctgttgcaagtttcgcttttcgcctttcgcttttttggctgaaaagcgaaaataacagtaaagaatggggtttttaaaataaacaat

SEQ ID NO: 14609 - DNA, 1643 bp, Heterodera glycines
caaaggcgactttatccctgtaaaaccaattcaactcttcatacacaaccagaataaagtgagaagaacgtgactttaaatattattataattaaggggaacacaaaagtcattatggcattatcatatttaatagctattcattattgagttaatgagttttaaaacacaaaaccctttttaattattgtccataataattaaccactaattgcttttagaatacaaaaaggataccgacaccctattacatgaagttgaatagggcggttgtcgaaaatacgacgttcactctccagggcgagttgcacccaaatgcacaatatttacgcgtctcatttttgtacaatgcgcacgatcggaatgtcgttggtaatacagtatccatttcatagacagtttataagaaattttcaaaattattttcttcaagatttaatttaaatccataaaattgtggtgccagaaggaaacaaatgttaaaagagcatgggaaaagtttggaaaagggagcgattgtagctcagttggttagagcatttaacggtatggaagggccgtgggttcgatgcccactgggcgagttagcttttatgttctacataaaataataattccatgttatttgttcaatattgattatgttagctttataatgtgtgtttagttggcgataccgttttcgaaatttgcgcaaacttttcaaggggtgtcgtcaattttcgatcatacccggtaattttataatttatttatttttcatatagataattagaccaagcattagtgatggtcgagaccaaaaatttcccgagactcgagaccgagacttgaccccgagactcgagaccgagacccaaaaaacccgagacttttctcgagtcgagactcgagaccgagacttttttcaaaaaattttcttacacacttaaaaatcgattaaaaatcatataaaaaatcaattttttaagttttttctaacatttttttgcctttttccttatttaagctatagtcagttttttcttttcatgtgaatgactttttacactatttttttgcggcgaacttttttaaaagaacttttcgggaatagaggttcggcggtgccgataggcgccgccgggggaaaatttagaaatgtttaatgcgccttgttaataaatttagtccaaaaatgacaatattttacgattttaattgttaaaattatgattgaattcccatcgaaaaaaacattaattttgaaaaaatgagaagaaaatataaatacttgaaggggagctgatccaacgcaaaaatacggaacagaaacaagaaccaacccactggacaacgtatatttttaacaaatctgaacaaaaaatgacctaaaatttataaaaatagaagtttaccaaaagtcaatcattaggggtgtaaaaaagtctcggtatcggtctcgagtctcgaaaatcgagaccgagacttaaaaacccgagaccgagaccaaaaaaaccgagacttttctcgagtcgagactcgagaccgagactctcgaacatcactaacagtaattttcaaaaaatgcaatatgcatttcataagtatttctatacaaaaaaatgtaataaaaagaaataaaaaataaaagcaaataaaca

SEQ ID NO: 14610 - DNA, 2024 bp, Heterodera glycines
ttgaaagagacaaaaataataaatatatttattaaatctatatccctacagtaattaaattaaaaaagtaatattaatgtattagtattaagtatcacattaagcgcttaaaaatttaaaaaataaaaagatttaatgtaaatgatgggtgagacaaaaagtgaactgacaaatgagttgtaaacaaattacttaactttctttctttttttggcaatttttctctaaaaaaaggatttttagaaaatatatttgagaaaaattaatgaatttgatattttctgaaagagcacacacatacttcattctgtaaaaacatattttattttatttgattattattaaatttttggcgaattaggggtcggaaaaatatgtttgtgtttttcaatattttttaaatattataagcatttttagaattttcatgtaaaattttggaattctttaacaaaaatgaaataaaaaatgatttatttttgacgcgatgacattttttggcgaaatttttacaaattttcaaaaatatttgacaaataaatctgtcgaaaaataatccccccgggatgataaaaagagcaaatacggaatcccttttttttcttaccattgtccgatagagtgccgtcgccatgcgttgagtcctcccactgattctgttgcccttcccactccatcattggctcgtcactgtttcctccgtcagccaatttgactcgcacgacttcggcataactttttgtcttcttcgtcgatggattgtcaaattgtgccggattctgttgacccttttgagagaacaaacaaatatttatttatctcttaacaatggatgggtagttgaacaaatgaacatacaaattgcatatggtccactggtgagagaacatcggccagtccaatggcttctaaattgtagcaatttttatttggttcgataaatcaaaattcggaatatgtgccaaccgaattcgttcggttcatcgccaattttttcgaaactgccgttgacactttgcattcgtgacaaagtcaattgctgattctccgcctcggcattttcaatggctgcttcactgacggattgagtgcgtccaatcgcacctggaaattgaaaacagaaatgtcggcatgaaaaatgccgtaaaaccgctttgaacaaatgcatttgtctgttggcgttgtccaaattgttcaccaccatccgcttccgtggcaaactgatgagtaataatgttcgtagctgaagggaggagttaggggtgtcaatgaatctcggcatttttgcttgcctttgtccggtgacatttcgtcgtcttcgtctgtatcgtttgccgaatttgtcacgattttggttaacaaattcatatttaattacctatgtatctaaaatttaaaggttgaaaaagtgtttaatctaaaagttggaatcttccacgtttcagactaatttcacaaagcaaagagagaaaaattaaaatatttctcttctacccaagagggaccgggaccaacccggaatttttaaaaattaaaaaaaataaaatctttatttatttcaaatgaaatatacaaaagtaaatttttattttgtttttttgtaaaagatttgaattaaatatttaaagaataaattttgacagcaaaggttgtgctctctgtgaccaaaatatcatttgggaaaccatggaaagtatttgactatgactgtacaacaaatcaagggcgtagccagacccttggcttcaggggggggggctgaaattaaaaaatcgatttttaggggtgtgttttccgttttttgaaatcccgaattaggggggtgtattttacaaaatttttcgccgtttttcgccaaaaaattacaattttttgccattttggcctctatttttcaaaaatatggtaaaatgggggtccggcggtgccgataggcgccgccgggaaatttttgagagttttaatgcaattttttaagaaaattgcttaaaattttaaaagatttactgaaaattttttacttt

SEQ ID NO: 14611 - DNA, 1348 bp, Heterodera glycines
ccccccccctgcctacgcccttgcaacaaattgaggtagtaatttaaagctgtgcgtgggattataagcaaatttataggcggggaaagatgaccgagggcgagtatgggggttggagatgcatttgcgactgagaaaggggcggacaggcacaaaaaagggacaaagaaatgggggggggggagcaacattcggcccctcgtcggagttgacatttgcaaaatgaataataaaatcaacatatttcattcaaatctgcatttattggaatccaactaaatgaatgggaaaatgccgaggacgggggaggagttggggaagcatttgctgctgctctgctgctgaagaattgggcagcggtgggcataaagaaagggacaatgaatgagcaatgggcaaaagttcagccccacgaagatttatgatttgcaaaatgaataaaacaacaaatcatcactttattttgtatatttgctgtaatccagctacaaacacgtcagcagaatgtaaaagtgcagaggatgggctggctaatgagagagatttgcacaatgaaaggttaagtttttgcctgtggcagagaaaatgtcaccgattgggggggggggcagataaagaaagataagggaatgtttgtgattgacaaatgaaaaggatcggtcggccgatccttttctgctcgccatccctgccgatctgctggagaaaacggggatcagtactgcaaagcacaaagaatcgaaaaccaacaatacaaatgattttgaattcagaatggtaataaaattagagccaggattattgtaatggccgggaccgggatttggaaaattgatattgaccgggacggcatcccgggtccgggactccggttttttgggaccggtctcggtaccaatttttgggccggggccccgccgggaccgggagtatttcaaatttgtgcaacattgattataaaatttaataaatggcaatattctattttagctttggtatagaccaagcaatgcaatgaccttttttgtttggtttcaaaagacttttttagggacgcttttgttaatttcaccaaaaactaccaaatttgcgattttgggccaatttttagggattttaatgaatttttgtaaaatttttattttttttctaatgccgatttccaagggtatccttggataagcattacaaccacgggggaagaggtacaacagtgattaggagagatattagatgcattataatttataaaaaattttagaacaaattctacttttatttataaaaataaactttgaattgtttaattatagaatatttattaattaaattttatttttttacaaat

SEQ ID NO: 14612 - DNA, 2090 bp, Heterodera glycines
taactcgtcaggggtcggttttagccaaaaaatgccttataacatttttgtagagcattttaaatgctatcgaatggtgtactatatgaaaggaaattttcaaaaattttcgagctaggccccctagaaattttcaaaaattttttttgggttgaaaaagagggtgaaaaatatttttctggggtaaattagggtcctgagcacaaatatgatgtttattttaagtttcagattttttggaatattttaaaaattctttattttttggcaattttttggccctcgggattttggcctaatatttgaaaattcataacaaatcgaagggttgatcaattttacaggaataaagccttaaaaatagagaaaaatcaggagaattttatggactttatttggaatttctatctaaaaaaggaaaaaagttattccagaatttctggaaaaattcgaattttcagaaaaaaattcataactcggttctgaaaagatattctggaaaaataaaatactacaaaaatccgcagttttttgctctattatataaattttatttggcatttttatcacttttttaagaatttttataaaaataaaagtgattttgagattcgggaccaaaggggggtgaccaggatttttgagtgaaaaaattttttcgacaaaaatcttccaaaaacatgtctttaggggttatttgggccgctgatcacgaatacgtgatcagattttacgtttgacatcgttaagccctcagaatccctgtgtgattggggattctgggacatgttctgagggggggggggggggcagcaggttcgaatccggacggtgtaacattatttttctttgtatttttggcttattttacaatgtttttaattaatttttgaagatttcttttaaattatttaaatttattttttttaaattaaagaatttcattatttatttttgaatttgtaaaaaaaaattcatttaatttcaaattaaataaatattcaattaataatttccaaggttgtttttaattaataaaagagtattttattattaaaaaatttttaaattaaaatgcactcgatttttaacttttaataaaaacgtttccttatttatttaattttaaacaatattgtacctctcctaacaatgttgtaccacttctaatcacagttgtacctcttctcatcactgttctacctcttctgatcactgtttacctcttctaatcactgttgtaccacttctaatcacagttgcacctcttctaatcactgttgtacctcttataatcacttttgtacctcttctaatcaccattgtacctcttctaatcactgttgtacctcttataatcacttttgtacctcttctaatcaccattgtacctcttctaatcactgttgtacctcttataatcacttttgtacctcttctaatcaccattgtacctcttctaatcacttttgtacctcttctaatcacttttgtacctcttctcatcacttttgtacctctgttatcacttttgtacctctttaaatcacttttgtacctctttaaatcacatttgtaactcttcatcaaatttgtacctcttctaatctctgttgtacctcttctaatctctgttgtacctcttctaatctctgttgtacctcttctaatcactgttacacctcttttatcacttttgtacctcttcatcaaaattgtacctcttctaatctctgttgtacctcttctaatcacttttgtacctcttctaatcacttttgtacctcttttatcacttttgtacctcttaaaatcacatttgtacctcttcatcaaatttgtacctcttctaatcattgtttgtacctcttctaatcgctgttgcacctcttctaatcactgttgtacctcttataatcacttttgtacctcttctaatcattgtttgtacctcttctaatcgctgttgtacctcttcatcaaaattgtacctcttctaatctctgttgtacctcttctaatcattgtttgtacctcttctcatcacttatggacctcttttaatctctgttgtacctcttttaatcact

SEQ ID NO: 14613 - DNA, 4187 bp, Heterodera glycines
  misc_feature (35)..(35): n is a, c, g, or t
tttacctataaaattggctaattttcagtgaaacnctgtttataaatgatcaaaatttccaatttttttccccggcgtcgcctatcggcaccgccgcgcccccaaaactcctattttttcttagaaatggcccaaaatcgcaaaatttggtaatttgatgaaaaactgttctcagcgtcgccccaaaactcctatttttcattagaaaaatgataaaaatcacaaaatttgatcattttttagtgaaaatctgtcaacaaattttaatcaaattttcaaaaattttcccggcggcgccgcctgccccctcttcccaaaaagtttttttggaaaaagcgcgcctcaaaaaagcgttttattgatttttaaatttggaataaatttaaaaaataatttttgctttatgattttagctattaaaaagttgcagaaaaaatttcgctttcgcattttcgcatattttagcttttaagtttcgcaaatttcacttttcgaatttcgctttttatttttcaattaaaaatctgattttttgattccgaatgcgctaaaattgatgatttgctaattttctccccaaaattgttaaaatcgataatgggagacgaaaaatataatatttgatacatttttgatcgaaaaattgtaaaaataactgatttgaagcaattttgcaaaatgtcctgattttcgaccccagaatctgattttttggacccgatgttctgattttgaaaatttttcgatccgagccctgccgtaaagtatgaaatagccacaaaatgacataaaaattacttttttggtatttttaggcaacattttcaaacttattttttctttataaattttcaaaatatgtaaaaaaatgaaaatatatatgaaaaaaatccaaaatatgtacaaatatgtaagaaaatcccgaaatatgtaaaaatatgtaaataaaagtcccggtttttgttcgcaaacacaaaaaagaaagtgtttttcctgctatttagagcaaggagaagccaggaaaaaaatgtatttacataaaattggcagccctacattcgaccaagttaaatataaaatgaaaaaagaaactttagctccacaaaattcaaatttctcctcttcgatggcgagtttggcacctgtcgctgtgcccgcctcggacggcggtggtggcggcgaatgccatccattggcgagtggcgacagtttggcgactaatgccaacagcggcagcagcacatgcgcacactgtggccgcgaaaatgcatccacgtacggggagcgagggcacacattttggcccattttttagggttccaagttttaaatttttgggggttttagccgcattataaattgaaaaaaagagaaagtaatgggatttagttaagaaacaagtttaatttttgcaataatgaaattcgggcggggcatttttaggagccaagaataattaatgcatttttaattcaatttttttttggggggttttccgactgattttgaaatgtctaaaatagtgattttttttagcttcttttgactcctattggaacccatttacacatttaacttcctccaaatccgctttttaatgcaattttttagaaaatggatcccaaattcgcccccacaaattcaatgccaatttttccagtgaatttgccgactccgctgggcccaatttgctgctgctgctccacgccggtgcgctcccctcacaggcatggctttatcctttggctcctaacaaattttctacacttttcatggcatggcttaatttttgtcgcctgacgggggatgatgtccaatttttctgacaaacttttttgggaatttggtcaataaatccgcttctgtttgcaaaattcgactctgattgataagtggtcgtttttgaaaatttattaaatcaaaggaacagaaatcttttctcattgaaagtcgcgaaaaatttttcccggggattaattaacgaccctttggtcgaattcaggcctgatattcggaattggttgaaatggtggtcagcgactcacaatctgaagacccccgggaacatttttctcgacttgtcaccaacttaaaaattttttggaaatttgtaacactaatggaaaattaaaaaacaaaaaaaatatttctaaaaatttaggaagcaaaactgttgcgcaaacgacgcgatttggcatgccaaagtgccgaaagtgttcctgccgctggcgacgacgagccgagcgtttccgaatggattttctgcgatttgtgccggaaatggtttcactgtgtgtgagtgaagcaattgtttttttttcttaaaatcaacaaattttcaaccatttttggaaactcactgtttaattgaccacttagtcacaatagttttcgcggatttaatgtcagtggcaacacaaaaatttaaaaaaaaaccggattttttttttgtttgaaacccttcgctttaagttgtgtcaatgtgcaggaatatgaggtaaaagacaaatgcgaaagtgcacacttttccacgtgcttttgaaatcgtttcccccggcatttgctgattcagaattattattttttcaatccctgatcgccttaacagcatttaaataagtgattggaaattttttgaaaaatcatcaattcttcaaaacaacatgattaatgcccccaattaactagaagactacgatttcttaattttaatgctgtttaggctatcagggcttgaaaaaatttataatttgaatccgattcaggaaatagcgcaaatgtccggggctcctttgaaattatgagaattttaaatctttttttaactttttttcaggtcccactgatcgacaaattccattgtccgacctgtcgctttgcgcacggggacagcatcagtgggttttggcaaaaaattattttctaaaaattccagccttttttcaaaaaaagacccctccaatgattttaaataaattcgatttactcattttccttttctttttgcagtgaaagtgcgccgtctttcccatcgctatgcctttgatgatgagtcggagcgggagatgcccgagcaaatcggcaccgagcaatggattcggcactttcgggagcgctacaaccaattcccggaggcgtaagttggcggacggtgcggtggttacaggggctgtggctgtactccccccttcgctccttttaaaaatttcagttttttaatactttcagtgccccccccccctttatggcaaaattttttgttcttttagttgcattgatttgggcattttttgggatcgctggtcacgaaatggtgacatccattttagcctgttccgaagtcgaacaaaaagtcgaattttaaaatttgcactttcaacatcaaaaaaaaaagtcataccgattcaaacacaatacacaattgtggatttttgttgatttccttgtgactaaaattaaaccaaaataaaatcgaaattttaattcattttatttttctctttttctgtcaatatttgttgagtgctgatttgtccccatttttcagtcatcagccgtcgctgatccaagtgtttgaccacggcgccgaaatgttggccaacttcgactttgagaagggttggcatttgcccatcaaagtgtgccatccgcatgggctcggcctgcgcatgccggacgacccgtactttgacgtgttggacgtgtgccgtcttttgagtgcgttttgaacgcgcatttcttggcaaaataaaattgacatattatgttcaaaaacaaggtttttttgatttttttttttcaaataaacgaaaaatctatggtccaaagaatcttgcggagactttttcagggatattccaagggcaccccaaatttttaaggtaaaaatgcaaggcctacctcatcaaaattcccaaagaattttttgtaaggaatttttgtcgtttttttctatgtgctcttagcaaattttgtttttgccagaaaacataaattggacggcacggcataaaatgcgtacataaaaagccattcaaattgccccatttttcaacttttccccaggcgacgccgtcaccgtggacaccatcgacgtgtacgcccagcgctcgtacacaatgagtttgggccgcttttacggcctgtggcgcaagcgggtgagagaacggctgtacaacattctgagc

SEQ ID NO: 14614 - DNA, 1915 bp, Heterodera glycines
ttggggataattgaattttgtcaacgataaaaaaagaatttccccccctctccgaagcattcaaccaaatttttgtcattcctatttaaaggaaattattaattaattgtcctcctcctccaccttatctctctctctctctctcctctccctctgaacattgttttgtcccctctctgctgacgctcatcatcatcatctccctgattagattagattccgataaatacgccataacattcattttgttcatcgtaaagagagagtttgagtgggaggagggggggggggggggagttataaatttagtatggtgtcgactaatgggacaaaattgagcgggcggacaaaaaataaggggggggggagagagtgattgaaggcacccttccgctgaagggtttacaaaaaaaacgacgaaaagaaaagaaatataattgaaaagataacaaacattttgcaaaagtataggggcagggaccatcaatgcaattgttggacagttttgcaaaattttgcaaaagagccaaaacaacaaaaattgataatggccccggggggggggaggggggagagacgagcggtggagacaaaaattgctcgtccgttgtcccattattgatgaggaatgagagtgagaggggggggggggggaggaatagaataatgggaagaagggaaaaatataaataaaaagaaaaaatttgaaaatttaatgaaaactgaaattaaaaataaattgccgagattctgaagtaaagtgtcaacgttttaccaacaaggtcaagttgaactcatttgtaagaagtgggacttgaaaagtcatatttttggggcgagatattatgaattttttgaaagtgaatctatcatttgtgtaataaattattaaaaaaaataaaaataaaatttttcttttatcaattaaatcttattatttatttgcacatatttcaaataatttcatctattcgatagaacattctaaaaacttaaattcgggggtgaacctatcattttgtgtcacactgtaataaattcaaaaaattcagtaaaattgagttttgatgagagagcggaccctaaaaaggcatttaaatatacaaaaaaaagaagatattaatctgatatcaaagataagaagaggaaaggaaggaggaggttaaaggatgaaataaaaaaactgaagaacaacggaagatgatgaaaagtgcgttatcaaatcacaccgtttcacttccatccatcacatacagtcacgagggcatgaagttaaaagtatgatgatgatgtgattgaactgacagacagacaatgagagagtgagagaaatagtacataacattttctctgtttggcattgtgttcttatggcaaaaaaaaattttttttttaaatgaacagacagcacagaaggaagaggaggagggtggaggtcaactggaaaagcagcctactattttggattttttgggaaatttcttaacagaaatgcaataaaaatagacatttcaatgcactacaccccccccccccccctcccgccgttttgcccggaaagtttttttaaacccgaaaatttttaagttttctaacttttttcgaggttaatctaaaaaaatttcattaagagaattctttcgaacttaaaaaaattccaagtttaaaaaaatatatttaatttttccaaacaaaaaaagccctaagaaaattagaaaactataaatttatcagttttttagaaaaaaaaaaattccctgggggaaggggatgggaaacgatacgaggtggaaacgaactgctccccctctcttcaccacccccactaacaacagtcactcccactccaccacccactttttgcattaaaaatattttttgtttataatgcatttttatttgccccatcgtcatg

SEQ ID NO: 14615 - DNA, 1215 bp, Heterodera glycines
aatttttttctggctatgcctgattccattgatatgtgatgtcatttcaaattctcaggaagtttaatgttgaacagggggcaaggcggcttataatccattagtcaaggggccaataattacccctcttttgttcgtccgaccggcagccagcaacagcgcttcgccaaatgccctttttatcaaagtgttgtgcacacattttctggccttccacccgccccccccccattcatacctaaccctttttgtgtgttcattttacgcctttttcgacggactatcgacccaaaagaaggcgagaagtgaatttggtgaaatgagaagaatgagaagaatggaatgaattgaaatgaaatggaattttgggcattttttgatgggtatgaggaggaggacgaggagatttattgcaataatttgacattaaatatgtaaaagaaatggtcaaattcggtaagaatttaaaaaaacaaagaaaataaatacacaaattccggctctagtgcacactttatgagtccaatcgacttttatgagccaattcttcagtttctttggccataacttttttcttacttggtcaatacatacattcttggtatcaaacgaaaacgtagtcccgggaatttataaatacaagaaaatagcaaacactgacagcaagtaaaaattacaataaaaaaacgaaatttaactcttttttttcgtttgataccaagaatttagggattgaccaagtaagaaaaaagtgttggccaaataaacttaagattggattcataaagtgcactagagcccaatttccttaaattgcactacaaattccggacttcaaaaacgggaaaatgcatgaaaaaaggacaacaaaggatgtttttgtgaaaaatatttaattttaaatttcgaaatttaatggaattacggaattacaacaacaaaaaacaacccaataaaaaagccgatgaagaaaaagagaagagagccaatggagcactaattttgtgggatttctaagacaaattcttttatacgtgcccttatcccctacactgagagagctagcagcacaattagttttgtgccgcctccaatggcaccggggggcccaattggccggcccttaagggcatgtaagatgaaggaggaagatgcccccgagagggttggaatgaggaggcggccgggatgggttcaatttggattaaatgctga

SEQ ID NO: 14616 - DNA, 3419 bp, Heterodera glycines
  misc_feature (19)..(19): n is a, c, g, or t
  misc_feature (31)..(31): n is a, c, g, or t
  misc_feature (445)..(445): n is a, c, g, or t
ttttgggctgcgcttttcnggggaaaaattntcggtctaactatccaatttttgggttcattttatgctaaaattcattggttttttttaaattcataaaatttcgagtttttttctttgattatacgacgggttctaaatttttttttcacaaaaaaaaaatggagacttcgcgtttttgcaggtcaaggccagctgggaaatgcttgatgcggagaagctggaacatgcggtgaagatgaaggagcgtggcaccacctttttgaaccagggcaagcacaatctggcacttgccaaataccaagtgagtgactttggcagaacatatcagatgttgcgttttgatcaatattttctgacaattttttgcaatggagccaaaaaagccgaaatttcaaaaaaaaaaattcagcggcaagattttcgagtgcacccgccatattanattgtccaattttttttttgtatcattttttttcaagtcggtcatttctctattggaatacgcaaagcccaccaaatcggacgaagaaagcggcaaggagttgagggagcaatttgagcagacattcatcgcagcattggtatgtttttctgggattgtttgtttctaatagatcggacaattttcggggcaaagataaagaaagaaagaaaactgtcttacaatggcatcaggggcgtatctagaaaaaaaattttcggggggaggacccgatctgaagactttttttttgtattcacccaataaaaaaaaatttttgccgttttaaggcaaaaaaaaacttgtaaaaataatggaaaatggaggtccggcggtgccgatatgcgccgcaggaattttcgcccgaaatcctgtcctggaggtccgtctcgaaatttgttttatttatgaaaatttttctaattgtaagattttttccttgaaaaatttctgtgttgcaattttttttaaatttctccggttcgacagacattgatgacatgtccatattttcagaaaatcttatttcttaattaatcgtattatttgttttttaatttttttttttttgtagctaaactcggctttggtcagcctgcgcatgggcgagtcggtggaggccatcaaacactgtgacaaagtgttggagaagcagccgaccaatgtgaaggcgttgtaccgtaaagcgcaggtcaacaaaacgataaaaccgaggaggctctttcaggggaaaatgagagagtgtgtgtttaatgaatcaatcgaaaaaatacggaaattttttcttgatacaaacaatgtttcgaatagaaaatttaaaaaattttcattacaaataaattttgttttctttaggaaaggggatttagttgcttggtttttttaaaatataaaattttgaaaatttcagttcgaaatttcttttaaaaagtgtttgtgggggaaacgatcgggggagggggcgtgggtagaacgttttgtgcaaacgacggggtagagaaaaatatgcatttagatttcttatctcataattttttgggtttcaatttttttttttttgcaggccctgcaaaaccgcaaggattacgcggaggccattgagcagtacaagcatgtccaccagttggatccatccaaccgcgccgcggcgcaacaaattttggaatgtggccaacagctggccgcccagcgggaggcggagcgcaaaaagtaccgcggaatgttcgaacggatggccaaagggacggacagcaaaagcggtggtggaggtgacggtggagcatctgctgctactccttcagcgtccgacaacaatgcggaaggggtgaaaaaaacaattcttttgtttttcaaaaaattaaatcaattttcatagaggggggggggggtagcaaaaaaaggggtcaaagtccgtgaaaaaaatgtttatcttttgtcattaacctaatccataccattgagcgcgaggttgatgcgtgacaaacctttgagaccggaattttgcaacgaatgggactggaacttgacggtggaccggaatttccgactaactttctcccttccataccccacccccccttgtttggaaaaaatttttcttagaaaattgtagaaatagaaaatagtgtttttgtgaatgtaattattttgaaaaacaaatcttatcttaatcatttcaacaattttttttaaattttccgcggtcgggaaacgaacgaactgcttcagtatccaaatatgacggaatagattaaacattttttcacacctctgctgtcaattaatttttttgttttatttgtcagcagccgtcgagtggcgccgcctgaactgagagaggagcaagcagtacatcacgataaaacagaccggaaaagaaatgaaaatggagaatcacaaaataaaatgttgatttttttgacgcttatgatgattatgatcttaaattgtttacttattttgtttttgtttcctcatccatcatcaatcatttggttgtttcaatgttacagcattatcgttttaattttgctttttacaaaactgtgtgacatcatttgtttaagaaaaatgttataccaacaaatttggttttgtattggttaatttgtgagttttggggggctattttcaagacccgagattgagaatcgaatgccaaaagaattgtcattgatgataggatagacctgctgctattctgaattggcatgcgtaaaaaaaatatgttttgcaaagactagtgtattcagtggggtcagctcaactccagagacatgttggaattctgctgatttcgacatttttgggctccgactctcggaattttggttgaagatacggattattatttgagaaaatcaatcgtttaaggttttttggccgtaacattttggtaatatgacaatttttttgggtttttacaagctaatagaagcttttaagagctacctgaaagatatcaaaatatttaattttggagaaaagttgtgccgtgtcatttctaataatggcgccgaatgtgggcgttgaattgggcggttccccacacactcactcaaaaagttcctctgtcatgcactattttacatctcaaagtgtctggcacttactatttcttttttattcttgatctctgtcccaatcgctgtgtttaaatgaagtcatttttatttctccaattgttgtaatgtgagcagagaaagaaaaattaaaaaatagtgcaaggcagagaattttactccttaaaaatatttagacaaatacagtcatggtcataagtgttgtcccatcatgctttgaaaaaaatattgcgtataaaattgtcattttccaatttcaacagataagtagcataccattggatagcattttttatgggctttccctcgggtgggatatttgcatttgtgacataaacatttatttgatttat

SEQ ID NO: 14617 - DNA, 1828 bp, Heterodera glycines
cggattgacaagtgatcgattgacaagcagtgaacacttggttgtccaaaaaattactaaatattgcgatttttatcctatttttaagaaaattccgcctgggattgatttggaactcaactttttatacttaataaatcttaccaaattttataggcatactccccggtaaaggactaatttaacctgaaaatacttcaacgcttattggttttaagaatttttttcaaattctgagtttttgaaaaaatttttatctcacatatttttcgataagagtgatcagatgctcaccaaactttgcagagatacttaagtcaagagaattaacctatgattaatttatcttcccatttattttgcttaaaaattttataacatttttaattgtgccctattattttaggtttttttagtgaaaatgtaattcctcaaatttttcaagtagtgatcggcagaagcgtaccatattttggaatttttaattattatgcacttgaaaattatgggtgcaaattaattaaataattttattcctcataaattttatcggttgtttttgcaattgcaaatcaaaatttctcaaggttttcggcagtgaagctcactgttgacccactcgcgcatccattcaaatttggatttgattttagagcctttagaattagcaaaaatgcaggaacaagttgacttttcgcgcgaaaaatggattaatgaattaatgatttctgttgatcaagcattcaataggcacaatgatttgtcatgtgccaaaaaatgcacgaaaaatgggaactctatctaaaagaaaactttttctttatgaatgataagtgatggctttcttatagtgatggtaaaataataataacaatatacgcttataaaaatataataaattaaaaataaataaacaaaaattttggtttggctaaaagatattattttaatatgctccatttatttatttatatcaaataatgtccaattttccattaatgtctaatttttagtgtccaatttccgtccaaatgtgcgggaattttttcttttaaatttaaaaatataaataaaaaacattacatatataatttttcctgatcatcaaaattcacatttttaatatgcaaaattggtcaaaattgattttagattttctgtcgtcatttgtattcacattaaaaatcaatttcattttcgccatttcagctgaattattgtatattttttttgaaaaaaaaaatttttcttagcaaagcataggcatttcgattttatttattttttctacaatttttaatttggcattatttaatcccacttattgtatttgttaggatcagcaactgctttttggcatgatggcctctggttaatcctttttcttttatacgtaattattagggccgcaacttttagtgacgaaaaataccgaaatagttaactaaaatagtgagtaaaaatcccaaaatagtgaagaaacagtgacaaaaagtccgaaatagtgacgaatagtgacataattttcagccaaaaattgagcaaaaataatttttattcactatttgcagttgcaaatgagtaggactgggatttttatgagcaaaaaacccaaaataattacctaaaaaagtttttaaaattaaaaatttttgccaagaaagtaaatttttgagaaaattttttttcatttcataggagtatattttgaaaaattttagctcgattcttaggggtgtattttttggttttattgcatttttgttaaggaatttttccaaaaaatgtcgaaatagtgaaaaatagtgacaaaacgccaaaatagtga

SEQ ID NO: 14618 - DNA, 2191 bp, Heterodera glycines
ttattttgttcatcctttttttttcatacatggcaaaaaactttcccgtcggtgaatcatttcttcatttccaattggccacttttggccaatccttcgtttttcattttcattgattcattttacatccgcataaattgttgcataatattaaatgacatttttccgaaccaaagtcttcaaaaatgttcaatttcttttttctgctgatcttcgcttcttctgcccaaaattcgtttcaacaaaatgtaaaataaattcgacattattttgtttaatattttattttttcgtcaaggaacatttttgccattctctccatggtaccgatgtctgtgttgaatgtggcccattggcggcggacaagcaaaaatgtaaattgaaataaacaaagaggaaaaacgtcattgtttgattcacaaaaaaattaatattttgaatcaccaggtgatcagttgcgcgtgcttttccctccgtcaccaatgcctttgaaagtgccgcattctccgcagctcccttctctggtcattaacaatccatcgggagcggaagcaaaaaaaggaatgccaattgctgtaatggtaagtcgcgaatacattatcaccgattaaaaaaaccaaaaaatttaatttctattcaatgaaaaataagaactaaatttaattggttgtaattaatcacaataaaaaggattactgttggatgagctgttcaattttgttagtttttgaatattttagaatacattattgtcaaaaaatgtcgaattagagaaaaaagaacagcagcgaccggcgacgaaattgaacaatacgcaaccaatgagccaacatgatcaagtgcagcactttaattatatattttaaaatcaattgaatatttttcagccaaaaactgttcgcgtcgccaaaaaatcaaccagtgatttttatgattaaaaatttcatatttaaaaaaattaatcatttaatagtgaataatgggaccacactaatggcaaatgccctgcagatcagcaaaaattcaactggtgagtgttttatttacattttattttaaccttatttgaaataactttatttatagaatttttattttcagattatttgatcgacgaagtgttatctttgcgaacaaaaatcaacgaaattgagaacaaaatggacaataacaatgtgagaaaaaatgtttaagggtctttttaaatatttatacttaattagcaatttttggcattaaatttacgtggcaccaacagtcaaatccatttgctgtgttgattgaactttttgctagagcttaatattccttttttggttttaataaatttttacatttacataaaggtcattcaattcaatgaattacgacagaacatcacgaaaatcgaacaactcattgtaagtattgtacaaacacaaacgtgtgaagaatatttgaaaattcaaggataattcataaatttattaatatgctctagttaatattttttacttccattagcaatttttcgctttaattttcattacccctatgggcaaagccaatcatgtttgtttggttgaaacatttaagcttaatattccttttttaaacggttggatatttttcagccaacaaatatcagcgtcgccaataattcaagcagtgattttatgtttaaaaattgcgtatttttaaaagaaatttaaatatttgtagacagcgtgaagaagaaactgtcagtgcattcttaaagcgattgactccattagtggaggttgtttatgctaatttggggaaaaagcaactacgagagcgtctggtagaagagcttcttgaccgtttgaagcctaatatttcatttttggtgagagttgcaggattggctaaggagaaggatttagaccaagtgaaagctcaggctgaagaattggagacacttctagcaactcaaggtggccaattaacccactcaatttctaagctaaataccgggacgaaattgcgcacatcggctcacatcttttggcttatgccgtcagtgctcctcacttttggacactttggatgaggagaagaaaaaagtagtggcacggtatgtgaaggcgtgccaagacacaccgaaaatggctaatgagggaaaatttacggaaatattaatgggaaaggaaaagcggcgcctcgtcttctgcacattaagcttggcgga

SEQ ID NO: 14619 - DNA, 3404 bp, Heterodera glycines
  misc_feature (49)..(49): n is a, c, g, or t
tagggccgcgatttctagtgaaaaaacttttttttttgctcgattgatntgaagaaaggagctcaaaaacgcatttctgcgttcaaaatttttcatttgaacgttattttcgtcactagaaatcactattttcgcgttttgtcacttaaaatagtgaaaattcacttttttggcgttttgtaaccgcaagtgtcagcgccgcaacaaaaatgaatgatatattgaaacagagcagacagactttatacgaagaaaaagcacttttaaagataacaataaagcaggaaaaaaagaataacccatcacaatcattacagaaataggaaattacagcaagaaattgtctttaagaataattccaattagttaactaaataatgacgaaaaaagaaacaatggaatttatgaacagagaaaaacccaatttttttagtttttacgactaattttggaaaatttttaaaaagttagtttatattttttcaaaaaaatagttaaataaaaataactaaaaaatccgcgcccaacttaccgtcacatccattgagaaagaataagctaaatttaggggaaagaaagcatcgaatcattcaatatcatctctaatttgaagcaaaaatggaaggaagctaaagaatatggaacaagcaataaaaaccaaaataggcttttgcaacataatagcaaaaaccaataagacctcaatcactaccacaatgggcaatttacgtcggtcaaatcgtcggcgacgacgggcagaagaattctttaagacaatcaaatttttctggctatttacttgctttttggcactgtcactgttgttcaatgtcgacgacaccatgccattcagaaatttaaatgcatcatttggcgttgctaatgacccgttgattggttccaattgtttgatgacggcactctttaccggcaattcatcgggcaatcccttggccaattgcatcaattgggtgccaaaattttcgagcggcactttggtttgtttcttttctgacactttcaattggtccaaaactttttggccaagaattcgtattccttgttcgttgatgccctttttggcacaaatttgttcaacgatttgcttaatctcgttgatttcttgggcgaactctttaatttgaataacactagcattagaaattgtttggcaccccttttccaatgcccactcgaataaaacgctaaaattgaccaaaacaatgtaaataatttaaaacatttaaatttgaataaaaaactaaaaaaataataaaatttgcctgttttggtctttcttgtattcttcacttttcataactcctaaactttgattatgttttcattttttgctaaaaatgaatctcaagcacctctaatttcaccgagaagctgctcattgccattgcttgaggaaaaatagcaaagcaatgccaaagtaaaagaaaacaataagaaatgcatggtttttgttttcagaattagaaaaatgaataaatggtaaagatgggggacatatttttatatggattaatattagcaaacataatctaattatttcatcattttccacctcagaatcgatattgccaaatcatcagcattcagctttaggcaccacagcgccaatttgtaagccacccttgccaaacaaacatacaaccgggggggggggggggttcgtaattggagtcgggtgagggctcatagggagaaaaggggagaaagggtcgacgaggggggggggaagagaataagagagaaacgaaagaaaaatgataattcatacagctctcttaataatttcattaaaatttctatattttttttctcgctgcgatttaatacgtaagaaatttcatgaaaatgtgtaactttcgtaattgaagctggaaagaggggaggagggggggggggctctttgtaatcaaaggcggtcagaaaattaaggagagaaattgaatgccggcgaagggagaaaagcgaaaattgttgaaaatttggaataaattcatttacaaattcattaaaattgcaaaaattttttacaactagtggaattgtaaattaggagtgatactgtatgagagaggaaaggtcatatttttgcacaacgatggtagggagcagggatggcattccgaggccccaaaaattttcgggcggaattccgaccccaaaaagtctggattccgaccccaaaaattttcgggcggaattccgaccccaaaaagtctggattccgaccccaaaaagtctggattccaaccccaaaaattttcaggcggaattccgaccccaaaaagtctggattccgaccccaaaaatttcggaagccggaactcagaaattccatgcaatcactggtagggagagaatggagaatacattaagcgaaatatcatacacggcgagtcaattttgggctcccagtgcaaataagtttattttttatttagtaatcagaacgccaaaacttttctaaattaaaaatttttgttaggattttcccttgtaaaaatggaaagagccgatctcgaattaaaaagcattttggtaaataaacaaagcattatcctataaatggagtaaaagtatgagtctatgcaaaatttcaaaaaaatctgaccctaggaaaacatttttgaccaggacaaagttttttcgttttctctcattttggcatactatttccatgtctctgacatataaaataacacatgaatcatttatttgccaataaacaatttttttaaacttttgactaacttagaaatattcttcagaattttcccttcaaaatgagcataaaatggttttatttggtctataattgacaaagttataagctaaaaaaatttcataaaatcaagggtaaaatatagtgtctactttttactgtttgtatttgttcttttggcgttctgtttttattattattttatttatttgctttaaaaaattgaaatttatacacaaacacaggaggatttgaacctgagacccccctttttttgactaactcacagaccactaagacgaaaaaaccaacttaattgtacttgcagcccaaaattgaatcgccatgtctaaaaagtcatggaaacatgtttacggggattttcagggtcgctgataacgaatctgaggcaatggtctagaattggtgtcccgacgaaaaatgttaaaaattttctaggtattttttctaggcttaaaaaaggcgctgatcacgaatctgagctcagattttgaaaatcatcgatttttatctaagattttttgtcaactacataattgatttttttaaatttatttttttaaaaaagtttagcaatgaatttggggttaaaaaatacgctggtcacgaatatgaactcaaattttaaaaatcattgactttt

SEQ ID NO: 14620 - DNA, 1560 bp, Heterodera glycines
  misc_feature (199)..(199): n is a, c, g, or t
gaaaatcgatcatatggcaaggagccgaaaatagccaaaatatatgaatcaatcgactcttcttgcataatcattttatgtcaaaattgattaaaattcttcgtataatttaagattattaaatataaccaactgaatggaaaacgctgtttaacaaaatgaaaagcaaaaattgattaataatttttccaatttcttntagttttcgtagtttcgttttcgttcgtcaaaaaatttacttttgttttcgcatttaaaaattttaaactttcgtttcgatttcgtcagacgaaatttggacgaaaaaagacgaaaatatttctacctttaagaatgactttttttggtaaaaaaataagtcatttcatagaaatgttgtggtttacactgtgttgcattagaatagggacaccctattttttgggagtttgaccgcttcccatgaaccaatcgatctgaaattttaactgtacgtagcaattctgaaaatattaagattctaacaataagaatatgaaaggatgttggaaaaaaattttacgaatttttttccaaaattggggtgttgcattagaatagggacactttggaaaactaagaaaaatctcaacaactactaaaaagaaactgataaaacaagctaaataagaaagaacaaatcttttttcacatttctgtttattttgcgtacagaaatatgtcttttggggagagttatgttgaattttctaagttttcaggagaaattaagggccaaaaggcttaaatcgcctctaacatttgcccaaccgaatcaaactaacagcaatcagctctaagataacgtacagacatcctttaagcattttttattcattttatgccataaaaaaggcattaaacacaaaatttttgcgggtgaaaaaatacgaaaatctgagtaaattcgaaaaaaaaattctagggggttggaaaaaattttccgtagaagatgattatgacgaacagaaagagcacaaaattctctacaaaatggcctttgaatgagggaggtctctacgtcgcgtctccgcgaaggcgcgactttctgtcaatggatggtcggaaaagtgatgacaaatgcctgaaaaagcaccttatacttaatttaaaaatataagatattcatgcttgcttatctttcgatcatcatcaaaaaattattttacaccaacttgatcaaatcactccttcataggcgtaggcacaccacaaaatacgttgaaagcaaatcacgaatccaccataatccctggacgacaattttgaaatggtgatcttttcgacatactcttatttgtttttaaaattactctgtactgtcaaaatccatctctgacaaattcacacgttgtcttagacacacagcaaatagtgaagaaaagtagaaataatttactgacgaaatcgctcactgaccaagtcacataatcccttcatattacaccgcggaggacgaatcatcccgcttcgaagacaaaccatggctgtggttgtcaaggctctttttaatgaatttcgtacactatacggtttaaattt

SEQ ID NO: 14621 - DNA, 2830 bp, Heterodera glycines
atgtaggaatttggtggatggcggaggtgtaaaaggtcagcctgtggtgggaattgaacccacgaccccagctttccgtgctgtgctctaaccactgagctacacagggcaccctttacacccttctattgccctttttcatcagtgcaatgagaaactctctgcctcccaggcactttgagagagcccgcactacaataatatttttttttaatttttcatattttttgcatttataaattacgtaattgtaaaatagctcaacaataaaaaatggctattgtgaaataactcgacaataaaaatggctaaagatttaaaaataatggaatgaaaagaattgcgaaactaatgagaaacgaatgtactaaggaaaaattgaattgtttaattaaacacgaataaaaaactaatattaaaaatgatgtgttcattagcagctacttcttttcttctaataaattattcttctaaaaaatctttctttggttctatttttaatatattagacgcataatccatctatgaaaatcatcgaatttcgaatacaaaatgacgtgatgcttgtcatcatttatttgattggttctcaaccatcaaacaccctctagtgcattttcctccgcttttccaaacaattttttcaaatatttttcaaaattttgacggattatcccttcaacgttttcatttgttgggcgcccattcgctgtttctgttgccaatttcaaaatcagtttattaattgtgattagtggttgattatgataattaaatctttcctcattcaataattttggctcaaattccaattcgaacaatttgtttaattcatattcatatttcaaactgatcggttcattaaaataaaactgcgaaattctgaccaaacaattcaacacataaattaatggcccgtcaattccaatttgtttctttttaataacaaaatttggttttgctgtgggaattgcggcatattctctgtacaaatattcgtacaaaatgtccaaataatttcgatatttttggcattccgttcgttcatattgttcagatttcgccccaattttgtcacattgccaattctttcgcataaaatacacaatgccaaggtaagctgcttgttttttcaatgtatattcactaatcatttgaatttcttgctcattttttataaaagcaattaataggtcgtcgtatatctgttaaattgggggtcaaccaaaaacaccaccagccaaaacgccgcccaaaataccaccaattcaaaatgacacccccaccactccaatagatcaccgacccaaaaggtcacaaaattaaaatgaggttccggaaaaatggacaccgccgaaatattggacatcaaaaaattggacattatagggtacaaaaaaaatcatataaacttgataataaaatcaaaatcaaattataataaaattattttataccgcatcgataactcaaaaaatcagaattttctggactcggtacagctttttctcaagcatccatgtgcatttgatttctctaaattttattggcttacaaatgaccctttattaaataaaccatgtattcggaatcgaattagattattaatccaatatttctaattaatttttttttcaaattttatttcttttttttaaataaataatatttggtgcccaatcttccggtgtccaaatttccgcttggtgcccaatcttccggtgtccaaatttccgcttggtgtccaattttctgaagtccaaatttcaagtgtccaattttccggtccccattaaaaattcgcttgacttaattgtgacacgagcatttttgaaaactcatttcttcattttgattatattcagtaagaaatatttttagctggtcaaattttgggcggagacacttggagggtgacgttttgggtaggtaggaggcccattaagttgtttgaaaaaattatttaaaaagtgaaactcaccgatagattcgcacctgaaaatggaactacaataataatgagcaataaaattatagctgcaggaataaacatgttttcagttttcgtgtaattaaaaaaacaatttgcacgactttttataggggtttatgaatatttagaatcgatttctctaatattttcattttatacatttccgatttttttttttgaatatcatttataattgatttttgatttttgcactattttcattttaataaacatttcctttttgcatttttcatttgaataaatatttccgttaaaagtatgaattttgattttcattttttgttagttttataagaaatcgaataaatataaaaaattaatgactaaaagcataaaggaaataaatactccgaatcctgaaacgtattttcagattgaaaatgtgtaacattatgtatttaattttatgcattcctttcaacatgaaaagacaattttattaaacggaaaacagaaaaacctttcttctaattattatttaatttaaaaataatttttcttctaattcattagtataaaaattcgctaattattaggaaatattttttccatattataaatcatatttttccttccaatattgaacattttttctactaatgttaagcttctcttcaatttttcgatcactcacatttgggttttgggctttgtatttctcaaatttttgcaccatttcaattttttcggcatcattgaatttttgataacctttaaagatttttttaaatgtagaatttttaaaatatttaccttttttgcataggtcaaattttttcttccatttataaattgtactcaatctaacaccaattt

SEQ ID NO: 14622 - DNA, 1195 bp, Heterodera glycines
agcctcagaagaattgccgattttcaagcttttaacgattaaaacagagaacaaatggccaaattgatggaccattttatggctggacttcgctcactttggcacatcataaaaagtagggaatgataaaatggtggacattatgacggattataatgataagttataacgtcttaatgctcaaaatttgcattatgtcataaataatcaagacttataaaattatctctctttaatctcaaaatttatttatttcattaaaataattttaaacattctaaatatttagacaagcatttgcttcctaaagatggcaaacaccaaaaaaggctgacgcgaagaaaaaagcgaatgtatgctgacgattacaaccccaactacgaaaggccaacagcaaattttttcggtgccaccagctcaaaattcatcgtgtgctttggcagtctgatccttttttcattttttggcggttttggcattttttttgcccttaagctggcccaacatttacagaatgagcacaatgatatgacttgggtggacggtggtttgatttccattctcatcttttgtgtccttgttttgatgcttagtggcttggcgttttatcgctcgtgcattagtgctaattaatggggctaaataattttttttaaatatttatttatgtacacgttcatcgaaactcttcattcagtcatggcaaactttgttatattgtcataacagtaaagaaaatttataatttggcaccatttgttagagctttccatgtgcctaatgttttcagtaaataaacatttcattcatttaaaagggaagcaattagtaatcaaaaatatgccaataaatttcattcggctcattaagcataaattgtccctctcttatggcacgcaaaaaaataacaataatattttaaaagaaaatcaggcttattataggttaaataataaaaaataataattttagacaaaattttatttattagaaatacatatttaacgcgaaagtttaaatggacaaaaaataaaaaaataaatttcgaacaaaaattttacttaattaattaaaaatttaagacttttatatttttcattaacactcaaatgttggctgtgattttcaacctttcccaatgattgaaagaaaaaaatccaatcctttaaataatatgcttaaaatcgaaaatatt

SEQ ID NO: 14623 - DNA, 4065 bp, Heterodera glycines
  misc_feature (950)..(950): n is a, c, g, or t
tgctaattaatgggggctaaataattttttttaaatatttatttatgtacacgttcatcgaaactcttcattcagtcatggcaaactttgttatattgtcataacagtaaagaaaatttataatttggcaccatttgttagagcttttcatgtgtctaatgttttcagtaaataaacatttctttcatttaaaagggaagcaattagtaatcaaaaatatgccaataaatttcattcggctcattaagcataaattgtccctctcttatggcacgcaaaaaaataacaataatattttaaaagaaaatcaggcttattataggttaaataataaaaaataataattttagacaaaattttatttattagaaatacatatttaacgcgaaagtttaaatggacaaaaaataaaaaaataaatttcaaacaaaaatttgacttaattaattaaaaatttaagacttttatatttttcattaatactcaaatgttggctgtgattttcaacctttcccaatgattgaaagaaaaaaatccaatcctttaaataatatgtttaaaattgaaaatattgtttcgtttttcaaagagtcccccacagtgatggccattttcgacccgtcccctctgatcgccattttggcattttccctttacacgcccctcgccctcgccactcttttgctgaatctttttgccattgtcgtgttggcacatggccatcgctatttctcacaacgcttcttcttcattgttggacgtcatctgttggccgctgaccttatgtccaccgctgcgcaactgtccatcgccgtgcccgtttcagcaatgtcaacggagagtgccaaaagtgggaaaagcagaaaatactccatacccagagtcaaaatctcaaatcgttggccaaaaaaccgagacccaattttttgctcttgagcgttcggtatatntggtaaatacaattcctgccttgtttatgaggaggtctcccaaccgaactgattttgttgcaaaatgcctctcattaaggccaaaagcctcagattattgtttttccaaaagattaaataccctaaaattccataaaagcaataaaaaacccttaaattcccttttcaaaaaattcttattgacaaatacattgttgaaagacatcacatcttggagctctgttaagattgccttacttctgatgatcagagggggcttctctttttatttaaattcctaatatgatttttattgccatattttagcttatctcgaatcaacgtttgcccagtttatgttgaccttggaggcattggcccatttggacacttttcattttgtcaccctccaggcatgctcatttctgggctgttttcaacaagagcaaatggcattccgattaaatgcatttgggtccatcatcggtctcgttgtgtggatgctaattgcaggtaattagctactaatcattgtgctattgtatcttagggtaatattgaatagggaataaataataatatttttgctcaacacatagcgtcactccttgcttaggccaactacttctgttcggtttcgtcccatgtgccaaacggttcgacccggtcactttgcacttcttcgacagttgcaattggccaaatccgaatgcgcgtggctctggatttgccttgctgaacatttggcttaccgtactgctctgtagcgcattttccatttacgcaattgcactgtctcatgtgcgccgtcgaattcagtaatctttttttaatattttcccatctttcaattcaatagctttggcacaaacttcgaattgaaataaatcaggttatttgagtttaaatggcaagcaacacaatttatttcttgcttattgatggaaaaaagcataaaacctttgtacttgatttcttccattgactccattacggaaatttgtttttggaaaatttaaggtcaaccctacccatttaaatttgttttgagcaaaaacttattagctggcacaggcacatcctcattctctatctaaaattggctctctgctctaagagagtctcggctcggtgccaaataggaccagcacggtaattttacagtaagagcacgggaattttcgccggaaagtttccctcaagtttttcggtcaactagatcccgccggcaaattcccggtaaaattttcacactatttttgaagaactttttatattttacaatttgttctcgcttaatttaaccagaacaatttcttcctgataattttttttacttgttttccaaattttgtatttatgagcaggattttgcgcttctggcgtgagagaaagtttagaattttatcgtgtatctgtgcaatcgaaaactctttagatatttttccattggaaaaggggcaataattattgaaaatgaaaaaaatattttcaagagcgtaaattctcgagaaattttgagtcgctctaatgccgttaagcaacccttcgttttcagagcatttcaactttatttaattaattttcatttttttgacatctttgcaaacacgatgtgctacgaggtcgccctgaaagcatcagcatcagtgtgataatgccatcccaaactttgatgccatccgctctcggcagcgtgccatccacatcgccaagcggctcactttcgccaaaaagcagagagcttaaagaacgaaaacagatcaaagagttggcccggttgcgggaaatgatcatgcaagtgcgttttttatcaaaaaaattaatggaggaatccatttgtgtaatttttatttatactatgataaagaattttttaatgggggcgataatttagatttaccacaaaaaattaaaattgttaaagaaatttaaagtgccaaaatctgcatataatggattaattagggtgaactcaaaagctgaaactattttataatggcttcttatgaaaaagtcaattctgaataatggcttcattagggtgaagtcaaagcttaaatttttttttactgtgttgccaaagccaccctaaaaatgcttcggcaattgtaattcagcaaattcataaattttgtcaaaataacaaaacttattctgtttagggttttttgatcatgcaatcgctgcttttgcgctttgtcggcttcttcgttttgccttggttggcattcgctgccggtgccaatggcattgaccaacgagcgcttctctgtgtgctggccaacactttaattttggtaggcttgatttttgaaaatttatttatatttaaaaagaacttttttagctgagcttgatcagtcattcattgatttattggtggtggaactcgaaaattcgtgaactgtgcaaagaagttgttgaaactctgcacaaaaagctccttaaatcgcgctaaattaacttcgggaataaaaattgtccaatcattctcgagagtgtcgataaaccttcattgatatttaagcgctaattcggaatttaatgataaaatcctatcttcattaaatactttttaatataaataaatattttaagcaacaaagaaatctttaaaatctatccatttagatgttaattaaaatcacatgtccatagatctctaatttcaaattttggcattttattttgcctttaccaactttagtccatgtgcatgtgtgtgagattcacatgcttttccactggcatggtccgccgcccattccacgcaccattatatccccggcaaaaaaataaaaataaaaatcgccaacaagcataggagttaatatattgttaatatatttaactcgtgtaagcttacgttaatcacattgattttgtttaaatcataagcacatttattgcataaaaatgaaaatatgaggaaaacatatttttattattaagcattattattattattacttattaaattaaacattacaaaagagcccgatagaaaaaaattgcgagagtcagaaattttggaagcgggaatcccgaaaaaaaatcgcgggaatctcgctccaaacgagctctaatttatatagaaaaaagaaaaaattaagataaacaaatgcttaataat

SEQ ID NO: 14624 - DNA, 2659 bp, Heterodera glycines
ctacatgatgtaaaattttcaaaaattttcgagctaggccccctagaaattttcaaaaatttttttggggtcgaaaaagggtgtgaaaaatatttttctgggctattttgaggtgctgagcacgaatatgatgtttatttttcgtttcaaaatttttggaattttttaaaaattctttattttttggcaattttttggcccttggaaatttgggctaatattggaaaattcataactcggtgatggtttcatcgatttaactataataaagctttaaaaatagagaaaaataaggagaattttttgggatttatttgggttttctaacttcaatatgaaagaagttattccagaaattctggaaattttagatttttcagaaaaaaattcagaactcgcttctgaaaagtcattctgtaaaagtaatatactacaaaaatccgcaatttttttctctataatataaattttattttacatttttatctcttttttgcgaattgttataaaaataaaagtgatttttggtttcgggaccaaaggggggtgaccaggatttttgggtggaaaaattttttcaccgaaaatattccaaaaacatgtctttaggggtagtttatgacgctgatcacgaaaacgtgatcagattttacttttgacatcgttaagacctcagaatccctgtgtgattggggattctgaggcatcattttgaggggggggggggaagttcgaatccgggcggtgtacattctttttgctatgcatttttggttatttttaatgtttttaattcatttaaaagagtgtttgttttttttaattaattttttaatttaaattaaattatttttttgtgaaaaattttttaaaattaattttttgtttgaatttatttaatttcattatttattttttgaatttataaaaatgaatttcatttcaaaataaatattcaattattaattttcaaaattatatttaatgaataaaaagagtattttattataaaaaaaattttaaattaaaatgcattcgatttttataaaaacttttcattatttatttaattttaaaccatgttgtacctcttctgatcactgttggactcatctaatcactgttggacctcttctaatcacggttgaacatcttcttatcagttgtacctcatctaatcattgttgtacctcttctaatcacttttgtaccacctcttttaatcatttttgtaactcttctaatcacttttgtacctcttttaatcatttttgtaactcttctaatcacagtttgtacctcttctaatcacttttgtacctcttctgatcactgttgtacatcttttaatcacagttgtacctcttctcatcactgttgtacctcttctaatcactgttgtgcctcttctaatcaaattcccaattattctctcgctatcccaacaaatttagaaacgggcgcgaagcgcccgtctgaggccgcaaagcggccgaatgatcctataaaaattggggattctgaggcatcatttttggggggtggggtgcaaagttcgaatccggacggtgtaacattatttttctgtgcatttttgggttattttgactgtttttaattaatttgaagatttcttttaaattatttaaatttatttttttaaattaaagaatttcattatttttttttgaatttgtaatcgtccaaggacaacaaaatttgaaaaacgggcgcgaagcgcccgactgaggccgcaaaacggcctgataagctaataaacgggcgcgaagcgcccgtcgtgagcctcgatgtggactaaaaactcctaataattttttaaaaattcaaaaaaacctctccaaccaacttcgatcaatttgaatcgcttcacagtctaggtagcgaagctcccaaagcgcgaagcgctttttcccagcgaaatagccgacggttcacgcacccgctagttaatatatacgttatattgacaaggagtttcgtttgcaaaaacaaaatctcccggccgaaggccgggagcgccctgaaagtggtggaagggtcttacaactttttgaggagaatccgggaaaactatagaaaaaaatttagcgcggacgactgagtcccagggacggatttctcattttttcgtgcatttgggggcccgtaactttttttctaaaacccaaatcaaaaaatgtctgctgtgagggggctaagttgaagtgttttctaaaaaacaaaaaaaattccaagcctctatctgcaataggaaaggctgtaggttcgtggactttttcagtaccaactttgtccagttcagtcccggttgaataactcattagggtttgatctgggcggggagttaccagcagacttattgtagagttcaatgagctggatttttccagtttttaaaatttcgaaaattttcaaaatttttcgagctaggcctaaaaaacggttttcgggtttttgaattttaggaatttttaacgaattttcccagagaaacggagaccacttccaaaacatagtttttcgagctctatcgactggtatttttttcggaaaaatttcgattttttcccggaaatagaaaaattttttggcctcagcgggacatttgagtcccgggcccataaatcgtcaggagttg

SEQ ID NO: 14625 - DNA, 925 bp, Heterodera glycines
ccttcaacattggcggagggctccatattttccttcaattgagtaaaagctaagattctatcaatgtgatttatttacagaaaatatttaaattgactttaaagttaagaaccaaagtagaaattaaaaaaagcaaagtgatgaggcaaaaacgcgcaattgtacaaataatcacggcgattcaattttgggctccaagtacaattaagttggttttttcgtcttagtggtctgtgagttagtcaacaaaaagggggtctcaagttcaattcctccttgtgtttgtgtatttaaagcaaattaataaaataataataaatacagaacgccaaaagaacaaatacaaacagtaaaaggtacacactatattttacccttgattttatgaaatttttttagcttataactttttcaataatagaccaaataaaaccattttatgctcattttgaagggaaaattctgaagaatatttcttaattagtcaaaagtttaaaaaaattgtttattggcaaataaatgattctttttttgaaattttgtataggcccatattttgaccccctctagcgattccaagtttattttgtgaaagttaagtttttaactcgagatcggctcttccatttttacaagggaaaatccccggaaaattttaagttttgcaaagttttggcgttctgattactaaataaattaactatactaatttgatgtgtgactatgtatgtcacactttgaatggacaatttttcgaagcgaaagtctttgaaaaaaagaaagcaaaaaatgaggatttatgtaaacaaaaaaacacaggagatagtgttgagaaaaagataaacaaaacgagaaaaagaaagagaactaaaggaaaaaagaaagggagggaagtgggggggaaaggaaggaagcgagagaattt

SEQ ID NO: 14626 - DNA, 2924 bp, Heterodera glycines
  misc_feature (1207)..(1207): n is a, c, g, or t
gggacgagacaaaatctcgccgctcgaagtctcggcaagacaaaatctcaatttctgtttgaaaattgtggtaaaaaaatttcgggcggcgagattttggggtgcatcagaatttcacatcaaaattcgttaacaaaaagtaaatttctctatagagtaaacaattatattttatccattttttggattaaaaagcgagtaaaaattacaataaaatctgagattctcgtttcacgaaaactaatggaataaatggattaaactgtccaactgactggagcgtgtttggtctccgcgcattgtgcacaacaacgccaactttgtgctggttgtgttgccggtactcccccaaattccgtcgccattcccttcaatatcagtagtggcgtcacttttgctgcacattggcaccatcgccgccgtgtcaacgcaatgccacactttcaccgtgcaatcctcgccgcaggaggccaacagtttgccgttgtggtgccaacacaatgcccagcaacggtcctgcagcgcgcgcagtcgctcctccgtgtgcagtgcggtggcgacagactgaaaatttgggaaatcggggcgaaggtgacgaatcaattaaaaaaaaaattttttttataatttttaactgcagagaaaagatggcataattttcttgaaattcacaaaaatccacaaatgacttcctacaatttaaatagacaaaaatttgcttaacaatacccatgtcttggaaacaaagaattttctcaccttcaaacaattggcggagggctccatattttgcttaaattgagtaaaagctaagattctatcaatgtgatttatttacagaaaatatttaaattgactttaaagttaagaaccaaagtagaaattaaaaaaagcaaagtgatgaggcaaaaacgcgcaattgtacaaataatggcaaaacaaatttctgaattgatcgcaaaaaaattgttctagtgaaatgccgcattttgtcgaacttttctctcctcatcattttcattggtaaaccgtcgctcgagtagaaaagcatccgccgattcgccgtcaattgccctgcactgataatggccatgaatttgctgaacgacctcaaaaccatgggcccgatatagacaaagtgccgcttcatttgtcgtctgacagtgcaaaaagatattctgaaaatccattttaaagaatttattanattgggtattaaatgaataagtacttcgacgttagcccatttttcacattggtttatcagcgaatttcacagacgagtggcaacgccatgacgacgaaaagtgggcaaacactgcaaaaggggcaaataacagttcataaaatgaaaatcgttataatcgcacgcccatgtctgaatttggacagaaaacatttgtttttgtggctggacgaccccatcggtttatatggaactgcaacaggaacagttgctgtttcggttggacacggtgatggcacccacaagcatgggggcgtcttcctcacaatcagtgccattttgatcattgaaatggtgacgataggccatcatggtccaaaagctcgtgtctgaattcgtttttatgggggcaataaataatttttttaaaaattttaatatatgaatgtacgtcatcaacccaaaactaggtaaattcggggacagtgtgagataataaaacgaaaaaaatcaaaaatcccttaactaccgcattcgtccccattgtcagggcctttttccgctagtcgatttcgtgtcacccttttgtaatgagtcgagcgcggattggtcccataactgaacagaaaatcaaattaacattaacagaccgaaaaagatttgcgttttttttgatcgaaaatgggtagtcttttgaaattttggacgaaaaataaaatacaaatttgaaagagctcatcgactccgaaacacacggaggcttatttgatcctgaaaaatcaaataccagtattttgcggcggaacccaattcaggattaccagaaatcaagaaattgcttcagattgttgtatttatgccccaaaatagggcgcacactaaaatgccttcaggcaattcttaaaattttgagctgtaggaccaaaagcgaaaagtaccaaatatcctagctcaataatacaacttgattggaagacaggagatgttgagcaacataagttgacgcactgactgttcgccatcgggtgggcgtaagaccaacattgaatcaaaaaatcttaatgctcgtgcgacatgaatttctcaaattcaatttgaaaacgcggattagtcgaccactttaacaacaaaatcacaattttttaaactcaataatttattcaaaaaacaacataaatcaaattttatacataatacgctaattaaatgtcacaatgtttttcttgtccatcttgcgcaccccggtcgcctcattttccaagtgtttgacaaatttttcatttccgctcaactctctccacgccgttcgagaaaacatgaaaatggccaacgcataggtgccgatgcgaatcaccgcattgttgatgcaaaaatcgagcatagacataatcaagaatgaatgaagctaaaaataaaaatgggacgaaatttatgcgattattgtaattttaacgagttcaaaaatgaatgaacttttaaaaaattaatttgatattaaagcagggtatccctctaaaaaatctcgcaggattcccgtttcattctcagcttaactaattccagttttttccaacaaaatttttgaaaatttaggttagttttttcaattcatcaaatttcaggcaaatttgaaaaaggcaaaaggcaatatgcatttttgatcttcaaatttaaaaaatataatgaccagggctgcaaaaaatatgcacgaaaaatgaccaaaatatgcacataaata

SEQ ID NO: 14627 - DNA, 1124 bp, Heterodera glycines
gcaaagacagtccatcatggatctaatttctttttgtcggtttgaacttccgttttggggtgcacttctctataaatgtatagccaagtcactcgccgctcactgtcgcatttgccattgcgctttcattgcgtcttctgccgtgtcaattactcatcaacaaatcccccgggcaacgtgcgccactccgtcacacttcgagtgccgtcgccggtgggtgccatctgtcggccgtccgtcgccttcccttcgcttttccttcttcaattagcctcccttcccttccctttttataatagttatttctcctcatttccctctcttttctgctgctcttttatcatttgcatttccatctttcccttcctttttcccttctttttcctttccttttttccctcctttcgttccttcggttctattctttcattgagttttttcttaccatttttggtgtgagtttcactttaaaggctttggtccattgccttaaattgctcaataaatgcaatcgacgaaagtgccgcaatgagtgacgacgaaacgaatggttaatttgggggagacaatgggcaaatactcaatttgttgcttatattagcataatccacaaaacgatttcacatttaacaccgattcaatttggcctcccattcaaaaaatatgcaattacaaattaagagacaataaaataaaaaaataaaattgaataaagaacaaaattgtgagtatccgaatgaattatgtaacagacataaagaaatagtacgcctaaagaagtgttccatttagtgccgtgccgtctccccagccgcgtgttcgtcctgctactgctcgccatccctcccgcttccccccgtccttcaaatgtttcctcctcctccgaactttgctccgctcgtttccctcccgccatttttcccaatgtctttttggactgtccttctctgaaggcttttctccgttccgaagatggacaatatcacaatgtctcatcacttcggttggactgtgaaggaaaagacgaagcgcagctgaaagtgttggacagactgacagaaggggacacttttcgttggcttaagtcagtgccaaagtgccgtgtttgtcccactcccgctgca

SEQ ID NO: 14628 - DNA, 2023 bp, Heterodera glycines
  misc_feature (1396)..(1396): n is a, c, g, or t
  misc_feature (1406)..(1406): n is a, c, g, or t
agtcggtaatgagttgatctctcccccctcccctatagggtgtcaatttaatgccttttgtaccaatggtgttgactttggctgctttttagtcccatctttccccaacttcccgaacacatcgctttcactgctccgctccctacgaattgctcttttgcccattgtcccaacgaaagtgtgaactttgcggaaaaagttgtccgctcccgccttggcgcttctcttcgacttcgctgccattttcaaactcaaaatgtattagccaaagaccgattcgagtcgaattcaacattagccaatgatcataaaatatttgtgtggccattttccaatttcgaaaatgagaggcgatgggaggaaaagccgataaacgggggcgacgtagatttggtggtaggctctctgaacagacatcaccttgggctcgtcgcgtgccgatgttggcattgcaattcgccacgctttgatgttaccgaagtgggttcttttttccatttcctcccatcactttggacttaaagcttcgtttttggactcctctctcaataagcgttaatgtcgcagtttatggcgaaagaacggttgagcaaagtctgctggtgcacggatatcccctcgaaagccttcggcttgaaattcgtttccttcaacacaattcgacagaatggcacgaattcagtgccaaagagaacgaaatgtgagtttcttttgcggcacattctgaaggcctttgatcacaaggcacattttcttcaacggctctctgctggtccgttctgaattggcccattcccactttttccttcgctatttctccattggcattcacgagtgcactgattgccgtcactcacaagtcggcggtgcctttgaatttgaggtgtgccgagaggtgacgacagaaaatgaaaagccaaaggacagcgaatggacaccactcagcgaatgcgccgagtctgtcgtgatccaactccaaccgaccaaacacccgaaatcgaacggcaccggcgccatcgggagcgtaagagcggtgccaattcaaacgccgtcgccgcttttcatttcacagaattcgggcgcaaaattaaacccattcattctgtggattgtcatcattttgtttctcattttgttacttttggcaatcggtgcattaacacgaacagtggtaaaagagaagaaaatgaaggggaggagagggtggaggacgaggggccattcccaaagcacggcagagacgtaagtgacgggcaaatgcaaaacggggcggggaaggggggaattggcgaaacgaaccggggtaccatgagggaggggcattggcgaagcggaccctcaaaatggcacagaccagggacagaccgggtaccatggggggggggggggtgtaccnccccactacnccggggaccattccggccaatgctcaaaatgggttttggtcgcaaccatttgattttctgaaggagcgtccctttgtacactctgtcgcactgtccgtccctccctcagcagcgacacaatttgcgagtgatcgactcacgaaagttgcagctcaatcagtgcataggcaatgtaaaaacacaaagcgataataaattgtcattattatttttcggttttttccttagggcgcttttggcgctgtttacgaagcgatttggacggaaagtgaggaaaaagcggacggggaattggggacgagcaaaaggacggaattagcggaacattcggagggaattgagcagcgcgacgcacggaaggtgggaattgtgcccccaactcaatgccattccaacaggtggcgattaaatttctgaccaacgtcaatttcggcgccgtggagaaggaagcggtgcgtttccatccgaattcgcgttaaatgccgtcttttcaggctttactctcccgacttgacccccccgaatgtgttgcgaatgttcggaatttcctattggaaaggagaaatcgcgttggttctcgagctgatgaacagcggcgacctgccggtggttttaac

SEQ ID NO: 14629 - DNA, 4225 bp, Heterodera glycines
  misc_feature (10)..(10): n is a, c, g, or t
ataattatanctagggtagcaacttttagtgacgaaaaatcccgaaatagttaactaaaatagtgagtaaaatgccaaaatagtgaagaaatagtgacaaaaagtccgaaatagtgacataattttcagccaaaaattaagcaaaaataatttttattcactgattgcattgcaaatgagtagggctgggatttttaagggcaaaaaaacaaaataggtacataaaaaaataatttttaaaattaaaattcttgccacgaaaatacctttttgagaaatttttttttcatttcataggagtatattttgaaaaattttagctcgattcttagggggtgtattttttgaaaaaatttttaggtcgattcttaggggtgtattttttggttttattgcatttttgttaaagaattttccaaaaaatgtcgaaatagtgaaaaaatagtgacaaaacgccaaaatagtgatttttaactattttagtgacgaagtcgccaaaatagtgatttctagtgacgaaaagtgacgtccaaatgaaaaaattttaacgcagaaatgcgttttttgagctcctttcttcaaaacaattgagcaaaaaaaaagttttttcactaaaagtatgtccctatttggtggtttttaatccatataatttataaccctagtaatgagtcctcctcccttccccgtcaaatgcattcattaatcaaatgaatgctttgcaattatttacctgctttatgccaaagcgctgctgcccatccctttcttcaattgtgctgtccaccatataatccttaaatcacatggcaaatttattgataattcttttaattataaaatatttttattatttaataaaatatttcaatgaccgatcgtgtcaaaaacaaagtgtacggctgccgttggccttctcgatgaatttccttcatcatttcgatcattcgaccatacaaattattcgacttgaccattccttctgtcgctttcaccaaaaagtcgaagtcacaagaaacgagaaagtacaatttttgcatcccctaaaaaaattggtgcatcatcgtagagttagcattccatggcattgaattacaatagaaaacgtatggttttaaaaaatcatagttagatagaaacaataataggctaaccaaaaataattttgaataaaaaacttttggaaaagttaatgaaaatccaaaatgtgcacaaaattttttctcattccctcacaaaaatgcaattcttagggttgtacgactcggggtgacgggtcgaggtcgggctagtcgggggtgcagagagtcacggtttcgtttgggtcagggccccatcctggattcggctaataggaattttcaggacgaatcccagaccctaaattttacttgtacccgattttgaaaaacgacaaattttgaatgctttgcaaattattggtgaaaaaagcgtacggtgtgcacatccatcgcctgttggtaagccgaacgtgggaatggggacgggaagagactgaacggctgaatggaaaccacatcgctgttccttcttaaacagatttgacttggagtttgcatcaatcaaattaagcgcccaaagtggcatcgatttcgttaaaatgggcaaaaatgttcggcactgagtgggaagcgaacccacgccctaaacagctgtccttgcgccgttctatcacttgcgcaccgtttccgcgagtcgtcgtccgacaagcgtttgatcagtccaaattcgtgggccacatcgacggcggcttgcaccagcgtggccaattggtcgctgctcctcaccgcttcaaccgctggattgctgattgctactgcaaattggtgggaaattttagagtttcacataattagaggtgccaattgtaagaaaatcataaaatatgtaaaaaaattccgaataatttttttcattatgatttatttttataaaaaattccctaaaaatctcaaaatatgaaataaaaaagaaaagaagtataaaaaagaaaaatttaaaaaagccagaaagaatccatcggtttttaggtttttacacatttttgaattgcgacaaaacctagttaacaccctaagtagaaaaatatgtacatttgttttatgtaaaaaaaaacttagactacctatacaatgtatttaatgtgttctttttcaaaattttaaaacactccgtcagatttgaaaatattttaacgaaatattaattaagaaagaaaattcattaataattttgggtcccaggccgagttccaatttttttattgatgtaagcataaataagaccatttggatttgcgtttgaatgaaattgaagtgccgaaacaaaaaaggcgaaaagtaaatgcatagaaataaacattaaaattctaaaaattaaatttttatttttatattattttattgtaattcataaacaaaaaaaaaatggagaaagaaagaaagtgaagactgaatgaatgaatgcatcaaatgaaaacaacaaccatttattactcctaagccaatattttttgatttccgcataggaaatccggggggaattaatcaatttcacaataaatcactaaacatttgcgtagcaatttataaattatataatattttatatgtttaagtctctgagaaaataatttggaaaaacaatcaaaaattttagcaatgagaatgtcctggattgtcggatggtccttttgtatccctttattccccaaaaatacagtttgcaacagtacgcctgaatgtcataagttttgttgactttgtgtgtaaacagcagcgacgttcgaattagcagcgtataatcacttaatatgtgatttgatcatgataaaaaaaaagaagcatggattaatgtatataactgttttgaaaaattcagcaattcgattaaagaaatgagaatttgacgcgaattcaatgaaattgcaatttttataaatatgacaaggaataatttttttctatgggtaaatgaactataaaatcattttatacaattttgtaaatattagaaaataaaatatttggctaaaaattttagtacaattttgtagtggttgaaaaaattttgagggaaatgattgagccctttttgcgaacaggggatcgtttttttagcccatccctgagatatcaaaagaacttaactcactttccttccaccgttctacgaattattcatccattccaaaaaattttgctcaaatagtggccaaaagtatatgctcaaaaatttcaaaattttagagctaggctatgcgaaaattctgaaacaattactgctagcttagcttttaattctgaacaaaaaagtcacttgaacaagttttgatcagatcactccgtcatggtggtttgaaaaccccaaaatggtttgaaatggggaaaatttataaaatttcaagaaaaaattttcaagggggctggaagaaattttctggaaaaactcaataggcttataaagcacaaaatcccctacaaaataacttttgagcgctgcatctacctactgatttcgggctttttagtccatattttatgtacatatttgtcgttttttagtccatataatttataaaaatcctaatagtcggcgtcgcatttcttgtccgtccaaattccgtttttatcaaaactgcatcattttaaaaaactgttaacaaattttttgcaagttttaagcaaattggctgctcaatcttttagcaattctgagaatggtaaagtaaaaagctcagtaatttgagcaacttcgaaaattttcggcaatctttgcttttttctacagtctcagtctttgagcaatctgtggtattgtctagagttgtacgggactgggaattttgagaaaaaaccgggaccgggacttttctggttgaaaaaccgggactttttggctgggaaaaccggtaaaaaaccgggactagtcacggttcaggacaaaacctggacttaggtactcagatgtaccttttatttatgtaagaaaaataccaaaatatgtttaaaaatatatatattttaaaatggttattttttgaaaaaaaaattcttcgtaaaggatgaattaagcacaaaatgccataaatgccataaatgacttaaataggcttagaatcactttttaatatttttaaaattactttttagtatttttcaagggtacattttcaaaattattttttcactataagttttcaaaa

SEQ ID NO: 14630 - DNA, 3609 bp, Heterodera glycines
  misc_feature (567)..(567): n is a, c, g, or t
agataatgtcagacgactttaggtttttggagattttgtttattatttaattctaaatttttattgaaatttccaaaatcccgcaaattttaaatgcgggattaatctcgcgggatcccgccccgcaaaaaaataggtttcaatccggcagcggaatatggaaatttgaaatttctggggtctaattggttccacacattttgttggctttgtaacaaacatccaatttggcattctgtttccatttgaaattcccccaacccatcaaaatccaaccacatacagacacacctcattggtgccgcccatttgcgtctgcgcattgagcgcggcaagccaacccgaaaattgggacagttcaccgctggcactgtaaatggagcacagcatgtcaatggggacctctgaaattggggaaaaattttttcacggctttttttgtgccaaaatgacaccgtgggggatcaattttcgcaacatttcctccgtcttctccggcaccacccggtcaatggcactcttggccttctgcacccggttgatcagctccgagcgcgccttcaccantttgagcggcctcggcggccgctgaaaattgcaaaaaaagcatttaaaagttgttgattccttgcccaacttgttgctgatgaggaaatgccgacaatggtggagcgcaactgctgaagcagttcatcgttttggccccggtcggcatcactgaaacacaaaatttgattaaattagggccatattgaattataataatttataatgaataatggggacacatttaggtaatttatttttattgggaaaaaattgtaatagttttttaaaatggaatttttatttgaatttgaattaagaatttaatttaattccagttttaaaaaatcagtctcaaatcaggtttaaaaaaggtttaagtttccaactttctgtgtattttcttttttttaatttaattttccagtttttggaataaattttcgggatgaaaaacggagggggtgagggccgtgtccaaaaatgccgaaaattggcgcgtccacccaccggcgaagtaccaacgcctcgtggtcagtttggccgacaatgtccgcacgacggagcgcgtccatgaagaagcggaacatgttgtccgactttttggcgtccaattcgtccaacagcgacgcgctagcacacaaatggcccaacgcggcggtgaccgacgcgcggggcaccccacgggacaacattttgctgcaaaaaggggggggattggaataaagcggaaatgccaatgccgacgaaggtggcggggaggatggcaccaagatacaggacaattaaaaatgaatgggatattttttgtgcaatttggttgcaaaatgccaagatttaatactccaaatgcatactccacatgtttggcataagtcgccccataagaaatttaacaaaaaagtctattaaattcgaaaaaatatatttaaaaaatgagaaatcttttttgaaaaatttgtaatttcaaattcggatttaaaatttttttttcaaataacttgtcgacagtgttcgcgcacctcaaaactttgggcaatttgaagaaaacgaaaacgtcggccaacgcctcgcgctcgcggcggtcgccgtcaacggaggaggaaactgtttcaagctgagaacgggaaaaaattagaataggtattatttgaaaaaaggtctaactaatacaagaaagttgacctcttttgtacaggttttcggttttcacagggaattgtcgaaattccgtctataataatttatgtcagatatatcgttgaaatccgcaaaaaattttcaattattattagagagcacatcttgaaaagcccggacttcccccgtccgtttgccatgacccaatatatttttttcggtcacaatatcctagaaatccatgccaaattttttggatgatccaaattgatgtgcttctcctcgttcacctggatgagaaagccggcccgtagcaaatccttcaccatttgttcatggcttatgcccagcacttggcttagggtcagaaatgcgtctgcaacctgtgacaaaatggggaggaaaatgtgcctcaaattttattttttttaaatgccatttttgtacttcatcggcggatttgagcacacgataaatggcgtagacggaggccaacgtcagaatggcgggccgatgccgtcgatggatgaaattttcacggaatggaagccaacaattagtgggcggaggggtggcaaagctgaaaaaaatttgggggaatggcacaaaagccacaaaattatggcacaaaaacccccaaaatatagcacaaaagcccataactatggcaaaaaaccccccttgtgtttagttcttactctgcaaatgtgtccacgagttggccaagttcacgaacgcaatcagccaacgaagggcctaaaatgaaagtataataagaatggcacaaaaatgccgattcgcacgcgggggaaattggcaccaaaaattggccaaatgacagagagagtgtgacaaaaatactatcccattttgtaatttaaaaatatatttcggatttctacacccaacccaatttttttttgatttaagggcctttcccggttgccaaaatatttgaaaaataaaaaaataattctcaaattattgcatttttgctgccacaccgtcttcgtcgtgctgttccttttgttgttgtggtggcgttcgcttcggcgctttctcttcggcgtcttcgtcgggctgtttttgttgctgctcctcctcatcccccctcatttccatggcggttgtcccatcgtcggcagcagtttgaccttctccactttttgtgtcaatgccctaaaaaaattaatacaaattttcattaatggcatctcaaaaaataaaaaaagggatcgttaagacagaaaaaagcaaattttttaaatgttttttggaaattttatgatgaataatttcaaaatttttccaaaaaatcgctaaaaattttgaaattttataataaaaaaaataaaatttatacttgttatattcttaaaaaattccaaagttttttttggaaaaatttcttttgattttttaaaattttggccgcgattttgtctcgtccacttaaaataacaattttctcattttatttaaaaccttttcttcccctccgttggcctcctttttcagttgtccaacacattcattcagacggtccaaaaggcgcgccatttggtcatcggccgccggcgctttgtctgtggcaaaaatttttataaaaaaagaaaaaaataaaacaaattaaatgaatggaccaaaattaaataatttaaaatgaatgcattactagaaatttgtgagaagaacacaaaaaggagcagtgcagagaatggcacggtgcgaaggcgacaaatggcaccaatcaaactgaggaaaaggcgacgcaatggcacgtcgaagggctaaaaatgggggcaaatgtacaaaaaatgtagggaaattttaaaaaatgaaaccaaaacccaacaaaaatttctcgtcaaagtaactagtcttagaactttaaaataaattgttcagtgcctgcgagaccaa

SEQ ID NO: 14631 - DNA, 1750 bp, Heterodera glycines
cggggtttgaaataggtcgcaatgggtgtcatatttgtgaccagcgcccccgaaaacccccgagtactactcagaagcgcataaaacccttaatttttttcttttttttagggaccaataaagtacatgattaccgtagcctttactaacaaaggtctaatgatggtccgttttatcgatgtcaaagtgtcgaacaattatgtactaaaatgagattggattcacgactttttcgaattgtttgaggctccgaataagtccaaatcagactctttaatgcgataggcaactcaaaagaaaattttatgatcagacattgaagaataattttcaattttttagttcctttcgataaattcactcaacgaacgcaagcaatcgaaggcttattgggtatgcattgatttgttggagttattgtttgaatttaaaaaaataaaaacacattaaattctttgttgtttattttcaggcgaaatttcaccaaaagaggacgagaagggaaaatatggtaacgaaaataagagatataaatcgaaaataattcaaaaaaactttttttttaagtttctgctgagcaattcacacaattgcaaaatgatcagaagaaacttttggaacgcgtcaacgaattggaaaaacaagggccgactatcggtagcattatgataaaataatattgatcattttttaccatgttttagcaatgatcaatgaacaattcgaacagttgcaaaatgatcagaagaaacttttggaacggatcaataaagtggcaaattcccaacagcaggaaaaatacggtaggtttacgatgaataatttacaatcatattgttttgaaattaacttttctctttttaagtttccgttgaacaattcgaacagtttcaaagtgatcagaagaaggcaatttttgaacggatcagtgaattggaaaagcagatgaaagaacggatgcagaaacaggctgatgaggaaacggggccattggcaaagaaaggtaagtgggttcagagagcccgatacgccacttaatccgccggggtgggattttgagggattcccaaaattgcgggattaatcctgcgggattcagtcccacacggctcgcgccgtaaaacgattttgagataataatttgtgctcattgtcatgatttaatttgttaatcaatctttggctttttgtgaattctttaattgtttaagcattattggtcgatgaacaattcgtgcaactgcaaaatgatcagaaggcaattttggaacggatcaacgaaatagaaaacaaacgatacggtaggtttacgataagtgcttttgaattttgaagaatcaaagtttacgcaatgtcaatttctttcatttttcagctgcagctgattacgtaattggtgtgaagaatgacttaaacaaagaagcaaaagaattgaaagaaaaacaaaagcagtttgcgcgagaaaccattggtgagttgatttgaacaatgtaattttatgcatttaaataaacatttggttatttcagcgaatttcgaacggttgtcgaaaaaatacggtaaggatatacaaataaaatttaattgcaaatataaatatatgaatacaaacaattcgaataagcttttccaataacatataacgaagtcagaagttattcagattatttaaatgtgtaaatttagtcaaatttgtgccatcaatttgattttttaaacgggaccaaaaattgacagtatcaaccgtagt

SEQ ID NO: 14632 - DNA, 2848 bp, Heterodera glycines
  misc_feature (28)..(28): n is a, c, g, or t
aatgattgaatattattataataatatnttgcttttcacatcacattttttcggcgtgcttttcaaaacatttttgggaaagaagggggtccggcggtgccgataggcgccgccgggggaaattttgaaatttgggtgtaatttgttaacagattttcaacaaaaaaaagttggttttagggattattaagctcaatttgtatggattttctttaaaaaatgataaaaatgtgttaattaaaaaaaaactatgaagaatcataggtgctgggacgttagtcaaaaaccattaaatgaatcatttttgacagaaaattattcataatttcgtctaaaagggatcaaattttataatattgatttttttcaaagccctaagtgttttctattatcctgcaaaatttaaaaaaaattctttaagtttaaaaaaagttatgacttgagaagctcagaaaaccaagtttttttgaacatttttagtcatactttcttaaaattaacgaaactatttggaattttgtaggctaatagaaaacactgagtgctatttaatgctatcaagaattaaaaatttagatgctcttgaacaaagttatatcaaaaaatattttcatttgatggttttttgactaacgcccattatgatggtttttgactaatgtcatagcaccgaccggacgggatcccgcggaattttttcaggatcccgcgggattaaattcggtataaaaaagtgcgcaaaaaatctttttaacgcaaaaaaattccgttatttaatgttgaaactcttacgcaaaaatccgtttgacctaccccattttattattccttgttctgatttaagaattttcacatcacaacttataatatttttctattttgatttaatacaacaattttaaaaacttttatataaatgatatttattttcaactacatcaaaacagattaaatgttcttacattttccattacttattctcaacgtttttcatgatgataaatgaatggaccaaagaagaatgacaagaaattacaaataaaaaattccattaatataatagcaaattattaaaaatcttttaagcaatggaaagttttatcatttttatataattgaataaaatacttttaatatttctttgtaaatttctttttgatattttgttaacaatttatattcttatcaaaaaattaaaaacaattgtacaactacaagaaatacaaagtagcaaaaaataaataatatccacgttctattaaatattatttataattttagattaaatgggtgtatttgagcgtagttaattttaattacatttaattttgtaaaacaaaaaaaaatatgaattaaaaaagatcttttaaatacatttggtaataataaaaattgataaaagtatttatttaaattatttactgtagaataatttaatgaaaacgggggcattaaaagaatacattaaaggaaattaaacaaggaaataactaacttttcgtaaaaactgctaattctacagatttttcgagaaaaatcgtcataacttttcataaaaaataattcaaataaaatttcaaaagaataggaattattctaaataaatcaatctaattttgctaaaatacccatattggtattctaaattatacttttattttacttaaacaaaattagatgactaataaggggcgataaaaagagctatgattctcgaaattttattattaagaaaactctttttttaattgcttaaaactcaagttaaatatttaaactattaattgaattgaattgaaattgattttataaaatagcatataaatgaaaaaagagaattgacgtaaatggaagctaattgaaaaagaacgaaaacattaaaaaaaaattaataacaatataaaaaaaagaagaaaaaaaactcggactaaagacggaacaacgaatgtgcattcacgatcgagaaggagagaatattaatttgttattatattttaattcaataaaattaattacaaatacattaaaaatcgacattattatttatcataagattaattatttaacgtttaattttatttaaagtagataatatctgtaattaaaatttttaattcaatttttacatgttatattattaaaaaagttgttttccttgctgaaaagttttttacaaaatgatgacaattaaaaactaaaatttttttcttaattgaattgaaaataaaattaacaaataaaataaataatatttaatatatatgaattaaagaaaaataaagtattaaaagggttaaaacaaataaaattattatacacgtcatcatcctgcttaaatttgtttaagatcactttattaattttacaaaattcaaaaaaaataaaattataattataattaatatttattttaaaatcttccctcaattagcatttgaaataattagaatagtttaatatttaaatctttagtgtaatttttttataatatttttagtgaaattaattgaaataaaaatttttatttgttaaaaattgcttttattaagtcatgatgatgtacagtaaaaccattttcaatgaattcaataagtaataattttttttatatttaattcacttttttatatttaaaactttctttttttgtttttaatttccgctatttctttataaaatataaattttttcttttgcataaaatgccgagaatgcttatttatgatatttaatttatattatttttaattttaagtttttctcgttgtgttacaagaacatgaggtcgaattttatccttcccttatgttattaagtaggtatttaattaaatgaattatattttata

SEQ ID NO: 14633 - DNA, 3667 bp, Heterodera glycines
tccatcttttatttttgagtttttaattttagtttattttaacactttttctcgccaattagcctttgctaaatgcactttttcgctccttttgcgatgactttggccacttttttggccatatcactcgtcctctcctcaattttcccttgccaatcagccgaagaatcaatttttcgctcatttctttttcatcgtcgggaaatgtgaaaacggagggcgggggaatttccgattcattctttcgttgccttttcggcgagtgttgcataagaatgtgaaaagacgaagaaaaagacaaaatcttacgatgattcatgcttttcctgctcttttgcttaaaatttaaaaaagtaattattgaattatatttttgaataaatatttaatttttttttaattaccaagcttaaatggacatttcagcaaaaggtgcaacagttccgcataattttctgctgctaccgattgaccaaattattatattatttctgatgattctctggcgccctttttctttgataatccattcccaaaaacccattaatttggcccattaaagtgactttggccatgaccaatttatttattatgaaagcgtcttaagtgtcgactatgtcctgtaatccttgctgctgtttgaagcttaaggatgccgctattagcatcggaatttggtcaacggtgggtaatttcggttaaatatcggaggaaaaaataagacaaaactcagtgatttcttttgctgatattccctcactttgtcaattttgattaattttgttactccaatcactaagtgatgcagccaatttcaatagttttggccgtaatttccgtgctcagttttcaaatgcgacggtcggcttctctgtccccaatttcacacccatttgataattacagattaatttttattttaattatcaaatttaaaaatgatgagtgaagtgcattatgcatgattagaagaaatcgctgccctttgtgcgatggtttcacattataatttgcatttgacattttgtcgagactatcagcagaatactgtaatttcgcattcgttctgtttgtttcatcccaattaaagatttactctctcgcccaaattgccgttttcggatggcaattcagcgtcctcgcccagtgccaacatgttataatggcacagtccaacctccaatgtgactattactgtccctgtgttggcgcttcaaccgcgcgaacttccgcaataattgagggtattttgtggaaaatgtaaaatattaaaatgcatttttacgataatttgtttacacattgcattttttgcactttaatttcagtatttattcctttttaattatttattttttattctttgtttctctctcaacttctgctgctgatcattttcattattattttttgtgttccaacttttgtgttgatttttttatgtattttaaagtgagggaatgtttcggtgttttaaattttttcgcattttaaatttccaattttttgtcccattttctttcattgatcaatcaatccaacaactccaacagatatacagcataatgcaattggccattttcggttggcaaatggccgccataaaatacgaaaaggaccgcgcagcgaacactcttctgcccaattacaacacttatggtcgctacgacattccgacttattacgaaagctattggcaatcaccggaagaacgctattacagctgtaaaagcattgtttaagtgaaaagagtgtgaaaaatgcaatgtttaaacaaaatgaaaattgtcattaattacttttttaatcattttgttttgcccggcccaaattacccaaaatttcagggcttttcgtaatccaaatcctttgtctgatcgccgccttctttcttctgttcgcttccattatgatgatttatggggtgcacacggtaaatgaggtgtcattcaaccaaaatgaaattccgtccccgttgacagtggtcgcgcttccttctcgtgccgtggatggtaacaatgtgcgcttccatcctcacttcgttcgcctattgtgcccatttgcttctggtccccaaaaatgcttttctcctcctccccattaaggtttaatttggtgggctggcgatgtgagggattattggcttctgctaaccatcgtcgaaatgttcggcgttttgctcaatgtgtgccattggctaattctctttcctcatttgggcattcgcttaaggtgtactgtttcctcgttattgttatgttccatcggcgaatgctggtcgaacttgagtattatgcgagaagacgaaagtacgaccgattcagccaattgccaagtgaaacggcacaccagcaaagaacagaacgaggcaagaaatgatgagcaagaagagcatggctaattgggtaaaacattcagcagaaatggacagaaccgacccgaggcccagcaaagagacggcacttacgtgccaacgccccggcgcggaaagccaatggccctaccaatcgcctcatcatccattggccggtgctcaattggcgggtgattttgatgcaacaacaaaccaacggccgaatgaaatggcagacgaaattcacacggcacgacaattggaacaacggcaccaaaaaaggggtaaaagagagggggggggggtggcatggcaaaatgtgaattcaaatatatgctagtttaaagagtcagtctccctaattgtttaccaaagtgttatccttctcggcattagattcaccgatcattttgtctcatcttcaccaaattcggtccctctcggcgatggaacgtccgctacaaaagcctcaatttgatgaatacggcgaaatgccaaggagagatagacggaggaggccaacttcgcacaggaaaaagtgggtgacatcgaattcagttgattacttgtccctcatcgtcgtcatttcggctttcagaagcactccctgcggaatgtgccacagggaccaatcccaccgccggtgccattgttgccacgcgtctaagcattgtcattggcacggtcattccgctgaaaggcatcacaaagggtcgttctcatcgtcaagttcgaattctgcacttggcgaatattcggcagaggaattgccggcctttggacgaagaacaagcagaaaaggacgacggagtaggagaaaaaggagcagagaaagagcacgtgaaaacaccgcatggtcggacagagagagcgaattgtaaaagaggggggggggggcagagaaagagagggcggcgcatttcgggccaattaagcagcgaattgggccatacggtgcgaagtgaacgcgagtacggtaatgtgggctcattggaaaggcgatggacaagaccggcaccccacaagcaattcccaactttcgaggagaggcggagacagcagcagcaacaaagcatccgcaaggggtgggaaggggggcggggaagagaaaccatttttggagtttgggtcaatttgtagccatagggagccgatgccccgggcggactcggccagcggcactttgccgcttcagccccagcccatttcggcacccccaccaccggctggcattgctatcccacagcatattgtgatccctcccgcacaaatgggtgcgcgaaggagcgaaacatggactcgcgggtaattaat

SEQ ID NO: 14634 - DNA, 2511 bp, Heterodera glycines
  misc_feature (2468)..(2468): n is a, c, g, or t
ctaatcgttttaggtatggaattggtggaaggctgtattttaaaaaaaaccctttggtgaaatatttttgacacttctcaattttttgtatatttttttgaagagacggattccaaacctcaggagcataatccaataaaggcctaatgtaagttttgtataaaataatacagatttttgacgattttgattttattattctaaccaaggatcgcatacgtgaatatgcatttcttgttatttgtaaaatgtgatcagaaaatctgttacttaagaattcttttatccattttaaaagcttgcccctaataccaattttttctaatttatataatagtaaattgtgagggacagaatcaaaagctttttgaaagtcaatataaatacaatcaacattttttccttctatgattgcttcgtaccaatcttcaacaactgatattaatttacttgttgtagacctatttctaacaaaaccaaattggaactctgaaattttattattttttaatagaaaattataaatatttttgctgagaattctttccataaccctgcaaagtgagcaggttaaggaaataggtctataattttctggattaaatttatccccctttttaaaaagtggaaagacgattgattccttctaaatgtttggaagagaaccactgtctaaagataatcgaaacaagtcagaataacagttggcaatgaagagtggcagttttttagttttataggaaatattatccggagaagtaccatttttatttggcagttttcttaagtatttgtgtctcaatgatgttaaaatttatatctgattttttgttttgttttgtttgtggtattcaaaatgaaaatttctcgttcgtctagaacgactcgaaaaattgctccaggggtctgggaatcctacccttatcccaatcatcgaacggcttgaaaaattggaaaaattggtggaacggctcgtagagggtgagaatcgatatggacatcgatttggtgacccccaccacacccctacttcggcccccacccctaagaacggcaatgttcaatggggtcaaccaccgcctttctctggctcgggcgccgtttctcagatgatcaccgaggcgatcatcaactccgaacagctgaaggaaaagtccactcgggcagtcatcgaaaaaatgccggaggcgatggacggacgggcattggtggaacaaattgcagaagaatgtggcatcaaagacaaactttcgccggacattcaccgccatccaaggacaccacctgagagcggggcaaaaagggaccgaattttgaaggtgccgtttttggataaattatcacgtgacaaattcctttacaattttcgtaatgcactgaaaaaatttcctaattttccacaattcatcaaagttcgcagggatatgacccaaagcgaactcaaaattttgtactccctgcggcaacaagcctatcaggccaatattgccgcaggtgagtacaaatattttgtggtcgatttggagatcaaatctctgaaaaacccccgcccgctcagaactcgctagggatacgcgagcaaaccaaacaaaaaaattaggaataagggagaaaaaaatccctgggtttcctgcctattaataaatgcccgatcaatttcaaataaaatatctgatttagaacatatagcacaaaagtatgatccatcaatattcatcatcaatgagacctggttaaaccccagaaatacaattgaaaatgaactatctataaatggtagatatagagtaattcttgcgaaccgaaatgagaaaaagggcggtggatcagcaattctaactaaaacaaatattccttatcagacactattctctgggacaaaattccaaagcgaaattttacacattaaattactttttaaaaaaccaatccaaatcataaatatatatcgtccaccgaattgtacagttcagaatactaaaaagctactcaaattcatttcggaccagagtaattctgaaaatatcatatattgtggggattttaacatcccaaatattttatgggacgacaataaggtacttcaaagaaatgagcctgtgtcaaatttattgattgagtttattgaccaaaaacaattgaaacagcatgtcaaacaaccaacaagagaaaaagctattttagatttagtaattactagtgaatcagaaataattaatgatttaacagtacttgaaaatttttcaacttccgatcacaaaatggtcggattcaaaataaagggaaaatttagtcgtaataatcacagagtttatagaagagatttaaaaatattaatttttcgaaattaagtcaggcgatacttgaaaatcgaaatgatttagcaataaactcagtatacaccgttgaacaaaaatataaagaatttttaaataaagttctgaaattatatgatatttttatacccnataggcctctaaaatcgataataaaacaatcatatcctaaaaa

SEQ ID NO: 14635 - DNA, 2531 bp, Heterodera glycines
accatggcttcattggattgggccgcccattaatatttttaatttttggggaaaaatcatttgggaaaaataagaaagaaaggcaaaagaaatggtttggaggaaatttctccgccatcaaaaacatagttgggtttaacattctttcaggtattggtcatttagggttaatccataaattatgcaaaaacaataatgcaaaaaacccaaatatttattattcatggtaaataaagtgatccgcggatcaggtcgatttagaggaaaggaaaatagcgttggatttgatgagaactactgaggaaaagaaaaggaatacaatccacggatcgagatccatgggatacccaatccgatctttatgcatacggattttgatccacggatttttcgatcctcgaatcagtgattcgtggatcacgatccggggatccgatcctgatctttatgcatacgggtactgaagcatatattttttttgctccacaaatatgtatacagtatacttatcctcctcctgtaatgaagttgcgttttctttttttttgttttcatgataatcgcatgtacgacgtacatgtacacgtttactgtcatattcagtttctctcacaaacgaatgaatgttttagtaccaggcaacacttcccacttctcatccctcttccactgctgattgtgaattaccccttccttccatttaccaatgttttcctcccctcaccacttctctcctcctccttccactgccttccaccattcttcgattaccgctccacccccccccccccgccataattttgcttccttttctttccacatacagctagctctttacatctctgcatttctctgttcttttattttcgctctgtctctctcttttcacaatcatcatccacacatactacattcggcttgttccccgtgacatttaattatttccacttctgggtctttccatttcatcatttattctttccatttcatcatttattcttttctaatttgtacattccgtcatttggtcatatgacagctaattgaatttaactcaacgcatttatatttgtcccattttttatttaactcaatcatttatctattttgttccttctaattttttagcgaatactctttattcattataatgcaaatctttgtcaagaccctcaccggcaagacgatcaccctcgaagttgaggcgagcgacaccatcgagaatgtgaaggcgaagatccaggacaaggagggcatcccaccggaccaacagcgtctcatcttcgctggtaaaactccctttgctagacattctcgtaaacaattactgttcaggaaagcagctggaggatggccgaaccctcgcggactacaacatccagaaggagtctactctccatcttgtcctgcgtcttcgtggaggaatgcagatctttgtgaagactctcaccggcaagacgatcaccctcgaagttgaggcgagcgacaccatcgagaatgtgaaggcgaagatccaggacaaggagggcatcccaccggaccaacagcgtctcatcttcgctggtaaaactccctttgctagacattctcgtaaacaattactgttcaggaaagcagctggaggacggtcgaaccctcgcggactacaacatccagaaggagtctactctccatcttgtcctgcgtcttcgtggaggaatgcagatctttgtgaagactctcaccggcaagacgatcactctcgaagttgaggcgagcgacaccatcgagaatgtgaaggcgaagatccaggacaaggagggcatcccaccggaccaacagcgtctcatcttcgctggtaaaattccctttgctagacattctcgtaaacaattactgttcaggaaagcagctggaggacggtcgaaccctcgcggactacaacatccagaaggagtctactctccatcttgtcctgcgtcttcgtggaggaaagaactgtattgatgaatgacacgatggacatatattgttttgtgcttaagcactggacgctcctgtcaccattatgttccgttttataatcttcatcatgaatgtatttcagtgatcacggaacgataaatcttttccctcagtttcagacttggtaaattgttagaattatatgcattggggtgctatgtaactgaaattatttcttatattttgtatcgattagaagtggtccttggcagaaatcttaacgctcattttttgacaagatttcttaacccgactatttgttgctgaataccttcgtttagctcatcataatcacctcataatattatattgaatgcttatattgcaagaattggatccgccgacagaggcggtaatcgaaacggagggtcaagtggtcgctcattgggaaaatcattgccttggccagggaactttatatttgatagagaggtatgacaagattctgcccattttgtcatatcataaacaaatacaaacgaaatcacaatttagcgctttggtttggataagccacggcactaaaa

SEQ ID NO: 14636 - DNA, 1528 bp, Heterodera glycines
tttagacattgaatacgttcccgcggaggtcgacgacctttactaagagaccgaggaggaccctgaggtcaaaactgtggcagttcgtctcgtcccgacaaatgcaatgcgaagtagtaaatattcatttgggcttgttttcttccccctaagtttccatttaccatcccattcgaacatcccatttagtttctgaactgttttctacattgagcaaatgtcaggaactgaatcccgagattgatgaacagatgtcaggttgtcgtccatttttaattcaaatttgagtctccacattctgacggggatatttctaccccccccccccctcgtccgtcataagggggcggcagtaaaagaggtggggtgtgggcaccgacgaagggggaaaaggaaaaatcttaaaatttgaacaaattttctaaaccaaattcattaaagtcgcaaacttcacccggcggcgcctaaaatcactatttcttctttttttaattggttcaaaaatcataaaatttggtgcgaaaagcaaaaaaaaaggtcgccgctgggaaaattttggaccttcgtgtcgaaatttggccctggcgcaccccttgcgcgtatattattgcattcgggagctattttataagtagtattaatggtcagataatgacagccttctcggtgacgacgagtgcgatgacgacggcgaattggcgcagaatggaaattccgaccatttcgacgaaccttcggctgctgctttgcacgaatggtgagtcatcaaatagcggaaaacgaaatccatgaattgcaagatgggttcttttccgttatgctgcatctccctcccctaataattttctgggctagtcaggcactaatgctggagtcaagtctaaaaactatgtttcgtcatgaatttgtcattgattttcgtagtgaataaatttatcggagccttacgggttttttctggattttttcgaaaaatgggaggggagggggcggggcatgcggcgtggcaaacagatactcaatattgaattataatcgtaattaacaatgtctctaatataaaaaatggtgtacttttcataggtttacgttggacagtcgatcggatgagtaagttcctttttttatattttaaatcaattttcgtttactttgtttaaacgtcatccgtaatcgaagggaggaaacccctcttccccgtgcgaaattaaatttttctatcattggtttagaaaatggacgtgcctacaattattttgtagttatttcatttttattttagggtacggcttagcgcagaagggcgagcaaatttggtaacaatatgaaattatttgtttatacattttaatttcttttccaggaaagaattgttggctccttgaatgacgctccgggcaaaaaacaaatgcatataaattcgaatttaaattattaactctgttcagatgaaaatgtttctgatgatcggccgaagtcgcggaatgaacaggaacagatggacgacaattgattggaagtgatcgat

SEQ ID NO: 14637 - DNA, 1703 bp, Heterodera glycines
  misc_feature (60)..(60): n is a, c, g, or t
ataaggaaaaaatttgatgggttgtgggtggctttattaatattatttataattacgacnccataaacgcacaaattaacactttttattaaaaaataaattataaatgattacgatattttatgatatatttatacaatagaattacttagaaatttaaaattttaatgtttttatttaaacaaatgcaaaaattcattttcttataataaaatgaattttattaactattttacttttaaaatgatatattgatttttattttttcataatttggtcgaaccctattagaatagttgctttatttatgtaagcttaatttaatagattcataacaaatctgacttttatgagtccaatcagactatatgagtccaataaaatatttatgattcccatgacaatttatgagtcaaatcattttttgaatccaatgatttttatataaagttttgagtcgaatttttatttttcaaactgtcagcctgaaattgcaaatacacaaagtaagacaaaataatagtggatattggtatcgaatttcttcaagaatattttagaaaatttttgaatttacatggaaccaacacaacatatactgataaaggtaggtgcgtaacatgttagagttagttacgtgcaagtgtcgcaatccatttttgagtcaaattttcagaattttcacaggcaacgcctttcgacatcgtcggacccattactgaaaagaaatttttgtaaaagtctaggtctcgagtcttgtctcgggtttttggttctcggtatcgagtctcggggtcaagtctcggaatcggtttcgagtctcggggtcaagtctcggaatcggtctcgagtctcggggtcaagtctcggtctcgagtctcgactcgagaaaagtctcgggttttttggttctcggtatcgagtctcggggtcaagtctcggaatcggtctcgagtctcggggtcaagtctcggtctcgactcgagaaaagtctcgggttttttggttctcggtatcgagtctcggggtcaagtctcggaatcggtctcgagtctcggggtcaagtctcggtctcgagtctcgactcgagaaaagtctcgagttttttgggtctcggtatcgagtctcgggtcaagtctcggaatcggtctcgagtctcggggtcaagtttcggtctcgagtctcgggaaatttttggtctcgagcatcactactatcggcaccgctggccctgctcccaatgccacgccaagacattgtgccattttttgaccattctgattagtctaatttctcaattactgtactgcaaaatgaaaataaaaaatatttaaatttattttattaattttaaattttattaaaaaaatgtcaaaattgcattgcatatttctgtgcaaaaaacagaaagtgtcacaagcacaacagttgtgacccgactacgaatatggattatcgacacaataaaaccaacggaaaaggtgaaaaatgcggtgatgcgacatttatagaaagtatgacattttttggcgacatgttcaaaaagatttcaaattttccactaaataaatcagccgaaaaataatctcccagtctccattagtctaccagtctccaattatctccccctttctgcggaggttgaaaaataatataccatggcatataaaaagagcaaatacggtatgtatgtcccgggacat

SEQ ID NO: 14638 - DNA, 1538 bp, Heterodera glycines
  misc_feature (976)..(976): n is a, c, g, or t
tttaagcaattttctgaacaaattttcattaaatactcaaaaaattttcctggcggcgcctatcggcaccgccgggaccccccattttaccatattattgaaaaatggaggccaaaaatggaaaaaacaataattttttggcgaaaaattttgtaaaaatacactccctaattcgagttttcaaaaaagcaaaaatacacccataaaaatcgattttttcaaaaccgtagcgggacctgccgggacctgagaagccgggaccgggacctcgatttttcttcgggaccgggaaccgggaccaaccgggaaattttaaaaattttaaaaaattcaaattttaattatttttttaaagtgaaaataatataaaattatttttttattttatttttattttataaaacccaaaagttaaagctaattaaattaatgaaaattttcaaatcaaattttcttcatttatttcaaacaattaatcatttttggaccaaatggtcgaatattattagaaattcacatttgcttttcacataaatttttcggcgcgcttttccaaaaaatttttgaggaagaaaggggtccggcagtgccgataggcgcggccggtggaaattttgaaaatttgagtgtaatttgttaacagattttcaacaaaaaaggctggttttcgggattaataggcgcaacagtttgtacggattttgtgtcaattaaaataaaactatgagtaatcatattttgtcgataggaaagccatgagtatacaaaaaaaaattctaaacatgttagtttctgtagagggattgaaccaggggaacgaagaaggaaggagactagacactaggccttttgcacaattgcaatcgtcccttttaaagaatatattaatatatttttaaaattttttccttttaactccaattttcttcactaatttttcactcagacccccattcttgccagtgtttgtttttcnccggttgccctaccgggatcgggacctgagcttttcaaaatctgggaccgggaaccgggacctcggatgaccgggaatttccagcccggtcccggtcccgtggcactctatactaaactgacccagcccataattttttataaagttggcacaagaaaaggcagcacattttaaactttatctcaacaaatttccgcttcaattgacaaattccaatggatttataataatttaaaacttcgaattacgttgtgaaatcaatcaaattgaattattttgggaatctctcctttaactgaggcacccgatcatatcacgggtccaattcttgcaattgttgttgatgaaatcgtagttcttccacatgccatcaaacactcgctgaatgccatcaaattccgtggtgcgaatgccaaagatgggctcgtccccgtaagttttcatgtaacggccccatctgtcactcgttacgtctttacacacaatttcgtaagttttgtatgcaatttgaccacaaattccgcattcgtagcgcacttccaaagcggtgtgagtaatgtct

SEQ ID NO: 14639 - DNA, 1401 bp, Heterodera glycines
  misc_feature (1381)..(1381): n is a, c, g, or t
atatacctaaaagccaacatacgatctgcatacattggaggcggaatcggtccaaacgtttcctaaaattataaataatttgatttattttcaaattaaaattatttttcgattaatttacccaaattctccccgtcttcacatatgccatcaaatccttagcatcctttgtttccacattaatataatttttaagaccaccaatatatttttgtttccgagttccactgaatggcgtgaaaaagtccacaatgccaatgtaaaggcgcaactcttggttctccaaatatgtctctgagttcggatggtttttgcattgattacaggtggcatggaaaaatggcatttcatcactaaattttaagggatttaacgccagcagaagaagcattgttatccgccattttttaatttctcaagcaatccatcacccacaaattttccggtggctggtaatttcgacactgggtaaattcgacactgagtattttcgacactaagtaatttcgacactacgttttcgacatagagaaatttcgacactgaactatttcaaaaactttcactgttttccagcattttcgacactggaccatttcgacagtgagtaaattcgacactattgagaatttttaaaaattaataagaaattttggtgttagtattaggtatgataaattttcctatttcattttctaattcgtactttttaaaaggttaggttggtataactagagttggtcgggaccgggaaatttgacaaaaaccgggaccggtacttaccaggaccagaaaagtcgggaccgggaccaacttttttgaccgggaccgggatcgggaccgcgagaaaagccgggaccaaccgggaattttttcaagagaaaattttttttgaaaaaattttgaaaatttgagtgcactttgttacgaaaattgccaatattcaaaaatgttcccataaatattgtagtttcgttttgggggacgaattcgaagaaaatttttaaaaattttcatttcgggggggggggggggggaatcttgagtcccaaaattctggatttttataaattaattaaaaaattttgcgaaaatggccctcacgcgaaaatggccacgcgaaaatggccctcacgcgaaaatggccacacgaaaacggccctcacgcgaaaacggccacgcgaaaacgaccccgaccgtggaatgggtcgaagcgggtcagttccgtctggccagttccgtcttcaaaagtcatgaaaacatgttttagggtgattttcggttttcgggccctagaagccctacaaagcgctttgaacaattaaaaattgcaatgatcagtgatcactgactgatcaggtttttttgaattatcgcccanaaatatcgctattggcatta

SEQ ID NO: 14640 - DNA, 1948 bp, Heterodera glycines
ggcacaaggggcggttcgccaccaaaataattgtaccatttgagcacgacgtcgtttaaacgctgttttgggtcaacttcgaccaatttgggctgacgggagaagacgcccttcacatcaaagttcaaaagtggcaaatccttggcatttttgaacacattttccatcagcagaaagagtgttggagtgttctgggaaaggatttttatcagcaaaaattgtttaaaaaccatatgaacatatatgtaaaattcgaaaatttgttaaaacttattttattaatttataaaacacatttatacgcatctgaaattgtatgttaaaagtatcccctaaacaaaataagtaccacaaaaaaaggaaacgaaaatttgtttacaataaaaaaatgaaataataaaaaatacacatttgatttaatggtgtttttatttaatttgaaattttaattaccttaatttgcactcgaaacaccataaagattttgttgataaatgatttgtctcccattttcatcatatgttcaaaataattttctaaagttttttcaattattttcgcttcgtcgtcctttggaatttgctttaacaaaaaaatctcgtctttcgtacgatagaatccgtttgagcttttccctttgacaccaaggtcagttaagtcatccgatagaaaagaatcctaaaaagttttaatttttagtctattaattgttcaaaatttaaattgacttttatcgtaaataaataggttttccatgtttttatgaatacaaatgcttggtgttagattaggcaataaaaatccacttgaagaatattcttttttcgtcaagaatctcttaaaatcgtaggtaaaagtctaagaattattttacgacaaattttaggtatactaaaattagcgaaatgaatcttatacattgccttgacctaatttaagaaaatgataatgttattattaaatattattaaatctatattttgctaatccacattcgttcgatacaattcattttttgtgcaaatgtctcgcctctataggcttctacctaaggcgcgagattacataatcctaatgaatttacttaactccttgaaaccgttaattttgatccgttttcttatttgatatttttatttgttgttcaccactttttatttgcggcgtacgcacttgcgtataaattaatattattattataagttttaccgctaatttcttgtaagtaattccaaatttcacccgcatttcgcccattgcttcttccgcataaaattgaacatcgtccaccgttgtccaatcaaagtcgtaatttagctttttgggatttttttgcttgtttttttcattttctttcatgtttttgcaaatatatttgcccaattttgcttgaattcgttctttatcgtccattttaaagtgcgcatcgtctttcatttcatcagcatcagccaatgccaaaaattcaatgcaaatgttgtcattttcatctttcaaatggcaaaatttaattatatttaatttaattttaaatcatatagtgaattaaataataaattaatattttcgttattcacctgtcatatcaatttctcttggcatcagttcaatttcttgcccttcgaatttgtgccatttcccaattggcactttttcatctggcactttctcaattgccaatttctcatctggcactttctcatctggcattttctcaattgccaatttctcatctggccctttatcaattggttgcactttttcatctttttctttgtataatattccggcagcataaaaatttaatttgccgaccattttttctgcatcaatttcaacaccaacaaatgcacctccgtcaagtgcgacttcttttcgtgccttacttgtttcacctgcgatttttggccgtttgccaacgtcatttggatatctgagtatttcgcat

SEQ ID NO: 14641 - DNA, 1824 bp, Heterodera glycines
aaagacgaagagcagcaacagaatgtaataaatggcgaggcgaatgatggcaaatcggacggtacggcaaaattttatttgataaatgggagtgagaggggggcaggggacagtttcaacaatttctaacagtacccaggacaaaaccaatgttgaaggacgtcgtagagggcttaaaggaaatctgaaaatgcgacataaataaacgttttttagtggcaaaagagttgctgatttgccattcttcctctcccactgcatcgcctcaaccgagcggatgtttcttaacgtccgccaatgtcgtagcggaattggacagaattcgaagggaacagaacagaagcggggccggagaagcggacggacaaagcaccgccgcaacgacaccgaacgcatcgcgaaggccgagcaattcatccgctgccgcggtgattagctaataaatcattattagtgaatgactcatttaaatttcaattttgtaggtcagtggaagcgttgaagacgaattggccaaaatcaaagtggtcttacgacagcacgagaggaggatccgattgcttgaggtgaatggcatttatacggaaaaactaaaaaaacaattcaggaccaattggcggatgccaacatggccaatgcttatggattatgaaaattaatacggacagaaatattgtgattgaagaaatgacgaaaggaaaatatttgaaaatttatagcaaacaaatgcaatttgttcatcacaaaaaatggaatatccgccagctttttgtaaatgagcttcaaatgtttggtggttgtatttataaaagtcgctaataaactcatctaaaaatgaagggcaaatattgccaattgtgcagaatggtggtcccttttccttttttttattttgggataaaaattctggagttaaaagcctgctgcttattgttatgtaacgaccggggcgggaattcccggtcccggcttctcaggtcccggttttgcccaaaattcccggtaacgaccaactctagttataggatttaccaaaattaccaattttgcaatttcgggtcaatttttttaagaaaaataggaattattggggtccggcggcgctgataggcgccgtattgtttcaaacgaaaaatatgacagttaactgactttgttcgcaattttatgatgttttaaaaatgaggatttctcatgccaaatgaggatttttttgaggtattttagtggcaaatgaggattttttatggctgaaatgaggattttcaaaattttgagatagaagtcctggcataatgtcaacaagaatttcgcatcgtattttcgaaaatttatgaattctaagattcggacttattaagccaattcattctaccccgattcgtactaaattttcccaaacatgtaaaatgtgttgagtgttcatccaaatttttcaaccaaaattccccatttctcgcttctttacaattttatttctataccattattcgacttcaaacagagtttattaacgacatggtaattttaaacaaaataaaagacaaaattctccgcttttagccaggcaatgaaacaattcgaggccatttggaaaaacggaaggattggatccgacggacgagggaccatcaggaaaagtcggcggatatcaaaaagttgaagagaagcgcacgggaacggaaccccgacgaattccattttcatatgttgcggagtcaaatcggagtgagttggccattaaaaaaatgccaaaggatttggaaattgaatttccattttggcatcccttttttgttagtttgttatgttaataatagggtt

SEQ ID NO: 14642 - DNA, 2407 bp, Heterodera glycines
  misc_feature (222)..(222): n is a, c, g, or t
tttttcggtaagagaatggcaattggacatcctgttcttctgaccattatgaaaccatttaggaattgatggacccgaccttaggcttttacaacagagaagaggacaaagtgacactggccattgacgtcactgtgaaagaagcaaaaacggacaattcgtaaatattgtgggcaatgtttaattgtttagcattttatgttcaattttgacattttttgnttgttacaaaaacatttggatttatttatttattctgcaataaattattgtttttagtgatttttaagataattcaaaaaatattttcaaaaaattgccaagcacttaaaaagggttttgggtgtactatagtcaacccccggaaaaaaatgatttaactgtggtgcaatgctgtccaggaaacggagaatgagcgacgccgtccttactccgaactttgcaaacgcataggaaagggaacgcgaactgacggtaggtgttgcaaaagttgagaagctgaagagagatttgtgactgtcaaaaaagtctgagttaaagccgaaactgatcaaaaaaggagacgcacggagggcagccatttacaaatggcagtacgaaaggaagaaatgagttgataaggaggaaggcaaagtgtactgggattgaaaaattattgtttatttgaacacgttgtttttgtctatggaatatatttatgcactcttttggaacggacaatgacttgggttggttttaagttggggatggtccttcgtctattttgcttcctctttctctctctccatgtcatcctctaaggtctgcgttcgttactcggaaatggtaaaagtccatcgcggtgatcgaaacgttccaaccggcgcttgtggcggcaacgaagaaaatgaaaaggaaagtgattgggtagaggaagaattgcgtgtttttcagcgtgggaagtgctgaaaacaaacattgttaaatatatttcaattgatcattaaaatacaaccggtatagccgaggaaagtaatgtaattataataaatggtggcaatgcaccaaatggaattgccaaaaaagcgggcgagaaaattttggtaatcaaccaatcctaaaaaatattttgttcaaaaaaagaaaaaaagagggaccgtagaaaagcaaaggtaaaatgacgtggagaagaatgagcaacgggaaaaaagcattcaaatggacatcgaagcaataggcccactcgaccacgtcgcaatccctcgtccgacgcaaaaagcgatttgaaatgaacctaaaaagggagggacacaaaaatatgtgaaatcggagagtaaatatcgcaaaatagcgaccaaagtgcggttgcaatggcaatgccaattccgatgcaatcgatgaacacaacccaaaggaaaaaggcgcaaaacgaagaaaaggacaaattgagcgctaatgcaaacagaacactcgagccgagcagagaaagtgccaaaaggaggagaaaggcggggtcatcgcgggcccattgatctttggcttctgaacgaaattagaaattaatgaattaattgagagggacaacaaactttttctgtacatgaaattcctgtacaccttttgcggattgaccagcaggtaaagcatttgccaagcagcgaattcaaagtccatctgtcggacgtgcaccaaacggcggaagaaacggctgagttttgccgctgcggtcattttaacggcggaaaaacaaccgacgtttgaggacgaactgcgaaaggagagaatgatttaacatgaaataaataacacattgaaagcaaaaagcttattgtaattaacataaaactaaagcgacgcaaccgaaaaatatgccaaaacgaacgcacaatctgctggtgcctgaagtgattgagccgggggtggaacatccgcttctgttccaataataatccttcctcaaacctcccgaaaacgaagtggacggagactgatagccggctgaatggttaaaatatgttttagtttaattaccaatttctttcttttttctacctcttggaacaaagcttttcttatggctatcggcgaagctcattcaaatttcatcaaacgtggaataaaaggataataattaaatgaaaggaacaaagtcatataaaagaaaaggaagtgaacgaattattaccagccaaacaaaagccaaatattgaacaatactctcctaaaagttttagcctcagctaatgttactaagaaaactcatcgacagaatcatatgatgaaatcatagataaaatcgtaagattttatattttgaagctagttcttgatcagcgcctagattaatctagaaaagttaaaaaagttcaaccaaatataaccaatcaactaatgtatgcaaagtattcatgtaggaatgcatcaaaga

SEQ ID NO: 14643 - DNA, 2986 bp, Heterodera glycines
tcaagtatttcaagactgacgaactaataaagtaatcactttttattgtggcctacaaagaattcaattttccaaaataaagaagtcatcaaattttatgaaaaatcaaaataataaaaaagccgaataaaaagtttacaaaaaaattaaaatatattattttaaaataggcaaaatttatacctttcgccaatttaaatgaataccttaacaaaatgacaaatctcggaccaaaatgtcaggatcagggtcttatatcaacttgccgagatcaggattgacattaggaatccagctaggatatgattaccgtagttcaaatcccggtcaaaaaacttcttctttttagctaatcgaggcaaattacgaaaaagcaaatctccagcactattaggcgctgaagcattctcagacagagaacagaggacgttagaaaaatttcatgagagattcgaaagggaaagaaaaatagcacgggaagagagaaaaagacggagtaatgaacgacggctagagagtgaaacagaagaagagagtgatgaagaaatggtattggacaaagaaaacacagacagtgaagagatggaaaaaacagacataagaaagggtggagaaagcgatgagaaaggaagaaataacaatggcaaagaaaaagtggaacggaatgataaaagaaaaagccacagcggagacagagaagaaaagaaagcacagaaaggaagaaaagaatattgaaaatgaacggagagtaatgagtagggatgggaattttaaaaaaaaattttgaaaatgttaaactaaaaaatcgggttttttcaaaaaataaaaaattaatttttcaaatactaaaaagtgcttcaaggcctatttaggtcatttttatggccttttttgcatctttcaccctttacgaagcatcatttacatatttcgtacatatttcatatattttcgtgtttttttcacatattttattttatattttgcaaattttcttaaataaaattcccatcattaataatgagagaaaaaggccccgccacttggactaacatgcaaaatttaccgtatatttattgattttttaacaaaattttccaatcagtccgaccaatttaatctttgattagtttagcattttctgatgaattaatgaacccacgataagtagccgatttgggtaagtggatcagatcgattaaagaacgatcggtgctgagacaaatatctttttttcaaaattgctcatttctttcttgttgaggtttattaacctctcaaatcccaagtctttatcttgaattcttctatgtttttttcaacataaaaatggcatccaggaataatgccaacgtcgaattgattcccattgtgccaacatcacatccgaattggtgccatttgcggtgccgttgcaaccagacgaccagaagcagtcatcggccgtgaaaaattgcctgcggcaattaggtgctcattgttcatgtttccaatgccattagcgttgtcatgttgtcctggcgctattttgcgaatttgaaatttgcggccaatggacggtataaggaggaggaaaagcgcgaaaaacatctccaggaaggggcggatcaaagcagcccattgttgaatgcttaaatttattatgaatttttaacgttaaatttttcgaattttaattcaatctttttctattataatcagggatgcaaaaaatatgcaaatgcatagtttttttcctagcttctccatgctataaatagtaggaaaaacactcttttttgtgtttgcgtataaaagtcgagacttttatttgcatatttttgcatattttgtggtttttctgcatatttcatgcatattttgccattttttttgtacatattttcagattttttgcaaattttgccatttttcgtcaaatattttccgatttgaatttcccttggagaaaaataattgattatgcataaaattaaatccaaatctgaatgggtgtgcgaatgggtcaaagtgagcttcactgccgaaaaccttgagaaatttttgatttgaaattgcaaaaataacggataaaatttatgaagaataaattttttgattaatttgaacccctaattttcaagtttttgtgcatatttggtgcatattttgcgatttttgtgcatatttatgcgcatattttggccatttttcgtgcatattttttgcatccctgattataattgatttttggtactgttttttaaaattaattgtaattatattgatcgcattgtttagtgttaaaaaaaaaattaaattttaataactttttggttagatgttttttaatatatattaacagggattccttttttatgtaaatacatattttttcttggattctccatgctctgaatagtaggaaaaacactttcttttttgtttttgcgaacaaaaatagggacttttatttacatatttcggggtttttctacatattacatatgtacatatttttatacatattttggacttttcgccattttttcctacatattttgcaatttttgaggattttttaaggaaatttttatcaaatgccccaaaaaatccaaaatttagcaatttttcgtacatattttcatttttttcatattttgagaatttatagaaatttcttgtgaaatttagatttttttttgagaaatatacctctaaaaaatcaattttttttttcaaaaacagataccaaaaattaatttttaaagtactaaaatgtgattttaggcctattttggtcatttttattgcattttatgcctatttcaccctttacgaagaatttttccaaaaaaagtaaccgttaaaaaaatttttatttacatattttcgtacatatttgggagtttttgtacatatttcatacatattttggcattttttatacatattttatttacatatttcgcgatttttcttacataaaaaaggaatccctgtaaat

SEQ ID NO: 14644 - DNA, 2314 bp, Heterodera glycines
  misc_feature (1287)..(1287): n is a, c, g, or t
atcggcgctgaagcttctctatcgggcgcgacatcttttgcttttggcccatggcgagcagcatccgtatatgggtcaaattgatgtaatattctacagataatatttcaagaagcaattacaataattggcaggccaatatcggcatcattctgtacgccttgcaagaatttgacacgtcgctaaagttcctcaacaatgctttaaccctctaccaaaagtacggcgtccctgtcaagacggcccttctccaccacgtgatcgcccgtgcccattcgtgccgtggcgatttccgcacggctctgaattttgagaaggaaacattcaacatttactcacgtgtattcggcaaagaacacgagaagacgttggtcagcaacgaatgtttgcgtcacctcaccaaacaggcggtcaatttccaaaagcatatgaacgacgcatcgcaaggcctcaaaacgtccaagagtctcgtgccaaacgtaattgattcagttaccattccctgtcattttcgttctctttttagtttcaagtacattctccttctcttcccaacattgtcgagctgctcaacgcatttaacaactttttgtaagtcttactttttgagacttactttccgattttaaatatttcgtttcaggttttggaagttgcaaattcacacggaatgaagcagccttcgtcatttcttccctaagacaaaatatattgacatttgttgttgcgtttctcttcaccattttcttattcttggcacttattgcagttgttatttgttgtttttgttttcgcgctgatatattctaattaacttagatttaccatttgcctcaaaagttcaatccatataattttgtttgtttatcttttgtttttttataaagcacaccaccattgctcatctgcgcagctttattaaatgatacacttgtaattcgaatggtattcaatttcatttcatgggtactgtagataatgcttccttcctttaacatttttaagctcggaaaccgttccgaatactgctcagaaatctgactccatttaattgcatttttgttaatatttttgggaaaaaactaaaataggatctaaaaactcgaaaaatagcttaacaacaacaacagaaaagatgtttttcgtgctttttaggtcctggaaactttttggcataaatatttttctcgctaagattgacttatttttcggaatttctccgataaaattctaattttgccttaaaagaaaaaaattcattaggggtcggggtcacttcgccgcggngccaactcgccgcgccttgtttttttttttgttaaaaagtagtcatctctcagtattttaattataaaattcagatgtttattaacaaaaccacggtccataacacaattatttaaaattcccctgagaaacaataatattttgggcatcaaaattttcgataacattcaaaaattcgcttttccgccttccaaacttctttttcttcatcggtggttcttcgccgttcacgatgttcacataatcggcgtcgcgcgcacgctgatccattcgaagaacttcgatgaagcgcgaaattgtagggaacactgaaggaacttattttataagcaaattgtggtccagttcttgccccacgatgtcgttcagcgcagtttgcagcagttaaatgctgatttggcaaaaatgagcgcggtgatcatacgcgccgtttctacgaaaacggggtcacttcggtagcgttaaacgggagacaattttttttgagaaggagacaatttctttttctgataacaggaaattaccttttgaagtccttcggaaattaggcgcttgtgcaggttttgcagtgcaatggaaatgttccatctgcgaacacttctgtcattgcttgcgcccaatttgcgtaagaattcttggcaaaaatcagaaccctgaatttaagggacttcaaaatttttacatactaaattagtaccggtattgagaaggcaattccatgcattccgccacacgcctcttgatcactgtgatgacttttgtttttttgtgggaccaataatcttcacaattgccgaggaatccatcgttctgcaatttttctttcctgcgttagctttcaatttgaatcatcttagtttggagagaaaatttgatgaaatgtattatattgagacatagttttaatgttttaaatgtattttttaacgaaaaaatctggcggcgagatagtcaaaaacaaggcgcggcgagttggccgcggcgagttggacggcggcgagatagcgccgcggcgagttggccccgc

SEQ ID NO: 14645 - DNA, 1650 bp, Heterodera glycines
  misc_feature (1621)..(1621): n is a, c, g, or t
tcgaataaattaataattaaaaatattacaaaattccatttatagattttcatttcctaaaaaatataaaaataatactattaatgaagtggtgacataaaaaaatttataaattctacaattatatgaaaatatgatttaaacacaatattacgtggaaaatttttattatatgattataattatttaacattggtaaaatattggttttaaaaaattgtgtaatatagaaaaaataaaataaaatttttggggtcggatttccgatttccgattaaatttcctaaattttccttatttaaatttgagtgaagagaaaaaatcagtgtaaaataaaagattttgggctcgcccccgccgagcaaaaaattggattgaacagaacagattagcgcaatactcgatattcaatgctaaacgattttcgtgcattatataagaaaactttttttttagtactgaagtgtccagtttcactgggactcagttgtcccacactaagattgcgttggttcgacttaattctttgttttttagacttagctcatcaagagctttcgaatggtaccaaatttgtggggattcgatcgtttagaaaaagttagagtgcgaaatctctcaatttttcgagttttgaaccggttcaaaacccggttttttggcatttccgcaactcgagacatatttttccatgcttagctccttgaggcgaatcgattggtatatcatttgacccattttttcacggggcgttcactatagtttacccgagttgagttcaaaattgccgttatattccatcacattactaacttttttagcctcttatttcccaaaaatggataatgaatgcgcacagcttaaatttgaaaaagccgaaaaagagaagcacattaagtacctcgaggtagagggcgcaaagaaagacgaacaattggataaaaaggatgaccaaatcaaaaatatgcaaaatgatgccacaaaaaaggtggaaatctgataggggagggaggagggggtagggggttaacggccaatttacaaagagtgtatatacaagccccgtaaattgaatttttgattttttctgttacttaaatgtttgttcaatttttgcgagataaagcaaaaattcaaaaaataattagttattaccgaaaggtgttgctctgcttgtagtgtgtcgacttcgcttgaacattgaagcatgcctcgggcattttgcccaatttttcaaatttcttactctcggaatattcccaaaggggaaaaccctccatttatccattttcctctgtgtctctcccgcccattgcttcttcttctccaatgtcctttcctccacgtggcagaccattgattgtttttgtcttcactgccatttgcttctttctctctccggtttattgctcttcttatttttgttggttgtataccagggatggcacggaattccgacttccgagttccgacttccgacatttttggggtcggaattccgacttccgacttccgaaaatttttggggcctcggaatcccgacttccgacttccgaaatttttgatgaaaagtcggaatttttcggaatttttttgagttttttttcaaaaattagcattntttgtacaatttatgttaataaattgcat

SEQ ID NO: 14646 - DNA, 3773 bp, Heterodera glycines
cgtagcctaatgcaatagaaatatttgttgtcttaaattttttttacctttcttcaatttttgcatctgttttgtaagagacgtatggcttcagctcgaaatttgctaggtccggcacgaccaattcgggcaccatttcgggaacatgaacaaaatcgtcagttttggggtcattaaatcctgtgggcgccactccggtgtatcctaaagataatctccactcataggttagcttccaattccggttcgcttactccatagctgtttaaagtttgctcctagaaattttggcgagagctcggggaattccttttgttgaccgggccatttgtgcgattcaataacaaccggcccattcttccgccatccagttgagccctttttttcaaaaggccatggcgcacgaaagcaggaggcagtcacatgacgaaccatcaaggaatgctgtgaaaacaaatatgtaagaaaaaatgtagaataatttgataaatcagagaacaaaaacgttaaacaaaaacttattttacgtttaaaacatgcaaagaaattatttttacatttaaaatatttatttataaataaatgatgtttaaatacatacaaaagagatctaaacatatgtccacgttaattagctctttacaattaaccattcataaatcaatcagaggggctgaggtgaaccgggtggaagaaaattgtcgaggaaccattgctcgtttggcacgaaaaggagcggaacacaaagcaaaagaacgacgaaggcggcgacgaaggcgtacagctccaagcggaggtcggcttttaggtacagttcgaatttggcctcatgggtccaatccgaggcgacccacgtagaatactgaccactggtgaagttgtagtctgaacagtccctcaattcaataaaacattatgaattgcattacctccaatttcgaatgcgggtgacctggccacggtttggtaagtgctcgtccggtagcaactcccattcccatttcggtcgttcatccacacaaaattgtacacctttttccaaattttaaacacttccagcaattgaaatcgctcacattttcttggtagcccctgtcacggcattggctttgtgtccgaacattttgtgccggttctttgctaccagttgaatgagtgagcaaaaagaataacaaatgccgaattattgggcgcctgtttctgccagtggcatcaccaattgaaaaggaatttgctaaattaaggaaaagcggtcaaaaacgtttaaagagtgatgcctgtgtcgttgagataggcatcgatttgtcggtcattagtggcatttgttagcgtgcggaaaagcggacatgaccaattggcaacgaaaaaacactcgcccaattctttcgcctgtaacgtaccaaaagataaccgaaaaataataaatctgtacataattctcgtcgattttgaattggtccacttcagttgcattattattagcaaataaataagaaagtgctgccctcaaagcaatgtttgatgcgtcaataatcttgcggagaaactcgtccaactgtttggggtgagtacgaatttggtcatccaagaatgagttcaaatacctcaaacaatggttatgctgataaaaagatcaagatagaaaatacggatattcgtagtcggcggatccaaatgagctcagaattagaccggggactttatcagatgccttcataatggagtggtaactggacggaggagcggcaccaaaaggcactgaggaaggatcgacgaaatggaaatgttcaccgcttccttttgcattatgaagaaccgtatcaatctgaacagtgtgataagaaatgctaaaatcgtcttttaattaagttaacaaaccaggcttttgttttgcttgtagatttgtgcgtcggtgtgtgcgtaaagtttgggggacgcgccgatttgttgaagttccatgaaaaaggacagttcgtccacgccaatctgtcggacattcttcgactcttcggagaagttctttgccacggcagggaaatgccctcgtcccatgtcccacacccatcgactgctgccaatgtaaccgagcgactcgccgtgcaaaaaggcgaacaacaactgacgacgggacagactggcgagccgattgaatatgtccattttttggccaacagaatgggcaacgagcagaagggaaacgagcgaactgagcactgacaaatcgccacctttggcaccacggaaggtggagaaagagtccatctaacaaaatgacagaaaacattgctatatttgaaaaaattaacgacaattttgataattaatttgaaaaggaaattgagtcgccataattaagtgtgaaaaagggaactgacccgggcagctaacacaaattggtcggcactgtgattctgcttactcagtggaggcaacatcagaaaaacattcatatcttcaagtacttcacataaagaacttaagagcaaaattgaagaaattaaatttaaaaaccccacctttcgccaaagtcagccgtccgttccaaacaaattttggtattcccagcagcggacataaattgtgtcatgcgccccacacaacgcaatccctcggccatcagttttttgttaaatggctcaatgcactgaagcaaaagattagtaaatgcaaattgtgctggtaaaaccttatcaaagattaagtcgatctcttcgttgctggtgacaagacgaagaggtttgttgaagtcgataaacttaagcccatccgagtgaatcgcgttcttttggttccatccatggcaactttcgatagttttctcattggaataaaatgctaaaaaactcagcttattgagatgtgattgttagcggtcacaacttcaaaactcactgaactgacgatttggacatgagccatcctcagaaaactctttaggcttatctttcccacgatgtatcaacagaatcccaacaacttgcgcgtgtgaacgaaggattccgattaaagcactaaaatttattatttacctttcgttaattcagaactttatcttttcgtcacttactcattaatatttgtgagttgaataacagcgattatgttggatagccccaatggtaaaatgccaatcgcattttgtacgtcttttgcatggacaatttcagtcaggacgccaacattcccattgcgactcgcttaatatgtaatcgagaattctaataaatccaaattaagttaaaaagtgtgaatacttacactgacatccaattgaatgtgtaccattcaacattcgaacacattggacatcggtgttattgagtctgataaaaatttgatcttctacgccatcataagcaaagactaaaacgcaattataatagcaaattattgccactggatgaataatgatctttcttatttacttacctcttaacacaaaacaattgaagagcaataaaatgagaaattgtgatttttttaaagagagcattattttaccggtcacctaaaaacccttaaaggtaattgtttcaagaacaacggaatttcttgtacatgtaaaaatttagacaccctgtacctaggtacatatataggtaataatagttcagtttgtcccaccccctttttcgaaatttttttatgttttcaaaagtcataaaaacactttttatggggttttcgggatcgctgatcacgaatccggcgcccatttagaccaattcttaatcccggacccgaattcgaacaaaaagtcggaaatttaaatt

SEQ ID NO: 14647 - DNA, 2400 bp, Heterodera glycines
cccatagtgaacgcgccgactcaacaacgagagatgaaccaatatacagagagtactgagacatatgcgcctctcaattaggcgcactattaagcacttgcctagggaacaatcttctcatctaagaccaagaaaaggaaattgtgtaaaaataggtaagacattgttatacaacgcactcattcgagaaaagattaatgaaacaagaaatgatagattcgtcgagtttgggtcggcgttgaaattggacaggcttttttaggttcgtttttattttgttcgtgtatcattgtcgatagatcaatccagcgttgcccagccctctgactaataatgccagattaacgcgaccctctgactaaaacggccagactaaaccgaccctctgactaaaacggccagactaaaccgaccctctgactaaaacggccagactaaactgacccggtccgaataaattaaacgcaaatctcaaatttggatatgtataaaaacaaatcccctttttattgctcacccaatgcaattaccgtatttgctctaattatcccccaatctccattaatcccccaatctccaattatcccccagtctaggaagggtttgaaaaataatcccccagtctccatttatcccccatggggataaatagaattttcagaaaattatatgccgtcaatttttttcaaaaaaacaaacaaaatcgacattgaaagtgctaacaaatgaaaaattcatcgtcatctccgactccatccagctctacatcaccatcatcatcagataagccggcttcttcgtgatcgtttcgtccatctttcaccgtttcattttctctaaactcgcgcaaaaattttgtccctatcggtccaattgctccttccggcttgaagcaagcaattttttcgtctcctgttccgtccaatggcgtagtcaacccacagacttaaaagtttcggcgtctttcgtaggcatttttattttttaaactgaccctcgaatgatttgatgatcacggctttggaaatttcctgccacgatcggtggatccagtcaagtaccatgtgaagcgctggtgccttcgggttgcctgccggtgtgaactctttttctgcatcattggacatccaagtgttgtagaaatgccgaattcgctccttgagcggcttgttccacgagacatcgggagcctagagaaggaaataaactttactgagaaagatgacactccacctgaatgaatttggtgcaaccgccagggacaaaaaccgtttccactcccaattctttcaccaccttcgtcgttctctcgctcttgtggctgccaaacgcatcccaaaccaagaggcgttcgccaacgaacagctttgccccgattattttgtgcaggtagtcctccgttgtgtcatcgttcatccatatcggcccagcgaaattgataaccaattttccagcaaattgtttgacaatttgcggcaccggtcgctttctgttgaccagcacgtacggcttgagtttttgtccgttattccgtgctgtaagacacaccgtcacccgcattttgtcatgtcctgtggtcacaactgttatctaaaaaaaacttacatcctttttactgtttggcaaccgtcaacgcaaattgtgccatttgaattagcgaacgaacagaccaaggaaaagcggacactgatcaaagcaagcgcaaatgtttgggaagaccgctgggtaatgaaacggtgccaatattgggagacggcggcggttcaatgggcagcccaaaatttggacggatttagcactgtcgagtttcattattacgtcgaagctggcattgggtgagcaacaaaaaagcatttgattttgtttaaaaaattgtgccgaatttttaggcctttgtctccacgtcgcaaatggtgtccaattatttgaagatgatttaatgcatttgagaaatgttcgatcattttgaattatggcgatgaataagaggtgatctgaccattttttatgctcgtttttactctctgatttgttgttgttttccgttaaaatataaattttctctctcgtctcgatgcatcccatgggtatgtaccagggatggcacggaattccgacatttttggggtcggaattccgattttcgaaaatttttagggcctcggaatgccatccctggtatgtatcaattaaaaagaaaaattcagggtgtgaagtttttcatacgcaatttatagttcccataacagtaccagtgcttgtcattaaaatcaagacacaccccatttttcagaatttaaccgtttcccgtgaactggtcaaattgattattaattcataaagttatttgtaaacacgattaaaaggggaccaaaaaaatcccgaaaaaaggacttttta

SEQ ID NO: 14648 - DNA, 2896 bp, Heterodera glycines
tctgatagacaacacttaatgctattgaataataccaataattattaatttggatgaaattgggccaagatacgaatttatatgtcttacattttttattttactacaacttggcagtatttaagaaacgcccacttggcagtatttaagaaacgcccacttggcagtatttaagaaacgcccatagtggcagtttttaagaaacgacccagcaccccccgcgtaccccccccccctgggaccgtccctgtgtggtacaaaccgaacaagtaccgaaacactgatgcaatttcaaaaatttcgatttttgtcgacttagctttagggttcgaatttgatacaaaaagtcggtcaaaaattggaggggcggctgggggagtagcagcactatttccacttatttgttagtaaattaaattcctttttatacaaataaaactcatgaaaataatattcataatgatgcacatatgtacaacatatacataggtataataatggcggtatttacattatgaacaaacatatagaaaatagcatcggattgatcgatcactttcgcccgattttcttctcaaatcctttcgcgccaccaccgccgttggctcgtcaattgtccaattgtatgatttcgagctcggcgaacaattcggtgagtttgttgatgaaccacagatgttttttggtgcacttgctcgccacgtagtcgaagttgtccagcttggcgtgcagttggcgcatctgttccacgctgagtgccattttggactgatcgatgctgaaaatggcgcgatgatcaaattggggtttatcggacgggggggggccgcttggccttcgctcactcttccgggatgacaagcgtttggccggagcagcgaatgtaccacactttgggcatcagttgggccaaaaattccatgtcgcgcaactcgatcacgcacttctgcacattgaggcgtcgtacttccgtgaacagttctctgccgttgctgattgactgaaatttggaggagacaaatgaatcaaatcaatgggcgacgccaaaatcactgacacgaaacaattcgacgaagtgcgactcgcggaacgagctgaacttgctcatgtccaccctcgcggatgttctgggccgcgaacttcgcaggtgctgacgtagcgggtccatcacttccatcatgccaacgctgcgctcagtgccgtcgtcgtcttccacgtccgtgtcgggcacttcgtcagggaacagcttgcgcaacaggtcgaccgagactcgctttctgctgaacctggtcattcgttgagcctgtcaaaaaaaggaaatcgtttggacggaaaaataaacaaattctgccgattgtacgcactcggttgaactgcttggagatcgtgccgacccgcttgaagtccttgaacgggagttgtgaggcgacaatgacaagtgcgttcagtgggagctggtcaagcggaaacgaacactggttgacaaggtcggaatttgttgatgaacacggcgcatccttgttttgtcgcttctgcaaattgaaaaatcaaaaaataaaacaataaaacagataaaaaaaattattacccttttatgggccattttcgttttttggtgaatgttgtaaaataaaatgcgttgtgtgtgataattccttctcttttatagacaattctacagcaataaattgtataaatttcgagaaatttcaaaatgttgaatgaatgcgttgtataaaagggaattgatttagcatttctggccattccattccaaaacatattaataattcattcctaaatattattaccgcctctgttctccgtccgtgccgtcatcaacaaatcaaatcaacggcagctcagccagcagcagaagtgcgcacaaatcgacgacatcaaacaaaactgggcaccgcacaatcaaaaccatcatcttcatcatcatcggacgaagaagaaaaaaaggtggcgcaggaggagccgaccgttgacaaacagaaacaatcagaagcaaagcaagcggagcagcaccagcaaccgcagcaggaagagaagggacagcaagacgcaccaccgcggcgacgcatggacaacacgtgagaaagtggaaaatttcttaaattttgttttttaagctgcacttttagcgaccaaatttggctggacacattggcatggcttaaccgtggagaggtcggcacgaacattgcgctggtcaacgcccgcttcgccaaactggtggacaagcagctgcagcaaaggcactggtggttggaggagttgcacatctgtgagcagaaaccgaaagggacaggcgccgaagcgatgagcttgaacagcgacggctcctactactcgttgccattggccaccgtaccattgccggaaaatgtcgtcggcttcaacagcacattcaacatttggtggccatttcttcaactacttcccaattgaattttaattgttcccacgttttctgcaggtatttcgacgctgaagtgatcgttttcctgcaccgaatgcgccgtctcttcaccacggacatctctctgcagttcgccattcggatgacggaatatcgcgcttggaaagcaatggcacgtcacatttggcccctgctgaagaacggactcatcattctggtcaacctgaagcggaagcaactgtccatgatgcgcaaacacgtgtcgccgaccgtcctcctcgactgcccgaaccttgttcaaatcaccagctctgttttgcccgaacgtccgaccgatgacgacactttttctgctgacttatcgggccgtgacctgtacatgtggctgcacacgccgcgccccgacgatcgtctgctggtgtacaaactgaccaagtggaacatgggatgggacaaattcgtcaacga

SEQ ID NO: 14649 - DNA, 1006 bp, Heterodera glycines
cgctcttttttttcactttaaatttattggtcatttaaatttttaaaaatttttaaatttttttaccaactttttttttcaattttttattaacaaacaattaaaagggcattttaaatcattgcccacttggcccctccatatccaatccaattaaattttccaatctttttttcatttcaattttctttttctttgccgccgctgccctttcctctcgcatttttgtaccactgcttcgcttgccattcctcggtccgcctctgtttgctcgagagcgtggacgaggcgttcgattgctcgtccaatgcccgtgtctttggcattggattggcgattgtttcttccccctcctcctccccattggcattcagttgctgctgctgctcattgagctgtggtgccgcgctgtcgtcccccgcccgactttgcgcttcttccgcgttcctcctcctctctctctttctctgtcctcctcctctgttgcgcctcttttttgtgctctcaccgccctcagatcgcgctgtgtcgccatccaaaattgaatcctataattttcttttattttcttttattttttaattttttcttttaaccggcacaacatcctccactgcattggacctcccaattgtaacaaattcctctggggcgggcagcagggccccactctccagacattcaattcgggtctcaaattcgaccttttcttttgcaaaaaaagcgattaattcctttttgattctgaaattttattttttttggattttaaatttcaatttatcttacaatgtggtctgatgggtttatggctccccctttttttaattttttgatatattgagtctttggttttattttcctttttcaactcagcgagtgcatgtgaagaaccggccgcaacagcgatgcccgacaaagaaaaggaataaaaaacccccaaacgatcaccccatttcttataagtaattgtagccccaccaattttggatcgtatttaagcccc

SEQ ID NO: 14650 - DNA, 2021 bp, Heterodera glycines
agggtttcgaggcttaagcccaatttttaaaaattttaaaacaattgcgccagtaaagctggatttgttaaatcggcccctaaagttttcaaaaatatacctctaagaatgaaaaattttctcaaaaattaatctccaaaattaatctatttattttcttggtaataatttttgattttaaaataatttatctcaagtcacattgaaacaattgacaataaaaatatcgatatttgtgcagtttaggccacataaaaagtcaataaatatacatttttctcaaaccatacttcattttttttcttttaaatttttatcgaatggaatactgaatttctcagtttttctgcagcctttcctatcagacataaaggcatggattgtggctcatcaatacgtgtttgcacctttccaaccattggaatacctctcctatccgtggttgaaccgatctatgatgtaattggcacatacataaattatttttttcatttatctcatcgtaatttaaacttgctgaatcgtcataattttagatgatttttaataaaaatattgtaaatgtaataataaaatgaaagcaacatgctaaagaatgcaccttacacaaagaaaaaatataaatggtttgaatttatatagatatataaaccatctaaaaagcattatgatatagcgtatataccctctttatatgtattaaatgaaaaagaacaaaaaatttaataaatgtcccgaatgtcctattaaattttgttttgttctaagcccctgccatcaatgcgatactcatcgaatcactttttaatcatcagaagacaagtaaatcacatcatccgactcgtcgttcacagagctgccactactatcatgctgatatgaaaaacaatttgatgttgacggcatttttgtatttttctgattctgttgcccatgtcgttgacgcttcttaggacagttctttgcaaaatgccccgtagtgttgcaggacgagcagcttaaaaatgtaataaatagatcaataaagaagaaagatacaaactcacagatttttgtccaacaattgctcacgcggcaaagcaactttgtttcggcgagacggtttacgacgtggctccggacattgattcgttttgtgcgctatactcgcacaattccagcatttgtccggatcccgtgcgcttgcattctcacaaagtgctataaaatataaatgaatagttcctaattataagaagtaaatatttttctcttacggtaactatcgggatgacgatatgggcatgacaattgcgtgtggccgcccctgcccaatggccgttgcacgccacagcaaaaacaacgaattagttgctgcacatcatacttttgcaacaattcaatctcatccgctggtctcgcatttcgcggtaagcgccctagacttatagtacttgaactacgtccctgcctcaatgttggtttctttgcagtcgtgtgcacagatgatgaatgcgtatgcgtaagtaacggacaagcatctttcaaactgttaaaaaaataattaaaacatttaaaaaacacaaccgtttgatggccgctgccgacgattcaaaatgttcttcttgctgctgtttgaacacaacctcccatccttccatggtgtccaatacttaaattcttttttagataaaaaaatataattctatatcacttaccgttaatatagtccgtccaaaaattgtacttgtctccgcatgtgtatccgcatgggaccaacagcctgtcacaaagtaatccgcagcagctttccaacaatcaaataaattttgtattatttgaaaacgttcggtatccttcttcttttcctcaggaaattgactaaataaaatggttgctgctgattatagaaaaaattttaataacacttgaaaattataatttcatgcaaaaatcacttcatccgcttatccgggtgacaaagaagtgcataacgtctatatttacgaacaactgcactcgagccttctgtagtgatgttt

SEQ ID NO: 14651 - DNA, 1293 bp, Heterodera glycines
agcattttgtcagcacaaatgctatgtattttctttcctttggtcggacctttggcccatccaaacactcaaaatgccatccccggcagagcacttccaattccaagggtgggtcactcaccaattggcttttaaggcagaaaaagccaattaacggaatggggacgggcgaattgaaatgggattattttgggcaattttatcgggaaaggatttgggaacaaagtcagccaaaccaacgaaaacagaaaaaatggactccgtccgaaccaattcaaaagacattccgaggaaaggaaagaattttattttattttttattctctcattttcaaattccgaactctccgatttattagttcttcgattttgtgcacattttgtgatttttgccctttcatttcacacacggagcggaaagtcagcaccaattcactcagtgcccaccgaatggaattgttttgtgtgtctttttttgtgcaaaacagcgctgtcataaacgggggggaggggcggggattgtcgtcccgggattacgcccgcccaatgctccgagtgaccttgatcaccccccccccccccctctctttccctatttattcatccctttccgatctctttgacattttccctccttttgactgagatcacttttatgatttacacaccgccgtctcctgctcgaaggcatccggatgatcaaacagacgaccggcacaagatggacccttaaacactttcaaagggaaggcatcggccatgagaatgttgccgtggaatgcctgaaggaggaatagactgatttctggtcaagagccgaatggccaattgaatttgaaactgaggagaggtacaccaattggcggactgcctccactgtcgcacacttttcgtgtcatacggagacaaaccgcgaacataattaaggtcgaggcaattatatactaaaaagccttggccctgttacgaaagggtttcatattataaattactataattaagcaattgacacataagctcatcaatgacagatccacccttttatccattggataacattcacaatggacgcagtttgaatgaaaagaaagactatctaatgaaatggaaaaaaacaagcaaaggaaaacttaggaaaggaaagacagaatctaagagcactcaatcgatgatcggccggtcagtcgatcgatactgatcagacattgctcatgattagctgatcagtactcattggtcagatcggccgggttggtcaactccgatgccttctccggacttgcggtgactgcc

SEQ ID NO: 14652 - DNA, 1942 bp, Heterodera glycines
gatattagaatttatgaaagacagtagatgttacacagtcaatacataatgtaataagcaatcagctacaattctcaccggccacatatcatatgagaaaaattgagatcagaagtcttttcataccgcgtggcacttctgatctgcgactacaatgtttgtacaagcattgttacgagacgtatgatcgtcgggtgtgtatcaaccggtgcgtatagcggaaatcctaaagagtcaccgttcgttgttgagcatgcaacaatacgctgtatcggtgtcgaagcgaatggcaaacacccccccccccccccccgggggcaaagggagggaaaggcacggggaacattgacaaaacaaaatgccaacaatttgagaatgaggcaatgaccggcacgcacacgcaggtcgacgaacatttctaaaaaaatatctcgaaaatattatttgaattgtcagaatcccgtctattctcggcttacattggcactaatggaggacagcggatggtaccgggctaattacaggtcaattaaccgatggagtcttcttttggcccaacttattcatgtgattagcattgccgagcagctccactggggacacgggttgggctgttcgtttgccatggaaagttgcgggaaatggatttgggagaagttggaaaggtgggccaagaaaaggcatttgggggagggggagaaactggcacttttaagcaatcagtcgacggcaccgttttgtgccaatataaaacacgatggaagccgatcattggccaccacacgctgcacagatcagagggtagggaggaaaacagacagatgaaagtgccattgcgttgataatcaaccaaaacacagaaatataaaagagcaaattattacagaaaacaaaaactttacaggagaagcacaaaaaacatattttctccactcaattttcgaattttagcgaacttttagcaaataaaaaatattggagtttagcaaatagatatctttgcttgtgtccaaaaagtttgctaagaaaaaggcattaaaatataaaaaaatttctctcgaaaatttaaataatattttttataaaacaaatattataaatatattacatcataaaatactttataaaaatttaaaaaactcttttttgtggatattttgaagcacaatttaaacatttcgagaaaatggcctgttttgaacaattttttgaatttttctcgagtttatcacaaattttgagtcttttttggcacataaatcccatccctggccattagtcaattttaacacaccataaataagtgaatccccaggattcgttggcattgtgcaatttggtgccttataaaaagccgctgcccgttgactatcgcaactttgcacatttgcatggagttcgtcacgaaggcaccaaatattatggaggttctgtggaattggcagacttttgcccatacaatcaggtggatgtgtctccggagggcgggggaggaggggggacagtacggtcgggatgatgtgcagtgccacaaaggggtgaggacagtgccaccgagggggggggggggaatgccgcaggggcgggcactgccacaaagggaggaggtgataatgtcgttgtgggctgtgcctccgggggagggaggacagtgcagtcgggtcaattgcgattcgctcaatcaaaaggtgctgggacgttagtcaaaaaccatcaaatgaataatttttgacagaaaattattcataatttcgtctaaaatggatcaaattttataatattgatatttttcgatagccctaagtgttttctattatcctgcaaatttttaaaaaaattctttaagtttaaaaaaagttatgacctgagaagctcaaaaaaccaagtttttttgaacatttttagtcataactttcttgaaacttaacgaaatttttgaaat

SEQ ID NO: 14653 - DNA, 1418 bp, Heterodera glycines
  misc_feature (22)..(22): n is a, c, g, or t
tttgagggttcattaatatttnttgacaaaatttcacattgaagcgcgttattttgttgctgactccgtgcacaataatcgccgcttcgtccccactcggcgccgcgccctgcgcccgtccgccggtgctgccgtccggtcccaaatcaccgcgttccaactgatggacgacggaaatgccgtagcttaaatggcgaattgcagcatttacttcgtttatgtgtcaggaaatttcataaagctatctcatcattctatctgataatcaaaaggtctctgatcacttttttggatttacaatcaatgtgccctctctgatcgatgatctgattatatgtctgacccattcttttgtgtttccctcttgatttgtgctgatacggtggcttgaggaccttacgaaattcggattatattcaggcagaaatatgcatatgaaaatttttatctgttggaaaaacccgtaaaccttataaagaattacatatacgaataagagtaaggattatgtttggctgggtacttatacggggtacggattagccggctaacccgtaaaatccgtagcccgtaaaaacccgtataagtcgaaaaaaataggggttgcaagttaagtgtccgtaagaacccatgtacgagtccggcccgtatttgatctctttattgattagtcaattttgtcttcatctgatctatttatcagttagtgttaatttttcaaatcacttttgtttaccgattgtgaatgaacacgcgaaagtcggcgctgaactcggcatttacagcgcataaaaatggggacagaagttggagcagtacgactttgacgtgcatctgctgaacagaacaacaaacaaaccaataataattgttggggaaagagaaattaattttgcatttatttacatacatccaatttggaagaagcggacggcttttcaatcggctgctgctggacgatgttcccccccaacaataaactttcagaaattgataaaaatttagtgaaatgcaatgcaataatattcaaaaggagaaaaaatttaaatccctttcaaattggatgacttttaaaaaattatttttcggtgaaattttattaaatataaagcctccttaaaaaggttaatttttgtttaattcctgaaactttttgagaacggtaaacaaatttgcaaaattacgaaaaataattaaagtcatgtaaatactaattaccccttaataaacagtcggtcgaaagaaagatatattttatttttttcatctatattaaaaatccctaattctattggaaaaatttgaaacctttaaaaatatttgttcctagattttttgataactttttgatcgaaaataattttttagggagctataaaagagttttttgaaatgaatggaattttcattcttttttt

SEQ ID NO: 14654 - DNA, 2584 bp, Heterodera glycines
gacgtgcatctggtgagcagaacaacaaacataacaataataattgttggggaaagagatattaattttgcttttatttacatacatccaattttgaagaaacggacggcttttcaatcggctgctgctggacgatgttacccccccccttccccccccccccccgactttctcccatctttttcacacaattatcccaccccccgtgtgtgtttcggattgatgggaggcactgaaaaccggcttaattccgctaatcccgccttgtccgcgcacatcctcagccaaccatttctcggacaaaaattgtaataaaaacgaatttaaatggaaaaataaataaataaatacaaaaagcaaattaaatggacagttagggacaaatactgaacagcggaagacattttcaatttaatggtacaaattttttcattcgcacaatgccgtaaatggtcgatcatttatttgtattttgactttcggcaaggctaacgaagagacaaatgaaatgaaagcagccaattgccagcagatcacattgaatattgacagacactctttattttattcatttcaatccgataaattattcttttttttcttcttttttttgttttttatttttcctgaatttcacttcccctccctttccctttgctttcccccgcgtgcttttggctcatttctcgcgatcgttccacttcccacacataataaaagaacaataaaatgcgaaagaatgagcaacaaattgggaaaccaaattgttttattgagaataatgaatgaaagacggacgaatggccaaatgattggaggaagagaaaaaagaaagaaatgaacgaaacggataaagaggagggaaaagcacaaagggggggggggcgagaaggaaaaacagagagaaaagaaagggcaaaaggaagagagaaggaggaaaaaggaaaagaagaagaggaggatgaagagagcggaggtgtggtggtctgcccactcacaactcaccgatcagtcattgtcacttgtgacatttgcgtaggccgcgcaaaaatgatcaaggggaaagtgacggagtgtggccaagtgggaggtgcagacgaacagcgaattggaaaatgggcgagaaagcaagacaatgtcagagggcagcagacacaacgaggaaacaatgcaatgccggaggcaaaaaaggtgatcagaaaatgatgggacaatggaggttcccgaggggagggcgcaaaagacaaaaactaatcgggccaaagagtgaggaggggcgagaggggaggggccaatggagggggacgaaagaggggtccaaagggagggggaatagaaaaaagggagagagagaggaaacagaggaggaaagtgccaaggggggagagaaaggggaaaggtgcggagggggacagaagaaaaggggaggagagatagggccaagaggggaaaagggaggggacagacgacgaccgaccgaatgtcaaatcattcagttgcgcacgagttttgtgcagcaccgcccaaaaccaagcagaagggacgggacacatcaatcagtggcagaaaaagagcaaaattagtggaaaaggggaaaaggtcggaccgttcgtcggctcattttgtgcatttgcaattacaacggccgccggggaatggccggacattttgctgatgatgggcaatgggttaattaaaggcgtccctccccctatccgccgcgattgtttcgactaaacgaaatttatagaaaaaaaatatgaacagatgggattttttggattcaaattttaatcttcgatttccgattattacccaattcaaaaagcattgattgttcagtaattgagacgataatttgtgagtcccttctaatgattccttagctccgatcagtgccaaatgatcggtcattaattaacttcttcaattttcagtccaattctttctctttgtctcgtccaatcatctttgccaatgtttgtccgttgtttcattttgcctttcatttctttggcattttttgtgtccttttgcacggcaatgagaagaaatccatcgggtaaattgccattttaaaatgaatgtatttggagttaattaagattatgatcagtcacgggtgccgcccaatctgaggataatttcatggtcaatttattttctattaattgtatttaaataattaagattcattaaaatattttcgcattgaatatttttaataattgttttcttccaaaataatttatttaaatatctaagttttttaaagaaatctttaagtaattctgcacataaataaaattaattatatttatttaaaaattatttaagtttaaaatattcagaaaaaatgcaaaattaaatatttttgtgaaaattgctgtataattcttttgtggggttgaattctgtccgattattaattttaaggcttctcggcgtttggcgttcagagcatgacggcaaagcggtgaaaaattcacgctaattaattttatttttttgatatttttttaagatgtttcccaccatcccaaaattcacttacggcgaagaaatttcaattgcactttcggac

SEQ ID NO: 14655 - DNA, 1251 bp, Heterodera glycines
ggaaccgctcagttgggccgtcacgtttggaccggcacggttgggccccagcatgcttttccacccactatagcttttttctttgttatccaaatccaacaatcttggtatcattcgaaagctcttaacatgcttattagccttactaaaaaacaaaaaaagttttaagcctggaaaaaatttattaagaaaaaatttaaaaatttcgactttttgcaattttcataatataactttttttggtaattgtctaatcgctaagcaatagcttagaaaaaactttaaaacatgttaagctttcgaatgataccaagtttattggatttgatgacaaagaaaaagctcaccaatccctcacgtacattcgttccaaaaaatctttctgaattttttttcaatttttcggggatttattgaccacggatttcaactcttccccctacgatttctcgggagagatttctcgatctctcgtttcttcagtttgtatcgtatattgatcccaaaaaaaaactaataaatttatttgtaaattttatgcgatttggtggccacggatttcacctcatcctcccatcacctgtgggtctcagttctcgtggttcaattctaggcctaaattccaatactattattgttcgaatttttgttagtgatagtcaaatgagcattccctacccacttctaacgcctataaaaagcccaccaatttgtcgtatatcatccaaaaataataaatataatttgtaaattttacgaggatttgatggccacggatttcatctcatcttcccatcacccatttgtcggtctcagttctcgaggttcaaatataggcctaagttctcgggaactttctcattagtctcagttttcgaatctatagtagatttactattgtaaattctcggctaaaaattttcgaagaagcagctaattttgaaattcttctggtggcgtctatcagcacccaccatcgttaaatgcttcctctaaaaatcttggaaatagcgtgctataaaaaactgctgcaatgagtagaaaaaattcacgccgagccaaaagataaaaaaaaacatgaaactttttgttaattttcctaaaaatcttggggtgatctgggaattgaacccaggacctctcgcacccaaagcgagaatcataccactagaccaatcaccctaatgcttttcctcacgagaataagcaatttgtgatcaaaagggcgcacatttacagcaaataatggaa

SEQ ID NO: 14656 - DNA, 2529 bp, Heterodera glycines
  misc_feature (5)..(5): n is a, c, g, or t
aaatntaatcacaattatcagcagcaatttatcggcatcaaaaataacatttgataatttgatgatgaatgctttacaaattctctgtgttttactaattcattttaataaattttagctcattcaacagatggaaactgccgtagggggcttaaaataaaaattcaaatttaaaacattaatttaattctgtatacaattttgttatgttcatgcttcttttggcttgtcctcttgcaatgattgaacatattcttccaattcagtttctttttcatccaacgactttcctttttgacggagtatttgctttatgtgatttttcacctaaataatttatataatttaatttatgaggtaaataatttaaaattaaatgtataaagggtaataacttataatgtgagaatttaaatttttatcaactcgtaaaccagttcggcccggcaattcaaaatcccggtttgactggctttgaagatgtcgggaccgggaatcggtttcttttggaattaacacccctgcccgactaggcggatttgcaaaattgtgttttgtctctatttataactaattttctgatggaaaaacgaacatatggcggattttatattacagagttagcttaaagcattaattaacacaaataaatgaaaacaatcactcacattcattggaagcagggatgtgcgaaaatcacaaaaaaaaattttcgtatacgaaaacgaaacgaaaaagggcattcgacacgaaaacgaaacacgaaacgaaaaaagaaattttgaaaaccgaaaacgaaacacgaaacgaaaaaattttgacggacgaaaacgaaacacgaaaacgaaaaaataaccattttcgtacgaaacgaaacgaaaaaaccgaaaattttaaaatatattcaattttaattaagaactttaaaattgtatcctctaactgagggaattaagacctagtaggtggaaaagcggatgtggctctaggacaggggtatgaccgaaaaattttcaaaataagaacatcaaggacaaaaaattattgaaaaattttacgaaattggaaaaaaatgttttttgtgataaaaactcaaaatttttacgattttgaatagcatttcgttcaattttttatgaaattctatttaatttccaattcgtaaatttcatttgaaatgaatttcgttttaaatttcttaacttttttacgatggatttgtaaatttttcaaaattatagatacctaatttttgtgaaaaatcgttagcaaaattatataatcggttaaaaagcgcaaatttgttcgataaatctgttaacaatttgcaatcaaattaaaaaaaatttcccgccggcgcctatcggcaccgccggactccaaaaactcttgtttaatgttcgtaataaaatttagaacgaatctatattagtattttagtaaaaaaaaatatggtttttattgattaaaaaacttttcaaaaaaccctgatccgtatacgggtccgtatttttcctgcatacggacttatacggagtaagggttttccgggtttttagtccgtaagtctgtagtccgtatggatgcctagtccgtagtcctgatcctgatccgtattttcgccaaatgtcgctctctaaaaaaaatatcaacgtttcaaactttacatacaatttcctggcagatttaatataatacttcaagaaatatcttattttttcttaccaaaaaagtcattcttaagggtgtaaatattttcgtctttttcgtccaattttgctctgacgaaaacgaaacacgaaacgaaaatccaaaatttaaaaaccgaaaacgaaacacgaaacgaaaaaactttggtagacgaaaacgaaacacgaaaacgaaactcaaaaagtgccgaaaatgtaggacgaaacgaaaacgaaacgaaatttcgtccatccctggttcaaaacagcgaacagtaaagtaattaatgaactgcgaaaaaactaatttagctggagaaattatgaaatcttcaattacagcttttgtccttttttaaaaaaagcatacttgtaaaaacctataaagcacatatttcttatcagagctcgtaagtttttatcaaaataacgaaaagaattcgacccaaacattttgattccaaaaaaaaatcattaaaaaattacttttaaacattatatcgataaaataggtaaaaaggtttgcattgttatgtaaataaattacaaacaatttttcaggaaaacagtaaatttttcttaaaatgaagggtttttgttaattaaaataaaaacagtaaatgcaatttaggcgagagaattcattcgcttttcaattccattgcaattttagcagaagagatgggaaggatcgaatttgaaattcgggccaaagtttgcctccaccaaatcgccagcacagaacagggaaacgcacgggaacaaaagaacgccggaggcggggtaacggaagtgaatgcccaaggcggaggagcatggcaaatcaattaaatttaattaa

SEQ ID NO: 14657 - DNA, 697 bp, Heterodera glycines
ggtcttgtcttggcatttttcttaattagccttaccttatgacttgtgcgcacttttcattaaatgccatttgttaaccgtttttccaaacaaacattacaattgtttttagcgctattcaaaatgtaatgccaaattttagttgaaataatttctaataaaaattaattaactttcattttttatttgaaaatatttatttcattaaaaagttaagaagaaaaatcattttgacttttctaggagaaaaaattctcttacattttgtgacttttgtgaaatcccggcatttccaatcacatcccatcgacaacaaattttttctgaaattttgctcccgaaccccgacatttctgtccccgaaatgttcgggggtggggggcggcaactctattttatattgttttaaaatgtgtacttagtgatgctcgagaccgaaagcttgaaaaccctaggcccgagacagagattagccgggcccgaaaatccgagactcgagactgaactcgagactagaccgcaaaaacttcaggctttttttgagtctaaactcgaaactgagacagactcccgagcatttctggcgtagagctttcaaattaagtgcccaccaagttaccactaatctaatttcgatgatggcaacgcccggcggggcactaccccctcccccccacaccccctcgggggggggggg

SEQ ID NO: 14658 - DNA, 2142 bp, Heterodera glycines
  misc_feature (5)..(5): n is a, c, g, or t
ctttntggagccggacttgattttctatgcttgacaccctttatttaaatttttgtactttcggcacagtgaacacactttaatatctttcgattttgggtttaattttttttgaacagtggattaatttttcatatttttggcacctactggatttgtatttatacttttggcattatgtatgtcaatttttggcatcttttgcatcgtagtgaattcaaattattttttgcttttggtattttgttcgttagctttttttttcccctcgcccgcgtgccgattactgtgtggttgccctttacaaaagcttgtttttcaatttcccatgccgagatttgcttgcgcaataagccggtgtgccattcattagtggcagtcgcctcgggggatgccattaaacaataaacgaaacttaaaaatttttgtttttgcaaaatgaatgcctccccctcctccgcccaattctgcacaggccataaaacccatgcctgcccaacccaccaccccttgggggaggcattaaaattgtttttgttggaattggcaccacagtgccgtgccacacacaaaagcgccctaaagctgcttttgctttgcagctgctgctgctgatgatgttgatgttgatgggggatggatggctcattacacttactcatgttgatgccctcccccataccaatgctttatccccctaatttctctcctcccaagcaggcggccgcacccttagggacaaatgatggcatttttctgcccatcccccccccccctataccaatgttttatctccctaatttcccccatatcccaaagaaagcaggcgtagcacccttgggggcaaatgatggcattttgccaacatttgaataatgtgccaacatcgatcaattattggtttttatttgaaaatagcggcgctttttccattgcactcttaacattttcattctttggcactcgtccgtctgttttggcatattccccccccaaaaaaaaacataattgatttgatggatggcacactttcaatcaatgaatgtctgactgatcgagacaaaaaaattgcaatcctcctaaagccattttctggacagttcagccctaactagggcgaaaaaattgcaaaatttactgtacttcgggctaatgacactgatacaaaatttgcgaaaaaatacaaaaaattttcccgttaaattcatcccaggaaaaactcatgtccccaagtacatacatacaaaagtaatgtgccaacacaccagtacgagtccccaggtccaaggtcctggcctaaaatcttggtcctatgctttatcttgggtaggatataaaagatcttgggactgggtcttcaagatcttggtcagtctcaaaaattgcttatatgcactattttcacccatttccttgaaaagccaacagttcttcatgtttttagaactaactcaataatttcccggtcaaatccatcgccggacgattcagtccccaatctcaattatttttcctaatttattcaaaagccaacaatttattcatgtttttagaattaactcattaatttcccgtcaaatccatcgccggacgattcagtccccaacgaacacttggcacacacaaaaatttgtgtatgtgcccagataatatgcactttagcccacacccataaacaattttgcacacagaattatagtgcccttccctctccctcccatgcgctttttcatcatcgcgatttattatgcaccttcgccccctccccattcctctgcatcataagcatgtttttgtattcgtgctttttctttttatttctgctgtttttatttctctctctgtgtgtgtgccctctgggcgcggctatgctatgacagcgacggcaccaccgcgccgcggggcacaataaccgttgtacgacgtcctccccggcttttttgtccttccgccccattcgtttgcctcccccccccccgcttcgcttaatttcctgccctcccccccccccctcctcccagacatttgtcgtcgttgttgtttgtttttttctgtctgtgctttgtgtgccgccggccgatgccatccccgccgggaccaccgttttccccctttgtgtgtgtgtgccgtgccgcacattct

SEQ ID NO: 14659 - DNA, 783 bp, Heterodera glycines
cccccccccctcccatcggtgtgccaaagggcggattaagcggggtggtcggttcagtacggcaccagtgagtccccccccccccccaacccgtcggttcttcgtattaagacaacagaatgatgcttacttaattggagggagtgaccaaattgtgcgtcataatgcaattaaggagcatgaatgaattggcaccacaattgagtcccgaattttgttgtatttattgtttgtgtattcgtctggcacaattgtgtaccgaattctctatttaatggttttattattttgtatcagtctggcttgcgccattacttgactaattatgtaattgttgggtattaatgaggtcgtctgacaccattaagtgtcttctgaattcagcttgaatgcctgacttctgcaattagatacatatgtattaggattggactttgaattttctggtgctggcatcattaattcttaataggtaattatcgggtgcgttaatgaatctggaattgagactcgagtctaaaatactctgattaaggggatctgataatgaacaaatgtggcctaaaacattgatttccatcattaatgctaattgatttgagcccgagacctttagagttcgattttgaattttggcacattgcttatttacccgtaaaaggcatttttactcatttaacacagagagacggacaaatgagtcccatgacgttaggctctgtctgactcatgaataggcctgatctttaaaggtgctaaaaactgccaaaataggtaggtttt

SEQ ID NO: 14660 - DNA, 3668 bp, Heterodera glycines
agaaattctttccacagaagcgtccgccgttttggcattttcctatttcggctttacgacgtgtgggaatgggtccccggggtcaaactttggaaagggccactcaaacggaacagtcgacgggaattgtaatcaactgaaaaaggcaatttgtcaaatcattgccgcaggaagttttttttggcgagtgaaaagcagtgagaataatgaactgcaaattcataaaatgaatctaattaattaattttattaggacatttttaaaaagaaatggaatttcgcttttgtactttcccataaatccaatcgctctaatggcatttgccccccccccactctctcccattttccccaattttccaatttccatcaaatgaatcccccccccccaacaatggccacaaggtgaggagaaaggcatagggccaaacataaagcgtcgattatggcggcacaaagaaacggcgaataaaacaaatgatttctttcgagtgttattttgtttggtttatttattccagcatttcatttccactccctttctttatggctgtgctaataacaacgttaataatattgataataatatggtaatccaattccttccccatttcacccctttgaccccttagggaatgccatcgtccgccaatttcgccgtcgccgttaaatgcccttgcgcttctgcgccttttcatttgcgtcttcttccaattatctttttcttttcttcataatcactttcccccctttattctttatcatatcacttcttaatttcttcttcgatgttcttcacactttcgctgcttttcctcttccgctgcttttgaggcgcaattcgattggatttgccctcaaaagtgccgaaatgagtgccgtcgaatttgaatatgccaatgacgacgatgacgacaggcagcagcagcggggggaatgtgagattgggtcgttggagatgccacgctccgaatggcttttctcctccgtcgcgacctttcagcagagttacggccaagtgcacccctatttggccgctgttttatgtattgtcggtgagtaaactgagtaaataaggagcaaatgaaaggcaattaggagagacattaaggacaattaataatttttacggcttttttcgtttggctgaaaatagcagcactcatttgggctgatttgtgctgctgttggcatttcgttttgagttccctttgtcttttccgattacagaaactaattaattgtcccttgggtaattattaattgcccattggccaacttttaatggccctttgctaattgcccccccccccctccaaggcactttgatgaatgctatcactgttttggtgctcactcgcccctcaatgcgttcccccgtcaatgttttgctcagtgcggtcgccgtctgcgacatcgtcgttatgtcctcctatttggtttttgttgttcactttttgttgaccgccgcttcgcgctgcgagcccagcgacttcagttacggatgggcactgttcatggcaagtgaaaaagggcagaaaaagggaaaaaggaaatgaaaatttaaattaaatggagatataaaataaataaataataaaattcaacagaattcctaataaattgttcagattttccatgcccatgcttctgtcatttttcatgccgcttcaatttggatgacggtgagaaatgagaatcgaaatgccccccctttttcccccgaaaatgctaattactattagctaatgcacaaatgcttttccgctgaagtgcttggcatccaaattcactttcactttgcaatttgtcaaggtttccctagcccaaattcgcgtgctgaccattcgccgtgccaccgccggcccttcctctccgctggtcacagaacgttttacggtgctattagctgtgctgatgctttgtgccatgaccctcgtcaatttgccaaattttctaaccttcgaagtttgttgcctctgcccgatcaataaaaactcaatcattcgataatcgacgatcgattgccggatcaattaataaaacgatctttacagataatggaagtgccctccagctcaatgttgccctgcttacattcgcccgactccaccgaattagaaaatgacggctctttgcaaaatgtggcaaaagtcatcggcacagacttttcacaaaatgacaccgcagtgaaaaatgaatcaaatgctattttaaacggaaaaatgctcaatgacagcgaactgaacatatccaatcactcttctgataacttaacatttacaacaataacgactgcacaccggatgagaaggcacagagagacgaatatcagcatgtggggaaagaagcagaaagaaaggaatgataaggaaggatatcaaaacagagaagagagagagagagagagaatgggagaaagagaaagtagagagagagagaggaatagaaatagagtgagagggagggagagagagagaaaaggggggagaaagagagatcggaaaagaaagaagagatacagatgagtcataccgtatgacaaatggtcgatgcgatcactgatcagattaggatctgctgatgggatggggttgaaaaacaaaggcttccccatttaaaggcattcccgtggaaattcggagccctttggcaccaaagacagtttcgcctacaccgtccgagcacatgacagcgattgcatgaaattgaaagtaatttgaaaagtgccggggaatatgccaatccatttcttccgattttcccatgcctttgcctcttcagttggccttttggtctaacggaatgatcttcaaagtgatcccgtgccttttgctgactttgtccatttgggctttgctgcgcataattgcggacgtggcacacaaaaggcgcaatttggcacaggttaattaaggtagaggagggacacgtgccaatgccaatgccaacgatatttgaggtgatgcgcaagaaagtggtgccaaaggaccacacgacgccaatggtgagggaggaaacgcaatttaaattcaaattgaattcaaaatatttcgggcaaaggctccaatttgattctcttttagctcgccgctgttctgctcatttttctgctggctgagcttccccaaggccttttcctggtgctcaatggcattttctccgccgaatccttccacaaacgcgtttatttgccgttgggcgatctgatggatttgctttctctgctcaattcggccgtcggctttttcatttacgtgggaatgtcccgtaaattccgcaccgttttcctgcaattgctcttctccgtcctcagctttctcacgaggtgatcaattgttctgatcagtccataaaatttcgaccattccccttgtgccatccctttttttcaatttgtcattttttgccattatttttttcttttgtttttcgattggcttccgccgatcgttttttggcctttttgccgttttgtgtttgatcagtagggctcggatttttaggggcgaaaaagtccaaaatagggacctaaataggggcaaaaaaatcgcgaaataggtgcgaaaataggggcgaaaaagtttcaaatgtaggggtgaaatttattaaaattgctgttttctctatctaaataagttaaaattaaggcaaacaattttatcact

SEQ ID NO: 14661 - DNA, 1072 bp, Heterodera glycines
atttacaataataatttgtttttaatcatttaagcatttttgaaaacttgaaaaaaacattgtcacttgaaataataaattctaaaattttgtccaggaaatccagtttttttcttgttttgcccggacctggatttttttttctcatttgacctggatttcctggacaaaaaatccaggaaaatccaggtgcaggaaaaatctaggttgcagaaaatggcctggacctggatccaggaaaaatccaggcctggagcccggtccaggtcgagctctaattatttgaattaaaaaaataataatttattagatatcgaatggcaaatttccatcggattttgttgttcattttgctgctcagcggttgtccattttggccaatccatcagcagcacaacaaatgtacgtccaccacactgattgtatgggcagcagtgattgtggccagtgaaattgatgctggtgtccatgcgctgttgtggcgcgaggcagacgatgccaacaacagaaacttgagcggtgaaaaaagatttttttttaatttaaagctaataaatttcattttttaataatatccagaaatttgaagttattttggaaaaagcaaaaagcaaaaataaaaaattttaaattatttaattccgatgaaatttcgtaattatggtacatgctgtccttaaattagttctgtattaaaaaataaaacattttaatacaaatatcaaatcaggcaattattttgcaatgaccgatttaaaaaagctatattttatttttcaatttttattaataagttttattaaaaattaattttattccttgattcaaaaaaaagttatttttattgctttgattaaattttttatgaaaaagtttttttattattaaatttttgtttctaagaccgtgccgtgagtgctacaattctgcaaaatcttaatatctataacagcggcgacgatgatgccatgggagattatgatgaggagccggtccattacagattggaacgacatttaatgtcccgctacaataataggcaaaaaaaatattttaatttttaaatatattc

SEQ ID NO: 14662 - DNA, 1728 bp, Heterodera glycines
  misc_feature (127)..(127): n is a, c, g, or t
  misc_feature (133)..(133): n is a, c, g, or t
  misc_feature (165)..(165): n is a, c, g, or t
gaaattttatttaatcaaagagcaaaaaaatatattcgaaaattcactcatttgaagcaatggtttgctgtgacacacaaaaccgaaaaatatcaaaaatttttaaaaaataatagaaaaagataanaattanaatttatagattaatccctcgtcgctcaacgnccaggttcaaattttgatttcatttttttttaaagcaaatttttttagaccaatccaagtccttttcaccattggcctttatcaaatcattgaagtgaacgagccgcaacaatacattcttctcaattcgtggattgttgaagtaaaacatatattagtttaaaaattttctaataattataattacttaaaaagcatttaaaataattaagattaattttaacgcatattttggaatagaaactaatgaataaatatcttacactttaagcgatgaataagtttaattatttaattaatttttaaagaattaaaaaataattttaaattatatttcaaataaaacttaattattatattttatttgtaatcacattaagtgataaatgaatttatttacttaattgaatttaaagcacttaaatagtataaaattaatttacacatttcgaatatataatttattaattatttgttaatatgtaagcgataatatattatatttacataaaaattataaaaacataaaaaatcaatgattttttcgaataaaatttaattaataatttataaattaataacttatttaaattttaaaccattaaaaatatttaaaattaattagttttttgaataaaatttatttaataattttatttattaatttaacacattaagcgatggcgcgatgatttgctgcactgggcgcccgctcaatttggtggattgcgtgaaattgtgctcccacgtgattcagtgattgatttttttaaaattttacttctattaaatgtatatttttaaataataaaacataattataggtgtggattccggacacaacattatacaattcattggtcatggatgatgagcaaagccgtcgaattttaaatgtcaaagtacggtaaaagaaaattataattggaaataatatttaattttattaaaaattatcaaattgattaattttatttataatttattaataagcttttcagttgaatacactacaaaaggagaaatcggctttagtagagtgagtttaactgacagaaatgtttaaattttcaatgtttttagaatgctttatccgacattatatcaattttcttgcatgttagaccttcggtttttcccgtacgacattcaggtaaattattgtctcaacttgtgaagccaaactttaaaatgattcatttaaaaatgaaattcattattttggtctaatgtattgcgaaattttcgtttgtgattagcagcaggctttcgccaaaatcttaccacaaaaatgtgttaaatttaaaactaaattttccaccgcacaagcattgtgtgatgatgttcggcagttggtcccatgacaacacgaacattgactactttgcctacgatgacatttccgactcggtgatgccgcccgcactggacgcggacggcaaaccgttgcacgacacaaccgcttccggtggcattagcataaagcattgtatcccgaacgaaggctggaacattctttccatagagggtctaattttgacatctgtttctaaggctaatgat

SEQ ID NO: 14663 - DNA, 2600 bp, Heterodera glycines
tttccagaaggctataaaatgcaataaacaattcgccttcttggatagaaaagaaatgggctaaaaatatttcatcacttagtcgtgaaccattacaagatttctatagcagggccatattggcaaaagaagcacacgtagagcaggctcgaaataagggcaaatgccgaaaattttaaaaattcttgttttattagacccactctgctttgactggccatatctcgccagggagtggcggtagaccctttgttgatacatttgaaagggtagagcgcgcctagctcattcgaatagcatcaaattggttgcatttgtcccgaaacaacccgcttatgacacgtctaaagaaaatccgttaaaatttgcattcacaaactccattttttcattggcaaacgtgtaaagcaaacccgaaattgataggaaatatatattgctcataataaaagtacaatttttatttgtcccacgccattttctgggaaaactttttcgcgaaaagccgaaaaattttccatcggcctcttccaacggcaacagatgcgtttcaaacaattgacaatataattatgattgaagtcaaaaagcctctttagaaaatgcttaaaaaatttttgttataaatgttcacaaaatattttttttgttactgacaattcatttccattcaatttaaaagcgataaataatgtattgagatatgaacaaacatctagaaaaattatctcaacaatctgtcagaaacagtccaggaaaaactttgcgcgagaagccgaaaaattttacaactgcatcactgttcatttgatagggtcaatcaattcaaaaacataacttaatataaaatattgataaaaaaattattttccttcatctttagaaattgcccaaaaattgttgttgtaaatatactcaaatattcctaaaacaagctttatttttactgactatctttttccagaaggctataaaatgcaataaacaattcgcatgcttggatagaaaagaaatgggctaaaaatatttcatcacttagtcgtgaaccattacaagatttctatagcagggccatattggcaaaagaagcacacgtagagcaggctcgaaataagggcaaatgccgaaaattttaaaaattcttgttttattagccccactctgctttgactggccatatctcgccagggagtggcggtagaccctttgttgatacatttgaaagggtagagcgcgcctagctcattcgaatagcatcaaattggtttgcatttgtcccgaaacaacccgcttatgacacgtctaaagaaaatccgttaaaatttgcattcacaaactccattttttcattggcaaacgtgtaaagcaaacccgaaattgataggaaatatatattgctcataataaaagtacaatttttatttgtcccacgccattttctgggaaaacttttccgcgaaaagccgaaaaatttccatcggcctcttccaacggcaacagatgcgtttcaaacaattgacaatataattatgattgaagtcaaaaagcctctatagaaaatgatcaataataagttgttataaatgttcacgaagtacctttcttgttattgacaacacatctccattcaatttacaacagatacataatgtattgggatatgagcgaacatttagaagaattatctctacactctgtcagtcacagtccaggaagcaaagacaacgagaagctagaacactgacaccacggactcgcccttccgccaggtgccgtccccccgtcctttatggccatttgtgccatgaaattcccaattgttggcccatttttcgttgttttttggtttcccattaaattcgtttgtttttctcttttaggaatcttactttttctgggccttcggtgtccatgaaccgggtctgttcaatcttttgttgttgtttttcgactcattcgatttccacagattgttttgccgcggttgacgttgaaagtggcaaatcggccattttcccgcccaaaatgagtccggacagtgcaatttgggacggaaagtccgttttttcggaatttcaattttactttttccttaattttatttttgcagaattcagcccgaaaaatggttcctggacaaatacaaagtcagtgcaaaacatttgagaagcctttattgtgaagtggcctctcttttttctcaggttgacaacgtgaactttcaaacgaatggcgccgaaattggccaatttttgcacaaacttttcaacgccaaaaaattattgcttttggtcggtctttaaaaaaattcttataataataattaagtatactgcttcagaaggcagaaaatacggacagtggaaatgttttggagcccgcaaagttcccgggaatggacaggttcgtccggaaatttattttgtagaaaatcggacaattcacactttttatttaatttattttccctgtgctcaatttttttttgtttatgtctttaaaaagcttaaattgactttttgtttcttagtttcctttttctatttttttggcattttccgacattaaataactccaaaattcgagaaaattccactatg

SEQ ID NO: 14664 - DNA, 2616 bp, Heterodera glycines
  misc_feature (2580)..(2580): n is a, c, g, or t
  misc_feature (2591)..(2591): n is a, c, g, or t
tgcactaacttgatcagatcacttatttatggtgatctttggacaccgaaaaaataaaacgaaaatcggtaaaatttcactaaaattaacggcctataaattacaattttttaatgtactgtatgcccttgactgcgtatgcaattttaataaggtcaggacgaaagttggacgacttacgtttcctatcggagtcaattgacgacccatcgatgaacgccgtcttaaaacactcataaaattattaattaactaaataaatattcatactgtacctccgccaccatttcgacatctttgcaacaattcggcgtttccgaagcggtcaaatgcaattgacttttgtcctcctcgtcgttctccgaatttgcgttgctcagccgttggtgctgccgcgcattttccaattttagctaaaaaaatgccaaaaaattacaaatcaaaataatgaataataatttaaataattaaaaagcaaatgccaataaaaattctcaaattgtacaaaaccttcactttgaactttgcgcccaacatgttgttactgtggctgttactgtagttgttgttgttgctggtggaaccattgggctgagagtggcggttcagcggagactgaaacggcggaggggaaaaagcaacgcgtgggaaagaccgaccattttattgtagacatttttttttgatttttttacttttctatttaaataacattttttaaccgatgaaaggagagaaaacgcaaaaaaaaaattggtccatttttctgttctttttattaatgctttattgtacaaaaataaaaaatgggctaatgcttaattaagagggttaaactgttccgggtatccgacgggtccattcccggacacacggctttttcaagacctggactcttctttttttaaatctaatattcggtacccgaatcggaagatccgggcccaaaaaacgcactaagcaaatgccggtcaatttgtcgtgccaaatgtgccccaccggtagggattaaatggaatttcaattttcaaattttgggcctctgaattctttgcccatcacccacgtgttgttgtgcaattagcattttgctggccttcggtggcactgtctccaccaccgttctgttcaccgttcttctgtccctttcgcgccgaaagcgctttttggccgctcgcataattttgtagtaaatgagcataatggcaaacaacggaatgtaaaaggcggtcgaagtggagaaaaccttagcaagggaacaatttgaagggtcattagcaaattaattaattaactaattaatgaataattacttggtaggcaatgtcctgcgaaatcaaacacacttgctgctcccgaactcgtgtcacaaaattctctgttttttttattatcaatttaaaagttatttaattaattatatttatataaaattaattaattaaaattttaatttaatttaattatatttccattagttttccccactcaccatcctttaagccgaattgaggtgccaaggaaatgagcagtgaaagtacccaaatgaccattagcattgaaaaaatgcgtcgcggcgttcgattctttaaaaaatgtaaataaattatgttcgagacttggccttgcgatgaattaagttttccatttctttgattaaccctatgcaatccgttgttttgaaaaaataaatattttaaattaaaaaaacccctcggtggggtttaattttgctttaatttttaaaataccgtattaataaataaataatttaattgtacatttgagtaggatatgttggtgacggaccaatatctaaaaaaacacatttattatttattaaaaagggtaaagactaaaattaaaaatttaataataaaggaaaggcaggaattttttgaataaaaatgtgacagaaaacgggacgaaatgttcggcaaaatgccaaactaattgggaaaaaaaagtggcatcccccggcacctgtcaagtgcaatggccaccaaatggagaatggacgaagtacagacgagcactgaaagaatacggtagaagaacaaatacgaaaggggaaggattaccgtcgacacttatccaaaagtcacacaaagtgaccttaaagggggtttagaaataaatgaatgaataattccgcaagactctcgagcatggcactaattaatcggataattaattaattggcttacccccaactcccacgattgtctcaatgtgctcagagcacccagcggagtgacgatcagaccaacctgacaacaaagtgtgctttttaatgatgtaatttaatgaatgtaagtgccctttcaaattaccattaaatcggccactgctaatgagaagaccaaataatattgagggcggcagcgcaaatcgcgctcaattaggatggcagtgatcacaaatctgagatgttttagagcgaatattaccaaattaactaatgcaattgccaagaagcatggcatggcattaatggacgagaaatggccaaaaaaggggaaaagcaattttgagtattacaattaaaaaaatattagaataaatttgaattttcaaaangaaattcccanaaaatgcaagtgaaacaacacgcac

SEQ ID NO: 14665 - DNA, 1032 bp, Heterodera glycines
ggtaccggttaaaaaatttttcgtatcggaaaaaatgcgagagagacaaaataaattgaaataattgaaaaaaataattaaatttatttctcaaatttctcgctatttaataaaaaaattttgtccacctcgagcacaaaaagcactcccccaacgccgccttcgtcgcccgtccgctcggctccgccaccgccccctctgcctggtggggtgtccgtcgtgccgtttattccgctgccaatgacaccgccgtcccaatcgacggacataataataacaaagagaataacaatacaaaaagcagtgccaataatttgtgccgctgatgctgcgcttcttcttcttccgctgcttttgccgctctcatctccgcgtgccgttgccgccgcttcgcttcggtttggccattctctgtgcttttgctgctcaatcgattcgatgcgctttttcacctaaggctgcggaagatgggtcacgcacagacagaaaaatgacagagagaaaagcggatgatgttgcactttgccagactaattcccgttgaagtgctgtgccaaagcacaccacgacgactaaattggcatggatgggtgtgggagagggcactgggggaaaggggaggggagggaacggaggggggggattaatgccacatttcaaaggcataagcgcatgagtaagtgcattggcactcatcagtagcagcgcaagaataaaagaaaatgaaaaatgccaattggcagcggggaaagttgagaagctcgagagtttcggtcggtctcgagtctcgcggaaaagggtcagtctcgaaagcatcacttaagggtaatgcgcattttattcacagagagagcaaattgagactgacaggaaaaggtgaaagatcgaacttaaaaggcgaaattggcaattgaatgagaagaagcgcaaaaagggaaagcaggaagaatttgtgcatggaaatggaacgaagttcagacaaaagaacgaaaaagagaagcaatttggcacaataaaaaaggaaagattttt

SEQ ID NO: 14666 - DNA, 2973 bp, Heterodera glycines
  misc_feature (1870)..(1870): n is a, c, g, or t
  misc_feature (2029)..(2029): n is a, c, g, or t
tgttcattcccaaaagtcaaaattattagctgcgaggcgatactgtattgatctaagatggcttataatctgttcgttaaattgctgctttgtttgaatcgcctgcggcttcttttgaccaaatttgttttatggttaataaattaaataattattaacttttttaaatttttttttgttaggtgttgatgggttgccaaaacgaattcagaaagaagaaaagcaacttgcactgttgcttttgtatgcatcacacaactttggcaaattgaaattgtttaaatgcgattactactgacttatagcgtagaatattttgatattaatcacttatatataagtatttggatatattttattttttaaacttatttggatatttttattttttaaagtcatttatttgtttcacttaaattgtagttcatattgttaaatttatttttttaattcactaaattatccgcaaatgtcggctaaccccgaaaacatgtctagccaacaaaatagtctgcataagagtgtcgaataaacaccagcagagacgggaaaattcaaaaatgagttagtttcctttgagaaatttctacttatttatgaaaataaaaaaataataaattgtttttcgataatttttaatgtccgtttttgttaatgctgtttttaaaaacaggcgagacggatgccccagtcacgtgtaaccaaaattgaaaaaaaaacaatttctgcagcatggagcaaaatgtgcagttgtttttttaaaagaaaattgaataaaaatattttcttatttgaattttgttatttaaaaaatattatatataagccaatttaaattggctatttcatcatttcccttaaactattatataaaccataaaaaattccattttcatcaaacattattaaaaaattaaaaaatttaatgcattttttcttctttgcccttgtttatttttatttgttgggaatcgaacaaataatgactatatccgataatttatttgatgatatttggaagaggagcggcattttaaatttgccaagaaaaagtgaaaatgtgccgaaaataaaagtaataaacgcggaaatttcccaaaattatttgaaatatttatttttcatttttaaggttgagccatttgacgagcattcttcggcagcagcagcagatgcaaaggcaaatacgaaatttgggaaaataaaaaaagaaaattttgaaattttcgaaaaaaatgctaaaattaaacaagaagaatttggtggcagcgaatcgcgccaatttggagcaattaaaattaaaactgagaatgcttcaaacacagaagttaaagaggagaacgaaaattatcgaaatttgtccgaaatttatgaaaaatggaacaaaaatgagcatgaaaagactgttataagccggacagatcagcaaaatccgagtttatcaagtaatgtgaaaaggaaattaattaaatatttatgggccattttagtcggcaaaaaaggattagagaaataattatttattttctaagttaaagttaaatttatttaatttgaatttgcataaaaatcaatatgtgtaatttttgagttgcaaaataaaaattaaaatatattagtttaaagtaataatttttatgaatatagatttattttatatatttttttacaaaattcttttttttataaattttttaaattatctagcttttttagtctatacgtcatcgagcactaattatggtgacagtaattacacgaatgatgattgcagtaattatggtaatgatgatgccagtattacggtaatgataatgacagtaattacgaaagcgagtacagtacagcaaatacatatgaagatgaattnggatgatatgattttgaagatcaaaatgaagtcacaaattcaaaatccccaaatttacaaagagtaattacttttttaaatttttaaatgatttttttttgtatgatttgggaatattttttttataattttttgcagttttgccattttgggaatttntaatttgtttctaattaatttaatttcacagaggaaaagcgttattacagtgaatcggaaaaggaagaatttgtgaggaaatacaaccaaattcagagggaaaagccggaaatgaaagacgaagaaactgttcaaatgttgaacataccaaggcggacaatattcagatggaggaagcaattagcagaaaaaagtaagcgccacaattaattaattaattaatttaacaaagtaattaattaagtcaaattatccgaaaatgacgaaatgcgtgaaattgtgagcgaatttgagagaagaaaggaacaattggcacaacaatgggggagagtgcccgagagaaggacgcaaaataaaattgcgaaggaattgggcgtcagcgcacgagcaattgcattttggaaaaaggaatttggaggtaattaattttaattaattagttttggcgaattcattaaatattaattatcatgaaaaagaatttgtgaaaaataacaaagttttctaagaatttgttccagaaagaaaagcataataagaacaactcttttgcgctctgtttagagcttctttggtcatttttataatgtatgtttttgcctattttggcatttttatcttggtttttggattttagaaatatcaaattcacatcctaacaatggcactaaatatttcaaaaaaaaatccctatgaatagcgagatttttcaaaaattttcccatatattagagtacccccaagcatttcgtaaagaaaatttggggtttgaaaatatttttcaatatttttgtctattttacaatttgcgtgcgaaatattgatcgaatccctgttaatttgcattttaaaaataaatttaattcaatttaattcattttgcagaagaaaagaaggacttaaaaaatgaaaagcttcgaattgttaaccgtttcaacaaaatg

SEQ ID NO: 14667 - DNA, 1009 bp, Heterodera glycines
ccccttttgtgggagtgaaaaaaaaaccccccggggggttctatgctatcaaaagtatcacaattttagttcactgactcagggacggtccctgggttttatggggcataaaaacccataattactgtgttcaaaaacgcttccataatccctgactagcccaagtgacgatcctaggctcggctggagaaactgaaaaccctgattttatattaaatgatcattttttcaaaaaagagtaattttggccacttgtaatggacgggggggggggattttgtttcgaaatagttaattttcatgattttttgtaattaaatgttccgagaatttcggagtcattaatgcgaatatcccaaaatttgtcagttaaatgttataatgacgccgagaaaaaagaattgctgaaattgtatgaaaaaattaaaaagaaacaccccgaattggacaaagaaaaaattgggaaaattctaaatgtgacgggacgaaccctaacaaattggaaaaaccaattttatgggaatgattccaagaacaaatgtgaaaatgtacagaagaaaagtaagttttttttattcaaaattaaataaatttttgaaatttaaggcaaataaaaataaagcttcaaatcccctttttaataaattataatcattataataattaatttaattaaatcattttaaataaacaaaataattattggagggaattaagtgaattattaaaaaaaaacaaaaatatctttttttctagaaatgcgaatttacacgaatttggaaaaaattgaaataatagagaaattctatagaattaaagaggaaaatccgagaataactggaaatcaaatgagcgatattttgggcatttcaaaatatacattagggcgatggaaaaagcaattcagtgaaaaaggtaaaaaaaattggcttttttatttaattcacgaaatttaaacagaaattttgtgaacacaagaaaaggaaacgtttatataaaaggaaaacaa

SEQ ID NO: 14668 - DNA, 1822 bp, Heterodera glycines
  misc_feature (212)..(212): n is a, c, g, or t
aaatcggtgactcagagtggcgccaaacccatactgacttgcgtcagctgccacgattacgggctttttcgggtcatactgagtgagaccaaagtccgactgtaaaacctgtttggctttttcaatagcggattgctgctcttcaccccaaaaccaaggagtatcctttttatgcaacaaagcgagaggagagcgcaacttacgcatctctntaacaaaacgcccataatagttgagggcaccgagaaatgatcggagagttgggagatcatggggcggaggcatgtcgcggattgctgctgatcgttccggatcagggtgaatgccttccgttgaaacaacgtgccccaaaaatttgatctcctttttgaaaaagtgacacttctcaatttgaattcggaaaccatacgaatggattcgagaaaataatttcaaaagtgttgaaacatgctcatttgcgttccttgaagcgatgatgacatcgtcgagatatgtgaacacaccaggaattccggctgtcaactggtccatggtcttttgaaaaatcgatggagctgatttaactccaaacggaagacgctgaaattggaaaagacccctgcgagtgtttattcccacaagagttttcgatttgtcgtccaattccaactgcaaatatgcatcacggaaatccaactgagagaaaattttcgagcagcgcaatgcatggaaaatgtcatctgttcggggcaaggggtgcctatttagttctagcgcatcattaagacccgtcgaaaaatcaatgcagattcttactgctccatttttcttacgaacgtagagcacgggtgcagcccaacgagagaagtcgactggtctgatggcatccatttcgagcaaccgatccaattccttgtccactgcgtcttgaacatcatgtggcacttgacgtgctcgacagaaaatgggagatgcatcaggcttcagatgcagaatggctttcatctttgaacatctgccaattccgggggcgaaaacttggggaaaagcatttttaagctgttccgccagcccttgaggttcatcgggaattgcaattgccaaagttttcggttgaaaatgttcggaactcaacgtcgttgcgattggttgttcagttgcctgttcaaaaggagcaatccaatccaaacccattaaatttggtgcgttggtgtcggccacataacaatcgaggcacttgtgaacacctttaaactcaaccgaacatttgaattggcctagcaaacaaagcttatggcctgaaaaagatcccacaattttaccacttttaatcaattttggccctccgagacttaaccacatcggcctttgaatgattgtgagatgtgagcatgagtcggctgccaattcgattttgtgtccattgatttggatcggaaccatgatccaatctcgcgcctgaacaacactgaaggttgacgccacacaatgcgactgagacacggcggatgggcacattggtcttatatggccgagattaccacaaccataacatttgacatttgacatcctttcgataagtgcagtccttgagcatgcgggcgtttccacaacgttggcatttctgtctttgttcctgtcgtttatcattaaaatttgagttggaccctttttcggaaaatcccgatttttctttggaaaaaatcttttggaattgccatcattcagcttttggggccgattttgaatcgcatgaacctgaccaggatttccgagtgctgccaccgaatttgcagcgattggatttccgcggcactcctcgaacaagttctcccatttgatg

SEQ ID NO: 14669 - DNA, 2360 bp, Heterodera glycines
aacgttgttgcgattggttgttcagttgcctcttaccaaggagcaatccaatccaaacccattacgtttggtgctttggtgtcggccacataacaatcgaggcacttgtgaacacctttaaactcaaccaacatttgaattggcctagcaaacaaagcttatggcctgaaaaagatcccacaattttaccacttttaatcaattttggccctccgagacttaaccacatcggcctttgaatgattgtgagatgtgagcatgagtcggctgccaattcgattttgtgtccattgatttggatcggaaccatgatccaatctcgcgcctgaacaacactgaaggttgacgccacacaatgcgactgagacacggcggatgggcacattggtcttatatggccgagattgccacaaccataacatttgacatcctttcgataagtgcagtccttgagcatgtgcgcgtttgcacaacgttggcatttctgtctttgttcctgtcgtttttctccatttgtcgcaaacattcgtgcctcaaatctttgtgcgcgtcaccaaggcctgaaatgaaaatcagacattttatctcctccttggtgatgttcatgtcggctctttcgcatttggagttgacaagcgcgccaaagtcgagcacattctgagagggagcacaggagagctgaaagcactcaaatcgacgaacaaaaattaatttcgtttcaccgatcaaatttttgaggcatgtaattgtttcctgaaaatttaattcagtcggttttttggaaaacctgctgttcataaagaacataatctgtggaagacaatttaccaggactaaccgtactcgcatatcctctcccaatgccatgccatccttttcaatgaatgggccgaacctgtcgaaccatagtgcaaaggttgagtcctgctccggatcatagcggaactccggaatctgtccattaatttgggaaaagagatcggaattattggcaacgggtgccgtccgattagtgaaagcattcaacaaatccaaaaattgcttttgctgcgagtccatttgcctttgttgcatttccaaagagctttaagctcatcttttggtgccatattttcaatcgggcgtcgccagttgttgtgtccaaaggacaaacaaaaataatatttatttgacagagaaaagaaaatataattttaaagtccaaaatcagaaaattgggaaatgcgacgaatgaatgaaaaatgaggaagggttgggaaatgggatacagtatgaaatggatgatgttcattcgtgtcaatacataataaaacatttaaattcctatccaacaagcacaacccaccagaccttgcatatattaacaaaattgaataaaaatggcctaaaatttataaaaatattttaccaaaatccaatcattagggggtgtaaaaaagtctcggtctcgagtctcgtaagtctcgaaaaccgagaccgagactgaagacccgagactcgagattgagaccaaaaaaccccgagaacttttctcgagtcgagactcgagaccgagtgtctcgagcatcactactaaacacacgaaattttccccacttcgctgttgaaattttaataaactaaagtaagaacttcattttaattagtattgtactaatcgtccagtgccgaatttccataatccaataaggtcttctaatatttattttctcatttatattttgatattttttaatatgagtttaaacattttctttttgttgtttttaatggcttttttattagtaaatagatcattcattataaatatgcattatttatatgtaacatttttaaaattagtttttatttgattttttatctcgattggccatatcaattagttaaattattttttatatagttatataactatacttttttaaaatattccttacttttcatgtcttaattaatatcataacattttattttaatattttgttgtattatacttttattgtaataaattaatattattaatttgttctttgttcattactgaaattatgatttttctatataaattttaataaatcagtgctcctgtgattatgttaattttttacgactttaattgtttaaaaatctatttgctttgatttttattatttataaaatatatttaattgcatgtgttatttttcttggtaaacattgactttcattaaattattaagacgaatcaattgattttttaagtttattatttatatatttaattataagttttatatgtgataatttccttttttattttaattgtttttaaattatttaaaaaaagggcttacatgaaattaacagttttagttaatcgt

SEQ ID NO: 14670 - DNA, 1691 bp, Heterodera glycines
agaaaaaggtgagaaaggatggcaattgctactcattcaaatttggccaaatcgcagaaatgggacaacgaaagttcaccagcaacagaggcaaaaggccaacaaaaaatggctgaccgttttcggcacttaccgacactctccgtagaagcagaagagcaatggcagaatgatcacaaccattttgaacccactaccgtactcgggcgcaacacgcgcaccgtatccatgcaattggaggaaagggacttccaattttggttcgccgtccttcccgaaaaggacacagtggcgacgcgacatgcactgctccaaattctgttttcatcagctggcgacggtggcaaaatgcagcagcgaatgagaagccgaccctttgaacttttggccaaattcgcgacgaaattttggccaatgcccgaacaaaacaaaatgacaataaaaccggtgggccattagtaaaaatcaatttaaatttggccacccaattaagctaaactaatatgttttgcttttttgacagcccccacacagtgaatggctttccgttttggccgattatgcccacggattggcattggtacgcggcagtcgcgccgccgtgcgccaacgaatcggcactgttcggttgctgcagcaaaacgggcaaagtgccaacgattggttcctcgcggcactgtttctctcctccagcctttcagccgaagcgaccagcgaattctgtgaacggtttttggaatggcgacggtaattgcccaattaaaaactaaagaccctatatattttttaatttttattccttcctcattattccttttaaaattttatttaaacaaatttccccaccccaaattatctgtcccatttaagcatttcctcctcttccgccccattttcgcttaatttcgactcagtttggcccgtgtgctgctccgtctcctccccctgccgttccttctccgaactgctcgcccttcgcgtgttcccccgcgtcctttcgttggtccgtcgttgcgtcgcctttcgtcccctccgggcctttctctgttcctgccgtattccctctctgttccacctgttcctcttctacaccaaccaagcttaccttggcatccttcctttccgagcagttcaggaataccttgtcgttgctgtgctgggcggaccggaatttcaggtcataaaataaaacaatggcactgaacggaaagtaaatttaggcacttcacttttgtgcagttttggcacatatttggtaaccaaaattaattcgcttaaatccaattttattttattaaattgaatttaattcccttcaccatttaaatttagcgattcttcgactcgccaccattctcttcacttttcttcaaaattgacttcacttttcttgcgtccgattttcttggccgacttttgcttctcaaaatacgcattcatcgaaatggacgaccattaaattgtgtcccaatcatttgccattttttctaataatctcaatgtgtgtgaaaaagacgggtgatcagattttttcaatttcaaatttacaaaaacacgtgttaaaatggcctcaatttgctgcctgttttcattaaatttggtaatttctgaatgccttcgttgcggtcgattcgtacggtttccatttgtcttgcgcaaatgtccgtccatcggtcgcgcaattccgctca

SEQ ID NO: 14671 - DNA, 1632 bp, Heterodera glycines
ttggattcggtcctgaaaccactatttaacgatcttttgcgcttgttctcacctgattgccatccaaatcggccagtgccatcccttgcccactcaaaagccaacggtcgtagtgtttgcgcttcttctcatcggacagcacttcctttgcaaactttagggtagtaagttttaatccgtttaattatcattaatttttgctgtgccagccttgtaaatccctgctaattgccaaaaccacctgcagctgttggaatcgtttgttcgcttcgtcgtccctcaaattgcgcagttccgccgcccctccgctgactttgtccggatgcaatgccaacactttccgtcggtactcagccaaaatttgctctttctgttgtcaaaagtgccaatcagtcatttttcttcgctcttttcactgatcactcactgtcgcctctttcggacatccgatcacttcgtaaagatcggtgggcattggcaaaatattttaaaataaagttaaactctttatttcgatagagaaatggaccattaattaagtgatagaaattttaaaatgcataaaaagagaaaaataaatttagtttttaagaattgattaaggaggcgaaggaaatgaaggcacaacgccaacacaaaacagcacaaccacccccgggggatgacaacgcatttgtggtattatttatattgatttgagggggcggcgggggaaatgcgcccacggcgctttcggaaacacagcacaccgcgtgaattattaattccttttcccaccatcagtttctcaaatattatttatttattcaagtaataaaagtccaaaagaagggacaaaggccgcttatactttcggaagagaatgatagtccgggaaacatgatgatgtcagatctccaacttgaaattaatcttgtaaaatgttttttacttttttatgaaggtgggcagtgaatttgatattgaaatatctgaatttttgcagatttcttgtagatgttttgtggttctgttagtaaaggagttttcagttttggttattttttgtttggttaccaaaataggaaaaggtgaccttttcctatttgaaaaattataaaggttttttgggttgaggtgagtagtatttttgataattttaaaggctgttatgatattaagatattttctcctggtttcgagcttggaaagttttagatattttagcctttcgttgtatgagatatagggaagacagcattttctgaaaacattttttgtagtttttctggaatttttccaggcggtttatttcttttttggttcgaggattccaaattcggttgcgtattctaaaaggggtcgaatataacttttataaactgtaatccaagtcttggttgatttggttttaattttttttaaaagaattcgactcttgagataagctttttggagaatgattgaaatatgtccgttgaatttgagtttgttatcgattagaatgcctaaatcacgaataatttttgattcagggaaagttgaatttttaattgtgtacggtatttttttgtaatttttacctaaatataagagggaagatttttttactgaaaaatttaagccccatgtttcagcacagtaaaagactga

SEQ ID NO: 14672 - DNA, 951 bp, Heterodera glycines
  misc_feature (862)..(862): n is a, c, g, or t
cctaccaagccaaaaactttcatttcgcctactaagccaaaattagtaggcgaaatgaatgtttttggcttagtaggcgaaatgtcgagtaggcgaaatgtcatgtagccgccttatttatccaataataaaatacatttttctcttcagtgctaagcactttcgccttttgacttttcggcgtaaaccaccgcctattttcaaagcttgtcgtcgcttgagtcgtttagtggcccaattcgaagttttgttttctgcggtcggtgccattattattatggcaccaaatctgcccaaaataatctgttggtgatgctggagattttaatttagtgatgaaacaaaaatcatgaattattttcattgaatataaaacgcccgaggggaaatagaggcaaaagtgcgcaagtggctgcactggagaacattcactgggcggaaaaaggacgccaaaaaacggacggataaatcaatgagaaaatggcacaggagaaacagacagagagaagagagacgaaaatgagagaacggcaaaatgttcgtgccgagcgaaggtacagctcccgagaaattgcaattatcaattggagctgacgacttattaactgaaagcttgggccaactttggcttccatttgattgttgtaaaggcgctttatggatgagtaaaaagaagcaccaacgaatttagaaatgaacacattaaacggtcaaaatcaacaacggcaaaacattttctaatcactgacaaagaattttctgatcaccgtccctttcctctcacttcagcggtcactcaacaacttcaaaagctggttacgttctttcgaatcgcgcaggtcatcggcaaatgcgagcgcgngtctcccttttaatttgttttttattggctaattaatgccatcaagaactgacctttggcatcagtctgacttttgtcggctccgtttt

SEQ ID NO: 14673 - DNA, 3147 bp, Heterodera glycines
ggaattagcaatataatttttaataaaaatcacgcgaatggcaccgaaaaaagtgacaaattttcactaagaaaaaaagatgaactcaaactgctaatgcatgaaatgcgttttgaaatgcaattttgctatatttcggaagtcactgacggatttccatgcggccttcctgacaggcgatgaccaacggcgagcgattgtcttcggcaaacaccaaacagttcgcgttttttccggtcaacattttgacggactcgagctgccctgcaatgacagcatgcccaagggcggtcaaacctaaaatgatttatttatattatttaagcattgaaaaatatttttaataattttataagatacacacgaacaaagtgaaaaaagttaataagaaaaattcaaaattctgcacattttagcaattgaaatatctacataaaagatcttacgctgctagaattacaaattaacataattaagtactctaattgttcaaattacagctcaaagggctctgttttcactcatttgaatgaagggtgtttgctcataataatatcgctggtaatcctacttttagtgaaaaaaattttttttttttctcaaactaaagctattttggagttttcggggtctgcgaattcggtttttactcccatttcgattcaattccgtaatctgacgcaatagcgaacaaaaagtcaaaacttcaaatttttcgagtttcacattgaaatttttttcgaaaaaggggggctaccaccggtacaattaccgggtgcttgaccattctttttttaaatggaaaatttggtcccaatttttctagcaagtattgtttattctatttttccaagatctgatcataacactggcacttatattgtctggggagaatgtttggggacaaacttttctgaaaatttcatacaaccaaagaattagccatttgctttttcctaaaaaatcccccccccaaattaaaagcattgtctctccatctaaaaaagtgccagaggcctaattagcagataaatacggtaactgaccctcgtcatctttttgctcaattgtcgcgcccaactcgacaagacagtgcgcaatcccaacgttaccgaagacgcatgcccccatcaaaggggaaagaccgtcttcatcggcaaagttcacattcgccccgcgctcaattagggatttgactaaaaaggaataaaaacaaaatgatttgtcactttaaagcatattaaaaacttattttgaattgccattgccaattttaaccataaattctcaaacgtactgttttttaattccgcccctttttcgcatgcatccaacagttgggcatttgaattactggccattttacacaatgaaaatgattgaaggtatttgtcttgcttaaaaattgaagattaatactaaatgcctggggtaatcgaacagagacagtaaacgagctgaacaacggaacactacgaaattttttagaatttaatggagaatcataaacaataaaagaaacagaatacaaatattttttaatgtttacctaagttccaaattttaatgtcagtaaaattagaataaaagacggttttaattagagaacggcatttttagaaaatacggatcaggattcaggattacggataaaaatcctagtccgtaaaaatccgtatacggctccggtccgtagccgatctttagttttaataggttttagattaaccgaggaaattttttgtgtcgcaagagtgtgaaaaatgggatatgaatgcgaaaaaaggcaaataaataaaatacaactaaatttaaaaatgatttttatgtagctgtacacgagatggaaagaaaagtgttaatcggtggataattgccttttcaacgctcccattagtcacttctgtagcagattaaatcgggtgggaacaaaaaaaaaacagatcccataaatgagaatgtggaggggggggggggggatattggccaatggaatgtctggaattggaattgattgggttcgttcatacttaagcaaatcttataaacccaaatcggagttaagcgtcgtggtcgaacggtttaacactatttaaaccagagctgtgattttggaaaaagccaagttaggggcgcgattgccattttatttaaaaaatcgggtactggtgtgtccatttctgactgggactgaatcgtagtccggacaaggccgtgccgtaaaaacgattcttgaaaaaaagacatcgtcgctgggctctccattcacaaatttggccgctgcccgacactccatcaataatgggacgacgcgaaaaacatgttttgcattttgaccgaattaatttgattaatttaagcaatttggaaatttttatcaccttaaactgcagaattgattacagtacaagaaagatattgtatcatttcccttggcaacttaaaataattatttgaaaaacgaatatggcggcatttcgtcacgcccactcatccaatcgccttcaccacaccactctcctaaatgccggtgttcaacatctgatcagaaaataaaatgaaaataaattaaacaatttaattgcccgtaggaaaaatctaaaaaagtcacaaaattacagtaatcgcttaaaaatggaatcggagcattagcaaacaatcattattatctcaattgtcttcgataacgctttttttttgcctccagcacattaaaatgaatacttcaagtgacaaaaatgccgaaaagggacccgcaggagagaagccagttcgagagcggcaccttcgccattcaaatgtagaagaagccgaagttgaagcaatggatgtggaagctgaagcggaggaggaggaggacgacgacgacattcattactcgccgttttccaatgacgccaagctgctgccagccctgcataagcccgccttccaagtcaagcagttcacgctgaaggtgaaccagctgcctacatgccctaccgttgaaaatgcaacactttttgcagaccttctttgaactgcacttggaagtgatgggccgacgcgacacccgggcgagctgattgcgtaccttcaacatgacgatcggagacttcgagccgataccacctgaggaagtgccggcagcaatgcaggtcttaatca

SEQ ID NO: 14674 - DNA, 3601 bp, Heterodera glycines
  misc_feature (3260)..(3261): n is a, c, g, or t
  misc_feature (3446)..(3446): n is a, c, g, or t
caaatggggatacactgaaaaagtggggcgaatgaaatccattagacacattttccggatcacacaaatcccactaattccgcccagtaaaaacagggaccagacgcggaccgaaaaattgacatagatgcaataaacggtttttcaattattcatttcaaatgatgctttgaaaataacgcggtatgcgcaactaacagaaaaaatgcgcatcgataaatgatcgcgtttcattctaccctgtgccacgcttctccagccctacctgatgatgagtgcggacgaccaattcgatgttgagctttttgcaaacgctggcgaaggcaccggcgtgctcgtcggcatagtcaatggccttttgtttggtactcaattttccgtaaacgaatttttctctcagattttaaactttaaaaaacaattgttttttctgcttgcagcaccccgttccgagttgggcctgcccgagactcggctggccatcatccccggctgtggcggcacccagcggttgccccgggtggtcggcgttgcaaaagccaaggagctgattttgaccggacgcaaagttcggggggacgaagcggcacaaattggactggtgagtgagccatggcagcaattggcaaattattttaaattttttaataaatggggcctctgggtatcataaaattttttggatttttttttttgctctaatatcccttcatttgattaaatttttacattaaatttcattccccccgttaagctcaaccatttgacggacgacccttatgccaaagcgttggaaattgcgcgggatgtgctcaaaactgtaattaatttatttttgagcaattttccctcattttacatttttttttgtttccgcagggccctctcgcaaatcgggtggcaaaattggccgtggagcagggctttgacttggaattgcgcagtggtcttgtggtggagcaacagtgctatgcacaggttggccccacaaagcgcaaattattattttctctctgcccaattttaaaaaaaataaataaaatgttaaaaatggacgagaatgttttttaaaacaacaaaaaaataatgtgccaatttccatttagctgatgccgacaaaggaccgtttggaagcgttggaggcgttcgcgcaaaagcggccccccaaattcaaaggggaatgaatggaggagaattgcggcgcgaatgttgtgtgtgcatattattgtatctagtcatatcagcagtctccagcaatgaaaataagaatgaagatgacaaacaacaaaaaacgcattgttttttttatacaaattttgttttaattatttccctttgtttttgccccaaatgccaaaaaccctttcaaaaagcgaaatgtgcctttgttttttattattattgcttattggaacaaacaattataataaatgaatagcgaatttgaagcaacaattaaaagaataaaatttgattaggaccaaacatcttcaattaggcgctccttttcacgcagttttttcaacaattgaatcgcttcgacaggggaaaagcctggaaaaaaaataattttcggtctgatcaagtcgaccaaatctatcctgatttccctgtcgggttaggggccgaattggggtgcggccacagggattttgagtgggcccgaccttggggttttttaacgaatggatattcgggatttgtctcaaccaaaaccatgggctcaatgccgtccctgtttaagtcagccaaataacgctcgcctttctcgcgctgcaaaatatcgctgagacatgcccacaactctctgctcatgttcttcacgtcgccacacgcgtagaacagaccgccctcccccaactcctccgcctcattgtcagtgggcatcaaaaagtccgcaacttcggccgaccgttgccgcaacgcgtcatacactcgctgcggtcgatggcactgttgctggtggtgcggttgtggcgacgtctcattgtcgccggttgtgcctgctggtggcccagcgttctccgctgacgccgccgcgtcggcgactgttggacgcgactcgcacagcaccaactcgctcagcacaccgtcagcgaccatctgctgcagttcagacatgaaatgtgtgaattaaccatttggaaaacttggcatgaatatttgtgcgtggtacctgaacaggaattcgtcgtccaaattgctggacgcatagaacagaacgcgtttcactcgtccacaatcgccgcccattcgttgcatgaaatgcctgcaaaaattttaaaaaatccaccttttgaaagaattttttcttataaaaaaaagacagggcagatagtgcgaaaagtttctagaaagaatgaagtcaatttcaagttgataaatttcaatttgctcctacagcgccacaaaaaattttatatttccaatttccggaaatttttgaggcctcaaaaaaggtgaaaaaagggggacctgattttttgaagaaatgcaatgaacggagcaacaccagtgcctgggccgaccatcatcaacggcatgttcagcaacaacagcgcatggtcgggctggtcaaccatcgtggagtcgggggacggcattgaggcgggagaggggacgaaagaagggggcaaaaagcggaatttggacggctccttttggatgatctgcaatttttcaatagaatatggaaatggatttctttagaaccaaaaagctgtcaaaaaaagtaaattggacgaaaaattttcatagcaaaaattaaaaaagggtaaaaaaaaactgaaaaaataaaattattttcgaaatttttcacaaatttttaggttgagcggaatgcaagagaaaaagcatttcgtttataattccgaattatcatttttggtaaattggaaccatttttggtcaagttcgtcagggttcttcaaaattagaaaataattgcaatcgcaccaaatattttatttatttttttaaattttacgggtgtccgtccccacctgaacagtttggccaggccgttgctgcaacagccattgagtgcatgcgccgtaccgtttttgttgtttttggccctcaaattccgcacattcgtcaattatcactgacgggggcatttggaggacggagtaaacaaagcggaagcgcaactgttgctgattgtgaggttggaccgacaaatagcagcaaagggtgtaatggcggggcaaaaggcgaggaaggcactctgaaatttggggatttttttttgggggggnnggggggagtacaatgttaatttgtatggaaaaataacatcccgaacagaccgttgaacattttttcgagcaatattcaaaaattaggcaccgtcgaaattttatttgaaaaaaaggtggatttaagggccaaatttatgtgaaaatttcatttacgagtaagtgtaattgctaattttgacccanattttatccgtttttgattctaccaattaaacattccaacggcggtgtaagtgaagagaatgtgcacagcaattccaccagggaaatgttaggctaaaaaatgaaatttccaaaaaagaaaaaaaaagtattttaattaaacctgtcgaacaaat

SEQ ID NO: 14675 - DNA, 1598 bp, Heterodera glycines
attacgatatagtattctgtcaacaaaattatatagtaataatatttatttattattatcatggacaattttttaggttcttccctatgacacgtttgttttagactcggctcaacatgtcggacaaccattttttatttatcattcttctgtgtttagtttacttgtggttagtcattagaaactatttaaatgtccacttcgaaatcaactaacaaattcattctaaatttttgatagggccaataaaaaaatgtttataataaaaaaatgccacttttttatgccttgaccaaataattaccaggaagtttcatttgcaatttgtttccatcatcgtcggtgtaagtgatcagtggttcatctgcagcggattcgatgccagtgttcaatgaaatttgtaatgtgaatacgaaaaagaactggagaacatgttgagcattcaaatgtttcatagttcttaagtaaaaatagattttaaaaatcatagaaaattaataaagttttccacaaattccgatcctcggaaacttggaatccagagcaccccataccgtcggagataaaatacaccgaagggatcaaggaagaaagaatgaaatttttttttgaaataagaattttttttactagacatagtaacaaaaagataatatttattttaacttattttgctttttaaaaaaataaacatattatataaatgtaaatttcattggctcttatatagagtgcatttcataatttttctagaaaaatttttagccaccttttgcaaggctccaaactcctgtctagggcacatttaaagaatattaataaaaaaatgacattagcaaataaatttaatgtttaataaaaaaaaggataacgattttcgcgtggataacaaacactaacaataatcatatgaaaaagggcattattttattcttcagaaaattttacaaatttgcaagaaatttttcattgtatacaattataaaatcaaaaaatcaataagcaaatatttagctttatctaaaatatatgctatttgattgtatacataaaaacgagaataaaataaaattcgaataaaataaaattcgaatttcgccagctgatggatggtattgcaactgttaggcaccagacgaaattcaaaacatgtggacaattcagattgcttccctaatttttaaattttttaaaaaaaatcccctgaaataaagctctcatttcgagggggttgaaaaataaaccacaccctcctccccccctgaaataaagcctccctttcgaaggaggttgaaaataaggctgaattaaaactcccaaaatactaattagtgcagggaaccggactccgaaaatttgtttttcggggtatacccccaactccgaccccgaagctccgcaccctgaaaggtcgaggtcctaccctattcttaatgatttcaacactaatttttgttgtttttttttgtctagattgatatttaggaaacgccgaaaattgtggcgttaatttccattatttcaaaggaaatgattgtcaaaagccatgctgagtcgatccaaaaaaaaaaaattcatgattgataaaataaaataac

SEQ ID NO: 14676 - DNA, 957 bp, Heterodera glycines
  misc_feature (331)..(331): n is a, c, g, or t
ggggtggggcgtcggggaaaactccgcctaaaatggtgcctgaggcgaaagtctttcgccgttcagcttaggggatagtggaatggaggcctataaaaatttgaagtcaatcggacaaggggtgcgcgagttttgctgcgcatgggggagggggtggggcgtcgggaaaaacttcgctcaaaatggcgctagagacgaaattctttggccgttcagcttatgggggtggtggaatggaggcctataaaattgaagtcaatcggacaaggggtgcgcgagttttgctgcgcgagtctcgggggtgcgcaagggggcggggcgtcgggaaaancttcgctcaaaatggcgctagaggcgaaattctttcgccgttcagcttagggggtggtggaatgatggcgtgtgaaatttgaagtgaatcggacaaggggtgcgcgagttttggtgcgcaagtcttggggtgcgcgagggggcggggcgttgggaatgtaccgctcaaaatgatgcctgaggcgaaattctttcgccattcagcttagggagtgctgcacagacgacccaatgcgccgtctgaacttcttcaacaattcaaatgtttcacccctccccgctcttttctcatccaccaacccatcattttcattccatttctcccctttatattgatttcttgtccgttttctttaacgaatcgtaaagacaattaatgaaacgaaaaagccatgaaaaaactttaagctaagaaaagaaaagcaggcaaaaaaaaaaaaagaaagaaaagtaaaccaaaagccaggcccttaaacgaaaaaccatgaaaaaataaattttaaagctaagaaaagaaaatcctgcgaaaagtaaaagccaacaaaaagccatgaaaaataaaaacaattttaatagctaagaaaagaaaagcctgcgaaaaagaaaagccaacaaaaagcatgaaaa

SEQ ID NO: 14677 - DNA, 848 bp, Heterodera glycines
attgttgtcgaacttccatttcaggagcctttctgtgtggacggcacgcacaaccttcaatttttgaatggttgcgtttctgcgtttgggcagccattgccgtatgtttaatttacaaatgccatttcgtaatgtgttgagtttttagcccgctgtgcctgatcgtcgtttcggttgatcaccgaccagctcagcaaacgccagcgggtccgctcgcggtctccaactgtgtcctgcgcaccggcgaagggcaccgcgttgaagcctccgggtggcagcaacatgcgggtgtgctggcttccctgtctggcggcaccacatattggttcttcaactgtgttgcgcggacccgctacaggcagctggactgctggttccgcattggggttggaggccccaatgcgcttgtggtaccacatgtggccccacaggtaagtttttttcattttaattttaaaatgattttttttttaaatttatgtttaagcttccggcaaacattccgccaacggtgcttgttcagactggtgctggtcgtgatgcgactcacgtaccgccaaacgtgaccaccgctggtgctgaacgacgcgcggacctggacaacaacaacaacaatgtgaggaattgatcttttactatgatttgtaattttgttatttaatattgaataaataattttgtctaggacaatgttggtattgagccgcgttcaagttgtagtccgagtcgtacagctggtgcgcgacgaacacaaaggcgtgttgccaaaccggtgcgtttgagggttcgattcgatttgtccccagaagtagaggaaatttggggggtggaaagacaacggccatatc

SEQ ID NO: 14678 - DNA, 3370 bp, Heterodera glycines
aatgaatgttataagaaaaataaataaataaaagcgactcactaataccaaatctttataaaaatggctagaatttcaaatataagagtccttttatgaatgaaactgcaccgccagccattgactcgaacattcaaaatcttcaacacttaatggaaaatgaaaaatcacaaatttttatttaatatttttttcacaattattgctgaatgcacatttttaaataaatattttctaatatatttatgaaataagaaagcgaataagtaaaaaaaagaattaaacgaggtcgttagtaatattactaaatctcttcctactttgaactactgatttagaacaacccaaattgcgagaaaagtaataacagtgattttgtaatcaacaaataaacataatgaaattccatattaataaccttttaaattaattaaaaatatttatttttttaaattgttagtcgcacaaagtgaagcttaaatattatgcaatctagtgacatgagcaaagaaataaaaatagaatttgcagtatatttttatcatagcaaaataaatatataaaaatcaaaagtaattctgaaaatattaaaatcgcactaaaaacaagttaatgtaaaacataaatatactttaaatactcaacttataataataatagtcgcaaaaataattatattttcaaataaaaaaacaaacataaattaatagaatatttttttgtaaaataatatagagttaaatattataataaataattgaaagaaaataatatacaaaataatatatgctttttttcttgtcatagagtattaaagttaatagaaaataaaatttctattaatgattcattaaactaagattaatattaccataaaatatatatacagctggaatccgaaaacaaatactacatttgcgcaccatttgtgcattattgcgattgtgttttttgcctttttatgaataaatgaaatttaaagaaaactaaataatttacaatgagttatcacaatttattagcaaatcaaataatattttgcatattttttgttgttctcagcacggtttgtaatttcaaattaaagatcgtggtaattatatgttgggcaataaactggcgattcagaacaatattgaaccgggtttggacattctctataggcaacaatttttaggtgttcgagaaaggaatagtcaccatccgcaatctctctctttaactgctttaattgatcagttaaagattttttcttcttcttaattttttgcttcaaatctctcatttcttttcttttcttcttttctgcctccatgcgctgtttcgtcatgggactgatccggcatcggcgttttggcagtttatatataaaagtaatggcggataaagaattaaactttcacaaaatgaatacccgacatcattcattttattacaacctccattaaatccacacacatttgtttccaaattcaaagttaaataattttaaatcgaacccatattccaaagtaaataaaatattctaaattaattttcaaatattcctatctaagcaacctcacttttacaatggaaagtaaagcaaaaccttttgtatgcttcatatgccaaaaaagcttcaatatgaaaggcaatttacatacgcacattgagactcatacaccgatgtaaaattgaaattaaaaaaaataaaaaaatattgttaagttctttacatgtgtgaaatctgcggaaaaaaatcactttccaggattaaaagcgcacaaatgccgcgaatgctctattgcatttgtgtcctctaccacacttactgtgtgtaaatataataataataataataaacaaatattaaattcaaaaaaatgattggaaataaattaagaaccattttaaacggctccaccacggacttaagccgttcgagtgttggttttgcgaccaggagtttgacaaacttgtaagtttttcaatgtgaaataatgacataattaagcattaaaaatgaagtaaattattttgctttaacgaacactaatgttcatttttatggaaaaagccgtcgaagaaaaattactgatactttctttgaataaacattttcatagactttttgtagcctctcaaatggtatcataccccctaaaatattttgacataaaaacagacttctacacgggcctcctgctaagaaactgatcaaaaaaaagagaagaattcttcaatgcaaacttgatcagatcactccctcataacggcagggggataattttcaaaaaattatttctgggttaggatttttgtccataaagtataaacagtccatcagaaatggcctcataacagcaggaacacccaacacactgaaaatcgttataattttttgtccataaaatataaacagtccatcagacagaacacagaatctgcaccccggtattgctttttgaatggcggattgatgacttatactcaaatgaatttataagtgatcaaaattgactatcaaataaatgaaaatttttcgaccaattttcccctgggaatacatcaattttatggaggccaattttaggcacttgtaaaactcattgaaaatgagccatcgatccgccattcaaaaagcaaaacacgggcgcaggttctgcgctatacggaatttccggtccggtggccaactgagtaccagcggctcaaaaaccgacttttgccgacagtctcactgttacgaaattttttgcttttgtcttcagggcttagtgtaccccaaaagtgaaatgcccaaactgtggcctacaactttgccagcaaaaatttttttttttgatcagaccaaagacctgacctgtaggttaggcaacgtaagaatcactttttggacacttcagtaccaggcgaatagctcgccagggtgatcggagcgtggggtcgccagcggactttttgtagagcttttaaagctctatctaaccatgtttaaaaatttcgaaaattttcaaaaattaacgagctagccctgaaattcggtttttcggtttttgaattttagaatttttgccgatttttccagggaaaaccgagaccacttttaagcaacagtttttcgagctctatcgactggtatttttttcgaaaaaattttggttttttcccggaaatagaaaaaatttttggccatagcgggacatttgagtcccgggcccataactcgtcaggagtcggttttagccaaagattggcttacagcaaaattgtagagcttctttattttttggggaaatttttggccctcaggattttgggttaaattttgaaaattcattactcaatgaaggtttggttaatttaactgaattaaagcaataaaaat

SEQ ID NO: 14679 - DNA, 3457 bp, Heterodera glycines
  misc_feature (3398)..(3398): n is a, c, g, or t
  misc_feature (3403)..(3405): n is a, c, g, or t
  misc_feature (3411)..(3411): n is a, c, g, or t
tagagttgagcggtaatcggtaattgcaaaaaaaccggtaccggtactgcaaaaaccggtaccggtaccaactttttcaaccggtaccggtaaaaaccggtaattttagaacataaaaatttttggacaaaattttccaaatacaaaatttttattcagttttcgcgcgagtgcctgttttttagcattagaattgttcagaagtatatgtatattcaggttgaccaagttttttttttcaaattcaggacatagaacactaaaattcagatgtagacctcaaaattcagattattgcaaaacaagggatcagcggccaattttccaattttgcgaaggggtctccggccatgtaaattaatgtaaatcaatgacctttttttgctttcaacaccgctttttacgcggcacgttttttccaagacttttgggggacaaggagggccggcggtgccgataggcgccgccgggaaaaattttgtaatttttaatgcgatttgttaacagaatttgtaaaaaaaatgaccaattgattaagttttgggtttttaggatgcttaacatgaaagaaaaaagttggaatattttttaaaattaaaattttaattaaaataatggtaaagaaaatgtgaggaatattctatccaagtggggaattgaacccaggcgaaaaattatgaaagatagaaagtttaaccactacaccacatgtgcatgtgtgtactcccatgactaaatgaaataaaatttaattttttctcaaaaatttctccttcttcaccaatttcctactcttttctcgaccagacccccattcttaccagtgcaaatttttaccggcggtaccggtactagacaaaccggtaacggtaatttcatttttgaaaaaaccggtaccggtaccggtaccaaaaaaaccggtaattaccggccagtaccggtaccggtaccgctcaaccctagagaaaagaaatgtcgaacgcattgacaaaattttgttgggggcacagtgcgaaaatgcaagtgaaaaatgaaatgctgaaaaaggggcggaaaattgtcaaaaactttggatttattaacatattattagtgatttttcgcttatttttaataaaaattataggacgaatgcaaggaattgtttgcccaggaagaggaaaaccgcaaacgattggatattatgatggtggtgaacccccattggtctcgtgtataatttctgaccatatgaccatgaaatatctcttcggttttgtattttttgtatcgtttatccgctgacatacatttattctgccaatttttttgtgtgtttgtaaaatcttggtaaaagattcttgctaattgttttggtcctcataataattggctctattgcactttgaccgtcccatcagctgattttctctgttttcttggccataactttttaaaaaaactgaacacaaaagtcaatttgggagcctaaaatgcaagagcccaacagtttcatgttaattgggacatttggaaatcctgtctaatttaagagtgtgttttgcccatggcaagtgataattaattaattacataattaattgcctgttttccatatcacattttgagggatttgagtggggaggacaaacaaaagggggaaaagtgagggaaagggaggggagagacaccgccgattgaaaaaagacacccgcaaggtcaaaaagagggccaaagaacagttgcgaacaaacatttaagcaactttggacggacgaagggcaaacgatcgccgggggcaaattgggaaaagcggcaatgatcaaagggggtaattattaacgaattaattaattgactatccatgcaattttttgattgagaatagcttaaaggcatttgtaaagccgggattctgctgggtttgccttcccctcgtcctctgtggtcattcttcgtcccttttggtatatctgctgacaaatggacatggaggaaaaacactggtccatccacaaatatttgtttacttgagaattgaagggatttttcggatcattcgcccctttttccccttcgttcaactttcccccccccccccccccccaactgctgaagtgaattccattgatgacaataaacacaaatcatgcatttatttatttgactaacactaaacccaatcaaaatgaaactgatgccattttcgaaacaaacgaatgaatgaataaaccaacaaaaaacaaacagcgaaagttgtaaagccattgccatcaattaacaaattcacttataaataaaaatgggtcaacaaatgccaaagcaaagaatgcctccgaatatcagcgtctgcgaaagactatttcttctttttctgcactttttcctgctcaattggcgccggctttacaaagggaattcgttgcgaatattgcgatggcataaacggccgcaggggttccggcacgacaatgccatcctccgtctgattgttctccagaatggcacagatcactcgcgtggtgtcacacattgttgcgttcagcatgagcacataattgacctggaattgacattaataaagacctaaaagagaagaaatgcaaataagaaaccgcagaaaagctgaacccaagaacaggacaaatggtcaaggatgaagggcattatccgttttattaattgattgccggctgatcctttcgtttcaaatcactttttacctctccgtccattttcttcgtctgtccgtaccgtattcgtaaccgactcgactggtaatctgtacagttggagcatgaaaccagctcccgaaatgcaccgctgcccgggaaccacgcctcgaggtccaatttctttgccgccgcgttgttcagttcggccgaaacaatggccacaattcggtagggaaggccgagcactttgcaaaactcttcagcattgtcaatcatctgaattttaaaaagaattaaatttactggactatatttccaaaagtccactaacttcgtccatgtgcttccacgattcgttgtcaaatggggaacagatgacaaattgttcgatcttctcgaattggtgcacacggaaaatcccgcgggtgtctctcccatggcttccgaccttaaaaaagtgaaaataaaaggtaacgatgccatgggattaaagaaacaaatattggcagaatatacaaacctcctgccgaaaacaggtggacattccggcatatttgattggcaaatccgatgggttaagcaattcgtcaccttacaaatggcaaagttgaggggagcagaataaatggataaaaatgtacgatgaaaggcggcgattggctgctcagaagttgcgattagatatttctcgtcgggagagccgtcttccttggctgcgtccaaaggttttgcggtggtcccctnaaagnnncttatnctttttaatgaaagttacaagcaaaggaaagaaggtgatttgaaaa

SEQ ID NO: 14680 - DNA, 846 bp, Heterodera glycines
ataagtttgctgccaaacctttaaagttgtagcgctaacacgcagaaacacgtggtgcgctaggagcatcgcgtgcatgaccgtgcggctcgtgtgcatcaccgtttggaacgaacggcggccaagtttcatacggaaccgccggttcgtcaggagggaatgggaggagcggaaatgaaggggaatttatttatgcatacataggttatagtctgaacaatcacccaaagttaaaatatggctaaaaaaaaatttctaatgttttattaacatttttacagcaactgtgcttattcgatcagtttggagtgtagccaccgccctgcacctactgtgtggtgcgaggttggacaatgttctctgtcatcaatctggtaaaaactagcaacaacgacaacaacaaagccaccgcaaccagtaacaacggaaatggaagtggaaatgctgcgcaacaaccgcagcactcacaaccattgcatggaggcgtggactatctgttgggcattggccaaagcgttcagcgtgcgttgatgaattttggttggtgatgatttaacattgacaagagcacatcgcaattgtcttatttgccatgttaaaggtattgaatgcgatgcggaagtgcgtgacgaacgcggcattgtgcgtggcgctgtgccatttcgtctgccgacccaaaagagtgacaccaacgggacaaccaatggcaaaacgaacggtggcattgaaacgcaaccgaaaaagacgacggaaaaaacgtaaaggcatttggcaattttcaaaaggttttccaaattttcagttctgccttttgccctttcgttgtgaatcacgcgcctgttaagg

SEQ ID NO: 14681 - DNA, 3128 bp, Heterodera glycines
cccttagtcaaatagacatttaatgcttggctaccgtttcattgtttttcgtcgagggccaaacatttctgcagtattcaacatgctagtattccattttctagatatatacagccaccatttaaaaaagttttaaattcaaagacataatgtgaatatatgctctttaaagggaaatttatagcggattaactaaatttctgaaatttcaatttatgttctattttattactcattttcattgtctttttcagacttttctcggcacaagaaattaaatagttctctatttatttaaatgctaactttgcataaataatttgataaaaacaaaattttaccgaaaattttttctctcagttgaaccaatggcaaaacgaacggtggcattgaaacgcaaccgaaaaagacgacggaaaaaacgtaaaggcatttggcaattttcaaaaggttttccaaattttcagttctgccttttgccctttcgttgtgaatcaggcgcctgttaaggtcgaatgcaaatccgccaaatgtatcgtaatttcgggtgttatttagtctaattgttaactaaaatgggaggaaaacattttatttatttttttctataaggatatgtattttaagtccgcaaattcgtcgtcccccaacactccgtccgctccgttgccgcctcgtcctgcgttggaccagcagcagcagcaggcggctctgatggctgccattgcgatggcacaggacacggtgaagaagacgcttcccgtcgctctgtccggacttgaggcaacgtcggcggtgattggcgaatttttgtctggcttcgacccgtccactggacaggcggcaaaccgtgttggacaaacggtggtgagcaaagctcgacaaggcgtggaaaatgtacggcacatcttcaaatgaattgaattttacaaattaaaaaatgcatttcctgatatattttctgtcgctattcattcgcattttttaaattgtacaaccgacaagaattgaccatcaaattcttcccattttagctgaccgaaatgttgagtcccgaattcgcggccagcgttttgcagttgccaacgcccgtcgttgtgccgccgacaaaccacggacagaccaacggagaaccgaagcagcaaaccgatgagaagaaaactgcagacaaacgtatggactgacaaaaatttaatattaaaaaatgaacttttttcaaaattgtagactcacccaatgccaacccggacaacaacaccagcatcaactccgaagcagcatcggttgaccaaaatttgccgcatttgatgcatcgtatggaagaattgcagacgaaattgatgtcattgaacatgaacttggccaatcgcaatcgcgacgaaattgtaaatgatggcaaagaaaaggaggaaccgaagaaaggggacaaggcggaggacgaggccaacaaggaggaggaaattgttgtccttaacccatacctttatctgaccaacgaagcaatggaaaagacggagaaggagcacaaagaaaaggattccgctgaagccaattcggacacggtgaaccatttttgtgattaaatacagattgatacagtgcctagtactactaatttatacttttttaaagtttaactaatcgttatccgtataaatggaaacattttttatgaatttaaatatttttcgattcactttcagaccaatgccaattcgttggacaaagaaaagcagccaacggcacccatccaattgggcaacaagcgcaaattgggagacggagtgaacaaagacaacggcgaagaagaccttatgaagttgagcacgcacaactcggaggaaccagttgacaatggaaatggtaaaattcacttaaaaacaacattagctatatacctagtcttaattggttgcaaatcgttttccgtttcttcgcgttgcttgggagtcgatgatgaattgttccctttgccatccactcataattcaatagatattattttttagtatcatacgtctcttcgttctcgtcccgctcctccacgactactatgtcttccgttgaggacgaggaggacagtggcaccaacacgggtgacgacggttggatggtggtgaagaaggagtcgttcaagaagttgtgcgacttctacgagaagcgtcgtcgcgtggagtgcggcggtggcaccgtcgccgctgacccattcgcggaacaattggagcgcgaatttcgcgaggcaacgatggctgacaacaaccgcaccgatgaacgcgtggatgagaaattgacggcggagagtggtgagttgggggagggggataattttcgaagattttttaacttctaagttaggaaatttttaaaaattgggggattatgaaaagttcaatttggtctactaaaataactgaatttacggtttataataaatttattagtccaataattgagtctcttgtttaaaacttaaaagatattcacaattttagcctaatatgctcgaactttctacatgacaaagccatttagtgttttatttccctcaaatgcttcattttgattgctgtatttatttgtagaaccgaaaaaggcagacgaattcgtgaaggaagttggacaagaaccggctgccgaggtttatgtggcacaaattgtggatttgaccaccgaaaaagatggaaagtcagaaaaatcggagaaggtggtacataattcttcagtaaaagagggaaaaggaacattttttaagaccactccctgtgtccattcggttgtgatgcgcggcgtatgtgccggatgtggacaggattttcgtcaggtaaatgcaaatacggcaaaccatttattaaaacaattatttatttttattgttagccaaatgaatttatcgggaactcggctgccattttcaactttgaacaacagcagcaaaagatgaaccagaccgtgcccatttctggttccttcggtttgccacgatgttttcgcacatttctttttaatcattcatgtaacaggtgttgatgaccaccagaaaactgcaaaaaacatctatccgtctttggaactattggttagtacgatggatttagggggggggggtcaaaaagttaaaatcagacaca

SEQ ID NO: 14682 - DNA, 1773 bp, Heterodera glycines
tgcctcgtggacgacttgactgtggatgacctgccctgacccctcggggacagtaggggtccggaaaaattttgaaaatttacttcggatttgttaagagtttattcaaaaaatgaccaaaacttgtgattttagccaaagtgttttacagaatttgtatcaaaaatcgctcaaatattcaaagaatattaggttaacttctagagttgcatcggggccgggaggcgccgccggaaaaattttgagtaagatttgttaacagaatttgtcaaaaataatcaaagttttggttaaatttgcgattttaggctgtttaaaaaaagaaaaaataataatttaagttgaaataatttttattaattaaatttcaaaatataaagaaatttctgttcagttggggaattgaacccaagcgaaaaataatgaaaggcagaaggtttagccaacagaccacatttgaatcgggaggcgacactttttgcggcgcccagccaaagcgccatttggcgacgcagacacttgcggcgttacatttgcggcgcccagtcaaaacgacatttgcggcgcccagtaaaaaagacatttgcggcgccgacattttgtggcacccccatatataatgctcaaaaattaaatctcgaacacccttttgttttccttatggtcataagaaattattttcaaaattaataaagaaccactgaatgaattctttttaaaatatttttcagcggggactttaagaaatcttttgaatttttccgagttcataaattcttaaggcagggcctcgacgggatattgtaaggaaggagttagctagacgctaaagcaagtaaggcggcggttgataagaggcggatttgcctctgaacgaaatgaccgtgctgtaaaagactgtatttccaccccaaggcttaacattttgcccaattattattaaacgaaggaaatacataaaattaaaaaatttctttgttttggggtaatttaattctgcgccgcaaatgtcattttgactggtcgccccaaatgtaacgccgcaagtgtcatcgccgcaagtgtctgcgccgcaagtgtcacgccgcaaatgtcggcgccgcaagtgtcgctttgactgggcgccccaaatgtaacgccgcaagtgtctgcgccgcaagtgtcagcgccgcaaatgtcggccaatcatttgaatttgatcaaaaataaagttctctgattttaagacattatggaaattgcttggcaatggcacattctattttgattttactttctccaccaaatccttttttgtctttgtactcttgaatcatttcgtcatactttttaattatttccattttctctccgtcgtcccattctttgctttgatttgtcttttttccgctgttttctgggtttttagtatgaggttatttaaaaatccatcaaaataaaaatttttgcctataattttgttcaaaatcaaccaaagttttaaatattactatcttagatagcactaaggttttctattagcttacaaattgacaaaaaaattgaaaatttagttatccataaacagtgctatgacaaagtattaaaagtgcaaagaagctacattgtttaatggttaatttatttaaattccaaaaacagcaaataactttttccattttgcgttaattttatttataaaaaaatgaaaaactacgctttcgagacccgcttttgtagccaaaattataaatgcttcttcttcatagcctgctgaatgccagagtcatcata

SEQ ID NO: 14683 - DNA, 2099 bp, Heterodera glycines
agtacccaaaacaataagaaaattcaaattttaaactttggctcacaacgcatgaaattattataaattaattaattatctagcgaatattttaaattatgaatttaattaaaataattcgttttttcgcttttattttgatcactttgtacttttcgttcttcgctcagcacgctcataaacatatgaataattttttgtcaaaaattttctatttgatggttttttgagtaatgccttccctttttgcccagtgccgttttctgccacttatgcgaaaatgccaattgccttttccattcgtaaattttgtgccggtaagtgcccaattccatggcaatttctttctcaatttggaagcgattttcttttttgaaagcatttctaactttgtagctgttctttattttctcaaattcgttaacaattctcaacattttggcagttaactttttctataaaatttctttttacatttatggaatgtttctgagagattcgcccaattccttagcaatttaaaattcaattttattgtaatttcccactttattttcatttctgtttttgctttattttctcctttccaggaatacattaacaattcgcaccttttccattttaacttttgtttcctgcataagtttagtttaaattcatattttaatttatatattttttcgtataactaattaccaggtcattagactgatgatgctcaattgaacttgatggataatcctgctggtcaattgcttctttgctcgtattattttgctcacgaatggacatttcgaacttcagtgtccaaatcacttttacaatttgggcacggtcaaataatataagtgcaaaaggatgcgtattgtaagtgggaaataccttgaaaagcaaccaaatttcaacatcggtcgggcgaattcgaaccaatgacaaatgtaataaaatttaaacgattaaatatgtacaaattaacatactatttttgtctgatattttcatttgatcagttttttgatcatttttccgccgaagccaaaaaaacaaaaaattggcaattcaaatggacaatgctttatatgaaaagtgttttaaaagtgatttggacactgacagttccaaatgttcccttgtctcgaacttttgctttgccaccaaacccgacacactaccactctgccatgagaccacttgctagaaaaaggataattgcccactatatgctgcaaagacgatcacgtcaccactgcgaggggtactgtatcccggtgaaaaatccaataaattagccacaggcaagcggactcgaactttcggtctgtcactaaacccaacacactactttttgaaataagttgagcgaataaagcaaaaattacacggaccaagttaacaatcagactgcacggaaatattgaacatcttggcaacccatctgcaggatatgtgccgctgaattatcttttcgtcgcaggattctcatagagaagtcggtcgatgaatctgttgtccattacgaattctctctcgcaagaataaatagaatcctactgctgccgccttcctcgacatggaagcggaatatgagggcagtgattacaacgatgccgaaaacaactacatgctcggctacgatgaagagggagagaagccgcggtccgtcacgacatacgcctacgcaccagggatgggccaaattgaaaaataaaaagcgaaaagcgaaatttgcgaaactgaaaaatgcgaaatgaaaaaaaaagcgaaatgcgaaaagccaaaatatgcgaaaatgcgaaatgcgaaaagcgaaatttttctacaactttttaatagttaaaatcataaagcaaaaatcatttttttaaattttattccaaatttaaaaatcaataaaacgcttttttgaggcgcgctttttccaaaaaaactttttgggaagagggggcaggcggcgccggcaggcgccgccgggaaaatttttgaaaatttgattaaaatttgttgacagattttcactaaaaaatgatcaaattttgtgatttttatcatttttctaatgagaaataagagttttggccgcgccgtggagaaccgttttt

SEQ ID NO: 14684 - DNA, 1423 bp, Heterodera glycines
  misc_feature (1371)..(1371): n is a, c, g, or t
cttccgagggtttaacccaggtattgcattttttttctctattgaatttttcattaagacatacaacaacaatgccgtgtttgctgaaaagagcaaaatgatcacctcgatggcttttcttcctgtccaccatctccgtgctggcctcaatgttttgcagacacaactccctcaacaacttattggcgtcttcgattggtgagttttttggaatgttaaatcaatttttttttatcttaaaggttcatggacaattacaccggaaggccgtggttcaatggtggtttgacagtgccacggttcgcacaggaagaatggagtgtgcatcaacggacgttggatggaggagacagaaccaacaattacgcagaagcattccatagaaaacttcaacaggcatttgattgtacccatcctagtgtcttccacttcatcaacacaattcgatgtgagcaaaagtcaattgatgctgacatctcacgatgcgtcgctggtgaatccctcctctaaagaagcccaaatatcgtgccgccgatgcgagaattcttcgacttttgcagggatacaataccatcaacaataacccggctaaccaaaatgaccacaattaccatgccaatgtcaatgttaatcccgataacatcaaccatttgctcgttggtgcttctcgaaattatgaaatgcgcccgtaatttttcaatgctttgttatttttttttgttgttaacacattgataaatattttttgataataaattaaacatttttagaaaaaaatcagaatataacccatgtggcacaaaaacagcttgccagactaaaacgaccccctgactaaaacgtcccctcagactaaaccggccagactaaaacggccagactaaaacggccagactaaactggccagactaaactgacccggtccgctacgcaaaatcatttcccagcaatccggggatttaactacactacggcaacatacgccaagtattttagaatgaaaacaaaaaatatttcatctcatcatttaaccacttaatttaaataaatttattcaaacttttttacctaaggtaatcattgaaattacaacaattttattgttaatcaaatattcaaaatatacataaaattcattttaaaataaaatattaaaatccaaaaatatagatatatataattcaaataggaaaaagtatttacagcaaaatgtataagagatgcagaagcatataaataaatatttaaaaaaatatagtttcaaaataaaatcataaaaaattattcatatcatatatatacataaatagtaaatcatttaccagataaaaaatcaagcaaaatatattaatttaaaagctagtaataccngagaacgtaaattaaatttagtctaatatattaataaattttagtcaaaagt

SEQ ID NO: 14685 - DNA, 1736 bp, Heterodera glycines
agagtcacaatccggcaattaatttcaaataaacataaatgtgaaaaagtaacttttcatgcgaaatgataaatgcacggaaattttaccacaataattatacagccatgatcatatgtgtgtgtgtgtgtatgaccgaccacttgcttaatgacacctgcattgagaaaagtatgagcaacaaattataaaatatgtaattaaaaatttgaataaattcttttcttcaatttgaaaaaatgtttttcttcaatttgaacaaaaattcttttcttcaattcgttattttctattgtaccttaattcaagatttttgtccttaattgacaaatttatcttcctcataatgacctctttgaacaacaacaatacggtggtcaaatgaatgttaaaaataatgtttttaaattttttcaaaattattttagttctatttgacattcaaagatgccaatccgagtttggcactgatctcaattgcgctgcaattgttgtaatcatcgctctgctcgtgatcgttttcaatgtttctgtcatttttgtaatagttaagacaaagtgggtaaaaaattgaaatcacaacaattttttttaccaaaatctatttaaaaaaaattttaattagggcattccgtgaccccatcaattacctcactttgctcattttttgaattgcttcatcaacaagtggtaatcttaaaaactaattaagtgtaatataaaaagttacttttccgtaaaactttcgcatttcgacagtaaaatttaaaatttaagttttgatttttgtaaaatttaaattttaataattttacaggtgggatttatccgacaatgtttttcactggaattgacagactttatgtcgtaatttttgatgaaatgtaagaaaaaaatagcttatttaattttttgattaccatttttctaatgtaatgtcaattttaatgtggatccgaaattttataaaaatttacaaaatttttaaattaatattaaatgtttaggtatgccatctgctgatcggataaattgccgggcgtttccgagcacttttttgcatcatctctgtgaatatcggtggctaaaaatgttctcgctcgtctcgaccgacttgaaaagatgttagaagggtcagggaaccccacattggtcccagtcatcgaacgacttgaaaagttagaaaagttagaaaagttggtggaacggctaattgcgggtgagaatcggtatgggaatcgatttgctgacccccagcatatctcatcctcaccatcggcacacacttccaacaacggccctcaactccaatggggtcaaccgccgcccttcgctgggaatggcgctgtttcgcgtatgataaccgacgcaatcatcaactccgagcagcttaaggagaaggcgaaccgggcagtcattgaaaaattgccggaggcaatcgacgaacgggcattggtggagcaaattgccgatgaatgcggggtcaaggacaaactgtcgtcggacattcatcgccacccaaggacgcggactgatggaggggtaaaaagggaccgaattttaaaagtgccatttacggacaaatattcgcgcgataaattcatttataatttccgtaatgctgtaaaaaaattgcccaatgtgccccaacacatcaaagttcgcagagatatgactcaaagcgagctcaaaatattatactccctccggcaacaagcctatcaggccaatattgc

SEQ ID NO: 14686 - DNA, 2635 bp, Heterodera glycines
ggtaaatataaattcccaattttgcgtgttgctaattagttccaagtttgcttaccctgaaattgtgtttgggtacaattatatatccaatttataaaatcataaaaaccttccttttttaaccaatttaactgattcattttcagatctacatgtatcaactgttccgggcattggggtacatttttttcttcatctttattttaatttcatcatcccccttcaattttttagttacattcacagcattggcatttgtcatcgggacataaaaccgcagaatttgttgctcaatccgcaaacatcagtattgaaagtggggcatttaaaaaaaaattatttttaatttttcaccactttttagctttgtgatttcgggtccgcaaaaacgttggtccagggtgagccgaacgtcgcctacatttgttcacggtcagttaacattttggcgttataagggtttttgcgtaacaaaaaaaatcaaaatagttagctatttttctgccaaatttcaggtattatcgcgcgccagaactgatttttggcgccaccgattatacgaccaaaattggtacaagcaaaccaaatattattgtagttttagcatatattttttaccaacacataaaaagggtgcaattttttcagatgtttggtccgcgggcacaggtaaaaactaaaaattaaaaaaaagtttttgtttctacggttttattaaattttcagtgcttgctgaacttttgcttggtcagcccttcttccccggcgactcgggtgtgtttgtactactactatttgaattgtttattagttttgtaaaagcattttgggttttatgggaaaaccccatattttttaatttccgagattggtctgggtcaatttcgtcccgacaaaccccgtaccagtcaagattagggcgcgacatgatcttttgctttattggaaaaccaaatccagcaaaaacctggtgtcatttgaaatttttgcatgtttgggagccaaccattaagctattatttacaattagcactagacattttaaaaagtagcttacagcatgacaaccataaaatgcagcttttgcatttgtattttttagagagtatcaaaaaacaacaaatttctatttgatttttggtattactatattatctatataaagtcttttacactaagcgctttcgacttttatatttatgttttatatattttgagcaggtgttgatcagctggtggagatcatcaaagtgttgggcacaccgtcgcgcgatgaaatccaacacatgaaccccaactacaccgaatttcgcttcccgatgattcgaccgcatccctggcaccgggttagttcaaccttcattcattttcgtgataagagaactacaaaaatatacactaaaactcgagaaaaaattacgcatcatttccagttatcaaaaaattagttttcaagaatttatccattttcccgcaactaatttttattttggagatttgtgttgtggtacagtgagcaaaaaattatttgtactgtggactggtacaaaaaaaaacaatccgatactcttcattagtctaaccaaaaaaaatatattctggtatgggtcgatccgaagattttttgcttgacatctcattggcataagttttccagaccaattttcaaaaaaaaaaatcgttggcacgaaaataataatgaatgtgtttggttctgctgtttcagccaggaaaaaaatttttactttcgagagttatggggacactcattcatttttggatttttttttaggtgttccgtgctcgtacgccccaggaagccatcgatttggtttcccatctgctcaagtacacgccgagcgttcgtccttctccgttcgaggcgttggcacacgacttctttgacgagttgcgctcgccgacctgcaaaatgccgtcaaccggtggcccgttgccgccactgttcgacttcacggagcacgagctccagattgagccccgtctgaacgaaaaattggtgccaaagtgtcagtctgcttccgcctcctcctcattgtcggcgacgatgccaaagacgtcgacggcgccggacggtggtggtgccaaacagcaggagggggtcggtggtggagtggtgaaaacggacgaatcagacagcaaacagcaggtgagcacattgggggagcatttgtggtattactaaccatatttaataataaatccccccgagagttcaatttttcaggggctttattagaggggggcgggtcactaaaacattttttattagtcattaaaaagtgacttaggtttttggttgtttttctatttataaggtatagggtccaatgaaaattgaaatatacaaaaaaaatgttttaatactaaagaaataaaaggaaattcctttgcattcccatttttatttttaaaaaatgaggcttcatttttcgtttgtttgtttactttttaaaccgtacattaatatgcatgagttttgaattacatattgcccccctccccctcttcccctctcgtgctgctcacaatcagcgcattcataagcattagtattttgaaaatcaatcattacgaaaagcattggccaccaatttgcacttcatatctatgagtc

SEQ ID NO: 14687 - DNA, 914 bp, Heterodera glycines
taggcgagtgtagcgacagcaggagcaggcaccagtgatcgtaagaaatcggacgcggcggcatcgcttactaccggcgccgtgccgcaattgtcgtcgtcgggcggcggaggcgttgcagcgcaaccatcaaaaagtagcaacaacaacagtaacaccacaacggtgactacgacagcgacgccagcagcgacgacagcaccgaatgctgcgcaaacagcttgagaaaacttcttctgttcagccccctttcccttcctcctccttttctcccccacctcccctcttcccaccacgccagcacctctctctctctctctgtcgttcgctcttttttgggttcatgtgtgtgttccctgccctctctctcaagaccggaaccggatgctgtcatctgtctgaattttttgcctggatacaaacccaaatccgttaattttttcattgtatattcgcgggtttgggtcacaacaaacaaaaaaaatttggaatttttcaatcaaaaagatggacctgtcgggtcgtttccaaaaaagaaaccctctctatcgcaaaaaaatatatttattatgtgtgtttggttttaatccagaaatccggtccttgctgttcctgctgctgctggtcgtgtgtcccccgaatccagatcatgcattgatcaaacaatgtcgcgtttgttgtccaatcattttattattattggcacacacacacacaaaaccacaatttattttctcgtcttctgtgtgattattatatgacaaaataaaagaaaaaggagaaaaaaaatgcattttgtgagtcattttgttcgcttcggaattattgaaagaatttgttaattgaggtcatacattttatttattttattttatagcgacatttttgcgtggcatttaaaatatgttaggcaa

SEQ ID NO: 14688 - DNA, 1514 bp, Heterodera glycines
atttaatcaaaataattcttgaaaattacaaagatttctcaaatttctttgatttttttttaaacttttccaaatgctcattttcaaggacgtccttgcatacaaggacattttttattttcaagaaagagggcccaatttcaaggacgtccttgccattcaaggacggatcccatccctgaaagaaaatgaagtacttgatgaaatatagacaaaatcaatgatttttcaaattctggacacacatttcagttccgcaatcagtgtattttttatcctagaaaactcgaaaagaaatttttaaatttatttttcgtcgagacactacttctctagtattaacattgataaaactgcgaaaatattttaatgtgctaaaaaaattgagcgaagcaaattcgtttttcgtaatcctctcgtaaaatatttatctgcaaaaaagcgaaaaatatataagtcccataaaattagaaatgaatggatcgcgtgtagtcatactcaatcgttggaatgacggcctaaaatatgaaaatatgagagcgtgaagaatatgacaatcactaataaattacctgtacaaatttaaggaaaataaacaggtagtcgagaacattcagttctttgccgctctcggagtattgctcgatgagatgcttcatcacagaggcatggtggcacgggtggatggtggccaggcaaaggttgaccacgtgggggtgcgactcgagcgtaattgtgcggtccttgtggtccttcaaatgaaaagtccgcatttaaaatgaacattgaaaaatacattgtcattcgacctgtgagaagtcctccttcatctgttccaccgtcaaaggcgtgccattctcatcatagccaatcaaccaaaagcgtggaacctaaagaatagttgagataatggggcgggggaggtggtccaagggtcggccgatgatgacagcgccaggggaagtttttaaactttttagttttttccgaaagatcaaagtttccaattttatggattcttgcatcattttataaaaaaagaaattgagtccggaagtgataaaggtaggcagtaaaattaactaatttttaattaaaaaaattattgagaatttaggatatttttttatataaatttcctattctcccgtgcaccgtttacagccccggacagatatttctctttttatctatgtgtgtgaactgtccaactcccgcccgacctttatgaagccccaaccatttcatttatggtgtgatgaaggcaatccttcatcccgtaccacctgatagtatttgtcgtaagtgatgtgtaagtcataggtacgagtccgtaaaatgccgatttcatccgactcattctcagcagcctctttcggcacttttgctacagtgtttgctatatacctaaagaataaaaagctgattaaaaattgcccataattttttcaatgaattaaacaagcgtggaaactgaatgaaatttgttgctcgtcttatctccacacattggc

SEQ ID NO: 14689 - DNA, 1899 bp, Heterodera glycines
tcacccgtcgtgctttttcattctcttctgtgttaatcgtgtccactttaacaaaatgagtttcgttcattcgtttttttgcgattcgcagtgcattttccgctatttatttattttttgctaaggattaagggttttgcgacaggcgccgtttgtgagaattttaaaaattagagtgattataatcggtgttgcgtaaaaacaacattgaaaaaaacttttgggacataatagccattctaaaaatgccattacatcgtccaattcttttggtgccaaattggtttgggtgtcgaaatggtgcgtgtccacccattcgtcgccctcctccttgatgatctgataaatttataagatagatgtagtgcgaattgaggctaaaaatctctcatcaatctctaactgtcttccctcttgttttttgaactctctcggtgtttgttttcaacttcccattagactgtttttgttcggggtatgcgaaaagctgatttcatcccctcaataaaaatttccaccttctccaatgaatcgttgtagttcatttctgaacatctatgatggcatggcacttttttgctgatcagaaattgcttgtcaattggtaaataatcgcgcgctcttaaaaaaagatttaaaagaataaaatgaacagtcgaaacctgcttgaatcactggcctttgaccaaagccaagtcgggcaaaggtggacaaagtgatcgccagctgaattcaccatccattgattacttttagctttttggaggtttaacctgcgataaattcctcaggagtaagcactccagtctcacggaatttggactcgcgcaaaaccggcgtcaaatattcacccacactaagtgcggcacttttaaactgatttaccaggtcattgacattcattcctgtataattattcacggaagcggagggtctattaaaaataaataaataatttacactaaataattgatttaaatttttttaaattaactaacaatcagtatttcgagcaaatttttgtttttgtgaaattaaaaattgctttaagaatttttttaggtcacatttttgctagaagagctgatcgagaataaccaatgttgttgtcagcaaatttccggcatcttcatttattgagaattttcaatcgaattgtccgattgtctcctcactgtgtctgtcagacgacggaattattctccgaacggtttatttcaacttcctttcttttgcgtatgttcattactcattttgtttaattctaattctgtttttacattcattctttcactgttccaaaacttttgttcagcggatgcttttgcaccaaaaaaagtcgtaagttcctttcccatggcttctacatgttggaactgtcccaagttagttaatgctgtcgctttcactacatttttcattctctcagctgttcctttcgaaattttgtcacccgtcgttcatgtcgtcgatgtgattattcgcggacggaagaagaaataaacaaaaacaaaacaatatggccatgttcagagtgaatccctaatatcattagtaaattcctaattgcctattattgacaggtgcaattccattaattacattgacagaaaaacgtgccacaaatgcggagtgtcaaaaccggaaaacgtcaattcgaaccgaggcgaaaccgcagcggatgggtcttggttttgcatcaagtgaagcatttctcagtgttcaattatcttaatcgatgttcagatgtgggtttgccaatcaaccgatccgggatacttgtttttgctgtgacacaatggtcactgagaaacaattgcacgaagttctcaaaaaaagcggcatttgggaatgcaggtatgacagggaaagccgtggggggaaaaactttactaatca

SEQ ID NO: 14690 - DNA, 3111 bp, Heterodera glycines
  misc_feature (3084)..(3084): n is a, c, g, or t
  misc_feature (3095)..(3095): n is a, c, g, or t
cggggcgcacccgcgcgactccatcctgcgacctatctaatcattggcatttgtatttaatgatgaaaatgacaggaactgacagaacagtcagacccggaacggattctgcttgaaagcgaatctcaggaaatcggactccgtcagatgggccccgacacgtatgggccccggactataacttttttctttgtcaaccaaatccaacattgttggtattattcgatagcattgaatatcctctattagcctgcaaatttcgaaaattttcgttaaggttcaaaaaagttatggccaaaaatgactgaaaacttgatttctggtgtactttggccataagtttgttcaaaatttacgaatttttttgaaatttggctggctaatagagggcatttaaggctatcgaatgatatcaagattctgtttgaaagctaatctctggaaattggtctcttatcttaaccaatcactccaactctgaccgttcacatatcccgtagtcttcgtgcaccactgtccttggcacgtctccttccaattcgaattgcaatcgccggccgagtcgtagcgccagcagctcagacaagccgttgctgcacttggacagttttttgcttttttgttttgttttcacagttaacttggcatttgttgggtctgacgacaaaatgtttcggcaaaagcgccgcttccttcggccgcctctttctttggcatgaatttgttgttgcacgcgccattcacggtggagcagtagcgcacgcccacgtacagctgactgtacgtcttggcaccattggttgggtcataaatggtcacattgtgtgggtattcaccaaagtaacacctgcaaagagaaaaaagaacaaatggatgaatgacccaattaagtggaataattaagacacgttaattaggaccaattaaggatgtttgttttaagaatggactacgtgttgccaagtggtagaataccgacttgtcagtgtttgtcgacgttgtttgaccatggtaaaagtcggacatgcacccgcgcacaacaccgtactcattgcctgcaaatgccagaaacagtgaaaaaatgcctgccccatttttccgcagctgaccagcagcaacaagcatttccatgcaaacatcggcacacggtttatagtcagtgcccgtcccatcgcacgcgtggaacgcgaaacggtcgggcggcggaatttcgggaagtccagttgccttagcgggaattaattaatttaattaattgaatttattttttggacctcccattggttgtgaagtgccggcgatgcgcaagaaaaacagtcaatggcatcagaaatttggaggaattggccaatggcaatgaaaaacaaaggcataaaaaaagcagcggaaagcatttttaaaaagaaagaatttaaggaaaagtttagaaatggaaccatggaatatttccattgctttaactctttttgggatagaacgacccaattttattgcttggcaaactcacaaaatcagccaaaaagcaacagaaatatcattgcctgacttttaacattttattgtgaaaagcgagattgttgaatcatcttttgcgaagactttaacaataaaaaaaatggaaataaataatttatattaaaatgtttaaaataatttgtaaaaggaattaaattgaattatttttccaaatgtgaaaaagagtctgagcatttttcttgcaatttggccaatgattagtgaatgtaaaataaaatataaaaagctattcaaacatgaaaaaatgatgttggtaaaggaagaggaaaaatgtgattttttgagtatcacaaaatgagaaatattacgaaaaatggacattcactcgccgcaattctttcggccatttgtccgctgacaaacaaaatgaatgctttgtccctttttatgctttgtccattacatttcatgcaaaattttttgttctattttacccattcggcaaatttgccaagtcaattggaacaaaatatacagccaatggacggaggaaaaggcgacgaaatgacgacaatgggcacgaagaggagcagcataagcagaggcaaaacaactgcaacacaaccaacggaaaaagtagaggcagttgaacagctcgaaaatgggcgaatggaagagggacaccaaaacgaaaggggaggacggcacaacaaaaacaaacacagccaaaatgtgcaagaacggcacggacatgacgtgaggtaaggcaaaacgtatgggtggagaaagaacactcatggaccgtaacaagtcagccagggcatccatcatgatcaacaccatatccatgtcacgacgccgagaacgaaaattcatctgccaactgtcaaattgccaccggtgccaccggagccaaaccaggcgagaaactgcgaccaattggcacacctttgccatgtgccaatgtacagaaaagttatgcagaggtaaacagcaacgaatggcaaaaatggaatgtatctattaactccatgacagagagtgccaaaagacctgcggaacggacgaatgccaagatgacagggaagacctgtaattaatcattagcaataattactaaattctttcaaatacttcgaaattaaaataattaaatgcttcgtgtagtttctattaaacctttccaaagattctttcattaatatttcttagagttgtacgggaccgtgacttttgggttgaaaaaccgggactttttggctgggaaaagggaaaaaaccgggacttttcccggtcccggttaaaactggtcaaaatcgggacttcggtactcagttgtacgtgtttttcaataccaggtcccgccggtcccgtacaactctaatatttatttcttaattcagttgcattcaatgggaacgaagaaatttttgtacccttcgcttttacgcgacaatgcgatggaaatgcgcaaggacatgccgattatgcataccatttataacacataaataaatattgaataaaatacaataaaaagagaaattctttgtaattagttgggctaccatttttaataatctttaatttacgatagggtttttcaantaaatcgccanaaaaaattatcagtgt

SEQ ID NO: 14691 - DNA, 2574 bp, Heterodera glycines
  misc_feature (2512)..(2512): n is a, c, g, or t
aaaagatgattcaatatttcaaaattaaagcaaaaaatcaaaaaattagcgacaaaaaaattgccaaaaaattggaaatttcatgtcgaattcttagaatgtggaagaagaaactccttgaaaattagataactggttattaattgttcctgtaatggattatatacataattgaaattagttttaattttgtttatttcttttttttctgtgtcacatttccttaatgtaaggatcatttccaaaaacttttttttaaatttttctgatgaaattcaataatttttcaaaatctcaaattcattaaattacttttttgtgatttaaagatgaatcagtcgggatttcttgtagaaattaagatttcagcaatctttaatctgatctcgcatttagaattgaaaatagtgataaaatagtgaaaaaagccagtaatagtgacgaatattaaaaattcttgtcaagaaaatgaatttttgagaaaatttttccatttcgtaggagtgtatttttgaaaatttttgcgtcgatttttaggggtgtatttttcttaaatttttgaggtcgatcgatacataggggtgggtttgtcgtttttattgcatttttattaggaaattttccaaaaaatgtcgaaatagtgaaaaaatagtgacaaaatgccaaatagtgaattttaactattttagtgacgaaacaccaaaatagtgatctcaagtgaccgatagtgacatcagaatccaaaaatttcaacgcagaattgcgttttttgagctcctttcttcaaaacaattgagtaaaaaaagtagttaaaacctaaaaattgcaccccttactttttatctctcgttcaataactttcttttatttctatttttttcctttctcacattctctcttctctttctctctctctctcactctctctttctttcctctatataaataaatatatatatgtatctttctctctctctctctctccctctctctcctcttttctccttctctctctttcatttctcgctctctctctctctcgctctgttcgctctctctctcgttctctctctcctctctctcgctttctctctctctctccctctccctctctctcctcttttctccttctctctctttcatttctcgctctctctctctcgttctctctctctattcattgtttctctattctcccttgtttgcatgaaaattcacagcccatgttattaagcattcgctaaatttatgcttcaatggctcgacaattataaataatatttttgtcattttgctgcctagtgtcttatcatcatcatcattttgccacacgcctcaattgatacatcatttatttcttatattcatttaatactaatcatattgttatacatttattgcccctaattagtctaattatgcttttccatattcttgttctcttcattgtccagcttcagaacgcatgcattgggcaccaattggaattgcaggaggaaagaatctatgttaaaataaatgacggattgttacgccccgtttttgtgggtaattacccacttgacccgccctatttgtatgtggacgagtcggttcaatttatcagatctgttaattatgaaagaattgtggaatttgcaaaaaataaattgggcaccaataaaacgaaatggtcgcaagaaatgaaaggcatcattcaaagagcaacaaagagcatccaaaaagtgccttcaactagtgctacttcattattaaggcaataaatttatacgtaaaggtcctcctgaaccggaggcttaaaaattctgaaatttttaagccttttctgagaatcctaaattcaattagcagcctcgcctgaccaactgggtgtaggaaagggatattcttctgatttcatcatactaagagttatattctttgtataaaatagtcaattaaatattcaattccacttacagtttcttgcattaccttcgattcaacagaatcttcgagtactgtaatgaacatgaacatcttggtaaggaatgccattatttttacattgacataattggcgaagacaacgatgacggcaaagtcagcacggagtgttttaagcttttgtttcacaacccttcaccggctcaacgggttcaagaaaatctcgccaatgaatttgtcatcaaagaactgaatttgggcattttgttggaacagcacttaaaattggctaaagagaaaataaaatgcgtaacggtggagcagggaattggcaaaatgggtgagaaagttgaggcagaaattggcaaaaaatgccaacaatggggcaaaaaaggcattgacgaaaagcggcctaaagacaggaagcgatgggagaacgagaaaaaagtggtcaatgggggttgaccattttatgcaaatgtaattattatttgaattgataaatatgtcaaggtccgaacatttaaacatataaagaatttaaaaatttgatgtgattattttttatttcgaatttttgcttgtnaacaaattttggcatgaaaattatgttcataattgggtttttcattggcattccgttgagct

SEQ ID NO: 14692 - DNA, 933 bp, Heterodera glycines
tgaattttgttcataatttgcctcattacaatatctccttctctgttatctttaatgtaagagaaatttattttaaaatatattatgtccttgtaaatcagaccagtttacccgtccttggaaaatgagtttttccaatgggagcccgggtgtaatcagatctaccaacgtcggcagaataaatgttatgagcagcttcacgttgtcgatcaccaatgtcatcttcaaaaattttgattcattgctctaattcaatttttggtatatttaaattagggttaagccccgaggcgtcggggggcaaaatgtcgggggccggggacctcggggggcgattgaccaaaattttattttaacgaaaaaatcaatttttatttttaaatgctagtaaatcttcattttaataatctaatcaaattcattcgttggcgccagtaaaagtgcgtccaatttggcattttataacatggcattccgaggccccaaaaattttcaaaaatcgaaatcagaattccgaggctaaaaaatttaatcttaaaaatttgagaattttagcggtgcgcttttcaaaaaactttttgaaaacttggggagcgggaaatgtggtccggaggtgacgataggcgccgccgggaaaattttgagaattcgtgcaatttgataacagattttgcccaaaaaataaacaatttttgcgatttttgcacattttagtaaaaaaaattggagttttggggggccggcggtgctgataggcgccgccgaaaagtttttcggaatttctaattaattttattaagaaaagttgctcaaaatttcaaaaattttcaagagtccccaatttcccgagttagtgtcggggggtcgggggataaaaagtcggaggtagggggctcggggtcggagagcaaccctattataaacccccaaaat

SEQ ID NO: 14693 - DNA, 2831 bp, Heterodera glycines
cgcccgtcctgaggccgcgaagcggccgaatgttccccacaaaattaaaaaacgggcgcgaagcgcccgtcctgaggccgcgaagcggccgaatgttctcaataaaattaaaaacgggcgcaaagcgcccgtcctgaggccgcgaagcggccgaatgttccccacaaaattaaaaaacgggcgcgaagcgcccgtcctgaggccgcgaagcggccgaatgctctcaacaaaattaaaaatgggcgcgaagcgcccgtcctgaaaccgcgaagcggccgaatgtcccccaaaaaattaaaaaacgggcgcgaagcgcccgtcctgaggctgcgatgaattgctaaattacatcaatttctagcgacgcggcgaagccgcgtccctgagcgcgaagcgctttccccacagcaacagaaacaaaactgttcacaccatagccaactgtgcaccctagtttatattaccatagagaaaaagggggactcggcttaaaaactaatttgagtcgaacggctgtcgggaggggtctgaaagtggtggaagggtcttacaactttttgaggcgcatctgggaaaaatatgggttttccgctccggtggacggttcagcgccggcggcgctgaaacggcgtgaaattttttttgtccgtctttggtggcctgtaactttgcgggaagaagcgggagcggaaaatgcttggaggtaggattttaagttggactgtttggcaaaacttggcgcttatttggcggggctatctgtaaatgccaatgctgcagaaaatggcaaaatttggcacccaatttcggcattttccgtttttcgggaataactcgctgggggttaagcggagcgggttggcgccgcttgagcatttgtgcagtttttaaagctgcatccgatggcgttttcagattttgaaaattttcaaaatttttcgagctaggccccctcgaaaatttttcgtttttgaattttattattttttgccgatttttcccaggaaaacggagaccactttcaagcaacagttttttgagctctatcgattggtggcatttttgaaaaaatttcaaaattttccggaaatagaaaaattttttggcctgagcgggacatttcagtcccgggcctataactcgtcagcggttgattttagcgtaaatttgtcttagagcagttttgtagagaattttaagctctatctaatgtgctttatccggtatttttatctttaatataaaaaaagatataaaataaaaatgaattttttaatgcaaaaccaaaggggggaccccatggatttgcatttcgtgagaaatttttttgctcctaaaattgccaaaaaatacttttctggggtagtttgaggtgctgaacacgaatatgcactttatattgcgttttggattttttggagggaggtaaaaaaattttgaaaaatcaataatttttggcccttgaaaattcaacctaaattataaaaattcataaatcgcctgaatgtggtccaatttagctcatttaaagcataaaaaatagcaaaaaatcgggagaattttatgagatttatttgaaatttatacctcaaaaacaaaaaaagttattccagaaattctggaaattttcgatttttcagaaaaaaattcagaactcggttctgtaaaggtgtttttgaaattttaaatacttaaaaaatccgcaattttttgctctattatataaattttattcgacctttttatcatcttttaaaataaagatacaaaaataaaagtgattttggcattcgggaccaaaggggggtgacaggatttttgagtggaaaaattttttcaccgaaaatattccaaaaatatgtcttttgggccaatttaggacgctgatcacgaataagtgatcagattttacttctgacatacttaacacctcagaatccctgtgtgattggggattctgggtcatcatttttttgggaggggggaaagttcgaagccgggcggtgtatattatttttctttgtatttttggcttattttacaatgcttttaattaatttgaagattggttgtaaattttaaatttttttttaataaataatttcattattattttttatctgtaaaaaataatatcatttcaaattaaatgaatattcaataaataatttccaacgttgtttttaattaataactaccatttttttcattgttttatttatttaaaatattttttattttattaataataaattatatttttttatttgaattaaatttttttttataaataaatgttttgttttaaaattaattatttatttattttaattaatttaatattgtttgttatattaaatgatttaatataaaattaatttcttatttatttttaaataaaagaaggaatttattttataatttttaaaaaattattaacacattcgattttaaattatatttttttataaaaccatttgcttatttatttaattttgaaaccatattttacctttttaaactattattgtaccattcctacaattttagtacctactaataactgttgtactcttctaatcactgttgtaccacttctaatcactgttgaacctcttgaacctcttctaatcactcttctaatcgctgttgtacctcttctaagcactgtcaaaaattatgtatttaaggccctttaatgacgctgatcacggatacgtgattagttttcacttttgacatcgttaaggcgtcagaatccccgtgtgattggggattctgaggcatcaagatgagggggggcagattcgaatccggacagtgttcattat

SEQ ID NO: 14694 - DNA, 1375 bp, Heterodera glycines
ataaagcacagtgacaaagcattgactaaatgaaaaacttattttcattaattttctcaatttgtcccctcattaaaatttacgattttatgcaaaaaaatgttcgctctctgtgccgcgtggcatgcaaaagcgaccgcgcaattttgtccgccgtctcttggccttcgtccgccgattgttccacggcatctttcgcagcggaagtaattgcgtggatttgaaagccgaaaatgaaataaaatattattaaaaaaattaataatattgacaggaaaaacaattgccattgcgcaccggtaaaccaattgaaagagcgccacaaaaagaggggaatgtgaaaagagcaggcctggagggccaaaaggaaaggcacccactgaaaaagggaagcgaacggagggaaacgaattaattgtgattaattcattttcttttataaatattctacaatttcacttttattttctttcactttccttccccacttaattatgtaattactcacaacaaaaaatggaaatgggaaagtgagtttgataaaagggccaaaaggggggggcggcgatttatcgtttattttcgatcgcgcaattttgtgggacgaaaggaaatgtgggagaggggatgataaatgaacaaaaaattaaaattgacaaatacaacgaccgatgagagaaggggagggaggggagagaattggcgagcattttgggcattaaattcccttctgttggagacaaccaccaaagaatgaatgaatgaaatggatgaaaaatgaatgatacaaataaatggggggaaacgaacgaacgattggtggccaattagagaaaaggcacacaaaatatcagtttcatatattatttttccttttgaagggatattttaattaaaaattaaaaggcaccaaatttatttgtaaaaatgcaaaataacacacaaaattttcatttttataatttcccatattttaaggtggttataatcttttaattaaaacaattacgcaaaatggtcacccaaaacgaccatttgatggcaaatttgtccgaccaactcacaaatctgcaaaaggaattggacacactgaaaaaggacatgacggcgaacaacgacgcatttttcaattgtgccatggcactgatcatttttcgtatgccattttttattaattgattaattagtctattgattctttttcaaatgctaattagtgatgcaatgcgggttcgcctttctcgaagctggagcagtgagaagcaaaaactgcacgaatattatcatcaaaaatgtgcttgattcgcgtgagaaataaaccactcactaattatcaactaattatgtcttcagttctcggcataattgcttatgc

SEQ ID NO: 14695 - DNA, 1523 bp, Heterodera glycines
  misc_feature (1465)..(1465): n is a, c, g, or t
  misc_feature (1475)..(1475): n is a, c, g, or t
tcaaagttcttcttccaatttgtgttctgtgccactgcctccaccatcatttcgggtgccgtggcagagcgtgccgagttcgcctgtttcatcacttattccttggccatcaccgccttcgtttaccccgtgcttacccactggggatggacgaaacaggtaatggccaaatgttaatttatccttccctttttaagggttggatggcagccagcggatttgtagtcgacgacgctcaccaagtcacttacgtggactttgccggctccggaatggttcatgtgtgcggcggcactatctctttgatcgccgccgtactgatggggccacggatcggacgcttcccggagaggacagtcagcgtgccggtggggggaccgaggcggaagcagaaggagcccaaaagtgtggagatcaaaggccattcagtgccggtgactaacgaacattttaaagaggaagcaaattaaaatgcaaaaaattcgaatccgatcaatatcaaaatttttgtgccgaagtgtccagaatttatgcaaattaaattggcacagttcgcctctttggggggcttcattctgatgttcggctttttggcgtttaatggcggctccaccagtgaaatttcctcgccgggcattggccaaacagtggccaaagcgatggtcaacacaattctgtgcggagcattcgccgcactttcatatttgttcgtccatttcatccgaaagggcaaatggaccgttctgttgacgataaatgcatgtctaactggtattttaccctaattgctaattaatttcttataaatttgcaccgattaggaatggtcgctgcttgtgccgggtgcaaccaaatgtgcgaattgcaaattgctttttgccagtcgctttaacccattaaaatatgcttttaaggcccgcatggacttgcgtggtcaccggctctgttgccggcatggtctatttgctgctggccgaactcgtcttggcacttcgcgtggacgaccctttggacgcgttcgccgtacactttggcggcggactgtgggggcttgtctcggcatgtcttgtcactgagcagggcattctttacgcatttattggcgacgtaaaaatgaatgtggcactttgggcaagtgtcagacgccggtgaaaggtaaagtaaaaaatcaattcagcaattgttgtggcaaatggtttgtgccgtggccattattctgtggtgcactttgactatgacgcccgcctttcttttgctgaaagcatttggcaaaatgcgcgtgccacgagaagtcgaaattcgtggcttggacatttataagcatggcgaggcggcgtatccgtcgacagcttacggacacggatgggatgaagcggcagtgaagccgaacgtgaaggaggagctgcgcaaaatgagcgaatatgcggacggtagggcaagaagcaaaagtagggaaattttaggnggcaaaaggngaatttgtcaattgaggaggagggagaagggatttgaggggggggggg

SEQ ID NO: 14696 - DNA, 917 bp, Heterodera glycines
agatttgacggctttttgtggaacagtgccaattgaaccaatgtatggaagccaagcattcactcttcgacaaaacccacaacactatgaacacccggagcattgggagagggcccgagagccgaacatttacaaaagagtgagagagtgggagaatgattactgtacaaatagggattactgtaaccacagttttacaacaccaaagcgaacagtgtgggaccaatggaaggacactgacaaatgaagaagaaaagacgcaaaaaatgagcaaaatatgcaacagtgaaaactaattcagtgcataataataaatattataacaaataaaataattcatttaaaaatatttttataaattaaagtgaaaaaaagaagagtttaattattcgtggacactttcaaattgcaaatagacaaaaaagtgaagaagttaattgagaccatttaatcccttagaaaggttaaaatgactaaatgctcctaattttcaatttgccaaaagtgactaaattcaattattttgagtcaaatttttatttttgcccacctgataataggccacccttttctgtcccctcatttcgtgttcaattggaattgattcgtccgtacttaaaatttggaagcatctataaggaaaattacatggaaaattaccgcaggtaataagtgctttcgacaaggcaataatcgtgcgcatattgaacccatccggcacggaattcagctttggcaaaacaatttatggcgctgccaatgtaaagctaaaggaaggaaaagcatagaaacaaattaagaaaatgagaaattaaagcttcgcacggcttattgggttaataaagagattcaaattattcatcttgtgcacaataaacaaataaattaaacagtttttcatttgttttccatttttg

SEQ ID NO: 14697 - DNA, 1314 bp, Heterodera glycines
  misc_feature (9)..(9): n is a, c, g, or t
  misc_feature (30)..(30): n is a, c, g, or t
ttttaattntaaaattattgaaatcccacnccaaaatcttaaaaatttgtacattttaacaatgaaagaggctttaaaaaacgccgagtttggcacgttatgtggcaaaattttttgtttttatcggaataattgccgaaaaaatgctcaacattcaacctcctataaaattttctaggtttttattaggaaaaaaacttcgtttcgcattttttaaaaatctgacattgcaatgttttttcaagggggaatcgattatgtttgaaagtagcaaaatcttcaaaatttggtgcattttagcaattggaataggttttagaaatgttatttctcttaattaggtatacactattttttaaaattcctcccccattctctcaaggcctcgagttttgctgtacggagcagttctacatgtactacaaggcacgcgtgttcggcgacgaggccagtgccgtggccattctccgctcgcaggacccaaaagccatcaaacggtttggcgcgcacatccgactgttcgacacggccaagtggagaaaagtgtccattttggtaggtcggcattttttaatttaaaaaattccaaactttgcggcaagggaaagggaaaaagattcaaattgatgggtttagtagagtttttgtccgatagatcggtaaaattttaaaatcatcaaaatttttagattttggaaccaaaataattcgtgtccacatgccctttctcctttgccatcctaaatttccatttcaaaatagccaaaatttaatcattttctaaattttgggtattatttttttctggtgcattaaggccccctttaaaatttgtcatgctattttattataaaaagtttacctatttttttgttatttaattttttaatttttttttgataatttcttaagtgaaattcttcaaattttccaaatcggtttgaaaatcaaagtttatctatgggttcattatactcacaatttttgtaaaatataataattgcaggagatgctaatcggcaattggaaaaaatacgagcagaacccaatgttgcgccagtttctgttcgaaactggggacgcgtggctggtcgaagcgagtccggacgacatttactggggctgcggagtggtaaaaacattttttttattttttgctttttcattatttcttggaaatttttgaagaattttgaggggaaaggaaaactgtgtaattgataaaattcaaaaaaacatttttctctatttaattgtgtcatattttttcacttacgcagaattttactggaaaaaattatgagaatttgaaag

SEQ ID NO: 14698 - DNA, 1830 bp, Heterodera glycines
ttaaaaaacattaataatttgtcgaaattttcttctaaattttcttttttttttttgaaatttctgtgattgaaaattacaggggcatggctcttcccactccactctgaaaaaaaactataaaagttgaagcagagtaatctcctttttcacacacattcatcccacctcacgcacagcatgtggacaacacggacctggtgcgggacatgaacaaatggcgcggacgtggcgccaaaaatgtgttgggccggctgctgacccggatccgggacacgttcaaggagcgcgaccagttcaagcacgagtgggcagaggtgcagtcgaagttgcccgaattgtatggcatcagcagtggcggcggcggagggatgccgagacggacgatttgaatggacggagtgccaaaaagttttcgattgattatgccgtactcaaactttatttatggcagtagttcccctccccttcgtgtgtttatgttatatttttccccattcgtccaccattcccattttagtatggcgttttgtgcgtgtgtctgtgttggcattttgcccattcattttactcaaaaaaacccaaattctccttctccaataaattgcaaaaaaaaaatatattagttttttttaatttttgggcgttaatcaacgccatttcacatatctcttttttgttttactaaaatttgttatttatttacaattttgtgatcatgtttagctgtgtttttgccagcatggttgcaagagagaatatttctgaattcttcaatcagcggttgccacaaatgccggacgaagtgcggcattatttgacaggtaagagggcgggagcagctcgtttccccccccccccgcatcgtttccccccgagaaaatttttttttgcgctcttttcgaaaattactaaaatttctgcaataagcaaatttctaggtatttttggacgctgggcttgaatatggcatcattcatttttaccaataatcccatgacctgaatgtgaaaactcgatagaatgtgaattttgaagaatttaattttttgatcaaattcgggtctgtcgtttagaaatgggttaaaattatcatttcaagatcagcgaccctaaaaaaagctccttccaaagcactagtcttgccaaaagcgggacatttgcccagtttccgtcatttatatgttttgcagatctgctcaaggagaacgaggatgacatgggaacggagcaggacctgacggaaatggtcggagatcatattcaggttggacaattaaacgaatgttgatgaaaaatccaaattaaaatcccattttccttgtacagcgtctggcatgaaatttgctgacttgagacacttttaaataaaattaaaaaaatctaaatcgaattatttttctctttattttcattgaaaaacccgtaaaataccgaaaaattaattaaaaataaactgatattttaaatctatgtataagaattgattaaaaatccagaaaaaatcttcatagacttgtgtgttcttccattatcgtaaaaaagtcaatcgaaaacttccctaaaatggccataaatgttgaggtcggggggccaatccccattttatttttattcatccatttgcacttcaaaggcatcgtccgtggacggcatggcggacacggagttggctgacctttgtgcagcactgttcagcctactcaatgacggacgcaataacggcaacagcagcaatgggaacagtaatggcaacggaaatgccgacaatggcaatggcggcagaagacagcgcggcggcggaggcgtggaagcggcacgcaaattgct

SEQ ID NO: 14699 - DNA, 2580 bp, Heterodera glycines
ttttaaatttaaaccaaccgcacaaagtacaagaaagaccttctaaaaaagcttgaagttcaacaaaaaatgcatttttttttttgaaggctttttgttaatgagaatttgatgctttttattgggaggaaatcggcggcaatttttgagcggaatgaatgaatgatttgacgctccaatttgtgcccctttatatgtttttttggcttttgctctcctcacacccatgccattagtaatacagtttttgtgaatggattaaaatgcatgaaaatggcaacgtattatttattggccattagtaacaaaaatctgactgaaattaaaaaaaattcaaaaatgctgaaataaatgtttctcccccgctatgactgattggtaaacaaataataaaatggcatacatattagtcaaaaaaaaatcacaagaataaatttacgaacaaaaaagttgcactaataatttggaaggacaaagaaaattaaacgattttgaattttataatttttcaaatcgaaaagattaaaatcactttaatttatattattgaaataataacatttttaattcatttattggtgttcatttatttatgatttttaattcatttattggatgattattatttttataatcttatttatttaattaattaaaccattaattaaaaataaattggtaaatttactaatttataaatcagaaacattgttttattgcaataaataataaaaaaaatattagaaaaatataatcaaatttaatcaacgttcataattttcttcgttgagttttcattgaaaaaccatttgctaattatgcaaaactgtaaaaacactcaaattagattgaaatttaaaaatataattttatttgggtgaataattagtctcgattggtgaaatataatttattttgcgccgctaaaaaaataaaaaattaaatttactattaacataaaacttaatgcaaatgaacatgaaaaaaaatcggcgaagacattctgacgaatttcttctttatcgtgtaaaaaagtaattagaaacttcaattattataaaagaaatgtaaatatacttttatttggttgactaattagtctcagacagagaaacctaattaacaaatttgttatttgctaattagtctccaatacgaacgtatttaactaatatgccaaagacatgttaagaaaatggattgaactaagcagaatggacaaaaatgagtgaaatgccaatgttcgacactcaaattttcctttcaacttaaatttttaaataaaatacataaaaaaaagaaacaagaaatgaaattcctgtaataaaaagttgaagaatgttttttttaagaatttttttaaagaatttaaatttattccgcaaaatcattaggcattagtgctacattttgttttatgaattttatttctttgattttcttctttgcttgtctcttcatgttgcatcttctttccacggctcatttcaaggctgaaaattgggcaatcaattagtcgatctctaactatctggattcccttatgtctcctcccttttccacactatctctctccatctctcgttttctcatttaaacagtccccccccccaatctctggtcgatcttcatctatctgtattctcttattttctcctccccttcccacacactctctctccatctttccttttctcattttaattccccaatctctggtcgatcttcatctatctgtattctcttattttctcctccccttcccacacactctctctccatctttccttttctcattttaatcccccaatctctggtcgatctctaactactggattctcttatgtctcctctcctttccacacactctctcgtcatctctcattttctcattcaaacagtccctctcccccccccccatggtgcccttctcaattggataatgccgtgcaacttcaccttgcacacttggacacaatgcttctttgatgggaaattgtttgtgttgccgccctgccctttgtaggtgaattgcttaaatctcaaaaatcagaaaatgggaaaagccggtgcttatctcatccattaaattgtttgattgcttgttgtaccttacaactacggccgtcccaccaccatcgtttgagtgccaagttgcctcttcccacacttttgggcggattacatgcctaattttgaagaaaataattttgttttgtaatttttggaacttaatggtagagtatctaccggcctctggggagagaaaattcggggatcggtcaggaaatacccgacaaaattaattagttgaaaatggctttaaaaatttaggggatatcaattccattgtcggtagaaaattttcaaaaaataaaaaagctaacacatatttttccaaacgattcagggaggaaatcctacttaatgggcccattctttggaaaaagaaccttattatgccacaattatattcaataaaaattttctcgctggttaatgcttagtttactaattttcccaacacagtctctctcccccggcttctccccgctagcactgttctagagtctctgtctt

SEQ ID NO: 14700 - DNA, 1148 bp, Heterodera glycines
ccacacaaagcacaagaaagacggatgcgaaaagctggaagttgaatgatggcttcatttctttttcgagactgaatttggtgctatttattgggaggaaatcggcggcaatttttgagcggaatgaatgaatgatttgacactccaatttgtgccccttttatatgctgttttggcattgttttttctcacaccaatggcattagtaataaatgcattcattctgaaccgattaaaaaaacaaaaaatggccaaataatgtcaatggatgtgagtgatattgtgattgacaaacaaaaaaccccttaaactgtcgccattactaattctgctaggcggattaatgtgtacaatacaaaactaaaaaaaacggaaaatcggcaaaaataaatgttttattgtatgcaaaaactttttataaaactattattgaaaaagatatttaaatacctatgttaaatttagtaattccatcttaaaatttcattaaaataattagttaaaaagaaaatgccaactaattaatttaaagttcatttaaaaaataatactcttcaataaattcaaaaatttaatttagaataatttttatttaatttaatatttatttgctaatttatttatcattaattgtttatatcaattcaagacatttttgggtatggcggactgatcaatatccgattacaaaataaggagcaatggcgagaagtgcatttgatgtgatcatggattgcgaaaattgcgacttttgaccgattttttcctgaaaatcggtttaaaaacgcgataattgataattaactaattaatgatgtgaatatcgaaatatcacatttccaagcattacatatttcttttttaattcatttattttgcttcactatatctactatgtgtaaatttgttttggttatttattttttgaaaaataataaataatttattcatttccaatcagtcagtgggtaaatgtgcataatcggctcattacaaaaaataattatcacaatttgctaaatcactctttcattttgcctacccaatgatcagcagataaagctgcagagggagaatttttaattgtgagaaaagattcaatcgtgggtggagtcattttattattattattattattatcattagga

SEQ ID NO: 14701 - DNA, 2031 bp, Heterodera glycines
cccgctaattgctttcctttacatttaatcggaccaccttactagattatgtgcatcgtcctctatcgttttttctctcttttataatcctgcaaaatccctaaaaatgtgatcagatgcaatgcgctgtttcttttttttgttgtccattttttgtcgaaaaatcactcggagcaaatcgagaaacgaaatggaacaaaagaataataacttaaaaattatcaattcagctgatcaaaaaaggcatgaaattttggatttcgcgcctcgaaaattaactttaaaactttttgatcggaacaaaaacctgaggggagaaaaaatcaaaaatattagcagatcaaaacttttgcgcttcttctgtatgagttgatcaggctgggcggactgggacactttagtctggccggtatagtctgagccaagtttagagcatcataacttttttatttgttgaccaaatccaataaacttggtatcattcgaatgctcttaacaagctctatcggcttttcaaaaaaacgcaaagatatatcgacatataaaaaagttataagtaaaatatgcaaaaattctgactttttgctaatattcatgtttcaacttttttataagctgttcaatcgcttagaaatagcttatcaaaagcttctaaacatgtagagctttcgaatgatgtcaaacttataaaatttggtcagctgagaaaaaagtctataccggccagactatatagtgtcccaatgaatgaattttcatttttgagaatttattggtgaaaatccctaaaataagaatgtgaaaacagacaaaaggatattaatcaaaaaacagaggcgataattgacacatgaagttgcctttcattgatcagctgaagtgattgatcaaatcaaaccgatcggtcagttttttcctctttctcttttctcctccctgccctcctaaaatgacgtgctatttttgtcttccgctgctgttttcccaacaatctctcccaccaatttcgtgctttcatcgccctttttgagctctctctctctttaattttacaattcaaattctccgtcgtgtgcaaattttgttgctaaatccaccaaaagcattcgtttcgttttttcattttctgcattattttaaaagtttacctcccccccccctaaaatttatcgcaaaatataccattttatgcttcttctttttgtttagatattgcttattgtgttttcacatactgtagaagcattgattttgcgtattgtctgtcgaccgtttgtccctctcattttccatttgtccgtttcttctcccattagtcatttggttagcgaagccccaaacacacagaaaaagtgcatcaccacaacacattataatttgatttgacaattggataaataaataagcatttaatatttacataattatcgtcgcccactcatatttttgagggtttgggttaaatggtacgaaagtggaatttatattaataaatcattgggtttgtccttgaatggcaaggacgtcctggaaattggggcctttttctggaaaatttttaaaatattcttgaattccagatatccttgaaaatgagcatttgaaagaacattcaaaattttataattttttaaaataaataaaaattttatcagaaactgtttgatcgataaaaagaagtaataatattcaatttaataaaatttaattttccaaatactaattttataattcattttatacttttttcccatttttcattcgcaatttccgcccctccccccccccatttttatgctgtataaaaagggctgtttgttgttcattcgccacctttcttcatattttcgctttcttcgttttccagccattttcctgccaaaaaatggcacaataaaaagagcaaaatcagtcgagcagcaatcagaagaagaaaaagctgaaaaatatcgtctattcgtggtacagtcgaaggcaatttatgtgcacaaagtgcgaaggcatggccaaggcggggcaccacggaatggc

SEQ ID NO: 14702 - DNA, 2013 bp, Heterodera glycines
  misc_feature (39)..(39): n is a, c, g, or t
  misc_feature (88)..(88): n is a, c, g, or t
  misc_feature (211)..(211): n is a, c, g, or t
  misc_feature (223)..(223): n is a, c, g, or t
  misc_feature (332)..(332): n is a, c, g, or t
tcagtcgagcagcatcagagaaagaaaagctgaaaaatntcgtctattcgtgtacagtcgaagggcatttatgtgcacatttgcgaanggcatggccaaggcggggcaccacggaatgtggccataagtggacggaatttttgggaattaaaagatttatacgaaattactgaataatttagatttaaaattaaatattcaaaaaacgcgncccaaaaccaanaaaagaattgaaaataaatgtgaataccaaaaatttggacgccgttactgggaaaggcatttttgccaaaatcaaagtaacatatgaactagctggcacaattcacccncgggggtcttagtttcttttccctttgcccattcattccgtaaaaatttatttgtaaaagaaatttgatctgttccgtccatcgctttgttctgctgctgtctgcagttttctcctcggcccaccgattgttgtccttcttccgcattttctctgctgtcgtttttcatttctcttttgtttctgttttttctcactgtctctctctttctctttgtttctctctatctctcttatttcggtctctgtaatttctgactgaactgatcaattttctctgatactgatcgtttggtttgatcaattcaattacatttccatatttgttccaactcggccccaaagcagttcaggccctgttggaaatttagaacacaatgtgaacctttgagaggtttccgacatacaaaatatctgctttcaagaacccggacctcacaaattcatcctcaatcaacctatgcaaatcccgatcccgagtccctgtgttttgtaggattttcttgatcccagctgacattctgcccacaaactctcactcacaagcccgacattcacccccagccccgatcccgaatcgtctaatttcaggcattttcggcattttataaaatttgaaaatgtaaaattgagccgaaaactaacctgcattaaccaatgagtgctgaaagattcagtgattaatatttgtcccttttttgtgtcaaaaaattcctcaaaatgatggaaagtttcgattcaaaaaacaaacaaagcaataaaatttaattgctatggtcaaaaggcgtgcaactgctgctgccgtgtgctttgctgtttctgctggtgctttctttgccctcggcggagacgacaaaagcaaatatttgcgttgagtgccgcgccccaaaaaagggagggaaaagcgcacacagaagaagcggaactgtgtgggggcatttttgttttgttgtcgaatttgggctgaatgggaaaagaaatccgccgccaccggcggacggacgaagaaaatgagacgggcattttatttatttcactttctttcatacgcaaaagtggcaaaaaaagaaggcacactaagtcattgcctctctctgctgaggaggcgccttaaattttttcgtatattttttatatttaagattaaagtttagtaacgaaccaattcggggattgcgaaattgcactcaaaattggatgagagtgtctttaatgagtttcagactttttctctagaaaatttttgttttctttttttcgacatttatgagaatttactgcccgatcagggggatgctcctcgatattttttagattttctcaagcaattcccataattttttgtcgggggatttcatccccgatccccaacttttctctccctgagtgtcgggactatccgtccttagatgtgttattaatttaattaccctgaggaggcggggagggggggggggaactaattagcgggtgtgtactcccaaagcaatcatcaaatctgagggtcccgcaccgcaaaatttaagcggcgcgagagggcgcggggggacaggggtcaattggcacagtcacggcccaattgaaggaccgcaacaacacaagcaccacaagtcagtagaacaaatgatttttgagtacaagcaatgatagaggcaaatgcttgtagacatcatcactaatta

SEQ ID NO: 14703 - DNA, 4060 bp, Heterodera glycines
aataagtgtcgcacgtctcagtcttgttctcaaacagctttttttatattgtacgaatccggatcaggggttaggaatcggtcgaaatggatgtcggattcgtgatcagcgaccccgaaaacccctagaaacatgtttctatgattttttgaaagttgaaaaaaatttttaaaaaagggggggtaccatctaaactatttacctgattttaaattgcttaacagtcttaccttacaaaattccaaaacgccgttggaacacaaaaaatattgccaaaaaaaacgcctaaaaactgactttttctggcgctattttggcgcctcaatgtcaaaaaaatgaataaaaaaacataggaattttggtcgcattacacatttccctaacttctgtgtttgcaggtgtttctgatggaatatgccggacccttcttcatttatccgctgttctacttgcgcccagcgcttatctacggcacgggcgcttccatggcaccggttgcaactgccgtgacaattgtacaaatttacattgataccttatccctaaaatgccataccaaatggccttgggcacgaacggtccctggaattcggcacttgccatgagattttcagcaaaaaataaaccccaaaaaatggactgtcgccagcagtttcggtgtaagagtcgaagtcgagtaatttttttcgttttttaggcctctaaaaacggatgtttaataaaaatgactctgacggttggtgcccataggtctaacccccttgaaaattaaaagggaattcgttaaaataaaaatctccatcatttaaaaaaaaatttttttgtctaggcctgcatttgccacaccattcactatgccaagcgattgtacgagacacaatttgtgcatcggttcagcaacggcacaatgccattccaaaacttgttcaaggttggctgattgggtagaggagggcctcacaaatgcaaaaattttcatgaaaaattcaaaaaaaaaaattttttttttttttttttgtaaaccaaaatttctaaaattccagggtccaatttatatatttaactaaatcatagaactgcacgtactactggggcttctccgcgttcatcgcctattttgtcaaccatccgttgtacacgtcgcccagcttcacccaagtgatgattggccttgtcggcttcacaatcagtgaacttggtgagtttttgtttttgttttggctaccccctggaaaatttttttgcttttcacaagctccaccctcgggtttttttcaaattaaaaagcgataaatttgaagaaatcctggttccgaactctaatgcattaaattgtcaattttttttttaattcagaatttttttaacgatgttattagaaaaaaaaaccaataaaaatttgcaaattctcttcataaacattaaaaaaaatacatgttgtcctcaaaattaattgtaagaagaaacacaaaagtcaaaattctttttaatgctcaatttccactgaaatttgtgccagtagtaagtgtgaactgcttggcccagtggttagtgcatttgttttgttttgtgtgttgttgttgttgttggttcgattccttcttccccctttctcccgtttgaccgcactttggctctctcaactttgttgtggccaaattgtgaaattgtgcttcagtggcgggtaaatgaatttggaggactgagtgcagaactcgtttctctgggactaaggtcccgcgggtgcaccccaaaatcacgccgccgaaatcacgccgggacaaaatcacgccgctagaaatttaaaaaatgttttcaaaattttttcccttaaattttcctataaaaaaattttctaagaattttttcttgaaaaaattttagggttgaaaattttttaaaaaatttctagcggcatgatttcggcggtgggattctggcgccgtgattttgtcctgttcccggttccgctgatgcgttgaaatttgaactctttgacgtggtcattcggtctacatttttccattttttttttgtttttttctaaattttttttcgagttttcagccttttctacaggccgagaattcaaaatttgaagttgcctatacatttccaaaaaactttggcatacaaacatttttgaaaactcttttttttgtttttgcattttatttaaatattcctgaatttttgcccaattttaggcaatttgtccatccatcttctgctgcgtgaccttcgccccccgggctcccgtgagcgcaaaattccctaccccaactccaacccgttgacgctgatgtacaactttgtcagctgtcccaactacacttatgaggtgtgataggccaggccattgtgcgcttttgatttttaagattttcaaaaaaaaatcactcaaaaaattaattaaaaaaaatttcgttttaaaaaatctctatttaaatccccttttcatttcaggtgtattcctgggttttcttctgcgtcatgactcaatcgcttcccggttaatcaatgcgcaataaatagaaaaatttaaatactgtattttaattggtgaccggtacggtaaaatttacaaccgtatgtcaagcaatcaatcttcgtgaaattaggataaaaatggttaaaaaaggacaaatttcaccttttgtttaaccgaccgatttcctaatttatttttggtataaatccatttacggtaatttattgttgccataaatcaattaaattttccgctcactaatctaaatttaatttttttttttttttttgcagccgttttcttcactttggccggctttgcgcagatgaaaatttgggcggacggcaaacaccgggcgtacaaaaaggactttgccgcttacccgcgcaagcgaatgccaatcattccgttcctctgctgatgaatggaagattatgatagggatatgataatgatgatcagatttgatgtggggttctttggcgttgtgttgtctctgattgaatggttggtgatcggctaattcgaaaattgatttgatcagcagccgaatgatcggtccaacgaaatttaatgtttttttttcgtttttgccatagaaaaacttcttaattctcgatattacaatacactgactactactgcttgttgatggtgattttccctcatttgaacacttttccagaggcatataattaattaaatttgtattttttcaaaaaattattttgaatgtcatttttgtgatcactttgatcaatgttgaccttgaaatgctccggaaacccgcttttttcataaattattctcaaaaatgacggagtaagacaccatcagcatttctaccattctctacaccgtaattacccaataaattaattaattgtccacgccaatttccttctctctaaattattattatttttgttgatcagtttagcattgtcacaccaccacaaaattgccgctgtttgttgccatttaaaaaacaaaaaatatgcacttcatttcacttatcaaaatatattatgccttggccatgttaaatgcatatcacactaataataagtttgacctttgccagcaaaaccggtttatcaaaattagttaacttaaattagattttttgtttttcgaaactttccaaaagtttaaaaatcttttaaattcgaccggttttgtacgaccaccactttagtgacgtatttccccatttatttatcattttttcgaaataaattactaggatgatttaggcaacacatacgccccaattatgcatgaattgttggcattgaacacactgaagatcacgggcggccattttggctatgccaaattttttggtttaattcgtaatcccggcaaatcaccgcgggttcctttccggcggtggtctgtccgcggtatgctctcgagaggaatcctttgaaaaatataatttgataataaaagtatcataaattgaccgttatcttccataatgtttcttccgttttatcctacctacataaatatttttaatattgttgaaattaataatacagtttccctcgcattattgtaagg

SEQ ID NO: 14704 - DNA, 1064 bp, Heterodera glycines
tttcgagtgattcgttcttcttttgttctgatctggtggaggcaagcttctttaggaattctgtattctccttcacttcggagctaaatttatacatttttaatttaatttaaattcatattcttatatactattcaattggtaaataaatttccagagtctcatctggaaaaattttgctacataatctgaattcctcatcagaatttgggtgcatgttaatcatgagatagctaaattgattattggtcgcatcgttatatgcatccatgaaataattcagtctttttgggaacagttgtgaccccagtgtccttcctcacttgtaatttcctgaatggttgcgcattaaaaccagataatgggcgttagctcttgccgttttaatgtcccgaccgtagagactctgggttacaaaaattacgcttacattccaattatgggagcccctggtaaagagtaaatcaagaaaattgttctgcatgttaagcattaaatcgtcaagtatcagtaagagggtttttcctgttatttaatcttattcatgtccggaatcccgttaaaagtctcaacaccctccccgattaatcctaaaatactatcattcatctcaccgtaacaataacgaattttggtgggcgatggttcaattagattcttatggtgttttaaaaaccgtaatagccaacgggtcttaccactcccggtagaccccgagagaattagagtgaacggaccgcgaaacattttttaattcctcttatttatttgacctatttatattttcatagggaacatgtttcgcgcatttggggcatagccagaaattatcaaaaaatgatgtaccgtaaattaaattaaaacaatcatagtcgtaatattttccattttcttacaattgatatagtaaactagaatttgctgtatatttttataataacaaaatcaaaaaacctaaaaaataacttaaagaaaaaacatttgattgaaatttatatgaaataataaatagatatgttttattaattagaaatattttatgtggaaataatactaaataaaaa

SEQ ID NO: 14705 - DNA, 2325 bp, Heterodera glycines
tttgggtttgtattagcaaaaataaaaaaggcataagagaataatacttcattttaagtaaaaaaaaatgaaattataatttaaaaaaatttatgagtacattataaacgtcaaccgcatcagaccagcctcatccaagccgtttcaatcggttcaactcgaaatacaaactcccaagccgcaaggttcgagcattaccgatatataaagtaccgatataaaaaatttctgccgttgataaaatgaaaatgtgatgcaaaatactttatttttcatttacatgcaaatgatttttaggcaattatttatttaataaacttaaatacacataagcacacaaaccagagtagcaggcacaagagatagttgacaagaaataatatattaatttaatttctgatcatttcaacatcacttacacataaatatcaacctaaaaaaagtaagaaataaactttagaaagcctgagaacaaattaacacgaataaaaataagtaatcaataattttgtaagaacaattaacgaagtgagagactattaaaatgcagtgattaaattttattttatatattactatattcccttcacattcaaatgcattatataataaaaagtatattttttaaaaacaattaaacaaaatattctaaactatataaaactagattaaaaaacaaatatagcaatataaaataattttaataaaatagctggatttatgtcgcttcatgtcttgagttgcttttccaaaaatatataaataataaaataaattaaactaaaaacaaacatgataagtgccaggtcaattttttttttgtgattacgcgtgtcagctgctcaagattattgagaaaattatttatatggtcttccaaagcttcaaaattgacataaacaaataaaatttgtactaaagagtgcatcaattcttcgtgccgagataattaaaaagaaataataaataataggaaagcgtaattcaattaattttatttataattcgtaaaaagccaaaattaacattacctttaatttgtactgaaaaatactaattaatatgaaaagatattttaattgcgaaacttatgtgatttattaaataaatttaatacattgagacgcaaaaccttattcttgtagctgatactcgaggtacatttacctataaatttccttctaaataagcgcgacatataggcaaaattacttttttcgtttttgcttttcacagatttgtcgtgggaatacaattggctatctccggcagtagaattgttatattttaaaattatttttaattatttatgaaaaagctaaatttattaaaattaatatatattatacaaaaaattaaataacaaaaaattacttatattttccccgtgtaacataataattaaaatttaaaaaataagacgaaaaagataataaatcaaaaatacaatataatcaatttcaaatcatacattgtgaatatccaaatatttaactacaaatagagcaattattattttttatttaaacgtccaaaattaattacacactggaaaatctagccaactaaattcgaacagaggaaaactgaatgtaactaaaaaatttcatcttttagttttgtaattgtttgtaaaatgttgataactcctatgttttaattataattattataaaaatgtcagagcgacattgcgaaaacattggaaaattaatgaatatagtcaattataaaataaaaataccaacttatttgaataaaaaggaataaacaattatgtcggaacggatcaaataaacaataaatatatgacaaataaaagggtaaataattaatgaaaactttttaatatgcaaaaagaaaaaatgtcacaaaattataaaaacttaatattttaataaaaaacaattgttattagaaataaataatcattaattcattgacttggattaaacaataataatataaaaaattaaataactcgaaaaagaaatttattatctgcgctacataataattaaacggagacaaataaacaattttaagaattgtcaaaaaatttaacaaaattatgtgtattttatgaactgtagccaccaccacgcacacaataagtagagacttagcttgaaaattaataagaatgctttaattgaaaaaagataactacctaattaactaaatgaaaatgaaaaattgaaaaacatcattttccaattaaatttaactgattttttataaaaattgcaaaaagataaataaaagtaaaaagtacaaaatcaaatgcacaaaacataacaataattttttttgtattttatctat

SEQ ID NO: 14706 - DNA, 1389 bp, Heterodera glycines
attctgaggccttccgcgatggaggaaaaagcgttgcgccgaccaaaagtgccattggggcgccaccaaaatgatgatgtccaaaaccggcggagcaggcaaaaattttcggcacctgtggaaatgggcctatcgggaggcgtgcaagcaggcgggcatcgaggtgggggcctggccattgaaattccttggaaattttaaaaatttaaaatttcaatcactaaaaatcaatgaggttgtgcttcaatatttatcaatgcaatttgccattttagagagaatatttaaccgagttttaaaacttcgagttttgggaataattggaaatttaaaaatattcctttaaaagcagaaaaaattcattttccaaaaaacttttttgaacattttttcattggaatttcgtagcttttagtgattaattaattaattaaatttgattaattagtttaatttaaatttaattgttaataaaaatgtacggacaaagaccgaattgcgtcgcgctaatttataaaaaaaaaactaagaaatatattaataaaagacctggctactttataaaaaatttttaaatttataatttttttatttttatttgttttttgtcatttcgccacaaattgtgccaaattaaaaatgtgccaacccatacagggggcttcttctccgtccctagttcttgttcttgttgttgtcctattgtttcaccattttccaccaccctcaagccctcaattaaaggcgttagaatgagtgagtgtttgtgccattttttgttggcatttttcccaccacaagaaatggcaccactccaaaaatggcacttttccctttttctccggccggagggcgtttgagaaatttcttgcaataatttttaagtttaaaaaatactattatttttattttttatatatttatttttttgcccttttttggcaatttttagtttaattttttcgttaattaattttttactttttaatcatttttgttaatttaaatttaaacccgttcaatttcatgattgtaatttttgccattttggagaaattaaaaaaaacgaaaaataatgcctaaaattttaaaattttcatgaattgatatatttttattatttttttaaattagtaacccctacgaaaaaatgtcgtcaaatttccactcatgaataattaattaattgctgaatgtgctgttttgtgtgcgtgtgttgcgaatggtcagcgttaaattggcaatatgccgaggcaaattggctcttaaaaaggagaaatgccgaatagtgatggtactcagttggctatttcgcgctcaaatggcagccaaaatctttttttgagctcaaatgaaactatgagcattcatttgttcttcactcaaatg

SEQ ID NO: 14707 - DNA, 2079 bp, Heterodera glycines
taaaaacacttttgaaaattgtgcccgaggcgccacaaaaatttttgaataatttatgcgcagcaacggcgccgccgcctcggaggcggcggtcgttcgtttgtcccccgtgccgccgccgcctcctcataagtgcgctaataatgaaaagcggcacaaaaaggcagaaaatctcttaccccgggagtcataatatagggaaggaaatgatttttttattgttttacataaatgggggggacgacagaatgccaacaaattctaaatatttaaaatgccatgccaaaaaaaaacataaattttctggctctactgcagttgagatgcgcgtccaatcatcttggccatcctcgatttcttaggccgcatgaattttttatttcgtgcttagtcaatgccttctagagctcggcgcgtgacgggaacccgcgcgggatccatcccaaccctttcgcgggattttgcggggtcccagtccgcaatcccgcatattttaaaatagcgggatttgcgggattaatcccgcgggattccccattccgcaaaaaataattttgaattttttgaattcctactgggcgcaaagcaacatcaataaaatattcaaaaaactgaattttgtaaataaattcgagagtctcgaggagggtaattaagtctgtccaagggtcatccaagttaatccagaaattcgtggagtcttgcgcctccgataatttttgaggattaaattgggcccaaaaacttcgggggcaaatggtgggacaatcccgcccaaaatcaaagcatttcaagaaatttgacgagaatcttcaagccttcaatgttttggctttaaattatttgggggggggggaggtcaagggattggacaacttggcccgaatagaaaaaccaaattttttttaattgtaagcctgtccaagtgtcttaagcagaccaaaaaaactcgagagtcttgagccccttcgacaaatttttcaaatcgatcaaagaagaattccgaggccacctaaccaaccctttaagcctttaggtcacaaaaaaaactgattattaccaacattttttgagctgtttgagcgggaggggggtgggagagtaaaaatttcatttccaaaaaaatattgtgccacaatttccaaatttccaatgccaatgagtccatctgctgtccattttcagtcccacccccgtcccccgttcatcatcattgttctgctgtcgtcgtccaattttggcatcgctagaggcaatatatgtgtcattgccaccccagccgtccggggaggggcggcattttcgtcgtaccgttgtgcccccaggggctgctggcccatcccatccccgcgccgtgccgttgctgccagccgactgctggcggtgcccttccgcttttctttattaatttttcctgcctgccgccgcgaaacccaattttttttattattgtatttgcgcttcgccaaacatttgaaatgtgtatggtggttgtgatgataggccggcaggccgcccaatgtgccggcaaattgtgccgggtaaaaatgtggcatttttggaaggtttctctttttataattgaaaaaaaaactttcatatcagcttaaaagggcttcttctcttcatcaaataatcatagtgatcataaaaatgttcattgaaataatatttaaattaaaattaaattattttaattgtaaattatttggtttctctcattaaattaatttttggtctgtcacaatgccatttttgactaattaaagtttaggaaaaataatttattttgcctaaaaataattgactggatttaaaattgttctttttaaaggcatttataatataaataaaactaaatttttttttaaattttcataataaaaaggccaaaaatttaatgccaacattttcattaattcattaattatatttgtatttgtttgtttgctttttttctgtttcggcaaaatgcactattctcgagacattttggcgccgtttcttctttttacaaaaatattctgtccaaccctttaaaggggcatcaaatttcctttccattaaatggcatttttt

SEQ ID NO: 14708 - DNA, 1930 bp, Heterodera glycines
  misc_feature (1862)..(1862): n is a, c, g, or t
atatactaaaaacagtttgaaatcaccttttacatggtttttaatttttaaatgcgggatttgcgggattaatcccgcgggatcccgtcccgcaaaaaattttgagttccagtcccgcagcgggttccgcaaatttgaaatttccggtctctactaaagacaatacaaattaaatataatttacttagctcaagggcaactgaattttaacattattggtattgcgaaagccttgagttttctcaattaaaccgcaaatttaaaaatgatctaaaagaatcaaccaagttaaatctgtttgcttttaagtaaataaaaaaaagtgattttacggaaaactgctaaaataccaattttagaaacgcaccaacacagcatattgtacattttgttgttctttttttaaattaatttatgctaatttaagaaaatggaccggtgccaaaataaacaaaattttactcagtaaaaatattaaacatttcataaaatttacaggaaatgttgcacgaggccagcctgatgcactcggtgaagcatgagcatttgctgccggtcgccggcatttgtatgggcgccgccggggggctcaaaattgtgacacttttgcgtccgttgggctcgatgctcaaatttctgcaggaaaacgaaaaattgctgggttctaagcatctgatgctgtactgcttccaaatttcttccgtaaatatttctaatttttcttgaatttttccattttaatttataggccatggaatatttggccaacaaaaaggtggtccatcgcgacttggccgctcgaaatgtgctggtccgcaacgtaatgcacgtggaggtgggcaaaaaacaaattatggaatttataataaaaaacgaactatttaaggaatattataataataattaattaattaattttgcaatcgatgccctttaggtgaccgacttcggcttggctgccatgctgcaacagcccggcgattcggtggtggtggacggacgcgtggcggtcaaatggctggcgctggaaagtctaaggcgccaaatttacaatcagaagacggatgtgtggtaagcgcgtaaataattgttaattaattttaaaaatcaatgcatgacaataaaaaactaagaaattctcaaattttattattttgagcgcttttctcttcttacaatcgcatttttgacatttctttcgtttaattttttttttttacattttttaattgagctgacgaatttgggactaattttgtgattttttaaattaaatattttcaggtcctttggcgttacgtgctgggaaattttgacgtttggcgagtcgccctacaaggatttgctgctgagaagggagaaattggcttccgagttggcctatgagttggagcggggataccgtctccgacagccgaccaactgtagccaggaactgtaccaggagctgctcaactgtgagcattggaattgaagccgaaatttggggttatgccgttccaacacccgccaaaaaattccggaatgcggaattttaaattttgaaatttttccaaaaggaaaaaatcggttttcttcaaattttcatttcataaaattgccgagatgcgttttctcatatttggtattgtagtgaagatcaaaaaattaaatttggcttttggtccctttacaaaaactctttagttgacccttcccttccccgcccccttactgtatgataccgtacccatcataggttggctggtggacccggactcgcgcccgcattttttcatgatcaaagagcgctttgaccagctttgccgtgcaccgcacatttacattcaggtgaattttgcattaaaaagtgtttattttgngctataagatgcttgatattatttaatagctctattttctctattatataaaaaggtctatcgattat

SEQ ID NO: 14709 - DNA, 1034 bp, Heterodera glycines
aggggggggggggtgattgagaaaaagtaagaaagatttaaacaaattttcttgcggggtacctgttggtacgttgctaggtcgttacacaaattttcgtttttgatctcattcgaaagcctaaatttgatcactcgaggctgatcaggcttataaagataattattcaattctattgtcattgtccctcactataaaatgcttttattagttgattaaaatcaattgataattgcgttttaattaaaataaaaatttaattaaaaaattacattttaaaataccatgacccacagtaatatctcaaaaaataatttctcagatggcgcttcttcctgcagaggtgatgatgacgaagtgcattatctgatgccaaaacggtcaaaaagtgccgacccaaggaccagtcgcagtagtgacgacggcacaacgcaaccacagcaacaccctactacggtagggtacaacactgtagttggaggaggaaaggaaacggtgggcgcacgcgtttcggaactgtacacaccggtggtggaaggtgccaaaattagtttttaaaaactcagctattttttgctgttttcagccgagcatttgccaaattacataaatggaatgccaaaaaatgtcattgaatatgcgaatgggacgctggtgccgcagccaatgccgaatggttaccaaaatacgccgaactcaatggcaccaacgatgaccaagattaatgcaaaatgtcaaagtgaatcagtcatgtgaaatcccttttttggctttatgtttttaaatttataacgcgggttcaatgcaaaaatattaattacccaacaaaaaaacatcgtttgtagtcacttttagcggataattgtcaaattctcatttttaaaatttatgtatattttattttttaatttaagttcgagagtatgttgtattttttcattttgagattttcaagttcgaatcaaatataaatattatgtatgtgcccataaattttgaaaaaaaatccaacggatttaattctgagtaatcca

SEQ ID NO: 14710 - DNA, 1236 bp, Heterodera glycines
ttattgtataaaaacccggggattgtcaattgattggacgcataaaagtccattggacgcataaactgtactagagccataaaatcaaaggtaaaacgaaccatcctcgcaacgcgggcctagcttcaggcgttgactctggcacagaagaaatgtcaatgtcgattttgaagaaaattttctgacgatctgaaaaaattgcaatactaaataaaaacagcgattcacccaccgtcggcgaacagttcaagatgattaacgtactttcgcagttcacccagcgccattcgtgtgtaacagacgacaaccgttcggttgtagaggtcacaattatcatcatttctaagtgattcagactttacaagacaattaggttgaaaaaacgaaccgaataattaaaacagacatcaattccttttcacaaactcttgcttaatgtatcacaataaagaaattttggtactagtacagtttggatccgccttttggtcaaattttttcaaaatatatatttttttgttttaaaggatcctgaaaacaaataactaggggttttcgatgtcgctgatcacgaatatggcacctatttcgtccaattcgggatcccggacccgaattcgaacaaaaagtcgaaaattcgaatttttcaaaagttgcgcgtttgctctaaaattgattaaaacacggttaaattagtcaaaaataattgaaaacatcagtaaaatgattatgttgttcggattctgagataaaaatagattttaaagtcagcgagtgaatgttaattggaggtggtttcgcggaaagtttctgatttatttcagttttatttaaaaacattctgtcccacattttatcggagaatcgtctgtcggcgaaacgtcttgtcggtgaatcgtccgtcggcgaaccttcctgctcccgtttttctctataaattttaagcgtaaaagctactgcattttgtttgcacatatgacgatgagttctgttactaatcacttttgtcggatgtccttccttcttgttaacttggtctcagatgtgctatcgttaattattcggtacatatttttattttttagactaaccatcctttcattgactctgtctttttcatcttagtacgaaatggactctcccgctggtgctcagccgtcgaaccccaacgctcaacaacaaggtggaggccgaccatcgaataagcgactccagtaaacgcaggcacaagtggat

SEQ ID NO: 14711 - DNA, 2606 bp, Heterodera glycines
  misc_feature (2565)..(2565): n is a, c, g, or t
cccccatttcgcccgcaaagggcccaaaatgtcggaccatttcgcatcgagggggggccggtgtaaaagaggtgggggggggggtcgccggcgaagggaaaagaaggaaatttctgaaaaatttggcttttttcttaacaaaattagcccaaaatctcaaaatttggtcattttttagtcaaaatctggtagcaaaatggcactaaaaatacaaaatttttcccggcggcgcctatcggcaccgcctgctcctgcgttcgaaatttttttgagaaaaccgcgccgcaaaaaaaagagattttaaaaagcaaaaaaaaaaggtcgtcaaattgcatggctggaccatttcgcaaaattggcaaattggccgctgaccccccccccccctccagaccatttcgcaaaaattttggtcgaccccccccccttttcatgtatgatcactagagaccagggctgttgcaaagggaaaaataaaaggcgaaaagcgaaaccaaaataaaaagcgaaaaggcgaaagcgaaatgcctaacaaaagcgaaaaggcgaatttttttttccaaaaattattcataattgaaatcataaatttgaatattgtggtgcaaaaacaataacatttcagcattttcgggtgtcaagctttttcgcaagtcatttatgattaatcctgccgttgaaaaaagacgctcgctttcggctgaagtagccggtgcagaaagaaatcggaatgccagttgatcgcggaggaaaatcctttttataattacatgatttgcagaaagcaacccgcccagaaagtttgaagaaattccaaattaaagacatttcataaaaaagcttaaaagataaattctatagattttctcctttaatgtttatattaattattattttaaaaacccaatctttaggggtgtacttttatttcgcttttcagccaaaaagcgaaagcgaaaggcccaaaaaaagcgaaacttgcaacagccctgctagagaccgacttttgagggataccgtattttctctaattatcccccaatctccattaatcccccaatctccaattatcccccagtctaggatgggtttgaaaaataatccctctatcttaatcccccagtctccaattatcccccagtctacgaggaggttgaaaaataatcccccatgagggataattagagcaaatacggtaattccctccgctggtgccgttttgtcgtccttcgctcccattgcggccattccagtctcacaattcgttcgttgggagtgcgtgccgcgcttctttgagcaccgtcgccgtgttcgactccgttgggtgcgtgttcagttcacacaaacgaatgtcccgcgggtcgccccaccctccgttcggtttcgccggctttaacattcgcttgccaatttccaagacgcgcattgaggcggggaaaaaggaggaatttacgcgttcgaaaagtttcctaaaaaggtttaaaaaaaatatgcaaatttgaagaaaagaaattaagcaatgattaaggcaagcgaatttcgaaaatgtatgcaattctgtcaaaaattcggtgctatgtcgttataaaaaaccatcaaacgcaaaatattcaacaaaaaccacccataattttgcttaaacctaaaattttaattcttgatattattcgatcgtgcccagagattttcacctcggacatttgcgccttttttgaaaaaatcatcaattattcaaaaacagaattaatgcttaagaaactaaaagactatgttttcttaattttaatgctatctaagctatcagggattgaaaaaatttcaaaaaattaatgaccaaaaatctgaaaacctggttcttgagtacttttggccataactttgttcaaactttgacgaaattttttgaagttttgccagctaatagagaattttagagctatcgaatgatatcgaaaattaaaaatttagttagtttgagcaaatttatgggtagttttttgttgaaaattttcatttgatgtttttttatggtgtttttttataacggcccggcatcaaaaattcctgttctctcgttacgcctattaaattcaaaagaataattagttgaaccgtcgctgaatccatccccaatccatttttaaaaatacaaattaaaaataaaggaacaaacaaagcatcatttgcagcacgttcggctttgcatcgatgggtgtgaacgccacaatcgccgatatggagaactctaaacagggaaagaagaatcagaggaagtggaagatgggtaatggaggaatgagcccattttgttcaaatcagtcgttgtcatttgtcacctcggtgctttggtgtaaatgacgcgcattttcgaagccatacatttgacactgagttggagcaaagtccagtcccaattgtaatcgtcgtaggagcaaaacaactgcaaaatgttattaaattaattaatttaaaatatgaaaccaagacaacttttgaacagttctgcaccgccttccaaagtgttctgtcgacggccattcccatgttgaatttgctgctgtacanaattcgaggcccaatttggcgatatctttttcatatttgtc

SEQ ID NO: 14712 - DNA, 3523 bp, Heterodera glycines
  misc_feature (126)..(126): n is a, c, g, or t
  misc_feature (136)..(136): n is a, c, g, or t
  misc_feature (165)..(165): n is a, c, g, or t
tataatgggcgaaagaaagcaattgatttgtggtgttggaagggatctcattgtcagttatttcgacaaatgatttaataggcggctcaaaaaaatttctgattgactccatgaataagagaggcncaaaaggcantcggataataaaaatgggtacttccgggnttttccaccccttgaaaattttttttctaatatttttcccaggttgatcacgaattctgatgtctaattttagctagaacgtgttttacgtgagttacgtgaaattttactgaaaaacttaaaaaggtaatagtgccagaacttacccccgccccttttttcgaaaaaaaattctattttttttttaacaaagtaaagtccttttaggggttttcacggtcggagaatccgttcccatatccatttcgactcaattcgaacaaaaagtcaaaatctaatttttctagtttcgcatttttggtacaaaaccggcttaaagtaaggaaactaactaaaagcaatcaaacagagattttacgaaatattattgtctttatgccaactatttaaatttttgttttcaaatttttaagtttttcacgtaaaacactagctaaaattaaacatcaaattcgtgatagcaggtcggtcgttcgttctccgtacgcccgcacctcgaaatttttttttaaaagtttttcttaaaaatgtttgaatttttttaattttcgagaaacgacgcggtggaataaagtgaacccaaaaaggagggccacctgctgatgcttctgcggatgaaaacgtttcccaatgcctttgtgctttcccattttcgggtgatcccccgacgaataggcagccgcgtggtgtccattgttttgtggcatttgataaccgccattttgtgaagggacgtcgtgccaatactgagccaccgtataagccggcgcagttagctgaacttgctgttgaaagccctgtggaacggcttgttgcggcgagaggtcaatgttggtgatgttgccgtaattgtaataggtcacagcaggggccgaaggagggcaaaagtattgttggatttgagtgtgatgagacatttagagaagtgagagaagcgatggttggcaaagaaaaaaagaggtttcaaggctgaaaattagcataggtaggtatgaacggaaaaagcgatttagggccataaaatgggtcaacgtcagttgggcgccagcaggtttttggactataagttttttctttgtcaaccaaatccaacattgttggtatcattcgaaagctcttaatatgctctattagcatgcaaaattttaaaaaatttcgtcaattttgaacacatttttgaccaaaaaggttggaaatctggttttttgaattcttctggccataacttttttgaaccttaatgaaatttttcaaaattttgcaggctaatagaggacacttaggcttttgaatggtaccaacaatgtttaatttggttgacaaagaaaaaagttataactgaaaaggtgctggcgcccaaacgtgtcggcgcccaactgacgggttccgcataaaatatgggaaaaagtccagaaatatgacataaatttttacaaaggaagtgtgaaattctcaattatgttgttttgattaaaaaccagttgaagaattaatgtttggcgtaaaaaacgacaatggattcaaaaatccgagcagattgctgactgaccaaccgttttatacccatgaaactcctcctcggtgacccttctttggctaagggatcatcaacaatttcccagtccctcgaggattgaggtacataaaaaacaatgggaaattatgggaaaatggattttttttttgtccatgggccaaatattaccaaattaactaagagcaagccattagcaggggctgagttggttgccttatgattgtgctgttccttccgctgaaacgcctaaattgccactggctaattcacaatggtcaaagggtggacaaagcaccaaaaattagaaaggcctcagaagtgatcaggggaaaaatgtggagaaatttaacggaaagcccaaagagagaaattttttgttgtgtttttttttgtgagcaaaaattgaaaaaagtgaaggcaaaattaaatggtaaagcaaaaggaatcaaagtcaaaaggcaagagcaagaagagaaaggccaagagtgctgccgcgtaggcagagcaaaagtggcgaagtgcagaaaaggcgagaagagtaaccccgagacgcgaattcttctttcctttattgggccaaatgggatgggcggtccacagtgtccgggtgattggtggtgggtgggtaattctgattggtgggccaaccggtggttgggcgacagtgccgggtgagcaacgggcaacagatggacgggcaacggcgagggtggggcacaatcggaccgtgggggaggggggagcagggccaagaacgccaagccaattccggattttatcagtgcaagtcaccaaaatgcctgtggggatttatgggaagagagaaatggtgggcaaagcccacggattagcaattcatatttatgcgaaaaatgggaccattgggataatccccaaccaaaaaatatgtaaaaaatttgttttgcgtagaaaatgaacaataaataggcaactaaaaaggaaagtgtgtttgattccgaaaagtcaattaaattcccaaacaaaaatgccgtctttcgttctttggtcggcacaattcactgattcatcgtccgccggttggagtgccggtgttttcccatccgtttctgttgacaacatcggcgagccaattggcatcattccactgactctttgcccaatcactaaaataaaggacaattaaattcaaaagaaatattttaatttgtaaactttttaaaaataataactcaattaataataattatttaatttaaaatgtatttttcatttttgaatatgccatttttattaaatttatgctcttacagtgacgagtcaatgggatggccccatcctccgacgtatccgccggcgtgccccaaaacgtccctctttcaccgttctccgctcggattctgccccggatttggattactttcgccagaggacgcttttcccttttcattagccgccgattgtttgccattcaataaaagctgaatgaattttgaatagtataattttacaataaaaaatcaccagaagtaccattggtccatcggggtttggaggggcggggtctttcgactgcgccttcccgtgcatcgtaatgtaaatgataagtaccgccataatcgaggattgtctcgagaagagcggagcctttgtaatagctatacattactgataaagacgacaagtggtacaaaataagaaaactagacgatcaaaaaggcatatgaaaaaagcaaagagactttaagactcattcacaacttcaggccatgtcttcttttatctccacgcgcgtagtgttgaagcggagtgtcgttctgtgtgcttgtgcggcgccgccga

SEQ ID NO: 14713 - DNA, 1300 bp, Heterodera glycines
  misc_feature (71)..(71): n is a, c, g, or t
tgacaaaggcgcagcccataaaaggaaaaaaggaatgaatcctttttcaaaatgccaaaacaaaaacagcncacaatagatagagagtgttctgtttgattgcttcaatgcttttaaaaattaatttgctccctctaattacttttgcctaccaattagcccccctccacctattttacttcagtgcttttcctatgtttgtgcttctttctctgtcccttcccccttttccttttgccgtacttttgccttcctttcccatttgacattggatgatcattcctgcgcgttgtcacctccaattaattaaccctaattatgttaatgacccttccccgcccaatttgtccccgatgaccgggcaaccgtaaaattctgtgcattacgttaatattatgtgttgcactgaatgcaatgatcactttgtgacttttatgggatagtaaggaatgcaggaggaggaggggattttaaaacccactcgaattttcttcaaattttccataatgacgcaatttgtccacaaattttactccgccatttgaattggaatggcttttcgtcctcttctcagaaagcactcgttgcttgaacatcgatttaaaaactcttttttctccgctttttacataaaatacaaatgccatttgaatcgaatccgaacgaatcaccgaacccaaaaccaaaacagtgatcagcactagcagcagagattgccatcaattgtcgaggcaactgctgctgatccaccattcattggcactgttttcaatgcttctgatcattaaatcaccgattgaaacagctaacaaatgagtcgcaacttttgactgtcctcgcagtccgcagatgcccctccccattctccgtggcggtgattgatccctccgccctctccaaatgatcactttcccaaatcacttttccccctttcattgggcaaacaaacgcagcgaatgacgcggaaagagaacgattgatggaatgaatatgaagtgaatgagtgaggagtgccttggtgcgtttcccccaactcggcccatttgtttcgtttcttctcttttggctgtcataacaccgcacaaataatcccaaataatcccttctccgccgcgtcccaacaatttccgatcattcgaaaatcaaatatttaaatttgacatttcacaccaaatatttgttcattcaattgaattgcaaagtgaacaaaaaaccgttcatttgcgggacaaagttaagccaataaatcaaaaccaaaataattaatttaattggaaagccccttctcatatcatttctt

SEQ ID NO: 14714 - DNA, 1271 bp, Heterodera glycines
taagtgaccaatgatttttctctgtcaaattggcaaatcgaaggtgccgatcatttcaccttctttgctttttcatttgttctgctcaccatatttctcctcctcctcctcctgcagttgtactgctccaacttcggctgattttccattttttcgtttttttccaattgcaccgattcgctcattttacaatgcctttgctttgcaaattttaacagttcccccccccccccccattttgtccccccgggggagggcattctttcctccgtctttcgccaaatgcatcgattagaaatggcgtcggattgatgtcgcaatttcttctctcttttccatttgttcattcatttttgcgctctattttttgtttacattaatccgtcattcttttttttttattaattttcacttttccttcaattcgatcacttttcaatgccaaaatttcaatttttctttcgaattaattttaaaaaattttccgtatatttaaaaatatattttaatatttaatagatttacatttttcgcttttccttcttttttcacaaatatttccgccatctgtgctaattccccgcgcgttttattggccattaattccttggaaagagtgcaaaaataaatcgaatcattcattgccaattgactttccaaaatattttacgggaatttagctcaaaatggaaaatattttggcaaattttaatttagaagctgaacagcaaatgcagaagaaaaccttcactaattgggtcaatttccgtctcgaagaggtgattttccgtttaggctttgttttggattttgttaattgcctttttgggcatttaatcatctaaaatggctttttactgatcaatcaattggctttgactttcccctcctttgctttatcccattagttctcttcttcctttaagcattcctcttctggcagagtcaccgaccttttcattgacatgcgtgacggcgttttgctgtgccgtttgttggaagttttgactggccaagttttggtgagtgtttgggcttaaaatagaagctaattaggctttaatgggaatagcagttccgttacttttgattgcattattaagctcgtcattacggaaagtgccgttgtcgcgatgtcaaaaaacggacaatcgaacgggtgggtgattttgtgccgaaactcagacttttgcattttcataatctgtaattactgtaatttaattgtcaggaaagtccaaagacggcactcttccggcggtgtcagttca

SEQ ID NO: 14715 - DNA, 1188 bp, Heterodera glycines
tcatttttaatgatgtgttattttttgctaaggtcgagcaaaatctgtcactgttgcgacagtccgtttggcatcaaattcaccaacaacaagcggaacaaaagtgccatcttttggcattgcctggcacttccaatggcgggggaacagcggcgattgttacgcggacagcggacagtttgccgaaggagggaattgagcggcaactgatcaaatgggtcaccgacgaagtgatcgggtcagccgttaattggccaattaattatgccatccttttaatctgataattagtttgccttttttgttcagtgaccttggcttgcgtgtgcgcgatttcgaccgcagttggtgcgacgggcgtctcttctgcgcactcgtccatcgttttgctcccgcgttgatgtctcgaggcgaagttttgggtgggggaaacgacgtgcaaagtgcacagcggagaacggaaagggcaatggaggtggcacggctccatctgggcatacggtaattattgccctgattgattgagtctacctggctatactgtaatttattgcccttaattgattgggttcacctgagtatacggtaatttgttgccctatgaacacaactgggcatacggtaaacattgcccctaattgattgaatccacctgaccatacggtaatattgtgatttatgacattaatagtcgtttgtttaattgtcaagcccattgttggaggcgcgagatgtgactgtctctgaatatgtgccggacaaacgttctctgatcgcttacgtctctcaattcgtttgccttcgcccccaccaaatgatgagtcattcttcgattcaaattccttctgctgtccctgccgatgtttctgttgtcgtcgaacaatgccaacaaaagaaggaaatggaagaagaaaaagtgaaacatttgttcaaattagcatttcaattttaaattaatttttcagtttttcgtgttcaaagaatggctccattggttgcattccgtcgccgcggacgaacggctcaaattggtggcacggcaacgaatcacaattcggcattttattgtacgggcattgaaaggcacaaaatttgccaaatttttcagtggttcacgcaaatgcgcgaagaattttgggaacgacgggcggcgattgtcgaccacttgctggtggcaattagaaaaag

SEQ ID NO: 14716 - DNA, 4400 bp, Heterodera glycines
  misc_feature (8)..(9): n is a, c, g, or t
  misc_feature (540)..(540): n is a, c, g, or t
  misc_feature (4214)..(4214): n is a, c, g, or t
gcctgcannggtcattagaaagaattcgaaaaaataattgcaaattaaaatcaatgaaaaataggaattaattagtctttgtcagaatatgccgaaaaagataatgaatatgatatagacaagatttattaatcattttatgtggttttttaaagttaaaacaaattgtaacccaaaaatttaataaaatctaatttattttcaaaagaaacattatatatttatttaaataaaaaataaatcaacaattaattcatatgcaggataatttatgaatctattaacaaaaaattaatgctcaaaaagataaataaaacatggaatttcgataagtaaataacaataaaaaactatatccaattatatacatatatatatacctaagaactggaattttgcaaaaggatccgtcagaacaatttattaaaaacctactttgctacaccacagaaatttgtgaagaatgatgtccaattatcaaataaaactgaaataataaagcatataataaatgtgttatattaaaaatattttaatganagatatccatcaccgaatttttttgtattttaataatcagggaacggatttttaggttttcacctatttttttgcggatagcatatggtgagataagcgcaaaaaacacattttcttcgatcaattttcgatttagagcgactttttagcaactattttcaactattttcgcttatgaaactttttaacaactattttgacttgtgaaatttaaaaaaaactatttttcaactatttctgcttttcaacaaaaaaaattattatgaaaaatgcaataaaaaataaataaaatgcacctctaagaagcgatgttaattttttcaaaaatacacccctttttttgaaaaaatgcaccctcccccaagaatcggtttttcaaaaagcaaaaattcttgccatgatttggcggacgatcgaaaaatttttacgcttgaaaattttcaaatgtgttgatttacaattgtgcaaccaaaaaggataaagatgagaaattttgcaaaattcacaaatttattggcatgttttccaatttttggcaactttttagcaactattttggcgtttttcagtttttaacaactattttggcagttttttagcaactatttaggtacctattttgcgtttttagcacctaaaattccgttcgcgcggggatcccgtttcgctacgggctcgagatacggtgattctcatttcaaaaccatcaaaaatctcggaattatcatatgattttaacattttatacttatcgggaacgtgaacccaaaatgcattgaaagaatgattaaaatattgtcttaaattactgcgttttagtcgttcataatcatatgtgctcattttgaaattggccatgtgctcccgctcaatttgacgaaaaagtttaactgcttgcacataaaattcagcctcttgatttgttggcattggacaaagagtgtaaagtctggtcttcagtttctgttaaaaatgtttgcccaagagatttgccagatattaattgattcgatttgaattttctttttgtatattcatggctttcctatcgacaaaatatgattattcatagttttattttaattgacacattttatcatttttaaatggaaatccgtacaaattgttgagcctattaatcccgaaaaccagcctttttttgttgaaaatctgttaacaaattacactcaaattttcaaaatttcccccggcggcgcctatcggcaccgccggacccctttcttcctcaaaaattttttggaaaaagcgcgccgaaaaaagttatgtgaaacgtaaatctgaatttctaataatattcgatcacttagtccaaaaatgattaattgtttgaaataattgaagaaaatttggtttgaaaattttcattaatttaattagtagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaaagaaatgttcgcaaaaaaatgacgaaaatatttattgaaaatgcaaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgtagaaatgctatttttaagcccctttcttcatagcatatgcgcagaaaaaatatgttaatccatataatttacaaccctattaattagctttaacttttgggttttataaaataaaaataaaataaaataataattttatattattttcactttaaaaaaattaaaatttgaatttttaaaaaattttaaaaatttttttgaatttttaaatttcccggttggtcccggttcccggtcccgaagaaaaatcgaggtcctggtcccggcttctcaggcccggcaagtcccggtcccggttttgcccaaaattcccggtcccgtggcactctatttaagaggcttaacaaaataaaataaaaaacataggtggaagatattcgaagctgcgggcttgtcatagccaaaaatgcaacaattttatatcattccaaggagtattctctccgttccggaatattttttaatctgaatgattaaatcgcaaaattgccgattttctctatttttggagcattaaaacaataaaattgaaaaaattaaatatgcaattaatctatttttaaaagatttaattgctttttcggcttttagagataaattgagcgcttacagttgggaatgttaagtttagccttggaggccgacaaaaatattttaattaaaatttttacgcacttgcagaaccgcatgaggggattgccgatctttgcagcggctaacaaagcccgctttgtagtgagttcggtttccgtacgggtcaatgatatcaaaataaaaacgctcaatttcaactattgggtcggtaacgacctaaaacaaaattttgttaatagttcgtttttataaataaaattattatagtgcagctcatgtagttaagctttttcttaattagatttagtggatgtttttttatccgggatggggcgcggacagaaaaatgacgtgggtacgaaataataacgcgacccaaaaaatacttttataattttatttttttagaaaaagctaatttttttttattttggtggtttttaaatgacgacgcagcacgaattgactatgagcagcacttttaagagtaaccacaaacttcaatgtaatcattcatagaaatgaaacttttcatttcgttggtttggtgctgaacatgtcgtgtaattgaatcgaattttgctgcgacgtatttgtgtagagccgtaattgctttgaactcatccgactcgggctgaaagaaccattcagcaatcacaacgagaaattcacggaaatacggtatatcatgcgaaaaaaaatgattggggcgggataatatttacaaaaggtcgagacaattagcaaacacacttatctgtcgataaatcttgaactttttaaaaaagcaacagttaattaaaaaattagtaaaaaatattattgtttattttaaattaatgatttaaatataaatatagtaattaatttattatttatatattaatctcaatttaattaaatatttttctcaaaatcaaatggttcgaactccaccggaaaagcaacttcggcaccggcagctaacaaacttccgattgggcccgaatagcgaacaaacgttgctgcatgcttgcttatgtgcttcaacttttgcactacgtcccaagtcgcttgagtanatgttgagaattcggaagtaagtttgtgcacgtcttcagtgtctacaaagacggaatttgtcacttttgcattttttacaatttaaaaagaattttttacactttcattaaataattctctacaaaaagagcttactaattgaatgggtagtcgttgcaaataaaagtagaaacgccaaagacaaa

SEQ ID NO: 14717 - DNA, 761 bp, Heterodera glycines
aagtgaccatttgatcgggcagaaccggattggattcattggagaaagagaaagaaaagccgctcgagagtaattaattaattaatggggagagtgaagtaaagcgaaaacgacaagcgacgagagggggagggaattagcaggacgaatggactccgaatggcagtgcccgcattttagcaccacccggaagatgccgacttaaccattacacggggaccgcacttttagtcccaactgaattctttccagaatttttttggttttcagaaaaacaaaaaagcgctgaactgagatagccagcagctcttccttggacttcgtccgtttttctttttttccatgacaatcagtgaatggctaatcccttcccccgacagataaacgggtctcatttttcctcctttttcttcatttaaagtgatccttcgcaattcgtcgtccgctcgaacactttgtgcttttgttttgtttccttttgcgtcggccgttttgtgttcttttaaagcattatttgtgatggattgcgccgcttttcccctttttctttgtgcttatcctccgcctccccaaatttccatcgtccatcaaattgagacactgtcagaccaaacgaaagaacgggaagaaatatgaggggagggtaaaaggggaaaaatcggtcacatccatcggtcggtcggaacgtgataatcatttttgccctgggggacggcgatggatcatctacccaccaaaggcaccagcttgatttatcaccc

SEQ ID NO: 14718 - DNA, 2971 bp, Heterodera glycines
  misc_feature (244)..(244): n is a, c, g, or t
ccccccccacaacaaatatccttcgcctacggctcaaatccgccgcctccccctgccccctgctgtggtgggatgtgttgtaaagagcagagggagggcattgcaatgcttcattagtggtttctctccacaatccatgcgccatttgtgccgatcagtcgcgggagggagggcaaaagcaaagggaatgaatcaaatcaaaggcgggggagggggagggggagggggaggtccttcctgttcncttccatccaatggctttgacccctctcgccctttgcggatgattaacacaatacataagtgcaccgctctcccgccttctctcgcatttgctgcgcttgttcattcgcttgtccttaattattttttcaaaaattcggctgatttatttccaaaaaaatgaaaatgtttcttttgcagatgaatcagcaaaaggaagaaaagaaggcgtccaagggggagagggaggaggacgtcaaagtgttgttggccgaagcggaacgcttcaaaaggctggccttcctcggggtgatggtgtgcaccggtgggtgacccgtggaccattcattggcacttcgaatttgccgttgtctctttcagtggcaactttgaccgcctcaatgtgcgtgccgatgctctattcctacacgcagtacatccaattgtcgcttcgggatgaaatcggcttttgtgtgcatagaacacaaaatttgtacagcgaattcgcaaaagtccgttcccccccgttgcccatggcatttcctttcaattttcagtatgaaattgttcgacggcctaaacggtccccaatggtcagtcagtttctcatctccaaccacggcagtctctccgcggcacagttcactccaaacacagcccaacgccgcaaatcgcgacagggaggctatgagcaagtgatcgccggctacgccgccgccgggtcccaagtggcgccccctccggcgccgccggcacccgccaacgcttacccagggaacaattcgcctcctccgcctgcccaagaagtaccgcaagctccgccttcttcgcccgctccatccgctgctaattacgcggcaggggcacaagcgccttcggccggtgctcagcaggtgccattagtcagtgcccattagaaaatgatcaaaacacagcaggaacaggcggtggaggagcaatgttgctcatgcgcggttggcgccgccggaatgccggggccgccaggcgaagatggaacggatgggaaggacggacttcctggccagtccgggctggacggggcggacgcgccggagcaaggggcgaccggagggtacgacgagttctgcttcgactgcccgggtttcgaaacattttctcggttgggtttctgtaccatttgcttattcagctgcttaccccggaccgcccggcgggatgggccccaaagggccacccggacagccaggactgccaggccaacccggaattccgggagcgcccgggcctcaaggccccccgggcccacccggccccggcggagcgaatggaccgcccggacagccgggaccaagaggtaaaagagaagggagcggagcaaatgcaagcatacacttcagggttggacggacagctttcggatgtgcccggcgttcaagggcctccgggccccgttggcccaccggggcccccgggagtgccgggagagccaggccaacaggggcaaagccaagtaatgagggggagggctgaaaataatcatgctaatggccattaagccgggcccgcctgggcctcctggcgatgcggggctgccaggactgccgggacagccaggcgcacccgggcaaagcgcggcggacggcgaacccggaggaaagggcggctgcgaccattgccccgccccacggaccgccccgggctattagtcggattttggctccattcctcaaagcattgtccttttctttttctgtctgctcaatctcagtttctttccttatttacaatttcttcctcttgaaagcatttattttgtgcataaaatgcagaattgtcaaatttgttgttaaggaaataaatcataaaggcggggcaatcgcgggaaattttgatttaaaaaatgtaaatgtcaaaattatcattcaaatggataacttttattgaaagtggaaaaccagtgaacaaaaaaatgggaaaaaattgatcaatcacattttaatgatataattaataatttatgcaccaccaaaacacaacaacgccccctcactctaaataaagtaaatcagaggtggccatgctcatttctcaattccattttttgaatttaataactcaaagaagcaatcgcaaaacaaagtgactaacaaaagcattgccctcctcctcagtgtctgtttgtctcttcagtcttttttacatgcgactttctccgtctcctcttcctcgccttcgtcacttccctcttcctctgccgaactctctctccccaattcttcttgcgaagggacttcaacggaagaagactctttttggatgggatgcgtttgttgttgctcgggcgagtggcgcactaattccgtgtcgtcggcatcgaccaacttatcaagggaggacatcgaactgatcggagtggtgaagtcctgctgctcccttcgaatgttctgctgaaaatcagacgagagattgtctcatcgttacccgaactcaaaaatcgaccccaaatataatgtcaaaggtatcggaagtgaatgattatccaagtctcacaactcccaaccaattaatgacctcatcatcgccgtccgaaccctcagatgctgcaggtaacagtgagttttctttgctttccgggatcaaagtcgggttctcaacctaaccaaatgaaggaaaaacgctagaattattaaccagataaaattgaggctaaataagatttacgggtgattcgttggttggttttgcgcccaatatcgtctcattttct

SEQ ID NO: 14719 - DNA, 2554 bp, Heterodera glycines
  misc_feature (38)..(38): n is a, c, g, or t
gattagaagaggtaaaagagtgatttaagaggtaaaanagtgatttaagaggtgcaacagtgattagcagaggtacaacagtgattagaagaggtgcaacagtgattagaagaggtaaaacagtgatttaagaggtaaaacagtgatttaagaggtgcaacagtgattagcagaggtacaactgtgattaggagaggtacaacagtgatcagaagaggtacaacagtgattagaagaggtgcaacagtgattagaagaggtaaaacagtgatttaagaggtgcaacagtgatgagcagaggtacaactgtgattaggagaggtacaacagtgatcaaaagaggtacaacagtaaatagaagaggtacaacagcgattagaagaggtgcaacagtgattagaagaggtgcaacagtgattagaagaggtaaaacagtgatttaagaggtgcaacagtgatcagaagatatacaacaatgatgagaagaggtacaacagagattagaagaggtacaaatttgatgaagaggtacaaatgtgatttaaagaggtacaaaagtgataaaagaggtacaaaagtgattagaagaggtacaaaagtgattataagaggtacaaaagtgatagaagaggtgtaacagtgattagaagaggtacaacagagaagagattagaagaggtacaacagagattagaagaggtacaaatttgatgaagagttacaaatgtgatttaaagaggtacaaaagtgatttaaataggtaaaaaagtgataacagaggtacaaaagtgatgagaagaggtacaaaagtgatgagaagaggtacaactgtgattagaagtggtacaacattgttaggagaggtacaatattgtttaaaattaaataaataaggaaacgtttttattaaaagttaaaaatcgagtgcattttaatttaaaaattttttaataataaaatactcttttattaattaaaaacaaccttggaaattattaattgaatatttatttaatttgaaattaaatgaatttttttttacaaattcaaaaataaataatgaaattctttaatttaaaaaaaaaatttaaataatttaaaagaaatcttcaaaaattaattaaaaacattttaaaataagccaaaaatacaaagaaaaataatgttacaccgtccggatccaaacctgcggccccccccccccccctcagaacatgtcccagaatccccaatcacacagggattctgaggtcttgacgatgtaataactgaaatctgatgtcagattagtgatcagtggcctaaattggccctaaagacatatttttggaagatttttgtgaaaaaaaattttccactcaaaaatcctggtcacccccctttggtcccgaagccgcccccccccccaaaaaaattgggaatttaaaaaaattatcagcgatttttaggccgcttccagtgattagaagtggtacaaaaggattagaagaggttcaacagtgatcagaagaggtacaacagtgattagaagaggtgcaacagtgattagtagaggtacaaaagtgattaaaagaggtacaacagtgattagaaagtgggcattcaaatagagcatttatggtaattaaggaattgtttttaatcaaaatagataaaaaatcgatgtgttatatttttcattttttaacatataatacactttttattaatgaaaaacaaattatgaaatgtataataattgaatagttatttcaattgaaatgaaaaaaattttacaattaaattttaaaataatagctgaaattctttaattaaatataataaataatttaaatgaaaatcattattcatcaaaaaataatttaattaaactaaaaaaatttattattaataaaaccaaacatttaaatttattaaaagtaatgaaaattaacccaaaaaatacaaagaaaaataatgtacaccgcccggcttcgaacttcgcccccccccaaaaaatgatgcctcagaatccccaatcacacagggattctgaggtcttgacgatgtcaaaagtaaaatctgatcacgtattcgtgatcagcggcccaaaaaacccctaaagacatgtttttggaagatttttggtgaaaaatttttttcacttaaaaaccatgtgctcccccctttggacccgaagcacaaaatcacttttatttttatatctttttttaaagaagtgataaaaataccaaataaaatttatataatagagcaaaaaattgcggatttttgtagtattttacttttacagaatgacttttctgaaccgagttctaaatttttttctgaaaattcgaaaatttccagaaattctggaataactttttttcttttgaacattataaaaccaaataaatctcataaaattctcccgattttttgctatttttagagctttaattcacttaaattgaccaaaccttcactgagcaatgaatttcaaattttaacccaatttccaaggaccaaaaaattaaaaaatttcgaaattttaaaaattcaaaaatctgaa

SEQ ID NO: 14720 - DNA, 1376 bp, Heterodera glycines
  misc_feature (1341)..(1341): n is a, c, g, or t
gacaaatatttaattggttggctgctcaatggtctcctctaattagtcatttattctcgtcccctcccgagtccaccctccgtccaccgattgatggtgtatcagccagcgcgagcgtgtcccccgccccccgtctccccgctgattatttgcagcaccccgcaaggggggggggcactaatgggggggggacagcgggagacgcggaggattggatgggatgggatacaacaacatcacacactgcagaacaacacatcattctcagccagcacatcgcccccaccttccccccccccgcccattgatcaatgtacgagattagtggaggtggtggtgaatgggagaatgtgggggggggggggcgaagacgaaaaaagaaactaatcaattttaatgggtaaattttcaaaaaaaaaatgtcaaaatatttatgtatgcatgatgaaaaaattaaagtccaaaggcaaaaaaaaatgcactgaaacctaggggatatgccaaaaaatcaagtaaggaatcaaaaaaatgcaggatgactgaccccttctcgatttctaattttttttaattgggtaatttttaggtaaattatcgggagacttaacatccgtgcagaaggaaccgttggaaacattttatttattaaaaacggtataaaattttaaaaattgctatttgctgtatatgtataggaaattcaataaaaatgcatatttaaaaatggggttgttaggttatagggacaaccaaaaaatgggacaaataattgccccccccccacaaaataaagggcaaataataacccccaaaatgacaaaacatcgattaaatagtgtttggtgttgtgtctttgaaacagaggtaataacaaaagtcaaggtcgtctccgtccttgaaaataaggacaatttggcgggtttttgtcgcttcccattttaggcagtaaaataaattcaaaaaaaaaaactgactaattaacgccaaaaaattgaaataaaaaaaattatccccaaaaaggaaaggcggcccataaatttttgtttacatttggccaaggaataaaaggcgaaaagccattttaaaacaaaataaaacacacaggcaacgaacgaagaaaattgcgaaaagaacggcggagggcgaaaagcgccgaggcaattccatccatccaatcattcacatccattcattcatacattccgctgattcactctctcttctcacattcattcccctccattccccccatttctcacaacctcaaggaggggaggggtgcccccaccacccccggaggggtcgcccaatcgccgatcgattcgacgaccttttcagggngggggggggggaagaggagaaaggggggggggggg

SEQ ID NO: 14721 - DNA, 2650 bp, Heterodera glycines
  misc_feature (1487)..(1487): n is a, c, g, or t
ttttggacaaatttaagtcagaaatgaaggacccgaaaacctgttggatttcacgaaatccgagaatcctctcgctgctattacataaaatctaataagattttaggccttttaaaaatacagttaagtaaatgcctgtttgaatttctttcctatggaatttagaaatatttattttaatttaaaaaatactttttttgattttttagtattaaattcaaagcatttcgtatggtgggaatcggtgaagtgtaaaataaaatgctggccaaaatgaccgacttttagcaaaagttggcatttgtccctggggcaatttgttgccggccctttgggcacaaaagcattgaaaaatgttaacaatggcattgacaaattaaagaatggaaatgtggtgagaaaaagtagagcttgacattttgaaaaaagctggacttggattccgtattggacctggacacggatttcctggacaaaaacccaggaaaatccaggttatccaggcttgtcatggcctgtatcccctggcatagacctggatttttttaaatttattttaaaaagcaaacaaatgattgaaaaattaattaattgtttagtaaaacttgaaggtatctaatgacaaaaattatatttttaatttatttaataatttttgataacttgatacaaaacccaggaaaaatccaggtttccgaaaaatggcctggacctggatcgaggaaaaatctaggcctaaatccaggtccaggtcgagccctagataaaagtagcaaaaatttttagaaattttcatttaataataaaaagttggaaattgttatcagggaaaatgtaaaaaaaaatttaagtaaatcgtacgaacaaaatggcacttggattttacgtaccttaacctgtgaaattttggaaaatttcctaatttctaatgaagaaaaaagctaagccttatttttggccaaaaaccaatggctcttttcatggcaaaatttgccgaaattaaaaatgggcaaaattctggaaaatgtgagtgagtaagtgggtgtgtgctgctgtgtgagcatttgtcaattttttggccaagtcaatgggagagggggggggggggtcaatggccaactgcgaatgtccatttagccatccttcgccacaaccccctcccaacactgtgtctctctattgcttcgttactggtggggctgcttgctgctcgtgatgaaagatggatgagtaaagcaaagtgagcgaaaatgaggggagaaatagcaggttaaaggaagagaaaaagagagaaaggagggagaggaggacagaaagaggaagagaaagcggagagatagaagtcaatgaaagagaaagagtgagagggggagagagggagaacagagagagaggaagataaagagaaaggagagaattcaatggaagagaaggagagagggaagggagaggagggaacagagagagagaagaagaggagtcaaagngaaagagggcaatggaagagaatgatacagagagaggaacagagagaggaagaaaaagcagaaggatatataggttaatgaaagaggaagagagagagagagagaggaagctagagtgagggagagacaacgaggaagagaaagagagagggagagagagagggggaagagagagagagagagtaaaagaaacatgatagaacgagaagaaagtgaattttctaatttgttggcttcttcttcttcatatttaaaaaatataattttaattagcttttcaacaggtcaaaggttgaattggttgaaacggaattgtcggaacagaaatgccagttttcaattcaaaatggctttggtatttggctttttgaaaaagatatttgtttttctttgttattgtaggtaggtggtacacttaatccacaggctcaatttcccgcggattggcttacacttttgggctttaccctccccagcccattcgcttcatcatcaatttcacacgcttgaaataatggagagagtgtgtatgagcaagaggacaaaatggaaaacgggcagagtacagcagccacaggtaaaaacagacggcgagaaaagcattgagagagagagcgagggagagagaagagaatagagagggagagagaaaaagtgatatatagcaagagaatagggcagacgagagaaaagcattgagagagagcgagggagagagaagagaatagagagggagagagaaaaagtgatatatagcaagagaatagggcagacgagagaaaagcattgagagagagcgagagagagagagagagagagataagagatgaaatgcattgatagagagagtataagacagacagcgagaaaagcattgagtgtctgtgaagggttaaggacagacagcgagaaaagcattgggcagagaaatcgacagtcagagaaacaattttcaaaatcgatgaagcctcacttttccttggggttgcgtaattactactaagctgtggtcagtgtggccactgatgaaaagcggggctctggccatttggccaccctcggcagcagcaggcggaagcgtaacggaacacagcgcaaaattggatacataattaagaatctatttttggcacggcaagccaattatattttacaaatgaata

SEQ ID NO: 14722 - DNA, 2987 bp, Heterodera glycines
tgggaaacaagttgaatacctatttcttaatatatagccaccatgggtttcatttttcaaccccccccccccctcagaaactcagaagggggaggctttaattcaggggggggctgtattagaggaaatacggtaattagtttcccattaaaatattaagacgcaaataattaaatttttttttttgtaattttttgggctcatttttggtggaatccagttggtttggttggtgctgggacgttagtcaaaaaccatcaaaatgggcgttagtcaaaaaaccatcaaatgaaaaatttttgtcagaaatttatttataacttagcctaatatgtacgaaattttaaactcttgatatttttcgatagctctaagtgttttctattatcatgcaaaattttagaaaaattaattaagtttgaaaaaagttatgacttgagaagctcagaaaaccaagtttttttcaacatttttggccataacttttttgagacttaatgaatttttttgaaattttgtaggctaatagaaatacttagggctatcgaatgatatcaagattttaaaatttggttgcatctgagcaaagttatatcaaaaaatcttttcatttgatggttttttgactaacgcccattttgatggtttttgactaacgtcatggcaccgtttggttgggtaaaaatcaaagttcttttttctcataccattgcaccgcctcccccacacacaccgcaggaggaacgcgttgccgactgccgcaccaagcttggcgcgctcaaggaacgcattgcgatggcacgcgacaaggcgaaccgggtccgtctcggcgcgcactttgagcaacgcggcggcgttggcgcatttctcgagttgccgttgtcggccgcggacgaactgtccgtctacaacgacatccgcttcttcttccgcacgcgcgaaacaaacggtgcgttaattgttttttaattgttcattttggcgatcgacacattttttttaatgaacttgcggaacattcgtcctgcagagaatattaaaaatttaatttttgtttttttttactaattatttttcacaatttatattttttaagatttattaataaaattaattttgcattttaatattcttttgagattttctaataaaaataaaatgctgaacagtttataacccaaaaaaaaaaatccaaaggaatttcttaattaaaaatctaaaagatttttgacagaaaatatttttctaaataaaattaaatataaaacacgctctttttttgggaagcagctcgtttgtcgtttcccgccccctcctttaaaaaaatcgctagaaaaatcctaggggtttttttttggggaatttctaattttgatctttgcaacctactcacaaaaaaatatatgaaaattcaaaaacaaaatcttcccaactcttaaaggccaactgctgtttttgggtgcggacaatgcccatctgtccggcgaatacattggcgtcgagttggaaaatgagcgcccaaaactgacggttagccttggcgcgcgaagcgtcgatgcggcccagttgcaaacgcccgtcaacgacatgcagtggcgtgagctggtggtcaagcgtgtgggccgcgctgtcacgcttgcgctcagcaaaccgagcacggacgagcgcgcggaggaaaaggtgcgtgcaattcctgcttaagaatttttaaaatccgcacaaattcaataaattttgattaaatatgttaataattattgtcagaaattttttttattaattttggcaaaatataattcaattatacaattaactgagggtgcaaagccataaaatatagtcattgaaaattttttgatttcaagtcttaattaagtctttttttgggggatgcattacgttttcacccccgcatcgctccgtattttttttttaatttacaaaaaatattttaaaaattttgttataagaatatctcttaaaaaaatttgaaaattttttcactatttaaaaaaatatatatatttaatggacttatttgtttgtaatttatcatcaaatattgaaaaatttgttagaaaattttgtttgtttttttttcttgaaattttcttttattttcattattttttaaaaaggttttaaatttggaaaaaatttttaatttttcgctcttcttttggttctctcattttccattcgttgtacttcttttaaatttttaataaaggtcaatgaaatttttgttcaaaatattataaaatatactaatttattcataaaatttaaaaaaaaaacggttaaacttttaatttttcctgaaattttttaagaaaaattttaaatttttaaaaattttcaaatctttattttttttaaaatttcagtcatttactgttggtggacctccacccaaatcggtgctgaatttgtttgacgattcgcgccgtttgtttgtgggcggcacgccgcgcgacttccgcatgcccgccacgctgaagcagaaccaattcacgggcgacatggacaagctgcgcatcaacggcgagctggtcggcttctggaacagtgagagaacacaggtgtggtaactatgcaatttttgaatatttatttatacaaaatttattttgccatggtaattattagggatggaatttcatgtaaatttgagagttttttaaggaatttttcttgaataccccaaaattaaacatttttaattgctactgttcgaattagcttgacaaattcaattcaaattttttgttcagctacaataaatgtaggaagaatatacatatttataataaaatcagaaatgttttttcgagaatttttataaggcttattaaaaattatttttattattaatttatatatatttttacattgtatccaatagggtgtcaccggagcggaaatgcgcccgctggcggacgcggagcgcagcgcggaaagcggtgtcagcttcaacggcaagggct

SEQ ID NO: 14723 - DNA, 1201 bp, Heterodera glycines
  misc_feature (545)..(546): n is a, c, g, or t
  misc_feature (562)..(562): n is a, c, g, or t
ccccccgcccactttttccatatatggctttttccatatatggccctaaacttggctggttctgagttgacccgcttcgaccggtgaccggacatttggacagtggacatctggacagtgaatgcaaaattttgaaaataaaatacgtaaaacatacagtcatggtcatatttcaataaattttagacaccgaaactgaagttgccatatctcagcgagtataaatcgtataaatttttggtcttacataagtattgtagagtattttgtgttctttttgattgcttactcattatttccaaaaatttgccaattccctaggaattttttttttcaaaaatttctccgtttttcagtgtattttggggtgttcagatcatcatgacgaactgatctgttcaagtttgaagaaaatacttttgatcgctaacataagcaggaagttttcaggaatttgactaaaattgtctgttttatcaccagctaccaaaaccatgaccatgacagtatgatttacgtattttattttaaaaatttacattcannctgttcgtaaatgccnactgtccccaatttccacttctgtccatatgactttcattgtcctaatgtccactgtcgaaatgtccactgtccaaatgtccgggacatattttggcgtttggccatttaaaaaatgttttttttttcgccaaaatttgcctactgtagtttaaataaattataacgtaataataaacataaaaattaaaacaaaaaattccaggcctgcttttcttcatgggcaaagaccgtgatcagctgatggtggagcttgttggtggtcgaatcagtttgtcatttgaccttggctcagggcttggcaaattgttgaggtaaggggctataaaaaaaattttttttgaaaatttattaataactttttccagcaatggccaacggtacaacgatggaaaatggcatcttgtgcagatggatcggcaagaacgttcggccaaactaaaaattgacgacacggataaagtgaggaagaaataattttttgcatattttttgtttattattggaattttaggtctcaaaattttcttggaattggaaagataattgtgttttctatgattaaaaatttaaactttttactcaaattacttgatcaataaacttaggtatctattttaagtcatatttttcttgaact

SEQ ID NO: 14724 - DNA, 1101 bp, Heterodera glycines
cctcttagaagtcccagaaggaatttccaaggaccacgtgcatcattgctacttcggtgccttaacggcattttaacgtcaaaacgcccgacactagtgcatttctttagacaacgaaaattaattctcgaggaatttcccaaagccacgcgcagcttcgttagaccgacgccgaaacggcaatataattggaaaaggacagacaacaacgcttttctttatatcagctcgacggtttacaaaaatcgaaatacttcctgagtactttccaagaaccacgagaataaatatcgcactagcgccaaaatcgaacaagaacgctaatcatcagaatcatcttaattttcccccagtgatttgtgagtgataagaaaatagaagaaattcagggattaattcctgaggaatttccaaggaccacgtgcatcattgctacaacggtgccttaatggcattttaatgtcaaaatgcccgacactagtgcatttctttagacaacgaaaattaattcttgaggaatttcccaaagccatgcgcagctttgttagaccgatgccgaaatggcaatataattggaaaaggacagacaacaatgcttttctttatatcagctgatggtttatttacaaaaatcgaaatacttcctgattactttccaagaaccatgagaataaatatcgcactagcgccaaaatcgaacaagaacgctaatcatcagaatcatcttaattttcccccagtgatttgtgagtgataagaaaataaaagaaattcagggattaattcctgaggaatttccaaggaccacgtgcatcattgctacaacggtgccttaatggcattttaatgtcaaaatgcccgacactagcgcatttctttagactgtcgcgacaacgcgaaatcctaagataaaacccaaaataaaaaagaggaaaaataaaaaacaatagaaaataaaatggggaaaaataaaacataaataaataaaaatatttttacatttattttggaaaaataatattataaaaaactatcgaaaatataattacataaaaatgaaaaaacctttttgaatgaataacggaaaattgtttgaaaagg

SEQ ID NO: 14725 - DNA, 3510 bp, Heterodera glycines
ctgtcgcgacagcgcgaaatcccaaaataaagaaggaaaaaaaataaaaaacactagaaaacaaaatggggaaaaacaaaacctacataaacaaaaatttttcatttaatttggaaaaacatattagaaaaaactatcaaaaatataattataaaaaatgggaaaaccttttgaaatgaataacggaaaattgtttgaaaaggaaaagtgcatttcctcaggaatgaaaggaacgaaaattaattaatattaaatggcgaattctgttaaggattgcgttcgtaaacaaattattaataattaattaaatatattaaaggaattggaattgcaaaggaaaaagtggaaaacaaacaattaatgggaaaatggcagaacccaaacggatataacaaaaacagattttaattaaaaattataaattggagcgtactatggtttcaaaaaagccgtataaaaggggctgggttttcagtgatttcagatcgctcattggttccctccgaagtttccattccttgcccgtgccgtgctctgcgccttccctgtgccgtgccctgcgccttccccgtgccgtgcccgtccgcctttcccgtgccgtgccctgcgccttccccgtgccgtgcccctgcgcctttcccgtgccgtgcccgtgcgcctgccccgtgccctgctccttccccgtgccgtgccctgcgccttccctgtgccgtgccctgcgccttccccttaccattcccctttgtgcccattttatcatgtcggatttatttgttcattaattaattatggtttaattacccaagtttgagggtacaaaataaagtgaatttttggcgccttgggtctttaaattttgtcaactcgctctgaatacgtccgcccagcccattcaaacttttttgccgtcatcagaacgacaaaagtggtgccacgacccgggaccaacagaaattcgtccatttgctcatcaaaacctgaccaaacgtccgttaaacattcaacctaacaacaaaacacgagtgagctgaagcagttgacaaaatcaaacaaaaataaaccaaatcaatcaaaaaaaacacacgggtcaccaagcccaattaaaccaaacaagcaaaccaataaacaaaaaataaattccaaaatacttcagtgaaacgagtgacccgcgcaagttctcgcccaccagtgagcaaattgaatcaagaagtggcgaacaaagaattgaaccaaattttgaaaaattaaaaattttgcaccaaaaatggcaaaatttaatgaggcaaatgaataaaacagaatggaacagtgaatggaaactacaaaaaatattccgggaaaagcataattatttaaaaacaattaaggaaattgacgaaatccttgacacaattaaggatataaatttggaggtaaaaagaaggctgaaagcgctcaaaccaaattccccttcagaatccgacctagagaatgaatcaattgatgaagagcaagaaaacgatgatgaagaagccggagaagaagaagatgaagatgaaaaggaatatgatagtgatcaagaagacgaatcacaagaaatgcattcaagtgatcaaacacatcgtaatcgcataccatttgttcatcaacgatcaagaataaagcttccggcacaaactctaactcatttttcgggaaaattttcccaatggcccagtttttgggacgattttaaatcctcagtacataatgatccgaacatggaaaatatacaaaaacttaagtaccttcgtggactgttacatgatgagccttatcgaattgtatccccatacccccttattaataaaaattacccaataataataaaattgctgaaatcacgttacggtaaccccgaattaatcagagaaaatcttcacagtgaattacgtaacttgaaaaggcctagtgaatccacgattgaattaagaaaatttattttactaattgatcgaataattttgcaattaaaatccgaaggcgaagacataaatcatccccaaattaagcagtctatagaaacaaaacttccatataatctaagacttaaattgagagaaaaatttaaaatttattcaacaaagcagttaatggactttttaaatgctcacacacaagcgcgtgaagacatggaacgaatggaagacttaaatcgtcaaatccggaactttccttctaatcgaccaaactcaaacaggatacagagacaaccatatcaaaatttctctcaaaacaaaccaaaatttaaccaaagaaatcaatatcaaaccccaattacaccttttccatatacttctgcattaacaacaaaatcaaaaccattgcatccggcacagattaaaccaatacctacacaaaccaaaactcaatataaaatattttgtcgtttctgtgaaagagaaaaccatacaagtaaagaatgtaaaatatattcaaccccggagaaacgaaatgaacgagtacgtgaactcaaactttgtctcaattgtctaaataagggacatatggtcaatgaatgtaaatcgacctatttatgttataactgcaaacacaaacataatactctcctgtgcactcgtaaacaaactcagtacaaaacgaaggaacaaaaaaccagagtgaatatggctcaaaattacgaaaatcatgaagagactcagacattcatgacaatggagggtgataaaaatttaccaaattctgatgaagaagaattgcttatgactactgaagtaaactgcataaatcccgacaaatataaagtaaaaagggaaataattttgtttgataatgggtcacaaaaaagctatataaccgaagaatgtgctcagactctgcaattaaacacgattgaagaaaagttattagcaatttccacttttcaaccaaaataagccaaagatcattaaatcaagactagtcaaagttggtattaaaacattaaaaggtgaaatagagtacataacactacaaacagtagaaaaaattactgatgtcacaaaaatggttaataaagaaactgttgatgtacttggagtaaaaatcccaatcagtcatgcacgtcctcaaattttaattggaatcgactattactggcacttcatgctaccaaattcacaaattcaattacttccatcaggattttactcaataaatacaaaattaggaaaaatattatctggaaaaggaactattgaggacaccaattgtaactcagtgaccgaaaaaagaaaaaaagacgaaacgaaccaaatacttcagaaattttgggaattagaaaacattggaattatcgactcaccacatatgacggatgaagatgcagcaatgatacactttgataaaaatgttacatttaaaaataatagataccatgttcgatggccttataaaagagagaacccgaatttaccaacaaattttggattatgcatgggaagactaagaaatgttgttaaacaactaattaaaaacaagcaattggaaaat

SEQ ID NO: 14726 - DNA, 1515 bp, Heterodera glycines
  misc_feature (1504)..(1504): n is a, c, g, or t
ctgctattcgatgggcgtccattttgcaaaaaaatttttgaaatggccatttacgaccacggcacgggagtcctcgtacacccttgcgcacctggatgatcaaacattccatccacctccccctcctgcgctttcaatttaatttttaaatccacccgtcgctctccgatttgcccagtcgccgccgcctgtggaactccatgccaaactgtgcatgccaacaatacacatcgaaagctggttttcggcctcatcgccttcatgcacagcgaatcgtccacaatttggcccttcaaaacacactcgacatgtcgcatgcgaacgccgttgccacatgacacagaacaatggccccatttggcggcacgccttcaaaaaatccaacgagttcgcccagttcagcacaaaccattcatttcttaccaatatgggcatggccccggactacacactttgtagctttgtggcttctccgtctgctgttgttttttgatgcccatacacttttggtccgaaacttttcgtccttccgaatccacgcattggacaaggcgcgtttggaagccgtcctggccacaactgacggaacatggactccacgtgccgagtttccttagaaaatgttcaaaaaatttagatgcccgttcattttgcgatacaaaattaggtcgactcgaaaacttattgactgatcaatggtgaataagcttttgttggataacaaaaccctgataaatgaaattggattagccataattaactgaccaatggggacaagcggccatttggcattgcttctccacaattcgttcccttggttcgcaatccttctcttccaatcgttgcccatcaggctcacgaacgcacatgccctcccgtcgctgaacaccatcaccacaactgaaaccaaaacgaaattcaattggtcggtcttgatcggataagggtcccggattcatgctctattccttttgaacggcttcacacctcactgagcaaggtgaccattgtccaaagtgccatcgtgtgcacgagtgttcattgcacttctctgagtccaatttgacttcagcggcacacattcggacgtccaactcgcgaccagcagcatcttggcacgacgcatggcgcattcggagtccaccaccgcaagagcgtgaacactgtgccataataatttttgtgccataataatttttaaacccatctgctgctgctcggctttcccctcctcaccctcacctggtaccattgtgaatacacccaacgtgggcaaggcgttcggttgcactccgtctcgatgggctcgtgtggcactccctcacagaaacgggcgtccaatttgtgcccatttctcgtgtcaatgcaatgcaaatttcgtctgctcactccaccggcaccacaactctcggagcactgattttaaatttaaaatacaatttaattcaaacgattaagtaatgtttgttaaaagtcacctgactccattgcgaatatgcccagntcgtctaaaaa

SEQ ID NO: 14727 - DNA, 1998 bp, Heterodera glycines
  misc_feature (1105)..(1105): n is a, c, g, or t
ccacccgggcgcggcactttcagtccagccgctatacactccgtctcttccgcttgctcatccttgcccgcgttggtgtaagagcggacacagatgtactttaaaaccagcggggagaatgtcatttaagcaagcaaatatggataaatttgaatgaaaatacggctgggactcgactcccggcgggttgggaaaagccaggggtcgcttttcggggtcagcaaggtcggggcccggattggaagcgtcgggacaggggataatcccgaaaaatggccaaaaatgccagggtcccatctcccttgaatgaaatccttttccaacaaaaaacacacctgatgccatttttttcccgacgaatcagtgttaagtctctgcaaatatttgtaaaaacagtccacattgcacattcgcttttgtgtgttcggacgcacgaccgcggcacagtgggcgtccataacaaaattgttggagaatgcttccacacaacggacatgctgattctgtgtaccgggagatttaccgagtcggggacgaggaccgagaccggttagcaaaaaaaaaaaaaaccgtgaattccctgagttgggaagcgaatcaaaagaagcaaaacagaaaaaaaaaagtgagatttccctggacggggaccggaagtgcgaccatgaccaaaaaccgggtgattccccacgttggtaacggaactgcgaccatgatcaaatccgggaaatttccaagttggcaaccggaactgcgaccaccatgaccaaaaatccgggaatttcccaagttggcaaccggaactgcgaccatcatgaccaaaaatccgggaatttcccaagttggcaaccgggactgcgaccatgagcaaagatccgggaaattccctgggtcgggaaccggtacactaaaggctccacctgcgttccttggcacttcattgagcattctgtccaattgttttccgcctgccaataaaagctgttgctccctgcgttgtgttgctctgtttcgtttgaatttgttgtgttgctgctgcttcagattttgtactgcttgcaattggtgtcatgaaatggtagcgaatgttcggcttatttatgttgcncacactgagcacatgcaaataaatgtccgatcgcagcggtccactgccattgatgcgttcaatgggcagatcacttccggaatactgaaaaggagcgaacactgggactgctgttgttgctgacgatttagctaatccttgagcaacaaactaatgtaaaggtaagcaaacaaaggccgtaatcactgcaatccgtaacccaaaatttttaaatgcatttaattttataatgagacaattaatttaatagatatttaaaaaaattaatttaatattttccaagtgaaaaaaataaataatttgtgtttagtttaaaaaagcaatttagcaaatagattttcgctaaatgttattttatgagttttattttgtccacccacctcaagcacagtgtccaatattgggatttgttgacgaaacaccgacacttggaattgtccgttcaacaaatactctccggtggttgtgcgcaatgccaaataattgtcatcttcttttaatccattgtgtgccgtctgtgtgatgtcaatgccagcggcaccttgggaggggagaagataatatggcattttgtgctgaaatatcgagcccatggggtatctaaaaaaagaaactttttgatccccccccccaccacagcccgacgaaaaatttaaaaataaaattataattttttaaatttcatatatttaaaaattttgaattgaagaattaggttttttttaaatttttctctgaacatatttagtttaaaaaacaataaaaaatttgatgaaagaaacctgttttttaaatttttattttttattacaaaaaaagttattttaaagtaaaatttttgtcaggtgtagaaataaagcttctctaagcttcggcgactaatgtgtttcgga

SEQ ID NO: 14728 - DNA, 2328 bp, Heterodera glycines
aaaaattcttattgacccaggaatatgtggacgaagaattgaagaagtacggcgccattctggagaatgcgcacgagagtgccaagcaggtgaccgagctgcgcaaccgggactggctggactcgccgtgggacgactttttccgtggcaaaaacccatcccaattgttgcccaccggcattgagcgcgactcgctggagcacattgtgaacaaaatctcgcaagtgcccgacgggttcaacctgcaccggggactgcttcgactgctcaaaggtgagctggccagtggaatataaaaagtgaagaatttgtttctttatgggttcgttcttggaattttttttgcatcagaattccattggtcttacaattaatcagtactaatccatttttactaatttgttaacatttttttttgtaggacgaaaagaaatgctgagcgaaaacaatttggactggtccattggcgagtcgttggcgtacgggtcgttgctgatggaaggtatgtgggtttcctgttttttttggatttggttggagtaaattccgtcttaaattgtgccaggaattcacgtgcggttgtctggtgaggatgtggagcgtggcaccttctcccatcgtcaccatgtgctccatgatcagaaaattgaccaaaaaacgtacaatccgctcaacgacctttctgaggttggaattttttattttttgagcatttttatcattaaacttttttctatgccagacccaagcggagtacacggtgtgcaattcgtcgttgagtgagtacgctgtgctcggcttcgagttgggctactccgtggtcaaccccaactcattggtcagtcagtcctgtatcggggttgtcatgggactagaaaaaagacgtgggacgatacgacctaaagcctggatcgaaatccgggacgaccgaatttgaaatcgggtcaggatggtcaaaatttcggcattggaatttgggacgataaaaaatgtttgaattcagtggtaaccctggtcaatctgtaaaacgtcattatattaatcaaaaaaaaaatttgctaaggtcatttgggaggcccaatttggcgactttgccaacaccgcgcagtgcatcattgaccagttcatctccagcggacaagccaagtggattcggcagaccaatttgacactgttgttgccgcacggttctgagggcatgggaccggagcacagcagcgcacggccgggtgagtacagcttacttgtatttgtgcatcggatggaggttgaacggcgggttccgaactaaggaaatcccagacatttcaaggttcggaattccacattttttgggcgaggggcttaaaatggacatgatttggatgggttaatccacacaattacactatgtttaaggacaacaaaaattttgtccacaaatttcccaaaattaaaaaatatatattttcagagcgtttcctgcaaatgtgcaacgaagatgatggcatcgacttgaaggtgtgaaaaatggaatttaataaaaatttaaagaaaattcagagtgtcgctttggacgaggcatttgtggcccgtcagctgaacgagaccaattggattgtggccaactgtacaacaccggccaacttcttccatctgttgcgtcggcaaatttatttgccattccgcaagccgttgattgtgttcacgcccaaagtacgtgcatgaaaaaatgaataactaaaaaatttggaatttttttatgcctagtaatcctacgattttttctaaataaaataatcaaattaagttgaaatttgattaattaaaatttccagtctctgctccgccatccgttggccaaatcgccggtggacgactttttgcccggcacatcgtttcgccgtgccatccccgaggagggcagtgccaccaacaacccggcggccgtggagcgactcgtcttctgttccggtaagaaagcgttgattgatcaatcaagagtaaagttgttttactataaaactttgtggcgtgttattacggaaatgtttttttcaggaaaagtttactacgaaattttgaccgagcgcagaaaccaaggcctggatgataaggtaaatgaatattacgactgttgcaaattgcaattccaaatgtggtttgtcaggtcgctgttgtccgcctggagcagttgagtccgttcccctacgacattttggtgtccgagtgcaacaagtacagcaacgccaaagtgatttgggcacaggaggagcacaaggtgaacaaaagttgtatttatataagggtgtgacaacagaacaaggagttcgaaccccccccccccct

SEQ ID NO: 14729 - DNA, 1017 bp, Heterodera glycines
  misc_feature (838)..(838): n is a, c, g, or t
cagaatggtagcgcggcatcacaacaaaagccaatccgtgccctgtgaagggaaaacgagggcgaacgtgccaaaaccaaacgaaacaacaaaactaataaacgaaaggaacacgatcgatcggaggaaggaaggggaaaaggatggggaaggggagggaaaaaggggggggggtagggaaccgaccgacaccccccgggggaacgacggatcggacggaggagcaacagcagggaaagtcggggaaatagacaaaattctcgggggaactggtggatggacggacggatgctgatcagagttagaaccagccaacacacaaaacaaaaccgaagccaactcatcccacccgtccgatcactcccccccccacttctcgctccgcatccagtgccgctcagatcagttgattgcgccttgcgctatgtcttgagtggagggagttgaccatcgtctgttcgatgtatttggttgcgtttttcagtgcaaatgtcggccagcggtctctgatcatgtcaaacatcttttcgtgcgtggactgcgacttgcacgtaagctgacaatgcataaccggaaacttccgttttccaggactgaaattaggagaaaaacgattgaaaaactagattggaaaaaaagtaccgcgccaatatgacgtatagttgcgaagagcgtcggtgcacttgcgaaagttccatcggcgtaaatatactttatttggtaatcccaatttccaaaagaaatccgaccaatagtcaaaattcttaagtttagaaaaatatgtgaaaagctccctttaaaacactgcgctggtgtccgtctcgaccattctcggtgnatgtttcataatacgccaaaaggaaaagctcctgggcttcttcggagggggttgtgcattcgtaactgttccggaagttccaatcttgaagggttggcggcactggggggggaattcaatttcatggggggctccctttaccagcttaaaaaaaaaaatgggaaaaaagaaaaaaaaaa

SEQ ID NO: 14730 - DNA, 2954 bp, Heterodera glycines
ccccctccctaatgagtaattaatttctaaattggcccggtggttcatgttcgtttttgatcctctcaaatgcttctgcaactctctggcgcatgtgctgctcgctgagttcgaaatcagtggccaaacggatgtagccttcatgaagggtcagcttaggacggatgaagcgaattgtatccttaaaaaacaaacaaattaaatgccttttaattaattgcccattgatcaatggctgatcggacagttattcgctcgattcactttgcggttgtcttacgattgatcgaccctttccccattcgatcagttgcttcttcttccgttccgtccggtttgctcacctttagcgggtacggcagtccctccttcagtccccgtgccaattcggggcccaaaaatgtcttggccagcggtgccatctgtgagatcacttccggctcaatgggaatcgcggagcggtgcagccgaatgttcaatttgcgcaatttgaggtctccggcaattttcctgtcgacggcattcagtcgaatgtccgccattccttcggcagatgaaacgagaatttgccgatctcgacgggtggcattgtccgagacaagggtcaaaatgcgagctgatcaatggccaacggggagaagggaggaataatgccaaggaaatgccgaaaaaataatgccaaagaaaaacgaaataccaaaagcaaatgcaaggccataagatacccaaccaaccgttcaagtccattgtgctgcgtccattatgaaaatgcatttcgggcagttcgtggggaagcatcacaaatttggtggtggagttggggaagtgtttggccatggccgggatcaatttgccaacgcaaatggacttaaacggaccatttaatcactttcaataattaagttattaatcctttcatttttgcacctgcagaaagtctccattgacctgctcaatgtcggggcatgttgtgcttaagtttacatttactttgcccgaataattggccaaattcaccgcacaaatccccggtacatttggggcaacgatgcctcgttgaccttgacaaattgggccatcaatttttgattgattttttaaaatttactcgaatggtcagccgttccatttgataggcatggtaaagcatcgaattcagcgtgtaatcggaggcgtacaaatacaacattcggtcagagtcctgcagcatttacccattcattggcaaaactttgaaaatggaaattttggcactttatcggttggaatgggacgagggtaaaagggaatcggagacggcgaatcggcgtaacgtaattcgcctgaagggaagcaaaagccgagcatgggcaaggtggaaggaagtagaaacggacgaaacacaacctcgttgctgcgtttcgaagaagtcgttggtgacaattgggtcggccacctaaaaatgggtggaaaagtgcctttggatggcgattgattaatttgcgagaatctcgaagtgcaaaattgacggcatttaagctggtgggcagggatggtaggggtccgaaaatttttgaggcttcagaataccattcctggtgctggtggggtgggatgaatgctaagcccgcggtcgttaaccattcctccgtttcccccttcctcagtttttcttctccccccccccccttttttggtaccattcgtccgtcgatgaacagtccgtcggtgaaccgttgggtgaatctaacgacaaaacggacaaatgcttcagcgtttggccaactcctcggcttacttttcgatcactccgctgccattgctcagcatgccgaagtgttccttcagcggaatgtaagtgagtttttggaaaagcagtggcgagttgcgctcgacgatgtcgcgcattgagcggcacaaaaggttggggatgcgttgtcggatcagatcgttgatggtcacctacaaagagcggactgatcagcgatgagcgattgtcatcttcaaatcacctcgaatattttgaggatgggccccaaaaggccctccgggttgagggtgaattgcgagtggcgaagctgagtctgacaattggtcaccgccaccgaaatgagtccgtcggcagaggcgcggaactgagtcatcatttgaatgctcagtccctgcagttggccgaacacagtgccggggatttgcagcaggggacccgcctcgcccaagaagcggcccgacaacctgaactcgttgccattctgctgatcacttctccgcccggtctcacgtgatggcggcgtcttggatgccgaaaatgatagaattgggcggcacaaattgcagattggagaaggaaggcggacgataggccaacgtttgcacgtcgctgaggaaaatgttgccgcgaatgcccccctcactgatggcatgctgaaaagagacaaagtgcagaagtcaatgggggggggggggggcagaagagagaagcggcacaagcagaccgaacgatggcattggccaacaattgaattgcctttatcttctcccttttctctgggcccacctgtgcccggaagccgcgcaaattggccaactgttcgttgagcaatttgaccgccacgtttttcacgtgctccgccccttttcgactcagccgaagtttaatgcccgggttgcctaagttttgttttgccgaacttttgccaaaattgtgaccaaatcaccgaccgtagtctctgttccaccgattgttgggctgtggctcaattcgggcctgaagcgatgggagcagaaacagaacaaagagagggaacagaaccatggcgagagagggcaaaaacggaggaaaagcccaaaaagcctttgggggaattgtggcaaaacgaaggcaaagggaagggaaggcggacaagggggcgggggcaaatcaaacgggaaagaaagcgggggagggaaagtggcgagggcgacggtgccgtggg

SEQ ID NO: 14731 - DNA, 3877 bp, Heterodera glycines
tggactacccaagaataaacgaaagtgaactcgcttctctatcccttcggggataattgtcagtgggccgtcctcttcgggcaagacccagctggtccttcgtctgttacggcatgccaacttgatgtttgacccgccgcccaaggcaataggtatgtgcaaatggggtttctgtgcagtgggctgttgttatttagtatgggcatatggtgagtactcgacgcagattcccgatctggagcggcagggagttgtcccccacgcaggtgccccgtctgacgagatgctgaaaaagctgccaaagccttgtctgattgtttacgatgacttgatgggtgacattgaggccaagaagttggccgatctgtacaccaaaaagtcccaccataacaatttttccgtgattttcctcacgcaaaacctgttcgataaatcaatgcgggtgccaaggtccaacgcccagtacatcttcctgatgcgggctcccaacgacatgcttagcattcgtaatttggccagccagatgttccctcgcgagcaggggttcctgatggatgcctaccgacaggcatgttccctaccgtacggctacctgttggtgactctccacgcgaacagagacaacattatacgcctaaggacaaacattttcccagacgacgaggagagaatcatttttgcccccaaaaatggttaagcgggaacagaagatcggtgagcgggttgtgcacaactacgactatttgaagaagttgggaaagacaacgtcggagaagaagcgccgtcatttgttgaacagtgccggttgtgaggaactgttaacgcttgtcgagatttgtctcaacgttttgaacgggagtttctgtctgagcaggaaacaaaagcagagacttgcgccatttgccaaagacatcagacagttggcacgtgtgcgaagtgagaggggtgcgcgaaaactagtgcagcagtcaggcggatcactttttgcccctttgttggcccccattctgattgaggctgcccgatacctgctttcgcgcagcaataatggccaataaacttattctgctgccgtacgagcactacaaggggctggttgcagcgagggagacaaagaatgacgacgacgacattgctgagcggacaaacttgggctttgtcaaacgacaggtgaccgctgcagtacagaagcggaagggaaacgtcagcgagcggaacgcaatgtacaaccagcagctgcgccggtacctgaagatgcgcaaggaacataaggagcggcccgtccgagtacagctcagcaacggcgctcaactgctaaataaaacagtggagacgggtgtgcaggtacggcctggtccggacgaaccgaaggacaagtccgtgatggttaccgacgaagatgaagaggaagaaattgaagtgccaaagtttttaaccccaacaagccagacgcagggaagcagccgatcacccaggaccaataagaaagcggctaaacagcaaaaattgatcgagaagaaggaccgcctgttggccatcattatgtctgatccgcagagattcggcgcaactgaccgtgggaaaatcattaacccaaagacgggccgagagtttatcgactcggacctggcctggtcaattgaacgcctggtggaccctcgcccggagaatgcgccatcgccaagcggaaccaaagagttgaagaggaaactcgcacagaatccgctcgccagtagcctactcaatcgactgtttgttgggtctgggttcgtcggacaagtcaaacaaagcgggcgttttattccctcaaaatggacaagaaaataaacaaaatatacaccgatccggccaatccgagcgggtatgcgggggcgagtgctctgtacgcggcggtgaaggagaagcacccgaagttgaagcgtgccgagtttgaggactttttgcaaaggaacaccacctacacgctgttcaagccaaagagagacaagttccgacgcctacgcactgtgcctacgggtttcatgaccggtaagttgtaccggggcttattgcgcacaattcagggttcagatgttcaggctgacttggcagatttccaagccctttcgcgcaagaacagcggctaccgttacttgctgttggcggtggatgttctatcgaggcgaatgttcggcgcgcccgtaaagagtaagcgcccggtggacatgaaaagggcgtttgaggagctatttgagcaaatgccaagggtgccggacacactgtacaccgatcgcgggctggagtttgtggcaaaaccgttgaaggagttttacgcggagaagggcattcaaaagtttgagaccagttcaaagaaaaaggccgccgtggcggagcgtgccatccgcaccctaaagactcggctgtacaaatatttttccgccaacaatacgtcggtgtgggtggatgtggtgccaaagtttttgagtgccatcaacaactcggtgtgccgcgcgaccggacttagacccaacgaaatcagcgacaccaatgcgagggaggtctggaagagggtgtacggcgaagggctcgcacaattggacaagacaccaaaaatcagagcaggggaaacggtcagaattcccgagcctaagcacattttcgagaagggtattgtaattcacacattttccggtcattttttaaatttttaaggaaatatcgctcatactgcgttcaacttcccccaatcgaggcgccgcgcagtaccgcgcgccatccttcatcccgaaccctctattaggcacgcaccccccacccctccccctcccaccacaccacccaataggcaccgaccccccagctgatcctctctcccttcattgggtcaaattcacttggaaaaaatgcggctttgaacaaaataacagcaatatgaattttcaaaaagagaaccaaagaattaggaccgacaatttaccgagagcaaaaattttcccaaaagtctccgcccctaaacgagcaaaggatgaccgaagcgaaagcaatttgtcgcagaaaccgatagagtcagccgatgtttcaacaatttttgtaggtctttttgcttcatttttggttgttgccaacgcgttttcgaatgtgaaggctaaaactcatagccgccgaatcagctctatggctagtagcagctcgaaattgccggcattatggaatccgttgaatgttgcatttgaaaaattgaggaaaagggaaaattccaaagaaaacggaatcaacagcaaagtgaaaacaccgaaagggaatggccaattgaggacaattgttttttcgaaggctggggaggaattggccgactcaacaggtccaacgacgaagttgttgaaagccgacacagaacgaaaattgtcagccgttgatggcacaattacgaataaagctgcgtcaagtcacgctatcaggcctgttcaaaattgtagttttcgttttttccgcacattttacaggtcaaattatgatgttggtctgtgccactgctgattgtccacccttactgcccctcgatggatttgaagcgctgacgacatcgctttgtagagggcgaggatgtcatatcattgttgatttgaattattttggcgttttgttttagtttttgtgaccctttattttatttttttttggtgtatgtgtgatatatgtgctcttcctaaatttgtaattgattgctgtgtgctgttttattaattggaagtaaaagaaagcagtgaaaagagacagcgatttggttttggatttgggatacaattcccctttcccattggactattctttttcctacgacgttttttttcttgccgttttggtttttgtcattttttcgcgtcctcgcgacgacgtt

SEQ ID NO: 14732 - DNA, 4107 bp, Heterodera glycines
atttcttctccacatttaactttttacttctcattttttagtctgtacggcgtgccaatgtttgtcggctgttgtgccattctttggctttattgggaccgcttcagaaaaccacgaggccatcacaaaaagaaaatgtaaaaaaaaactacaaaatttttttttaatttcaatttaatttttcagtttcatctccggcgacggttggctttgtgtgttcgatttgcttgagccttctcaattgggccttggaattgcacttgtcagccaccgttttgacttttacgtcgacgaacacttcaagacgcggcgttgggcgctcaaagccatggaaattaaagccaaatttgaagcggacggcacaaaagaaatggaaattgtcaattgcgatggaaatccgttgccaattccacaaaaagcattgccaaagaaagtcgtcggaaaaattttcgttgttcgacaaaaagttcgatttagggttatggtgtacggaattagttgaaatttacgccagattcttaatcagcgatgttgaaaacccccggaactattttacatgaatttagacaaaaaaaatttatgtcgggtaaagtgcattagtagtacacgaaaatggggcaattgtgaagattattggtcccacaaaaaaaaggaataaaagaccaaaaaacatgtttttaggggttatttgatgcgttgagcacgaatatgacatccatttcgaccaatttcgaagaggacccgaattcgaacaaaaagtcgaaaactcaaattttcgaattagcacttttattctaaaattgattaaaactagcagaaaataaatcacaggcaattttaacagcaaaaatgagtcattttatgcagattcgaacataaacaaagtaaaaatttaaaaaatttaaatttttgactttgttcgaattctggtctggggttcgaaattagatatcttattcgtgatcagagaccttgaaaacctcaggaaagacttattaaaaaagttatttaagtaaaaataaatttaaaaaaatgttcgtatccgggttcggggttcgaaacaaagtcaaatgatgatcaaattcgtgctcagcgcttcaaataacccttaaaaattggttttttaattatttttattcttttttttgtgggaccaataatcttaacaattgccctaacacagattaattagaagggtaattaagaaaaacgatttccatgaccattcaaaatgaacaatcagatgccatttccttattcccagcacaaaacatttacaaaattagagttgaattatttcatttttctatgattttttaaaaaattctataaagtgtcaactttaacgcacttttgtttctaaacaatttgcataaaacaattaaaaattaattataagaattatttattgagacaaaaattttataatattgtaatgcattcatttttcataaaaaggaaaacatgatggaattttacgaatcgggggaaatgctgagaatagaaaaagacccccaccctacgagggacccaacgacagttcctgcgcctcgggctcctccatgaacgtgctcagcttctccagcagttcatcactgaccacttcgctgctaatggcaccgttggcaaaggggtcgaaattcatccgttggaattggcccgtttccgcggtgaaattctgcactttgtcccacaaattcggcgcgttgtccagtctggcggattccatgtcctctgaacaacgttcaagtcaaacaaaaaaaaaacgtcgtcatggaacacgcctttgaagccgtcgtatctcatcagcaacggggccacaatcaaatccgagtcttcaattgtctgtcaatgaatggagggttagaaatttatgggctgactataaatttcaagtgataccaagagtaggcattgactaacaaagctaattgtaagcaataaaaaattgtggtctaatgaaatagccattgatttggcaaagaaactctggaatagccccaaattaagtgcctttaattttaaagaaaaataccggaaaagcagttttcataaaaaataagaattgtaatgccaccaactgggtttgtgctgcagtgtaagtgcgcctcaatgtcgcgcgaattttgcagacgaaattggtggcaagcagcgagaagaaggcaattggcacagttgcgcataaaaatgctgaaaaaaatataaacatttcatctaaagccgaattcgtcataaaacaatcatatgaccgctttgtatgccaaaatgccccccacggcggacctgcctctgcacgggccgcaaatgatcacacaattgctgcacttgtcaattgtgatggtggcagcgtggccaagcagtacaagcacagagcccttaaggagaatccgaagcgtaacaataaataaaaaaaaaaatgaatgcgatttgttaccgtgcattcgcgaattgcaaatgggttgccatcggctgaaaatactttattttctggggcatggtttaaaaggcactatgccccaaacagagccaaaacagtccgtcccatttgtactgcagtacctgaccctctgaacaccgtctgctcaacgatgccctgaaaggtcgtgtccacgtctttagctgataattggagcgcggaaattgcagccccaacgaatgagttcgattgcgtattgtgctcaaatgtgtcattgttctcatttctgtcatccttttttgggcgtttctcgggtttttgagaaaaagtaaacattctgttagaaaacgaaagcatatcaaattcaatttaaagaatcaaaaacgaaataaaaaatgagtgtaaacatggccaaaatataaaaacaaaaaaccattttgatatttatttaaatccaaacaaacacctaatttagaggggtttcgacattaatttgtattctgatagtttcgaacaaagcttatgcttccgattacaaagtcccaaaatatttgactaaaaaatgcccatcgaaatcccttttccatggtaaagaaacggctaaatgtgtgcaaaaacgtctcaattcgcttccttttcaagtttgttgtactgagcacgaattggcacccatgggaggagaaggtctctgtagggacgaccatagactgaaaagaattttcaaaataacaaaaaagatcaaaggttgaatggctcacaattgttcaaggtcaaatgctcaaagtcttcggggtgcgtctgaacgtaatgcgagacgacggcgtcgcgatcggccatcactcgggcgcgagactttgcaatgaaataagcaccgctgatcccggccgcaaaaattagaattttcatgttaagcgctgaaaaaaaaaatttgacaggaattaaaaacggacaatattcagttacgttaaaaaggccaaaaaaaaatatcgatgacttaccggcgtaccaaggctttcggtaccacaacatgtaataagtcaccttaagcaattaggtactcattctcaatttcataggcaaaacccaccgagcaagtcaaaattccggtgctcgtagcggctattttgcccggaaatgaccaggtgaacgggtcgaacacattgaaaggacgcgccccctccatcatctgcgcctccctgcgcttaatctccgcttcacttatgcgagtggattccatttgagcactacaaaacaaagctacttttgtacaattcatgtcatacaaccaaaatacaatcgtcaaaacgaatgttttcttcataaaacaacaatgtaaaattccattctttaatttacatcgccaatttattgacacacgaatttgtattaatgaatacaactaacaatgaatgtcaccatcacatcaaaagtgtcctaaataatcgccgaaaatttaacggtcgaacttcgcaggaaaacgtccctcctcacggagctcatcccatttctcggtccaaaatgatgggcaaatgtctttgtagacattctggaagaatttgcacggtttgtagtcttcgcccatcagctccttgcagcgaaagaaatccacataatattcttaatttgcaaacaaaaatgacaggatttatcaagcggaattttgaggcaactcattaactcaagcaaaaatt

SEQ ID NO: 14733 - DNA, 540 bp, Heterodera glycines
ccgtgcttcacaccaaaggctccgacttttgctgttccacccccttttcacctgcacattggcaccccgcgtctctccccatatccgtcagaattccgttcagttgggccagcgcctgcggcgtcaaccgtccctccgagtcgcacaccaaagatggcgagccgtcctctgccccaaaatggccagaagatttgcactgttcgtagtcatcgtaaaggtcggccaatgtcaccaacaactgagaaaataaattcataaaaccaattttatgttcaattttgaccaaaaaaaaattaattcccaaaaatgggaaattggcaaattcataaacattacttggccagagaaggtcagtaatagcaaaagatggagaaggtgacgaacacattccatcacagcagtgggtgaattaggtgctgatgctgagttgagaaatggtataataaacccattcgaagacgacaaataaatcagttgattcggtgtgggacaaattgcgcaaaatgcgtaagatgagacaaagcgaaaggaaaaggtggg

SEQ ID NO: 14734 - DNA, 2842 bp, Heterodera glycines
gggtcggggccgttttcgcgtggggcgagttttcgaactataacttttttctttgtcatccaaatcaaacattgttggtatcattcgaaagctgtaaatgtcctttattagccttcaaaattttgaaaaattatgtaaaggttcaaaaaattatggccataacaactcaaaaaaccagattttccaacttttatggccataaatttgtctagggcttccatttttaggcacaaaaatcgcgaaatagacacctaaaaaggcataaaaaatcgtaaataggggtgtattttctgaaaatttttcgggtcgattcttaggggtttatataaaagtcatcctacaccccaaactataacttaagagtagggttgagcccccgacgtcggggttggaaaattcagggttcggggtcgtcggggttggaagcgtcggggttcggggtcggggttgccaaatcgttcggggtcggggtttttcaatttttaccttatgccaaatagtcaaaatttttttaatattttttcggaaataatatttattaattttcataataatacatagttgtattgtttttatattttttaatttcttttttatcagaaattttgtatagaattatttttttttcttgaaattttaaaatttttattactttttttgttttccaaaacatcttttttcacggcgctcttttctaaagacttttagggagaaagggtacggcgtccggcggtgccgaaaatttggttagatctgttaacagattttgtccaaaatatgctaaatttttgcgattttgagccaatttttttaataaggtttatgaatttttgggcccggtgatgccgataggcagcgccaggcaaattttggaattaaactctattttctaagatttttcaccaaaaaaatttatgaatttcggtaaatttttgtttttcttcgatatgtattttgtcaaatatgccaagatttgtcgatttctatgagtatcaatttaataaaaatttggcaaaatggttaaaaaaaattcaaatttcgtctaacttttttgcgttttctcccacgaatgtcggggtttgggggcggggtcgggggcccgaccctacttaagagattgaaattttgtacaatttcaaggtttcaactgttaaaagatcccaaacccacataatatcaaaatttgattcaaaaaaattttttttgttgaaaaatcgtttaaaatgaaaattttagtaaaattttcgaaatttcttttctcagagttaaattaagggaaaatctaaaattccgcctattcggcgcagccggaatcttgtatataattagcactgtttatttgttatttcaggcgaatgctccggaaacttaagcatagtgctagttttccgctaatttctgcttttacacgcagatttagtaaaaatgtttccggctacaaaattgttgaccacactttcgatgccattgtggtgggcgcaggtaatcaacaacccctcaagttattcaaccttttatttatatattatttaaggcggcgctggtcttcgagctgcgatgggtctttcggaggggggaatgaaaacaggtcaatttgggtgtggggttcgcgtaatgtatttttttgtggttcagctgttattaccaaactgttcccgactcgttcacacactgtggcggcccaaggcgggataaatgccgcattgggaaacatgaacccggatgattggcgatggcacttttatgacactgtcaaaggcattcgatttgagggtctcccatgtcagtaattttcttttaggaagcgattggcttggtgatcaggacgctatccattatatgaccagggaagcgccccgggcggtcatcgaattggaaaactacggaatgcctttttcgcgcacggaggagggaaagatttaccaacgcgcatttggaggacaaagcaatgattttggacgcggtggtcaggcgcacaggcaagaaaaaaggacactttgggaagaatggacggggggtttcacttttgagtttaaagggtaggagattcccttcgggcactggggagccttcgccccccccaaccctcgcatttcctctcgcatcgtttccctgaaattttttaaaggtttttttaattaataattaagtttttttaaaagaatttattttccttttccggtgattttcaaagatttttttcagaaacccaagttttccaaaaagattttttattttctcctagaaaaaatcagtaaaaaatttccgtccaaattttctgtccgtatttcgtcccctcctcctcaggacgtgttgtgtcgcggatcggaccggtcattctctgctgcacactctttacggcgcttccctccaatataattgcaattacttcgtcgaatattttgcgctggaccttttgatgtcgcgagaagggcactgtgtgggggtggtggccataaatttggaggatgggtccatccaccgttttcgggctgccaacactgtcctcgcgacgggcggctacggcagggcgtacttcagctgcacttcggcccacacctgcacaggggacggaacggcgcttgtcgcccgggccgggctttgcaattcggacatggaatttgtgcaatttcaccccacgggaatttatggcgcgggatgtctgataaccgaaggatgccgaggtgagctttgagttgtccaaattctaaaaatcttggtacaggcgagggcggttttctgatcaataacgaaggggaacgcttcatggaacgctacgccccggtggcgaaggacctcgcctctcgggacgtcgtctcccggtcgatgaccatcgaaataa

SEQ ID NO: 14735 - DNA, 4179 bp, Heterodera glycines
ttttattgaagaatttggaaagggttttgatgccgtcgaaatgtttgtcgtggtggagagaataatagagaattggtattcattgacgtcagactttgtgatgggtcgggtttggtagtcattaaagatgaatattttatactcgcctgtaacaaataatgtaatttatttcattaataaaaatcaatataaaaagtaaaataatcaccgggatattttgtgctccacaatccctgcacttgatggatgtatatttcggcatcgtattccggttcagttgtcggaatcccggcatcgcggagtaaaagtagtactttttgacgaagaacagttgtttgattatctatgagccatctaaattgtttccttgaaattactcccctgatatataatgagtagtagcgcatcagttccagtgcataaaaaaggcaataattgtcgttgttgttaattatgaagatgtgtgattgggaagagtgaattggaggggcacttcctttggtcgttcgtcgtcgtggtaggccttcagtgtttagaacagttacggtgacaacaaaaggggccccataaaagttgacgtgtttggacttgcctgctccactttacaaaactggttgaaaacggcgtccacggcgtttgacgtaattggcgtaattggtaggatgatgtcaccctggtctaaaagttctgaagaaattataataccaaccttatttgctcctccaagagtgttttgtgcatcatgaatagcatcctcaaccgcagtgtgcacacatgaacggaattcatcctggggatttgcacatttttcaatttcatcaataacaaattttgattttgagcggatgaaatgatgtttaagacttttggaagtaaattggtcaattttacgaatgcatttatttaattgagatttttttggggagggagaagattgagggtttgaagctctcttcattataaaataaggtatgaattatgagatttgtattaaaataattaatatattattaaatcgtatacaaatttatatttaaatagtgttattagggtttattaaatgagtagtataagggtcagcaatggaagcaaatgctgggaaataggaactgaggtaattgaattctaagagcagagcgctgcggaggctttttggttagaagaggggagctggacgttgcaggagttgcaaatgaatggaagaaaggggcttttcgctgggaatggtcgggtatttatacccacactagtgagctagaagtacattttaattaaattctgaggttatatttggacatagcggtgtgaacattattaaattttgggccgtgtcgtgtttcctacatgaaatagatttaatgaacaaaccaaagtgtttacggtttaccttgatttaattaaaagcacggttttaagtgttcgaaggttccgcatctaaatttaattagaaatgcacaaacagaacggattcacatttatttaattatatggacagcgacagcaaactaaaaagagttataattaaatgaatctaatattattacatttattttacaccgacagttttaaatgaattttaatttttaggtaatatttaatatacaaataaaaaattgatagaccatgcatgcaaaataatttaatatgcaaaacttattggttatcgttgctaaccgaccataagccacttcttgccattttcggaagcaaaaagggagtgcgccagtgcagtgccaaccgacttctccgatggtcgctgatcctcctcgcatacgattttagcattgagtacatcagcaccaatgattttggtcaagccgatgtgctttcaaggctgatcgcaaagggaaaaagcgacgaagaccgagtgattgcatctctccgatcagattcggaaattgacgacattttgatcggatcaattgaagcactgcccattaaatttaaggaaattgtcgcagctgctgaagccgacaaaaccattcaaaaagtcaagaaatttttgacgaatggttggccaaggaacgtcggagacgaaagtgccgaaataaagctttttcatttgatcaaagaacagctttgcatcacgagaaattgcctgatgtacgccgaccgagttgtcatccccgaaaaacttcgacagaaaactcttcattcattccacaagggacacccgggaatcaaaagaatgaagcagttggcgagaaattatgcctattggccaaatatggacgccgacatccaacagatggtagaaaactgccaaccgtgccaaatggaagcaaaggcaccagttaaaagtaatcttcaaccatggccaaaaccatcacttccatggcaaagagtccacatcgactatgccggaccatttttcggcaaggaatatttaatcatcgtcgatgccttttcgaaatacccggaggtattcgaaatggccacaaaatcgacagcggcaacaatagaaaagcttcgatatttgttcagccgacacggcatcccggaaattttggtgtccgacaatggcgcccaatttacgagcaacgaatttgctaaatttatggccatcaacggtgtcaaccacctgttttcagcgccgtataatccaatgtccaacggccaggctgaacgtttcgtggacacgttcaaaagaacatttcgaaattgaaaggggagggagccccaagcaaagacggccgccaccagcacaaccgatcgaaagagacgtagaaatggcgagacgcttcaataagcgatttggaaccaaattaagggagttttcgatcggaaacaaggtctttgcccgccacagaatttcccaaaattggcaacagggcaagatttcaaagcgaactggtgtgatttacgacgtgacattcgccgatggtaagtcagggcgataccacgccaatcagcttcgtcctcgcaaaacatctgactctgacgaacagctctcggtgatgctcgaagtcttcgacatcccaagaccggttgctgttgaggagcaaagggaaatcccagtggaaatgccattggaggacccgcaaatttgggaggtcaaattgaccatggacagcaacgacggtaccctcagcgaaatcgccgtccgccgcagcgcttttcaccgtaacctcggaaccgcgcttaaggggggaggtgttcggggcactgccgccgaagtttgaatgacatgacataatgccaatcgatttctgttccatttcatgttccttccctcgcccataaatatgctcccattccattttagattgtattcccttcattcatttttcatttatatatttgttccccaaattgttgtgattttattttcttctccaataaataaatatttaattggacttaaacaaatccctcggaccgaacaaattccaaaatataagttgtacttaaattttaaaccattttttacttgacagatttatatttttatttttaaaaattttctagttaagctcacttgaaattgtaaagtcaatgattgccgtcaaagcatgcgttttatgtccgctacttactttaaatatatcttttaaattaaattataatattattatttaatttaacaaacgatgaaaaaatataataaaattatttagatactattatttattctatacttttttttatttgttaaaaaatttcttcggttgcaatgttgccaaatatataaatttcgattataaaaacaataaatttccgataagtgatgtttttgcataattttcatttttatttttcaaaccaatcaataatcaaatttaaaatttattttttattttagcatatatattctccaaattttttggttattttttcgattcttaaaaaaaagtaaatctttaagttgcgttttttatgaaaatttgcatattgaaacattattaatttttattttgtttatttgttttctttttcgttaattatatgtttaattatgttttgaatatcattattaaaatgtttgcagaatcgtagaaaaatttgataattttattttattattatttaatcaaatttaaacacaaaatggtttttctgcaaaagatagcctttttaaaattgagtgatggtttgacaaataaaaaaaatttgattccaaataaaaaaaggagaaataagaattaattcatgtattagtattcaacattattaattata

SEQ ID NO: 14736 - DNA, 2045 bp, Heterodera glycines
gtgattaaaagaggtacaatagtgattaaaagaggaagaacagtgattagaagaggtacaaaagtgatgagaagaggtacaacagtgatttgaagaggtacacctgtgattagaagaggtacaacagtcattagaagaggtacaaaattgttagaagaggtacaaaagtgattagaagaggtacaactgtgattagaagaggtacaaaagtgattagaagaggtacaactgtgattagaagaggtataacagtcattagaagaggtacaaaattgttagaagaggtacaaaagtgattagaagaggtacaactgtgattagaagaggtacaaaagtgattagaagaggtacaactgtgattagaagaggtacaacagtcattagaagaggtacaaaattgttaaaagaggtacaactgtgattagaagaggtacaacatggtttaaaattaaataaataatgaaaagtttttataaaaatcgattgcattttaatttaaaatttttttataataaaatactcgttttattcattaaatataattttgaaaattaataattgaatatttattttgaaatgaaattcattttttataaattcaaaaaataaataatgaaattaaataaattaattaaataatttataaaaatcttgaaattaattaaaacattaaaaataacccaaaaatacaaagaaaaataatgtacaccgcccgggtccgaaattcgcctatatgaaattctttaatcaaacaaaaaattaattttaaaaaatttttcacaaaaaaataatttaatttaaatttaaaaattaattaaaaaaacaaacactcttttaaatgaattaaaaacattaaaaataaccaaaaaagcatagcaaaaataatgtacaccgcccggattcgaacttccccccccccttcaaaatgatgcctcagaatccccaatcacacagggattctgaggtctgaacgatgtcaaaaaatcatggtttcaaaattaaataaataaggaaatggttttataaaaaaatataattaaaaattgaatgtgttaataatttttaaaaattataaaataaattccttctttaatttaaaaataaataagaaattaattttatattaaaacatttattcatcaaaaaataatttaatataaattaaacaaacaatattaaattaattaaaataaataaataattaattttaaaacaaaacatttatttataaaaaaaatttaattcaaataagaaaatttaatttattttaataaaataaaaaatattttcaattaattaaaatatgtaaaaacagcaaaaaatacaaagaaaataatttacaccgtccggactcgaacttcgccccccccccaaaaatgatgcctcagaatcccaaatcacacagggattctgaggtcttgactatgtcaaaagtaaaatctgatcacgtattcgtgatcagcggcccaaataacccctaaagacatgtttttggatggtttttgatggaaaaattttcccactcaaaaatcatgtgcacacccccctttggtcccgaatgccaaaatcacttttatttttttacaattcttaaaaaagtgataaaaatatgaaataaaatttatttggtagagcaaaaaattgcagatttttgttgtatattatttttacaaaatgacttttctgaaaggtagttaggaatttttttctgaaaaatcgaaaatttccagaaattctggaataactttttttctttaaaagataaaaaccccaaataaaacccataaaattctcctgatttttctccatttttaatgctttatttaatcaaaattggacaaaccttacgccagatatgaattttcaaatattaggccaaaatcctcgagggccaaaaaattgccaaaaaataaagaatttttaccatattccaagaaatctgaaactaatacaaacatccgatttcgagcttagcaccataatttaccccaaaaaaatatttttcaccctctttttccaaccaaaaaaaatttttgaaaatttct

SEQ ID NO: 14737 - DNA, 2058 bp, Heterodera glycines
ccaaaggccaaaactggaagggaattcgtggcaattcattttcccccccccccccccccccgcccatccatttaaaagctctgatgattttccgcggcggcgattggccaaggggcattgattgtgccacaatctgtggccaaatgtttggcccatggggcatcaaatcagcagaagcggcggcagatgtttggctttgctttgctggtttaattggggagatcggtccatattttttaaaatttcaaattttatcgcgaaaaattttgccctcattaaaataaaaatttcttatttttgaataaatcaatttaattagcaaaaagaggagaaatatgtaatattatttaccattatttgctttgtgttgtataaaaaatctttttaattattaataaaaccaatttacttacgcacaaaaaatgtttctttctttttggtgttaccactttctatgaaggaaattgagcacataaactccccaaaactttgttattttatcgccaaaattgtgaaaaaattgcaattttaatcgattttaatttataaataattttttataaaaaatttaattatataattaatatttataaaaagaattttatttattcattttaataaataaataaataaatatttataaaagaaattttaattaattaattattgaattatttttaagaaatttatttatttattcaattaaatttaattaattttatttttgcagatttatttagagcaatttatttgttttttttaaatcttttttgtgtaaatgttcccaatttttggccaaattccgcgttttgctccctttccattttatttgcccatttatttctcttggccacccaaaaatgtgtgctctctgtgaaaatttatgggcttttggccatccaacggcgagctgacgacatttattttattatcatcgacaacacaacagaagttcaattgggtcaaataatattattctgctgcaaagggacgattcatttagtgcaaaaaattatttatttgccaaattttggcatttaattaccgaaaaagtggaaaattaaattagaaaataattttaaaatcacttttaaagaaaattcaaaattttaaatcgatgcttatattaatttcgattttataatgagcggttaaaaatagatacacaatatttaatgttttaatttcttattttatttttaaattttcctttttatttttattaatctatattttgtattttagttaatcatttttcatttccatttgtcctttcaaactttacaaattgcttcaatggatgaacacatcgccgccgctggtgccaaatcgtttgtgccacccgcgccggcgggcacaactcatcaaaagacttcagtgcagcacgagttggacagagttgaacgtgaaaaattttggaacgaagtgagttggaatgggccaattttgcgctgccaaagtgccaaatggccagcttttgggttggctatgtgcccgattaaggcgggtcccgaacagggatggacgtaactgattttcaattacggaaatccataattatggggtccaaaaacgccgtagtttttgttttaatgcctaaagaaccgtaattttttatctgtgtaaatttaaaaattaaacatttcgccaaaagatgcgcgacgaggaggaggcgaggcgacgcgaagatgctgtacgtcgacaaaagcagcaggaactgttcgccaaggagcaacgtgaactgaccgacaaactgcacaaggcgcacttggaacatcagcaggcgaaaagcgcagtgcaacaggtggccacgtcattggcattgccagggagaaattgacccacattggcatttaacaatatgccatgccatccatccccagcagcaggggggtaataaacggaaattggccaaaattaaaagcatttcctttggagatgacatcacatcccctcggaggggggagggaagagcaaaggaagaatttgtaaatttatgtgagtaaaagtgcctgattatccgtcaccccgactccgccccaggatttttgaattact

SEQ ID NO: 14738 - DNA, 772 bp, Heterodera glycines
tcttgatttaattgtcagaaaaagaaagaattataaaaataaattcattactccctggcttgaaattaatgaaggtaggatgtcatttaatgtttttttgcatgctcttcaacttttcttgatgagagagatttcctagagcaagatatttctaacttataattcaactgtgaaaattggcaaaaagaaacctcgtctatattttatatacatataagtcagttcaagacttttatcccaacgcccccctcattttctgtccgatccgccgaccttttcttaatttgaaattatcgatttgatggcattccttcgaaagcagaaaaaagcttctccgaaaatgccttcgccctctccgacgtttaaattaatcggcttaattcgcaactttcattctttgttactttcctattattatgcaaatttattggcgttagatatgcctttgttgtgtcccctcaacggtcgaatttctcagtataaataattatatatatcacttttcatataaattccgtcactaattgcctttttaattaggggtattgactgtttaataagaaaagccgcccttggggttttgtgccggtgccgtttttaatttagtccaaaccacgtggatatgcgctcctttcccactttttgtagctgtgtatgtttaaaaatagaaaaactaaaaatggatatgctcgagaatctttggtctcgagtaccgaaatttctcttcgcggtattcggtcgtaaaaaaaaatccgcgtttctgttcgcttat

SEQ ID NO: 14739 - DNA, 1625 bp, Heterodera glycines
aagagaaaattggagagacagtgttggaagagagaaagaaagtcgctgatgagcagaaacaaacgaaaagcagatagaagaggagacaagcaaatgggggggggggggggaaagaacgggcgacaaacgaaaagaaatgctttgtccgccgctgcgctttgtctttggaacgcacgcgccacccacgcacaaagcgaggaacagagaaagcgaaatagggcgagagagagtgacaaaacgaagtgccaggtgaaaagaggagagcgtcagagaaacaaacgcattttccattcgttgtgttttatagtgcaaaaagtgagagccgcgaaaagccgacaacatctgatattcacgtgaaatgcagatgaatttcgccaggaaaaatgtgcggatgtttgtgcttatttagccaaaaggaggggggagagaaagagagaagggagagagcagatagttgagaggattcggagagaaagagaggaaatgggtgaggatttgggagaaacagagatgagagaaaaagaggaaatgggtgaggatttgggagaaacaaagataagagagaaaaagaggaaatgggtgaggatttgggagaaatagagatgagagagaaagagaggaaattggtgaggatttgggagaaacaaagataagagagaaaaagaggaaatgggtgaggatttgggagaaacagagatgagagaaagagaggaaattggtgaggatttgggagaaacaaagataagagaaaaagaggaaatgggtgaggatttgggaattgtgttttgggaggaggaaccaacaaccggctttttatttgtaacacatacataagctaatcagtttaaaagggtaacattcaagcccgtagtcagaaaaatttcagagggggaaacccgaagacctttttttttgcttttcgggccaaaaagactattttcgccattttggggtcaaaatttcagaaaataaggtaaaattgccgcgaatcgcgaatcgcggatcgcggtcgcgcatttttcaatttctataatcatttttttaatttttttatataaaaattaattaaaatcacgatgcatataaaatttggggggactgaataaggggggggggggggatttgcgaaggttcccagtgatgcaaaccagggatgggattccgaagccccaaaaattttcggaaatcggaattccgaccccaaaaacgtcggaagtcggaaatttttcaaaaaatataataaaaattttctaaatatttttactaaactaaattttttaattcttaaccaagtaaaaggtgatttcaaaaaatgttttatttgaatatttgcttgaaaaaattattcaatgattttcatcaaaactttttcatgtcattttacatttttagaatatttttgggaagagaatattacacctttttattgtgaattttatctaaataaaaccaaattgagtctttttcatttgtcatttggctctaaattacaaaaggaaaattgtctataaaaatgaatcatgaatgtataaatattttctgattgaattccatctaaatgcgctagaaaattggaattttagtcaagtttacaaaattttacgccttcaaatctaaatattcaa

SEQ ID NO: 14740 - DNA, 1204 bp, Heterodera glycines
aattattttgaaatttttggcgacagacaaaatcaatttgatatttattttattaaaaaaataagttttgataattttcataaagcattttcaaaaattatcattttttaatttgcaaaagggagttttggagttgcgtttcttttcattttgattttttgttgtatctattaaaatttaattatgtgagtgtatgcacaaattttggacaattttcaagaaattccatcccaaataataattattaattaatgtttctcgtgcagtgagtaattccctctcgcaaattaatttttagcaatgattactcattttgctgcttttcattggagcaataattcattccattgcttccatttttgctatgagaattgcgtcaagaatttggaaatttgttgaataatgccgtgggggcggcggggggaggggcgattcgctcgctgctgatttttgtgtgggaatgaatgggggcgtttgtgtcgggtgtttaaaagcactcccgtcacaggtcacaaatgaatgcaaaagcggtgagacatgctttcttcacgtgaatcttccaaattcagtgccgaattcacgtgaatttgtgaaaatgtttataaacggcagaaaaaggcaaaaacaaagcaataaaaaaacaataaaaacacttctacttgaatgtttttgtttatctaagtacagatttttattaattggtgagaaaaaaagaaaaagaaatgaaaaatactttttttgcattctttcgttaaaatgccatgccatttgaatcatttgactttgaattgcacggctttcatttgcttttgaatactttgcacattgacattcgtccccaaatatgatgaaagtggtgcatttgaccaaatgcaattggccaaattatttgataacatttcccgctgaataccctcgagaattctgaagcaaagcgaagggtcaaaaggcatcgaataaataaataaacaaataaataaattaattaattggcaatggaatttttaatgacactgataaaacaataaagaaatggcaaagaaaccaaagttttattttagttcccttttcaatttataaattaatgaatgattcattggatgcattgtgtggaaataaattttagtgaatgacaaattgctccacaaagaaagaatcctataaagaaaaatataaatgaatattcgaaatttaatattttgtt

SEQ ID NO: 14741 - DNA, 3412 bp, Heterodera glycines
aaacatgatagtgcttgacgaatcgggtcaagcgcctcttctggcggtctgctcggtcctctcaccccttcaggaagctcttaagctgttcatcactggtgatcgttatcggctggccgtgagcatgaaggacatccctgaacaactccgagtcggcttcggctttgacacagttttactcaacacagactcatctcctggtgtggacaaaacaacgttggaagtgaactaccgttcacatccagaaattgtcaattgcgttgaatatgcggcatacacaccccatggtgaaaggctaagatcgggaccgggaatctttaggatgttgacgagttttgccaaaatgccaattgctgaatctccaattgtgctcattcaccaagattcgccaatggaagcggaagaaacgagtttttctgcgaccaattctggtcaaactcggactgtcattgaccttttaaggagctggaggggttttcctggttcagtccggatcatttcactttactcaggccaagcagcacaaattgggtgtgaactgagagcgaatggcttggagcggatggctgcttcagccacagctgattcaatgcagggtcacgaggcagaccttgtgattgtgacaacgacagtttcgcatgcacgtgaccaagcagtgacaaggaacagcagacggaatgatttctggggggaccccgcacgcgtcaacgtctcgatcagtcgtgggaagcacggcctcgttatagtggggaatttgttgggattgtcggaggccaccatttggaaccgttttcttaaaaaagccttggaatatactgttgtaacttcgccagaatttgttcagatttcggcacagcggcgttcacattatgttaggggtattttgtcggatgaagatggacttagtgtccaaaactttaagtttcacatggaatggagtccatagaaaccccaaaaaccccaattccaatctcaagctgtgaatttcccaaatccctcccgtcaggttctttccagcaccgccacttccgttactacagtccaggcgcgaacaatggccaactccggttcagagcaccagtcaagccaatcgtccggggagcagcagtttttttgagcccaccaacagccaagctgatcagaggcaaccacagcaaatccgatgttggagatgtgacgaacttgggcacgtttcgagtcaatgccgggcagcattttctccatcaaaaacgaacatacgatgaagtttggggacaaacttgtggaaggatggacgtgtaaagcataattcaattatttccataaccaatttcttttctgctgttgttccgcccctttgccttttcccttcacatttgtctatttaaactgatgactttctacactcaaggatcagttggccaaccagtgcattatccgtcaaccattatattttaatgctattccaataaagcactgatcattctccgccgatttattattggtccggacgcggacggatttgggcttgggacccgggaggttgggagtccagggcccggattttcacccatcaattcccgcttctctttccctcttccattcctctggcactacctccatggtccttaatgggcatctctcttaagctctgggttggacacccggccgttttactataataaataattaaaattaaatattgatttatttgccagaaaactttaaattacttctttcactgtccaattagtcatttaaagattacaaagaaatttagccaaattgagaaaaaccaaattttatagatgaaaaagacccaaaaattttttgtaaaaattttaaaccatttgagagatcaaaacaattcagaaggaattttaaaagtttaaagcgagttttgccttttggcatttgttgtcattatttgttggacgaaatgccaaatgaaatcaacaaaatcccagaatctagtgaaaatgaatacgtttcttttataattggacaatttcttaatgtgggagaaaagtatgagcaatgggtcccccccccaaccccaacaaaagttccttggggttgtcctccgacatttggaccatcacaattcgcccgcatgctcaacagtgccatcatcaacaccgaaattattttttaaaaaaatcgatgcgatcagttgttaagtgcctcccagagcacctgaatgagacggactttgttaagcaaattgctgaggaatgcggattgcagggcggtgacctcaaaaatgttcacagacacccgcggacggcacgtgagggaaatacaaagccgagaattgtcaaaactcctttttcctctcaaaaagctcgaaatttgttcctttataaattccggtctacccttttcaaaaagcctgtgatcccgcataatttgaccgctagacgtgatattacacacttcaaatataatatgacatcagaaaaaaggcttttgaggcaaaccaagccgtgggcatgttcaaatacatagtcgtcgacttggaactcaaaaccctgtctaacccaaaaccactcaggtttagggatttataggggtgcgcgagcaaaccgcagaaaactttttaaacaatatcaattaattgtctatttttttaatgcacgttcgcttcctaacaaaatccctgaattatattttatgacacaaaataaaccaaatattttgataatttcagagacctggttaaattcaagaaatcgaatttattcgatatatcaataggtggtaaatatactgcagttttagcaaatcgccaaagtaaaagagttaataaaatttttgaaatttagcaagctaataacgcaattcaagggctatcgaatgataccaagatttggcagtttagttgcgaaattctatttgaattaaaaatacaaaacggatcgctcatttctcaaataattccttcattcattccactgatcagtgctttgccccgctggactctagaactctttttcgtcaattttttcgtcgagacaatgaaatagatacaatttaattgtataaaattttaacaatggcaaaactcactgatgactagggatgcaatttttaggacctaaaaaagcccccaaaataggctctaaaaaaatcgaaaataggtactacaaacctcaaatttatgggttataaaatgacaaaattcattcaaaaaggtaacaaaaagacaacagtatgtattgagataaacaatttaaatacaaattcatgtcaagaaaataaataaattagttttgtagatggaatttattttttcatttcttaggggtgtatttttcgtttttattgcatttattcaataaattttgtgaaaacgtcagatggttgcatgacatttgcggcctgctgaaaatcggacatttgcggcccgataaatgaggtcggacatttgcgg

SEQ ID NO: 14742 - DNA, 1675 bp, Heterodera glycines
ctccgtcttcgggatgtccacccactctgcttcttcccgataattgcgcccgtgggtgtggttgtgcattcgatgaattggggacagccagcggaggaatcgcaagtgggcggggggaggggctgagccgtccacccccagccagcagcttttcgccaaatcgggaatatagaaagggcaaatttgggagagagatgcgattgaaggggaagcagagtgggaagattgggatcaaagggggggggggggaagatggatgggaaaagagaaagccatttttttgggatacagatgcaatttaaaaattcattaaaaaataaaaggggcattacgcaccgccctccctctcatgatcgagagtatttgtattatagaaaattacccaaaaaagagaaagcccattttttgggaaacagatgcaatttaaaaattccttaaaaaataaaagggccattacgcaccgtcctccctctcatgatagagagtatttgtattatagaaaattatccaaaaaagagatagccatttttttgggatacagatgcaatttaaaaattcattaaaaaataaaagggccattacgcaccgtcctccctctcatgatcgagagtatttgtattatagaaaattatccaaaaaagagaaagccatttttttgggatacagatgcaatttaaaaattcattaaaaaataaaagggccattacgcaccgtcttccctctcatgatcgagagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcacagtcctccctctcatgatcgagagtatttgtattatagaaaattatccaaaaaagagatagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgtcctccctctcatgatcgagagtatttgtattatagaaaattatccaaaaaagagataagccatttttttgggatacagatgcaatttaaaaattcattaaaaaataaaggggccattacgcaccgccctccctctcatgatcgagagaatttgtattataaaaattacccaaaa

SEQ ID NO: 14743 - DNA, 4316 bp, Heterodera glycines
gaaaccaaagattccaacatacatgtcccttacaaattagagttgtttatttcttttttttctatccttagctattagcaaatctgctttgttttcctcctaatttattctattttggtgttgtttatgtgattctgatgaaattgttagtgaattttatttttttaattttttgaccatttcgctagtttttagcttagagatattttgacagccgtgttggctcggacggcaaaggggggcaatttggcaaggacaaaatgggagagagtgcgggaggaattaaggggggaataaattcctaataaataaacgaagtttatttaataaatataatataaagatgtgagtaagatgtgagaaaacgcggatgcttatatggagagagaaggcgtaggtggagcaattttagcagagcgacaaacaacaaaaaagagtgactaatactaagcacagaaatcacatattaaatatggaaatatcacagaaatataaaattaatcacaattattcaaaattatccaaattaactcaattaaattactcttccacaatttccttccattttctctctctctccctctttttccctcatttcccatcatttcttctttttctccactttcttagtcgctttggcgacactccccgccgaagatggttcagctacgattgtgccttcatcggacgaggcaccgacaaagtttcgacatctggtggcgggtgcagtgctcggcgcaacgatcgtaactcaaccgtctggcgatcgacttcagactgcaacagtgtgatggcaatgaccaagccatcactggtggaattggccaattcgttcactcccatggccatttgtcccacactctcttggacgtcgtccagtgccgtcctcaggcgtttaacaccgccgttgtatttcttgagtgcttcatggatggggactgccagatcgcgcttcttcttctggaggaaatggacggcctcttcccgctcaatcgcccacttgttcacgtgaccgtgaagaagttaagccatttctgagtcgacaggtggcggtggcacaacattgatcggcgaatgggatggctgcgtagtcggggaatcggatgaagctgccgcctttggtccctttttttcctgttcttcccgtggggggggggggctcgtcagggttttggcacttctttgggcgtcgggccttcccttccggcttttcgttcgtagctgaagcgatcagcttttccagttccattttccttttttccaaatcggcgagctcctgcgagagagagttgggcttggcgggcatggcacagaatgtgtttggaattggggaggcggagggaaacgaatgatggcccattcttgcgacccatggcttaaatagcggccaattgtgaactaggccagagagcaaaaatggcagaatggcagaacacagcggagagatgggtgagtcagctgatttggaatggctttcagcaaagtgttcgctgccgggaagtggtgaataagccagcggagcaaatttgttcacgatttgcacaaaatcggaaggtgaaggaccaaaaagcgacgaagaatagggcaacaagaagtgcaccagcatagattcataggatgagggggccagagatcgtgagttctcgaccaacaccgatgcggtattcctccgcggcacctcgactcgttgaatcaccatggggcataacgttgatcaccaattctcgggaccggggcggatggtcaattctgtcccagaacacgaagtgagacggccgggggcgtggatgtgggcatgttgacaagccccgtggtgtggaaatttggtcaggggccacgacgcggatcatttcgattgggaaaaaatcatggtgtccattaccgccgggctccatcaagcatggggcagaggggtgccgaagagtgatgtcatggcgagagcggtacagctcggagatagttgggccacgggcacttccattgtaggcaccgagacggttcgcaccacttcggctcagctcagatccctgaagccgcacattcctctcacgtgggtacagatgccttgtcttgagttcgtagccgcgactgtgcagtccctctttgtagaaatggtgaattgagtggcgcagaaacagcttttatagagcagccatgtggcaatttttgatctttggcgagatgaattcatagaaatatttgaaaaataatgaggatgagttggaaaaaggactattgaaacagttaaataaagacgacaaagaaaagattcaaaaaagacgaaatcgaagattgtacaaattgggtagcattactctgataatttttctcattattaatacaattatccaaataacggatggagcagcagaagttgtagtaatacaatcgaattccgaagattgtgaaagaaagtcaaatggatcagtatgcagaatacgcggaactgcagaattaactatattaccggctggacaaaaaatcactttagctttaaaagatgataatggaaaattagcaggttccttggatttaactttacaatttttacgacttcactgtaatcaaaacactgtaaaatggttacggtcctataaaataaatgttgtgtctaaaaaacggtgtccaactatgggatcatgtacaaaaggcaaatgcaaacacacacgaatgagtgatcaattaccggaaatgaaagattatgaaaaatttccaggaaataatttttgtaaagaaggcgaggctatttggggccacaaatgtgctttaccttccgcgggttgtttcttttatcggacttatgccaaaccaacatcagaaaaattatgggaattaatccgatacacaggatgggattacgaattaaaaatgaatttgtcgtttaccatgggaaatttgacaaaaaatacggaattaattatgtttcctggattaacaaataattggaatgaattttcatttacgccggaggcaataactcctccaatttctccaattttaaatgattattttattgtatcagaagatgaaatcatttatggtggaaaagaattaaaaagtgatttgttttgcgcaggccctattgaggcaaagaaattttcgtgtaatatatctaaagaagcatgtcccgaatgttggatagatagagaaaaggatatagttgaatgcgcatgtcatgattcaattttagaaaaaatggagccaaaattaccatttacaacagcaaaaataaacttaagaaaagaaggaaagaaaattttaagtgagacggaatatgcaccggttaaattagcaattagaattcaagggttaaaggcagtagctataactgatggcacaaaatgtgaaataaaaacaagaaattttaccggatgttataattgtgcaaccggaggaacattgaattatgagtgcaaaacagagtttggccaaacagaagccgaaattaaatgtgaaaacggtctctattttctagcaaaatgcaatgaaaaaggatatttgcaaaaagatgttttgccatttgatagagctaaaattaataccaattgcctggttgaatgcccattaggataactgcactaagccatttgtttaaacccgaaaacgaaatattttttagcccttttagaacttttccaaaaaaagaacttttttacagcatatttcgtacagaccccaaaaaggaaattttttattctaccttttacaattaaatattaggcatcaacgttgcataatttgaaggtcatatatttttttattggaataagtaatttattaaaacattttctgtggttgatgtgcccacaacgacgaaaaagaaaaaatattttgttccacctaatgttattccgttgaaaaaatcttacgattgttatgccctaaggggacgaagaatgggctgatgtgaaaaaaataaaaaactggaatgtcgtctcgatcggttatgattacatgggagatataattggttaactcattagggtctcaaattcggtactttagccctagaaggctatggtgggccttcagttctcaagtggcacacaatgggggctgaagatgtcgttggggcggtctttttgggcggctgtccttttttctcggtaaacagagaaccctttggtaatattatcccttccccattaaatttttattttaattttaagtcattcaggaagtgtttttaaatgataagcactttgtctttagagctgtttcgatgatgggcgaaaaaattgttgggatcgctaatgccggcccaatattctcatttaaagttaacacgttatttatacccatagcccaataggccc

SEQ ID NO: 14744 - DNA, 1931 bp, Heterodera glycines
aaaattggcttaaaaatccacaaatcgacctttttagcgaaaatttgttaacaaatcatgccaaaatcatcaccgacggcgaatattggcaccgaaggacaaatgttttttattttgtttaaaaacgcttcaagaatggcattctttcggagctaaatctttaaaaagtttcatctaaaacactcaaaatgataatttattgagaattgttaggaaattttgataatattttattttttgttcaataatatgcaaattcaggctttattattgcgtttcaaaaaagctgcttattttgacgccaaaatctaattttcaatcagtgatttgcttattttggaaaattttcgatgacacctctggttttaaggtgctgttgttctgctattttttgacttattaaaatagggttttttgggttctatggttcaaggctctaaaaaccccaaaaataggcactaaaaaacctcaaatttatgggtgtaaaatgacaaaatttattcaaaaacgtaacaaaattaagcaaaatatgcattgaggtaaataatttttaaaaccaaaaattcttgtcaaaaaagtaaataaataaattttagagataaattttcgtttcttaggggtatatttttgaaaattttagggtcgattcttagtaggctatttttctgaattttggggtcgatcttaggggtgtatttttcgttttattccatttttcttaataattttttgcaaaacgccaaaattgtttaaaattgattttttccaacattttttacatagtctttttcggctctaaaaataaaaacataggctaaaacctaataatcgtttcctataataacgatttttggcaataatagcaaaagtatcatttcccgattttttttgcgagttaataaaactcttcaactgtagtaatttgaatttttttaacagattaatattaggaatgagaatttaagtcacaaaaaatctccaaaaatttgactaaatagccataaaaaaccgccaaagtcacgaaaaatgcaaaaaagtcatgaaaaacttacgcaaagtaaaaaaaaaaatactatttttgtaaaacaaattgcaaagaatgtagagtacaattttgtcatatgtagtacataaaacgcattcgaagaatagatttgtaaacagagaaagatcgttatacgatgaactatttgtaggaacatgaaaatggggagatttcaaagtcaacagttttgccatgaaagaatttgacaaacttggatgattgtctcaattctcggggtcttctcaacaattattgaatgtttttgccggatttcatttgcctgttcaccttgaacgttttttcggtattttcttcgctgaatttcaatttttgaattaaaaagtgaaaaaaagataaaaatcccaaaaagtagaaaaagtctaataaaaacccaagtttgaagcttgtaacaagtgtagaacaccttttaaatttcggaatttttaggacttccattcccctgttacattatgttttcttacaaaaagagaatgtcctaatgttaaagcataaaaagattgtcaagaaatttatttatttatttttaaattagttttcgtaattaaagaaaaaagcctgggacccgacaagcgctcggccaaaatttgagaccatccccgggacactcatttgggctttctttggacaaatttttttactagtatgaccaaatatgcacgaaaaaggcacaatgcctttttatcttttgtgcctttttgcgttatagtgcctttttagtcttttttgatgattttgggtgtaaaaataaaatgccctagtcataaatattcatttttcatttatttattctttataaacaatattcctttaattgaatccatttccaactttttttttgcttcttttattttgtctacaaattccc

SEQ ID NO: 14745 - DNA, 1050 bp, Heterodera glycines
gtaaatctgaacggtctgaaaataccaacagataaaattggtaaaccaaaaacgacacaaaagtgtcaaaaatttggtaaatcagtcatttcctaaactggtcattctcaaacaccaaaaaagtttggtgaaataaaaggtcacaaagccagttttgcctggcggtgattgggatacggagaagttcctatcatcatttaaggatcccgtcatcgcgaagaagcaatcgaagagatctacaatcaatctcaccaaagaagggaaattggtaaaaagctcaaaatggttgaaaaaacgccattcaaaaagttccaaacaacaatacaaacaacggtggagcaaaaagaaaaattgctccaaaaaatggaacttttggccaccaaaagaagggagtcaagaagccacaacgcgatgacaaatcggtggcaactccttcttgccatctctgcggccaaagtcattggacgtcaggctgtagccgtttccgggatgccaaatccagagaagaaaaggcaaatgaagtgaaattgtcatcaaatgcctcggcatcaaccactcatcaaatgagtgtacagcaaaaatcagaaattgctgatactgcaacaaatgggggcacaaccgagtgttctgtccacaacaatttggggttatcaagatgtttgccgggtcaaaaacaatctggcgcatgcatggcgtcagttcatccggaagaaggacaaatgccgactcgccgacctcggctttcgatgcccaagggacgaagacttaggctggccacgcgcgagggttcaaacatctcgccaagagcagctggacttcggggagaaggagttgggccactctgacttcgacccggacgaattagttttcgaagtgccaaaggaaggggagtcaagcagcgaacgaagagtagcgcgctggcccgaaaacttcccacggcaaattcacgacaggtcaatttcaccagattgaaaaaaccaacccttttataatcatcgtatttattcggattcgaaataatccgcggtaccaaaaaaggggtcattaatt

SEQ ID NO: 14746 - DNA, 1398 bp, Heterodera glycines
  misc_feature (96)..(96): n is a, c, g, or t
  misc_feature (98)..(98): n is a, c, g, or t
agtgtatgtacatatgtttatgttccgggacaacccaacatttttatcataaaattttcctccaaatttctgttgtgtacgcaattagtactttcncnaatgaatcaccaatccaaatgataataaaaatatttcaacaccatcactttctactgaatcacatagaaagtatgtatgcttttttggtttggtaaatcacaagttctttcactttttaatattatcattccttatttttaaaaataaacgattataaccatcatcagacattttctttaattgttaataatggcatatcaagcggcacaggcgcgacagaacttctcgccttctgtggaggaggcagtcaacaagcaaatccgaaatgagctcaacgcttcctatgcatatctggccatggtttcaaatttcaacttttctctcttgtttgagttggttttttccattttcaggcaaactatttcaaccgcgtggatgttgcgttgtccggggccactgagttctttggcaaacaatcggtggaggagagggcacacgctctgaagttgatcgactacgtgaatgcacgtggcggacacgtcaaactgatgcctttgcctgtgagtcacttgtttatttaggtattcatgttcgatgttctctttgttttcaaggcgcccgctcaacaggaatgggtgaatttgcactccgcacttcttgacgcattggaattggagaaggcgaacaacgcgaatctgctgaaactgcataagttggcttctgacaacaatgaccccgatgtgcgacgtagggagcagaaaaacccattaaattttgcttttagtttaccaacttcctcgaagagttttacctccgtgagcaagtggatgagattcagcgccttgcacgcatggccaatcagctgttgcgcatgggtaccagcggactcagcgagcacttgttcgaccaggaactccgaaaagggacggtgctttcggatgaataagcgatggaacacatgggaccaaggaataatgcgatttaatgagtctatcaaatgcagttaattataatacctaattagaaatggaattttaaaaagcacgaagagggttaacaaataattttttgtttatgatcattgtttttgaaatatagaccaaatgacaaaacgccaaaatggatcaggaaaagcctcaaaattccattcctaatgtgacagttttattggtcgatgtctgtttaacaaaattaatccccaattccactaatgtaatgtttaatgatacccatttattaagtataaaaataaatcttttaattaacatgcctaaatgggcaaaggtacagttttgtggtttcttcgaaaaataaatttaaaaattttctttgtattttttctggggtagaaaaatgcgc

SEQ ID NO: 14747 - DNA, 2101 bp, Heterodera glycines
  misc_feature (321)..(321): n is a, c, g, or t
agtccgcttgcctgctaatttattttttagtcatactggctaaaaatcatagacaaaaacattgatttaacgaaatcaaggttcagattcatgaccagctcattttattacccttaattcataggaaataaaatttttaaaaataataaatttttggaaaaaatcatttacttgacgaaaaaatcatagataaaatcatggattttccaaaatccgagctcagatttgtaatcagcgcatttttctaagccagaattaatacaaagaaaattttttaatttatttttcgaagaaaccacaaaactgtacctttgcctaaantgggtgtgatttttgtaaaaatttaaaacaatatctcaagataataatatagatgagcttttcgatgaatgtgcaatggcaccattaaaacactgttttattttaactgaatttgttgcgaataaatattacaattttaatcggaccttataaaattcttcacccatttttgccttttatgtcgttggattacgcaaaatctctttctttttatgagaacaaaggacgacttggccttcccgaggttttatgcatttttttatttgttcaacaaaatctttagaaatttgatgtcgaagattcgctcgaagagaaatgtgtgcttttatcggaattgttaaaaaacagcaaattttgtgtcgtttttactggcgcggggataagcacaggtaaaaattctgtaaaaatgccgatgttggcacaaagccaaaagtgagtttaatcgcaattgtcgggacggactcaattcgattttattttttggttgggtaatccaattaagtgttttagacaatttaccttatttttctttctcaaccaacaaaacactgaaatgatttcaaggggcccaaattggcacagaaaatgccaacggttttttcctttcattttgccaatttcgcttcagctgccggcatccccgactttcgggggccccgcggcgtttggactttggagcgacagagtcgcgaggcggacagtgtccgctttgagtgcgctcggccgacctttgcgcactttgcgctcaatgcgctggagaggcgtggcattgtcaagtttctaatcacccaaaatgtcgactctctgcacgcggccgcgggctttccgatcgatcggatggcggaattacacggcaatgttttcgtggagaaatgcgagcggtgcggcaggtggaaaaaggggaaacagacagagttagacacacagagttagaattaatccaaaacttctccaaaagggaattcccaattccatcggcagggctttttctcttacaatttgaaccattctttttttatttacataaatttgacttagttttaattaagttttttttgctggtgacactaaaatttacaccgaattgtattagagacttttaaacgattgaatcactgaaaaacttttatttttgatggaattccgttggaaaacactttaaaatttgggacagctcgtcctcccgaaaaattttgtggttttcgccctttatggaagtgataaataaataaagaaaattaaatttaaaaatatttctccgactctcagaaaattcttccgtccgtcgcccattccgtcgattggcctcaaacccacggggcgaagttgcgactcggctcgcccgaggggaaaatgccgcggaaagctgcgcgacacaacgctcgactgggaggacgcgctgcccaccgccgaattccaaagggcgtgggaatatgccaagttggccatggcaagcggataatttgtgcatgcatttgttttccttcagaagggccgacctcgtcctctgtctgggcacaacgctccaaataaaacccgtgggcgacatgcctttgctttgtcacaaaaacgggggcaaattggtcaccgtcaatctccagcggaccaaacatgttcggacaatggcattttaaacacccaactaattaccccccccccctctaaaggagcaaaaggcagatttggtgatcaatggtcggttggacgacgtcttctcacgactcatgccaaagttgtgcagcgacgaagtgcggcggagggaagtgaccgccgctgaggg

SEQ ID NO: 14748 - DNA, 2200 bp, Heterodera glycines
  misc_feature (1683)..(1683): n is a, c, g, or t
  misc_feature (1880)..(1880): n is a, c, g, or t
  misc_feature (1884)..(1884): n is a, c, g, or t
  misc_feature (1970)..(1970): n is a, c, g, or t
  misc_feature (1977)..(1977): n is a, c, g, or t
  misc_feature (2106)..(2106): n is a, c, g, or t
  misc_feature (2135)..(2135): n is a, c, g, or t
taaaagttagtggtcaaatcgcacattgaaatgactctccccccggtttaaagtgagtttaatttatatgttcaattaactttattactctatgattttttttgcaatctttttaaaattatttttgaaaatcaaattaataaaattgttattttttaattttgaaacaattttcgcaaaaataaaatttaaattatttttaggacgacaagcccctgaagggatcagaccgattaaaaatcagcagccaaaaggacgaaaaagatccgcagggaatggtgttgttgttggacattcacgaaccacagaaggaggaccaggccaagtgagacaaacaaatggggtgggacaaaatgccgacaaagacagaataaaatgctgacaaaaatgagaacgtgacgacaaaattggacataatattgaaaaaaatgggacaaaatgtcgacaaaaataggaatgtgtgggaaaaatgggataaaacgtcgacaaaaaggaacaaaacgtcgacaaaaatgggacaaaatgaaaacaaaatgggacgctgtgtcgacaaagacagaataaataaaatgttgacaaaatggacaaaatgatacaaattaacagaatgttgacaaaaatgagaacgtgtcgacaaaatgggacaaaatatctactaaaaggaacaaaatgtcgacaaaaaatgggataaaatgtcgacaaattagcagagacaaaaggtcaaaataagtagacaatttatagttgctaaatactagaaaattataataaataatagaggaaacaatgggaaaaagtgtcgacaaacacgcgaaaaacgacatcaaaaaaacaaaatgtcaaaaattgtttgtcgtgaaatgcatagattaaacaagaagacaaaattgccacattaagagggcacaaatggcaaaatgtcccaacaaaattcaaaaaaattgcaaattcaaaatttaaaatttttaaatttaaattttcgaaatttttttaggtacaaatgcgtggtgaaaaacgcggagggtcgcaatgaacagtcgctgaacctgcagtttgaataacagcaccagccaggcgatgaaaatccgatgaaaattttgagaaaaaaaaattggcaagaaattttcggcaattttttcttgccaaattctcgtgccaacctttgtgtatcttttaatttgcataaccattattcatacaaataattagcttagtaaagcatgaaatttcgaaatggtatttgaaaaaatcttttaaaattcgagaaaacgtggcacaaaaaatccggcatctccgaaaattcaaaatttttttaaaaattgaaattttaagacaatttttttaaaaatgtaaaataaatttggaattttgccgaaaatttatagaaaaataaacaaaatttgtccaattcttgatcaaggctaaaacggaaattcgatccaagagcccaccaagacctcgactcccccgtaatccgtaattacgcacacagaacttttgcataaatttaaaaatctggcaaacaaaaaattcccaaaactttttttttattgcctttcgtatgtcattatcatcatccaccagaagcccagacagcagacaactttttgttggcgtcaacctccatttattcttcacaattagccttcttctttccgctttgtcccctcccgacgccccggnggcgccgccccccgcctccccccgtgtgacattgtgccaaaataaagtgcacaaacacacattctgtgccaatgtgctgtgccaatgtgccgtgtgtgctgtgtgtgcgctttaactcggcgtgccatcgtcagaaaattgaccccgcttttaccccccgcggcgggtgccacgaccgccgccgacccatgagaaangtgngagagcacacaacacaacggcacaaaatttattgaaaaaaaaataatttgagcaggggcaggaggggggagggggcgaacacattngcacacnaacatgggaaaattgcggaccaatagccaaggaggggatggacggcacggcacaaaaaagtgaagtgacagtgatatgcatccaaccaccctcaaatgaagaggccctttaaacatgatactacctaanattttttaaatttgctgttttattatggncgaaggatgggaaattatgaaaattttaaagcatgcacattttagaattttaaaacaaaattttt

SEQ ID NO: 14749 - DNA, 2395 bp, Heterodera glycines
  misc_feature (567)..(567): n is a, c, g, or t
aaattcaaaaaatttttaaaaaattgaatttttaaaacaattttttaaaaaagtaaaataaattttgaattttccggaaaattattggaaaataaccaaaattgtccaattctaatcaaggctaaacgggaaatcgtattcaagaatccaccaagacctcgactcccccgtaatccggtatttcgcacacaggactcttgcataaatttaaaaatctggcaaacaaaaaattcccaaacttttttttttattgcctttcgtatgtcattatcatcatccaccagaagcccagacagcagacaactttttattggcgtcaacctccatttattcttcacaattagccttcttctttccgctattgtcccctcccagacgcctcgggggcgccgacccgcccgcccttccccccgtgtgacattgtgccaaaataaagtgcacaaacacacattctgtgccaatgtgccgtgtgtgctgtgtgtgcgctttaactcgccgtgccatcgtcagaaaattgaccccgcttttccccccgcggcgggtgccacgaccgccgccgacccatgnagaaagttgggagagcaccacaacacaacggcacaaaatttattgaaaaaaaaataatttgagcaggggcaggaggggggggggcggacacattgcacacaaacatggaaaattggggccaaatagccaaggagggaatggacggcacggcacaaaaaagtgaagtgacagtgatatgcatccaaccaccctcaaatgaagaagcccttttaaacatgatactacctaaaattttttaaatttgctgttttatttatggccgaaggaatgggtaaattatgaaaaattttaaagccatgcacattttagaaattttataaacaaaattttttgaaaaatttaggtgccaaatttaccttgttcatgaattatactgtgctaaatttaaagatactgtaaaatttaaaatttaaactaatgagtaagcttcagagaaaacactcaattaaaatttaaccttttgaaaattttcatgaaatttttgtgattcgtaacaatacgtaaatttaaaacaaacatttttagaggaaaatactctttatttgattaaggtaaattttacatgaaattttcagaatgaatgttcagccttgctttgtgttagatttacgaacagagcgatacaactgcttgacataatgcaatgtttttaaaaaaattttgagaaattaaatattcccaacatttccggggcaaatttttggtaaaattctttttaaaaaagattaatttttaatacaaataccagagaaaatattttttttttaattaaaattaaaaaaatataatttcatatctaattaataattaattattatcaaattaattatatctagtgtagtagaccggttttttttaatttttggcggtttgtccattcgctaggcttatgaaaatattagtcccataaatcccaacaatttttcttcctaaatcctgattagccttccaaatatatataataaaaaagaagatttttttgtggccctcccaaagttttctttcccccttttttggcaaattattgtgccaatgccaaagcaggaatttgttgcaccccggggaattcgtatattcttactttttggacgggccatcaattatttgctgctggcggacttcacaaagacaacacactcatctctgctctaggcccccatccgattttggcattttttgagtccaatcttagcattacatcaaacatggcattaaatccaatcttggcattacaggagcattgatttttattttgtatttgttttaccgttgatcaaaattagagcacggaaatttcaaagttgcggatccctctgcgggattagaactcaatttgttttgtttttttgccgggacgggatctcgcgtgattaatccagcaaatcccgcaaaatcccgcaccgggctctaatccaaattaaacctctcatgttgttttcgtttttttgtatcgtttcacggcaggaaagttaccactctcgagtgttaaaagttctcaatttctcgggtatataatttttttggcatttttgtgtcaggtgcccggtcttaattctcgggtccgttctcgggctcgactcggttctcgacacttttgtcaagaaattactcgggattgcctcgtgattgcacacacaatttttcggtctaagttctcaactttcggtctttttgtgcttaatgcctatttgcctattttttgccaattttgccacttttggcgcctcataaaaactaagaagcaaccggcaaatttttttagaaaatatacccttagaaattgaaaaaatttttaccaaaaaatgattcctaagattttgagtttaaa

SEQ ID NO: 14750 - DNA, 3582 bp, Heterodera glycines
attctgtatagcaattaaacgaaaacactcttgcgatcttcaacgagagagagagagaaaagagaggggaaaggaatgcgagagagagagagagaaagagagtgagaaagggtgaatgagagagagagtgaaagagagagagaaagggtgaatgagagagagagagagaaaagagagcgagaaagagggaaagggtgaatgagagagagagagaaaagagagcgagaaagggtgaatgagagagagaaagagagagacagggggaaaggaatgaaagagagagagagagaaaagagagcgagaaagggtgaatgagagagagtgaaagagagagagaaggggggaaaggaatgagaaaaagagagagagaaaagagagcgagaaagggggaaagggtgaatgagagagagagagagagacagggggaaaggaatgaaagagagagagagagagaaaagagagcgagaaagggggaaaggggtaaatgagagagagagagggaaagaagagagagagaagagagcggacagagccttctggccgttttagtctggccggtttagtcagagggtcgttttagtctggcaagctgtctttgtcctacattgatccaattctgatttgtttctcgaaaattctttaaaattaacaccataacagatttatcaatgtgttaacaacaaaaaaataacgaaacattaaaaatattacgggcgcatctcataattccgagaaataccaaggagaaaattgatgatgttataggggttattgataagggcatggtaattgtgatcattttggtgagcctggttattgttgatggcactgtagctctgcaagagtcgaagaattctcgcatcggcggcacaatatttgggcgccttttgaggagggagttcaccagcgatgcatcgtgagatttctgcatcaatagacttttgctcacatcgaattgtgttgatgaagcggaagacagttggatgtgtacaatcaaatgcccgttgaagttttctatggtatgcttctgcgtaattgttggttctgtctcctccatccaacgtccgttgatgcacactccattcatccgatgcgaaccgaggcactgtcaaagcccattgaacatcggccttcaggtgtaattgtacatgaacctttaaaataatttttttaatttttcgttcctaaaaagtcaccaatttaagatgcccataagttgttgaggaagttgtgcctgcaaagcattgagggcagcagggagatggtggacaggaaaaaacgccatagaagtgatcattttgcttttttcagcaaagacggcatcattgttgtatgtcttaatatgaaaaattctattggaaaatacaaaaatgcaatcaatgcctgtgttaaaccctcggaagcaattcgtttcttcatacttctcaccaagtgaaaaaagcagaattgcacacgacaaagtggaaagactgtgcggacagcagcgaccgtcgcttgctcgaagtccaacgatatggtgtcaggtgcaaaatttggccatctttggacaatcagttaaagcatccgtgtgtatatatcacttcacattttgaagtgagaaggcagtacgcaatcggaaaaccccatttatcacgcctaaaaagacaaaaaaaagtggtaaaaattaaggttttactttgtaagtagaacataaatttgactgaacaaaggcggcgccaaactgaaagtgccatctgcgtacacatttttcataataccggcccattccgaagtcgaagcgcgagcaaatatcagaattcttaacacggaattttttaaaaattaatggttttattttttttacctttgcggtccagcctgtccctgaatttgaaaaacgccggtgtccgccaataagaaattctcctcttcagtctctgttcgattgtacattctgtattcaggcggcaattccaatgcttccaaactgagtggtgcagcaggtggtacatcttcgtcatggcgaacacgttttataacctaaaataagtgaacaaatcatactttggcagaaaaattcgtaaaagttgaccttttttgtcgcagctttggtagcaaaagcagccaacacgggggttgctgtattctgcaagacttgcgcacggattgttgcaggcgcttcgcacgtctcaactgcacgccgcttgagctgggtcacgcgtcgctgacattccacttgtgcggcactcatgtcgcatgtgtggcttccaataattttgaggacattaccattaatgtcagtgtgaagtcgccctgaatttaaaaaataatctatattttattttttgcatacacctttgcatttgttgttaggtccgaaaaactcgcagcgccaatacttccgaagtccatcgtcactgatttggtgaagaacataaagtgcaccttcatgttccagcttttgcttgtttcgctttgtctttatttcctgattgcgttgttccccattcgtgtttgtagctaaacatagtattttaagtttttacttgtaaataattgacagaaaaaaacatttgtaagaattatgggcgaaaaggcgaaaacgacttgccagactaaaccgaccctctgactaaaccggccagactaaaattcagaagggttctctctttgccgcttttgcctcccgacattatcagaagagctttctcaattatcgttgcgtcttctcctcctggaatgccagcgttcttcctttacttctctcgaacatacatcggcttgacacagcgccagttgttggatggtgttaacgcatttggagataattcactcaatttttcacccatcggcaaccattgtttgtttaaatttatgcatttggtttccaaaaatttgaatttttagctgcactcgggacaacaatttcgaccatcaactcggaacaagctatgcggctacccctgtacagttcggcatcggctcaccggcaccatcaactcttacatggccaaccactgtgagtccacgggagcagcttgttcaatattcgttgagcccgctatcgacttcgacagcaccttcaggcagaattctttaatcaattcatcccatggacggtaaaaaacgaaaaaaattgccaaaaaataattggcgtaaaacaaaacgccaacacacgcaaaaacaaagtatatgcacttacactggtaaatgccttttttgtattttttattttgatcagccataacacgcttcattcccaacaaaaatgaacaaatttggtatctaaaaaaagattttgaaaaggagaatctttttctaagtgaatgctaagcaatttgacatctcagaaaaaagttgtgatactttcaaatttttatcacgttataactcaagtcctaaactgctgttttcaccaaaaatgctaaaactattaatttctctattgattctaaatgtacaaagtgattttgtatccttataaccaaaattgttagcatttacgaatttgatgttttttcatgtgttagagacatgaaaatagtactccaaaaggagagaaaaagaaatgcgaatttttttcatccccatttttagtaatgt

SEQ ID NO: 14751 - DNA, 2073 bp, Heterodera glycines
  misc_feature (2064)..(2064): n is a, c, g, or t
agagctatctgacagaacagctctcctttgcttcctcgccagatcgctcgctatgctcggctacgcggatgcggagagcgctagtgataataagagactgaggtatgtgctcttcttatctccttttgaagttgttgctcttattttaaacaactttgcggtgttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctccaccccggtgnaactatctg

SEQ ID NO: 14752 - DNA, 1401 bp, Heterodera glycines
tttttttgttttggggggcattccccccgaaaccgatgcgcccagatttatggggaggccgaattcttcgggaatagcttcccctatagtctgtactttaattctgcggtgggatttttgcttcccataaatgtttgagtaccccaaacgggcacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcgggggggggggggggggggtgcagatttggttcgccggtattgtaagttatgaaattttattggggatctgttttgatagagttgcatatttgagaagattattaatccgtcatagaacaaggttagtttataaataaattat

SEQ ID NO: 14753 - DNA, 790 bp, Heterodera glycines
cagtaaatacatacatgttcagagataccatggaaaacaaaaatatttcagcatattttggggtaggtaaagcttaattatctcgtatatttaaaatatgtcaatgcaatgcaattaattaggtaggtggttaaaattgattggacgcataaaaattgaatggacgcataaactggacttgagcctttcccttttttgacaaaaggtgaattaatgattataaggaatataagtcaaacattgtgtctacgcataaattttatttaagttaaccttgtagtagcatttcagagcgatttggctgcaggaaaataactgatgatttggtgacccgaatcgaaaatctgacggggaaaaaagcacatgcgatgttacggcgtcgcctcttcttcgctcaccggtccaattggaactaaattttgttgcttttggtggtggggggggggggaagggcgttggaaaaaagtatatccgatttcaaaaaaacttcatttttctctttagtgaccttacatcaattttggaccggtttgagcagaaaaagcccttctatctttacaccggccgtgggccgagcagtgggagtctccacctcggccatctcatcccatttttcttctgtaaaagtttacaagactcttttgacattccgctgatcatccaggttcgtatttccatcgtcaaaaaggggcgtacgccggcacttcgtcaggggatgaattttctattggcagattaccgacgatgaaaaatttttgtggaaagacatggacctggagcggtctaaaaa

SEQ ID NO: 14754 - DNA, 1424 bp, Heterodera glycines
  misc_feature (1336)..(1336): n is a, c, g, or t
aaaaaaatgttttcaatgatttttttcatgaaattttcttataaaaaattttctaagatttttttcttgaaaatttcttagtttgaaaatttttctttttaaatttctgcggcgatattttgtctcggcgatatttcgggcggcgatattttggggtgcaccctaattattatagcgaaagttggagaaaagctaatcattacgtgcattgactcaaatgacaatttatgattgattttttgagataacaaattgggttttagatcaacaaatatgcgttcagtggcgggagggacacaaaggaagaacaccgccaatttgggggcgactgtaccgtggacacttccttccaattcctgcgctttttcctcgacgacgacgaaagattagaagaaataagagaggtttaaccacaattcattatcatagacttttgcttatggcacccaaaataaggcccttttagttaattatttaaatagaaatagcaatccatcacaattacacaattatttgtacgcaataaattttgttttaagcaatacgcaagtggtgctatgttttccggcgaactcaaggcgattgctattggaattgtgcaaggcattgtgtcagaattgcaaactcgaaggaagacgatcaccaacgacgtggtgcgcgagttcaccacgccaaggaagttggcatatgacttttagctgatttcgtgagaaatactgtttttgaacaaattgtcgaaagaaaaatgaagtgatcgttcttcaaactgttgattttttaatttattttgtttagaattacaaaaaggagaaccaaaatcatttgtgagattgttttgactagttttcgagatcactctcacactttgtgtgttctcctcccggcagaattatggtcccgataaaaaacaaggttaaatttttattttgggtaaaaatgccgtttaattatctggttgtgagctcagagtttgcaaagttattgagtttatttttgcaccaggaaaaacaaaaaaaaattttaatttaatttttaatagggaccacaattctgcggtattaccctcctctctccctggtttcagtcctcttcgctctcctccccttctttcacatctttgatcagttccgccacgtgcttcgcttgtctcagttttccgtcctctccaatcactcccggtttgatcattccctgttcctgtagtttctgtttattacctgtttaatttcttcgaataccatcattttgtccatacaatcgacaagtttcatcatttcatattccttctgctcctcactcattgaatcgatttgcctacgccattcttctagctganagcgcgggtttgatccatcgtgggagtgacaagtaaaattctgcactagaatcgtgtctgtgcccacctgttcgggcgggggaatgaa

SEQ ID NO: 14755 - DNA, 992 bp, Heterodera glycines
attcctaaaaaagcgatttcgacgttggaataataaaatatgcttacatcgctagcttctgccacagaattatcccatgcctctgaacctccattaactttttcaggatttagttgatgataaagcgtcggccatccaaatgccatattgtcctcagagacataattgctgccggcaaaatcacgaattataccttgtcaattaaatgaacttaattagtaattatccgcttatctccttttctactcaaaaaatataatcaatttaaaaaactgcagctttaaatttaatattgcaaaaaggaaagaattgtttatacctttgctagttgcaataccaatgtgtccaataaagggaaataaccaactgatgagggggattggcgtccaaacaatgcaaaaaggataccggtgctggtcagatcgaatattcatggtgtattagtaacaggccattcacaaataataaaattaaaaatgactaaatagtgccatcagtagggctcgaaattatatggactaaaaagctcagaaatggccaaatattaaccaaaatatggactaaaaactgacaaaaataaaattccagtaactcattcgaaaactctttttgaactctgcaaatctgtgtaagttttttacttatttttgtttttcgtcggagcctcaattctgtttattaccgtgaaaccaactcgcaatcaagccggcaatcatttaagaattggtgtcccgaccaaaaaaaactattaaaaatttgtcgggtattttttctaggctaaaaaaatgtgctgatcacgaatctgagctcagattttgaaaatcattgattttatctaagattttttggcaattacttgaattttttccaaattaaagaaaataagtccgacataaaactgatacaaaaaaagctttcaaatgctcttattaacggatgggaaagtcaaggtttgaatttttttccattttttgaaattaatttttaacccc

SEQ ID NO: 14756 - DNA, 1784 bp, Heterodera glycines
  misc_feature (82)..(82): n is a, c, g, or t
ataaagggaaataaccaactgatgagggggatggcgtccaacaaatgcaaaaaggataccggtgctggtcagatcgaatatncatggtgtattagtagcagcccattcacaaataataaaattaaaaatgactaaatagtgccatcagtagggctcgaaattatatggactaaaaagctcagaaatggccaaatattaaccaaaatatggactaaaaactgacaaaaattaatttactaaaattccaaaaatattcaatatttgcttaaacaaacttaaagaatacacaatattaccaaaaaatggatttaaatcttaaaaacgccaaattttttaaacaaattctaacttcataattccaaacggctccctgatatgccaaatattttataaattttttgaaccaaaaagcattaaatttgtgccaaatggtatgaaattaatcccgtaaccccagactcccgcctcatattacctaatttgcaagggaccaataatttaatttcaaaaatcggaaaaaaactaaaaactttacttccaaagagtagtaactcattcgaaaactctttttgaactctgcaaatctgtgtgttttttacttatttttgtttttcgtcggagcctcaattctgtttattaccgtgaaaccaactcgcaatcaagcctttacttccttaccaataacctttcatatttagatattttcagcagcttttttgtattccgtaatgacttcacgaaaattttttgtcggtgggaattggaaaatgaacggcacttttacgtcaatcgctgagttggtcaatttgctcaaccaaagtggtggtaattctgacgtggatatcgttgttgcgcctccaggtcagttggatttactgtggaatatatattcaattatcatttctttaattaagcaccttttcttcaccatgtgaaacaaaaattggaacatggcatccaagtagctgcacaaaactgttacaaagtaagctaatacttggcaaatttggtaaaatgttcagttacaaaggttgccaaaggcgcttttactggagagatcagtccagaaatgatcaaggacgtaggcgcgacttacgttatcctcgggcactctgaaaggcgtcacgttttcggagaagaggacgcattgattgcggagaaagcggcgcatgcactcagcaccggtttaagtgtgatttattgtattggagagaaattagaagagcgtgaagcggagaagacaaaagaggtggtagagattttaatttaatctattatactaattttacgcaagatttaaggtgaatttcaaacagttggaagctttactttccgtcaaaaatttggtctggccaaagatcgtcattgcttatgagccagtgtgggcgattggcaccggaaaaaccgccacccccgaacaggcgcaggaagtgcacggatggatccgcaaatttttgagcgagaaagtatcgcaagaaattgctgagaaaactcgaattatttatggaggtagtttattcaattctctgatatatattcagcgtttaaatgctttttttgtctaggttctgtgacagccgaaaattgcaaagatttggcagctaagcaagacattgatggatttttggttggcggagcatcgcttaagccggattttgtgaacatcattaatgcgaaatcctaaaaaagaaacgaacaattggtgaagggaaagaaaacattgacttacgactactactaattgtaagatgataaaaaggaatcatttatttatacgatatgac

SEQ ID NO: 14757 - DNA, 1130 bp, Heterodera glycines
  misc_feature (1042)..(1042): n is a, c, g, or t
  misc_feature (1054)..(1054): n is a, c, g, or t
atataaattaatattgtgctataagaactgactatttagtcaacagaaaataaataaatcataaaattagaacaaaaaatgattttattttagattgcacacagaagatgcataataagctaatatattcgaatttattttgaaataactgttcaacagattattagttgtttctaagaaataatgataggaagcttatctgaaatgtgtgctcacccaggttggaatttgtcatttcctgcaataaatgttttcatataaaggtttaaaaaatttgatcgggtttaggaacattcaacaaatgcatagataaattttttgaatattatacaatcgtgctttttgctctctatcaatttattataaaaaaattcacttcccttcgaaattgaaggcagaatgctcatttgaaactacgcaaatataaattaatatttgctataagaactgactatttagtcaacagaaaataaataaatcataaaattagaacaaaaaatgattttattttagaatgcacactgaagatgcataataagctaatatattcgaatttattttgaaataactgttcaacagattattagttgtttctaagaaataatgataggaagcttatctgaaatgtgtgctcacccaggttggaatttgtcatttcctgcaataaatgttttcatataaaggtttaaaaaatttgatcgggtttaggaacattcaacaaatgcatagataaatttttgaatattatacaatcgtgctttttgctctctatcaatttattataaaaaaattcacttctcttcgaaattgaaggcagaatgctcatttgaagctacgcaaatataaattaatatttgctataagaatcgactatttagtcaacagaaaacaaataaatcataaaattagaacaaaaaatgattttattttagaatgcacactgaagatacataataagctaatatatttgaatttattttgaaataactgttcaacagattattagttgtttctaagaaataatgataggaagcttatctgnaatgtgtgctcnaccaggttgggatttgtcatttcctgcaataaatggttttcatataagggttaaaaaatttgatcgggtttaggaa

SEQ ID NO: 14758 - DNA, 2537 bp, Heterodera glycines
  misc_feature (2520)..(2520): n is a, c, g, or t
tgttttctataaaggtttaaaaaatttgatcgggccttctaacattcaacaaatgcatagataaattttttgaatatcatacaatcgtgctttttgctctctatcaatttattataaaaaaattcacttcccttcgaaattgaaggcagaatgctcatttgaagctacgcatatataaattaatatttgctataagaactgactatttagtcaacagaaaacaaataaatcataaaattagaacaaaaaatgatttttttttagaatgcacactgaagatgcataataagctaatatattcgaatttattttgaaataattgttcaacagattattagttgtttctaagaaataatgataggaagcttatctgaaatgtgtgctcggttggaatttgtcatttcctgcaataaatgttttcatataaaggtttaaaaaatttgatcgggtttgggaacattcaacaaatgcatagataaattttttgaatattatacaatcgtgctttttgctctctatcaatttattataaaaaaattcacttcccttctaaattgaaggcagaatgctcatttgaagctacgcaaatataaattaatatttgctataagaactgactatttagtcaacagaaaacaaataaatcataaaattagaacaaaaaatgattttttttagaatgctcactgaagatacataataagctaatatattcgaatttattttgaaataactgttcaacagattattagttgtttctaagaaataatgataggaagcttatctgaaatgtgtgctcacccaggttggaatttgtcatttcctgcaataaatgttttcatataaaggtttaaaaaatttgatcgggtttaggaacattcaacaaatgcatagataaattttttgaatattatactatcgtgctttttgctctctatcaatttattataaaaaaattcacttcccttcgaaattgaaggcagaatgctcatttgaggctacgcaaatataaattaatatttgctgtcgccaaaagcgacacaaatttcttggaaattttcatttattttttaatccttttcatcgatcaattttgcattcgctcgctcgttaattatgagtcatcttctctcttcctcatatttttatggatttttttctatttgtttgtgcacatttttcacgtgcctggccccgcccccattgatttgtgagggtataaaagcccggcccattctccattttcctgacttcttgaaaaccttttgaaatgaataacggaaaattgtttgaaaaggaaaagtgcatttcctcaggaatgaaaggaacgaaaattaattaatattaaatggcgaattctgttaaggattgcgttctaaacaaattattaataattaattgaatatattaaaggaattggaattgtaaaggaaaaagtggaaaacaaacaattaatgggaaaatcgcaaaacccaaacggatataacaaaaacagattttaattaaaaattataaattggagcgtactatggtttcaaaaaagccgtataaaaggggctgggttttcagtgatttcagatcgctcattggttccctccgaagtttccattccttccccgtgccgtgctctgcgcctaccctgtgccgtgccctgcgccttccccgtgccgtgcccgtgcgcctttcccgtgccgtgccctgcgccttccccgtgccgtgcccgtgcgcctttcccgtgccctgctcctttcccgtgccgtgccctgcgtcttccctgtgccgtgccctgcgccttccctttaccattcccctttgtgcccattttatcatgtcggattatatttgttcattaattaattatggtttaattacccaagtttgagggtacaaaataaagtgaatttttggcgcctttggtctttaatttttgtcaactcgctctgaatacgtccgcccagcccattcaaacttttttgccgtcgtcagaacgacaaaagtggtgccacgacccgggaccaacagaaattcgttatgatttatttgttttctgttgactaaatagtcggttcttatagcaaatattaatttatatttgcgtagcttcaaatgagcattctgccttcaatttcgaagggaagaaaatttttttataataaattgatagagagcaaaaagcacgattgtataatattcaaaaaatttatctatgcatttgttgaacgtttctaaacccgatcgaattttttaaacctttatatgaaaacatttattgcaggaaatgacaaattccaacctgggtgagcacacatttcagataagcttcctatcattatttcttagaaacaactaataatctgttgaacagttatttcaaataaattcgaatatattagcttattatgcatcttcagtctgcattctaaaataaaatcattttttgttctaattttatgatttatttgttttctgttgactaaatagtcagttcttataacagatattaattttagcttcaaatgnagcattctgccttcaat

SEQ ID NO: 14759 - DNA, 1178 bp, Heterodera glycines
ttttgtttggatttttcacaacaaattttacgaccgatgtttcccttcaattgaaaatgccataaagccagacctttgtcgtccaggagcgccagaaagtgagcgagcgaacgggagaaaaaagtgtgagagaaagcatcattttgatgggcatgcccgcggggggagggggatggggggggggtgagatggaaagctgtggaggggaggagaatatgctgagtggagtgaagatgagatagtgtgatagagagaaagagagacggaggggggggggggtaatgctcgtcgctcattatataaaaaaaatgctggtccatcgattgtgatgaccaccgaacgagtcgttggtcatctccccaaccccattttatttatatatattttgttgttcattttttcattgtaataatatttttttttccaatttagcaaaaaaatgaatcaagcctgtgtacaacagaattgtgtcactcccgtggaggcagatccaaatgttagcaaaaagtcgtggaatcgccgccaatcaaaaggtgggttttatttgaaaagggtgggaaaatcagtttttacactgctgacataaattttcatcgcctttggcaaaattaatcagccgaatttgatgatttagggggcgtaaattttgaaaaattgtggttgtgcgataggggctttgaaaatttgataaattttcaaaatttaaatttttttggggggggggcttgagtttgctttgttttttaccaaaattaaacaaaacatttttttttttgctttagaaacagattctcatcaaaaaattgactgcaaacttcagcggcacacatcaacaacacaacaccaacacaaatggacaaaacgatgatggggacggcactgacaatgagcaaagtttcggcgacggcacatatggacaaagcgatgatggggacggaactgacaatgagcaaaattttggcggcggcggcggcggcacaaatggacaaagcgatgatggggacggcactgacgatgagcaaagttttggcggcggcggcggtgacaacaatgttgagggagagcaggaggggggccagcaacaacaacagtccactgagtttacccgacgtcaaaaaattaaaaaaatatttagaaaattaaaaaaatccttttgaaattaaattttaaattctttg

SEQ ID NO: 14760 - DNA, 3626 bp, Heterodera glycines
gtaattatctgtggataattgaatatgaatgagagaaacgacagatggagggatgggtgaaaaagagggaagaacaaaagtgagacgagagagagagaaacaaaaatgaggtgagagagtgagagagacaaagtgaagatagagtaggtggagaagcgaaaatgtaaaaaagattttaattgcattgggcaggcgaaatggagaaaccccccgagagcggtccagaaaaaacatcaacaacaacaacaacagttgcaattgatgcagaacggtgggccggatgcttatgagctgaaagaagtttttggttattataacaatggatgccaagaggcgtactatgtgtcgtggctcagtgagtccaatttgaaagtgatcaaagtggagcggtggagggggggggggggggggggttggaggaaggggtaatttaaattttaaaatttgacgagtcaatttaaatttgcaaatgattgaaggggagttgtgaggggagggggttacaaaaggatttgaaaatgattgaaaggcagggaaggggtaataaattggacccatcaagagcatcttttaaatttccaaatcattcccgtgtgaaaatttcccttattggtagtcttttcttctatattcaccatttaacattattaggttcccgtttctacagcacttcttctccctcattctatcgcctgggttggtggctgaggtcacttgtgcttgcacatgcagacctccccgccttctcgtctggtggtagaatgcctttccccttcctcattctatcgcctgggttggtggctgaggtcacttgtgcttgcacatgcagacctccccgccttctcgggtggtagaatgcctttccacgacccggttctaacccccagcttcctataaacctatgatgtaaatggtcaataaggaaaaaaaagtactaccaataagggaaatttataccactccttgtttttaagactttcgcaatcgcgaatgggtcaatagcattgactgttacggtctcgaattgaccaaccaattttcgagagaagcctccacccatcagacgataagggcgatgtgcggaaggagtgcgccgcatgagcaaaagaagctgatagttgaggatccgtattttgaaaaatgtatttttttcaaaatttttgggaattagtttctgattttcagttagagaacggtacggggtaggggaaaaattgcttggaggcgtttgaacgggagtgcatgcagcaaccacccgaggcttaacattttgctcattttttttttgctgtccgaggcttgaatttgccatccgatacttaacatttacccatttcttattttttaataaaaatgcttcaaatcattttttcatttatgaattaaaaatggcattactaaaaaatgaaaggaaaatgcgaaagtttagggggatggattaggcccaaaatagacaaacttattacatgtagtttgacaagtcaaacatttgcactgatcatcccctgaccatacgatcgagcattcagcgcacacattcacatgtgcgcaccattcactcccaaacatcggttcgtcgatcagacaaaacatgcaatgtggctcccatttgggagacacatcggaggtgcgaacggatgttggttttgtcattgttgcggcgcggtagctttgcagtgcgaggtgtcggcagcgcatatgttgctcctctactacagagcgtaactgttgttggcctctttcacgttcagcgtgtattgcgttgttcaaactttgttccattttgcgctccgcatcagcgatggcaaattctgccaattcttttgcctcggccaccttctcttccacaagtgccttcattttggcctccaaaaaatcttttttgaagctttccattgccatcccatctgaaaaagcgcactgttcccagtaatattacactacccttaccggaagttgcggccgatgttgctggctcgtcgtccacagaaaatcgtttgttgcgtgttggtgaacgaacaaactttttgtctttaccttgttaaaaactgtgatcacaaaaaacattgaataccttacttccccggcccaagcctcaagttgctcaagtctgaagcggtagttcacaaaatgatgacgcatctgcatcaattttacggactgtgcgccaataatttgtttcagtgacgcaatttcactttcaaccgatgcggaatttgcactcatttttattaaccgtgaagagggtgggagataaaatgcaaaaataaggaaggaaaaggatgagggcagagtgtgtgaggatatttgccgaacaacacaacaacaacaacaaccatgcgatgtagctgccgacagatggctaccttcccccccccatccccagccaccattgcgcaaattgaattaaattattttttattagttgagggcaaatcacataataataataaaagaaaggtatcatgatatcattaggcttgatcggttgaaagttttcgtttctttgacggagtcaatatgtccgttccgttgcaattcacacgagcacaattttcgcacatttcgaagtttagggccacacggtcgttgtccattcggcgaactttctctttgttctcgaacagattccgccagtcatcatcgcagagataaattgccaacatatatttgcctttgaaaattttccacagagctcgctcgtccacttttgccttttttgggcacgaaggttgagccaaaattttttcgggagatgatgatgatgacattttgtaaaaatgattttggggcttgagcgggtaaatttaatctgcttaaagtgggcggagtcctaattctcaggtatataaatgatgccgagtttaaacaaattatcattttatgaatctgaaatggtactcgtcaatgtgttttgtgctcagctattagactgtcccgtcaagtcactgcgcgaccgacttaaccaccccgaagattgtgtaaatgcgatgaatggattgatggggaagaaagttcgaacaacctacaaagatcgcaatgggatgcacaaaaccttttttgtcagcggtatcacggagcgcggtgcagctttcgttccggcttatggcaatctacgggcaccatacaacgtaaatgtggccgcttacttttatgcacggcatcccataaagctccatttcccttacgtgccttgcgtaattgaacgcttttccgggagaggtgaggaccgtttctacccaatggagttgctggaaattgtggatgaggaaaacaaagggagattgtttggacgaatgtttatggaaattggtgaagatgatgatgatgataatgacgaggatgtttcaacatcctttgactcaacactacgatttgatatgggacgcgatgagtgttcccaattatggcgatgatcaatatttgcaatattcatcttctattactaaactatgcacttttctacctaaaaatagcattttcacactcttaattatttaatcaatatattagtttttcactctattaattcggcatttttctacccaaaacagacaacttcttttttttcatttattcaaattcacaaaataaataagaaaatgtttacaaggtggaccaaagtt

SEQ ID NO: 14761 - DNA, 1525 bp, Heterodera glycines
cctcgttcggaaatgtgccaactccgtccaaagtgccaacccattgacttccatcccgtacgtccccagcagtgcaatggcactcgccggatttatcagcgaaaaattgagcctacagtatgccttgttgaacccggcgcatttacggtaggttgcaaaagtctttttgaaaaatcaagaatattctctggaatttaggcgttgagtgaattggaaccgtgcccaccgtgtgcgcttgggatgtaccgtaacccgcagagcggcgaatgccaaaaatgcgccgagagcgaagtgtcggaggacggaataggcaattaaataatacccctaattagcaagcacaacaattaaaattaattccaatcagtgtgtaagcgatgccctgctgactcgcagcccgagttcgggctgttcatcaaccgatgggattcgtttccccccggcgtgacgcccaaattcgaatgcgaattcgtttccgccggtggttttaaattttcttttggttttaattatatttaaatggcccattcgaattcattcagatgaattggccggcgattgccgtgtctctcccgcttggatttcgcgcggcgaccgtctcgaaagtgtgcagacgcgtttcacgggagtggcgctggaaatgagcagtcagtcaaacaattaaatgaatgaaatcagccaattcttgaataatttaagtaaaatttacttcttttttctctaattctttaaaaattactcaaaatccttaaaaattaacaaattttaacaaaatgagcggcccttttggcgctttctctacaacaaatttttttgccgaaaaatataacggaaaaatgcagcaaaattttcaaaaaaaatattttaagcttttaaatttatttaaaaatccattttaaggcaccatttttgaagtcttttgtgcttttggaatcttctagattttttaaattttcatcttccttagttcaccttggcgatggctttttcgctccgctccattcgggccgcgtgtccgctgacaatccgcttgcgctgatatcggtggagttggagctgatctgtgaggacgactcgtgccaattttacatcgttcaagtcagcggacgcatttaattgaattaattttaatgttaaattaattaccgtatctgagaacgatacaaaacattcgtgccaacattaaaaggaactcgacccgcccgcgtcccccgctttgctcgcacccgccgcaaatgcaccgcgtggcgaactgcaaatgttggcactgctcaacggcactcagccgcgccgaatgctgcaggtagttgatttgaaaaattgatcataatccccctcgctgtatgtctgttcaaaaccccgttccgtccgtcccttttgggtcgccgctgtgaccaccgctcgtccgcgtcgtctcgtgttcgcgttcatgcgctccggtgcggtgttgggccgtgacgcgctgtccgaccgtgcgattctgtacgcgatcaacgcgacgaacacaggcgacgcgcaacggcaa

SEQ ID NO: 14762 - DNA, 2098 bp, Heterodera glycines
tggggacaaaagggcggacgacgggggaggaggacgacgaatgcattttgacatcagtgcattgcgcgaaacggcacttaccgcacgggtgggagaaagggggaggcggggggggggggaataaaaatgtgccgaaaaacgataattaggacaaaattttcgaatggttcggcaattttggcactcaatttttcggcccaaagtcattccgacatagacagaaaccccaatgagaaaataggcgaattttgaattcccgagtcgagtcaacaaaaaaaatcgtgacggtcgagaatttgacatttccaacggggttttcagggcattcgtgtgttctccagagacggccagtcctatgtgcacgtgttcaacatgtcgctgttctccgatcggcacgtgcaatgccgtgacacacttttggccgaactgtccaatttagtcggacagacgccggcaaataatgacgaggacagcacaaacacagtgaaaatgccatctcttacattttttaattctaaatctcttaaattgaatgaaggatgatgaggcgatgttttgccgatgggctgctgttccgattgtcccttcggccgatcagtccaaaaatgagacgccattgggcgccgaactgttcgtctcctccacaatgttggcaaatttgcatttaaccctgtgctaattttagttcatttaatttacagaatttcgcgcaaattggcactgatcacgcgccgaagacaattcggggctttccatttgtcggatgatcagttggaatatggtaaaagaaaaattggaaaatgatttgaagatatatatcaattgactgattaaaccgccgctgatagggctttttatttgcccaattatcagtcctcgtacagtatttataccgtatcgtatgaccaattagggcatggtaatagacccctaattcgatcgtaatatgactgactatccaattataagtttgggtacggtatttataccgtatgactaattagggtatggtaattgcccctaattcgatcctaatttgttgtttttgttttactgagtctctctggctaatgcccttgctcagatccggccactcctcgtgaccaccttccactcgacgtgcacttcttcttccacccttcctccccttctccgtcttcttctgccgccgttttcctctccaattgtcccaacggcactttgggcgtcgtcacagtgcgctgcgagccaagcgttgtggcaaaaccattggttgctttttttattaattaactttatttaattttaatttaaaatttaattaggcccgcctttcacggcattgccccgatgggacgtgcgacgggtgcctttaccacgtgctggtggagacagtgcacggctgtccgctgtgccgtgctgatgattttcgcgaaattcgcggcgaatgtaacaaaaatggaggggggggggaagggataatggttagagatcgacctggaaacctgaatccaggtctagattttcctgaaaccaggtccaaacatggaatccaggtctaggctttttcaaaatgtcaatctttaataatggataaccgattgatcggcccgaaaatggaaattttaattttaaattgaaattgaaatttccaaatttaatctttgccaggcatcgacgggtcccaaagtgtccattcgctgccctccaaacattgcgctttgtcgggcgcccaaacgcgcgaacggacggagccgtgccgggtgattctgtcccaaaatgtgcgccttcttttggcggttgccattgtgctgatccttttcctcagccttatcatcgcggccatttaccggcgaaacaaagcgtaaaaattaaaaacatttaattaatttatataattttaattgattttagattggaatatcgttatatgcgtttggcggaagggcgagaaactgatcagagcgtgaggacgagctgtgcactgatcgaaagtgatgtggacggatcagaggaagaagaggaggagggcgtaaaacagcaagggcaaaaggtgatcagtgaacaaaaataaagagattgatcagccagcaaaaggcaatgaatgggtagaggaata

SEQ ID NO: 14763 - DNA, 2251 bp, Heterodera glycines
ttttcatttattttgctaacagacaatacaatggtggggtcctaaaataagatttaaatttaaaaaaaaattgaaaaccgtttagccaataactgaagcgagtgcaatcccattatcgtgcggcgtacactccccttttttatactccatttaaacggaataacaacaaaccacttgtttttcttggttagcatagcgaataaatgcaacatggtcctttccaagcaattcacttgaatcaattactacctcattagtgttataaacatggagcggattttgttcgttgttgacaattaagaaataaataatatgtttatagttttggttaaatttgaatgttatgggatcgccgaaggtcattttggctaccagtagcagaacaagagtggttacagtcattaatgataatgggagcatttttttgaaatgagtgaaatgaaaatgaaaatttgttggcaatttattggggaaaaatattatgctttctatatatttgtattgatttatatttttcttgaatttaaatattatttctttctatggataatattagtgaggattgtaatattattttgtgaaaagaagggttgagtgaagtggcagatttaaaaaaacacaagtctcaggttaaaatcgaacacgaaacctttttttgggggtttccaatttccgtaaaatgtaagaaaaaagtttaaccataaagttttaagtcttaacttcaggcgcaaaattttttagcaaatttgtataaatttttaagaacatatttaaatttaaagaataaaccagcttcgttaaagctttagcttttttaacattttttcacatttctgcgatttgtttttcgttttttagtaggaaaatttcactcaaaacatttattttatatataacaaaatgttaatttatctcaaataaaataataatgtcttctcgaatttggtatctgttgattcttttcgctggaggcttatgcggtggcggaggctgcgggagcggctggtaacttggcggttccggtgcttcttaacttggtggggcaggctcataggctggtggcggcggaggcggtggtggcggtggaggaggcggtggtggcggtgcggcaccgtagcttggcggctctggttgctcatacgatggaggtggcggtggtggaggaggcggaggtgggggaggtggcggtggagggggaggcggcggctttattttagaaaatttaagcggtagccgaaaaaataggcaaattaggagtggtatcagcttacatcactgatttcgagaattattatttcataatttttgggcaaaaactcatattttctgtcagtgatatttttatttctggaatttttgttggtaatttccattgcataaaacacttttgtctggtgttttaaagtaaactttttcagttttattctttattaatttagcgcaaataaaattaatttttgaaaatgtaaaaaaattattttaaatgaatttaatattaaataatttcataatgcatttaaattgtgttatctacatcttaaaactttagcgtttgagatttataattaatatggaatttccgcttcaaattcaaaaattcacacgcaacaccgatttctcataagaattgtgttaataaatgaaataaaataaactataaagatcaattttgtattaagtatcagacttccggcgcaaaaaaaaagaatttaaaaattttttctaagttttttgaacatatttaaatttaaagaataaattgtttgttaatcaactttgttaaagcataattattatagataaagccttttttaacattttttcacatttctgcgatttgtttttcgttttttagtaggaaaatttcactcaaaacatttattttatatataacaaaatgttaatttatctcaaataaaataataatgtcttctcgaatttggtatctgttgattcttttcgctggaggcttatgcggtggcggaggctgcgggagcggctggtaacttggcggttccggtgcttcttaacttggtggggcaggctcataggctggtggcggcggaggcggcggggctccgtagcttggcggttctggtttttcatacgctggcggctgcggtggtggaggcggcggtgggggagggggagggggaggcggcgccggggctccgtagcttgggggctgctgtggctcattgcatggcgcttctggtggctcgtacgctggtggtggcggaggcggtggagg

SEQ ID NO: 14764 - DNA, 865 bp, Heterodera glycines
ggaggcggcggcggtgctccatagcttgggggctgcggtggctcatagcttggcggttctgctggtggctcgtacgctggtggtggcggaggcggtggtggcggaggaggtggcggtggaggagctggctcgggtgctggcggtgctccagacgcgtcgcgttttcctctgccgtatttgccgtatcctttagatggaggctgcggttgaggccttaaaataaatataaattttaataattatttatttttgagtgtttttacggctgtttctttccgcaatcgcttgggtagttgcacacttggtttgcctggtcgaacacaagccctttcgggcagttcagcttcgtggacacaccgcctgagcatgcgtagtaaacgttggacgcgcaatatttaggcgccgacagtccctctcctttgcctaaaatataattaatggctgctttaataatcaaaagaaacaatttacatttttgtggtggtgatggtgggtacggtcccggtccgggcggcggcggagctccatagcctgtagtgggtcctccgtagcctggcggtggcggaggcggaggtggtggtggcggggctccgtaagttggtggaggtcctccgtaacttgacggaggcggtggtggaggcggtggtggcggaggcggtggcggaggcggtggcggtggcggaggaggcggcgccgctccataacttggtgggggtccaccgtaacttgacggaggcggtggtggaggcggtggcgcccctttcccgtcactgagcacgacaggaatccccacaaaaaataatgaacaaatgaccaatggagccaatgaaatcagtttcattttgactaaattcaaatataattt

SEQ ID NO: 14765 - DNA, 1709 bp, Heterodera glycines
  misc_feature (1576)..(1576): n is a, c, g, or t
aaatggaaagaggatttttggtgggataaagaaattgaaattgcctttttgccaaaaatgaaaaaattaaataaaaaaattgggtacgttatgaaattaacaatttttataaaaataggagcgatttttcagatggaaaagagtgaatttggatttaatggtcagccgaatctcaaactaaaaaaagccattttcatttttaaaattcaaaaaaagattaaaattaaataccgaattacgtaaattctaaatcaaaaaaaaaatattcagaattacaaaaccatttaaggcatgattataagaattttttgtaggaataacgattcaaattgattttttcgcataaattaaaaaatcggctacattaagaaataagcaatatttcaattttcttttttgacgaatgtgaaaaaagatgaagcaaaaaaaatgccatgcctttgaatcgatttatgacaaagtgaagaaatatattcaaaggcaagaaaaaatcatttatctatcataatatccgctgacacacaaaaatgcccaagccacgaaaattttcaaaatttttgtaaacatataaaaacgcagaattaatttcttagggggcgtaaaactgaaatgacaaaattttattcaaaaagcaacaaaattagccaaattaatattgagattcatgctgcaaataagtggcaattcgagttgttcgggagatagaagacgtcagcgattgtcagttaaaatagttttgtaaattgaaaatctaaaaacattcaaatttaggggggtgtaaaatgacaaaattttattcaaaaagcaaaaatttaagccaaattagtagtgagatacatcgttgtaattaagtagtatttcgagttgttcgggaggtgagcgattttcaatcaaaatagatttataaattgaaaatgacggtctacctcagttcggccccgcacggttcggccccagccgattttttgactataacttttttctttgccaaccaaatccaacatagttgctatcattcgaaagcttaatgggtttagaagctttttctaagctattgcttggcaattagacaaatatcaaaaaagatataacatgaaaactaaaaaatcaatatttttgaagttttttcttcataaatttttttaaagcttgaaatatttttgctttttgtaaagctaatagagcatgtgaagagcttttttagaatgataccgagattgttggatttggttggcaaagaaaaaagttatagatcaaaatgatcattcggcatcaaaatgccaaatagatttttaaatttttttttggtttttaggttctaaaaataaaaacctagaaaataggttctaaagactcgaaaagtaacttgttttcgtgcctttcaggtcaccgggagctcaggtaaaaataagttaaaacctaaaaatatactgatttttttcagcccgatgttctgattcgagatttttcgatgacaccactgattacgtgctgggtcgtttcttaaatccgccaaggggtaggaaaacaaaaaaatgtaagacacataaattcataacctggctctatctcaacncaaattaatatttcatggtatcattcaatagctcttgtgttctctatcagaatattcaaatttccaaaatttgcttttattttgccggattcaattggataagtaaagaaaaatgtaaaaaaattaaatgcca

SEQ ID NO: 14766 - DNA, 2048 bp, Heterodera glycines
aatggaagaacatgaacattcgtccgtcgctgagcccagcggaattggacgcacgtcgacagctgcagaaagaatgtgcagagaagcgaaaagacggaggtgactgggtgatctatgctgggacggtcggacattcccaatttccgcaaaatcaattgacttatccccaaatcacttttgacaaatacatatttttcaccaaataagaatatcttttccggtcttaagcatgttaagcccaataaaccaatgatgaaaataggggaagttaaggtctgcttagttaatataagatcaatccacaacaaaattgatgaaatcgctttaaatttggtaaattaaaacatagaaatttttctgttaactgaaatatggacaaaggaggaaaaccaaatcctctttagtccatggataatcgaaaactataactttatttttttgtcatagaaaatctcaaaaattaacgcgtgggggtgattgcggtgttttaattaagaaagaaattgagtttttttattaaattttctgaaacaaaatataattgcgaaattttggtttttcaattacaaaaacgtaaatcaatcagatttgtgcttgtttaccgacgacccaagacaacatatagacaaaccaaagaactttttaaatttttagaaacattctatagccataattgtgttgtgttgggtgattttaatttcccgaataaagacctggtatggaaggaagggcagccctattctatgagtaaatttggtgaaattttttgccacttttttagtaagcttccttttttaatcgccacgaatggactcaccagggaaaattcgtggttagacttagttttaccagcgaatgatcaaattgtaaagcaatgtactattgaaggtagtgttttttcctctgatcatttagcgcaaattttcacattgactattccaaaaacactacaaaaaacaaaattcttttacactcgacgcttttctccgtcgaatgtgtccctttttaatattatgatttcttctagaattagcgctttatccaataagcattttactgtaaacgaaaaatacaacgcctttaataatacactgctagaaaccttaaacgagtgtattccaatgaaaagaattaccaaaaaagatatgaccctaaatatccaacgcatttaattgcatcaatcagagagaaagccagactgtataggcaatgtaaaactgatccatcaaaaaaaacactatatgatagcattagtttacacataaaaatacaaacaaataaatttcattctcaaattgaaaaaaggctatttcaaagggaagaaattctatctttaaatatatacaaaaatacgatgttaatccctttgaaataccaaatttagtttttgaaaacaaatgctatcatgtgtttttccacgataacatactataaattttttctttggcatccaaatccaacatttttggtagcattcgtaaagcttaacatgattagaagcttttatacttcgaaattttaaagttttttcttaataaaatttttctaggcttgaaaatcttttcgctttttgtaaagctaatagagcatgtgaagagctttcgaatgataccaacaatgttagatttggatgataaagaaaaaagctatagtggaaaagcatgctggggcccaaccgtgagggccgaactgacgggttccggccaagaaaccttctctcatttacctaaaaattcatgattattttgccgaaccaagtcaataaaacaaatatagccagaaagaaataccaacagtagaagcaatcaaattgaagaagtttattttttttaaagtcaaaatcagattttttacctttctatgttttgtcatggcacattttaaagttaattccatgattttgctattaaattttcataaatttatcacaacagcaaaaaagatgaagataattttaaaaaataataataataatctcacgaaaaattagcacccgtctcataaatcaatcataaaattgaagtgaatttctttttccatctgaaaag

SEQ ID NO: 14767 - DNA, 3635 bp, Heterodera glycines
  misc_feature (16)..(16): n is a, c, g, or t
ttattttcgaaaaatntaagaataaatgccaaaattattcattaaaaataaaaacgatattgcacaaaaattcatttggtatttttcttctctttctttttcttatctgtgattatatttcagcttttaccagaattaatacacattcattcgaaaggcaagtaaggaatttggcgcacttttctttgggcctaatttttttttgtataaaaaattttctaccctatagacctaattattcttttggaagaatggagcctgtgttaaggattttttaaatttttctaagattttaacatttccgtttttaaattctttgttttggttttttcttatgctcaaaagcattaggataatctaaaatataataaaaactatagtaaactctggtacccgaactccgagggcaaaaaaatagtcataaatttgattaaaattcactcactcttagtttccaaaatattttttcaatttaattaattgattttaagaaaattctcctatgttcacattaattccttcaacaaaatttaattattatttataattacaacataaaaagcaccaaaagaaaaataaaaaatgggtagtgaatcattatttttgttcagaaaaaaattcctgtattttttgtatacatattctttatttacacgaaagacttacggagttgtctaatttttttaattccttccaaaaccctttgataatttatcctaagaaataaatatttctaaaagttcctatataaatcgggaacaaaaaataaaatatatacaaaaaaaaatgatttttttgtgcacactcccagtctatatttaacgcattaaaaattaccgtaggacaaaagaatagaagagggtggtttattttcctaaaattattttttatttttggttcatcatttatgtggttattaaaactgcttcttattccaatcatttcattcctttatcgattaagttggaccacaacaaaaaaaacggcagcgtactgcgcagtaaaaatagcgaaccaatcaatacctataaggtacgggattgatgcaaaatctcgagtgccttctcgagtttactgtttagcgggagaggcctaaaaatacgaaccttttaattggggagaaattgcgaaataaggaaccaatcaagcattttattgacaggttgtcagctgacacctggcacgtgactagcgtctcagtgaatatttcactgacagtgcggaatatttcgttgacaaatgttacattttcgacgcacgggcagaatgtcacgtgtctattgtgaaatatgcaacaaaaaaaaagtcacgtgcagattgagaaatatgcaacaaaaaaagtcatgtgcagattgcgaaatcgatggggaaaatgcaaaatagggaaccaatcaatcaattttgattgacaggtgacctaattttggtcaatattgcgaaatcgtgaagtcacgtgtaaattgcgaaataatggaagagaaaaaaagaccatcaattatttcagaaaattcaatttcattaatttaaatgaatttttatttattcaactattgtccaattaatattcctatatcatacaattaattcgaatttcattgacaattttggtgcttatcgattttttttcacgactcggaatcgcggcgcatcgacagagcgatgagagtggcggtctcattatcgattatttttttttgcgcggcagcgacatcgatagggaggacagtgctagtgtcattatcgattaatttgcgcggcgatgcatcggcggggagggatgggcaaaaaaaaagcacccgtgcggatttgggaattggattgggtgggcggcaacttcaaagggatgcacccctctcataggcacgggtgcttgcgcggcagcgacatcgatagggaggacagtgctagtgtcattatcgattatttttatcgattaatttgcgcggcgatgcatcggcggggagggataggcaacaaaaaaaagcacccgtgcggatttgggaattggattgggtgggcggcaacttcaaagggatgcacccctcccataggcatgggtccacgggcggcaatttcaaagggttgcacccctcccataggcatgggtccacgggcggcaacttcaaagggctgcacccctcccataggcttgggtccacgggcggcaacatcaaagggctgcacccctcccataggtacgggttcgtgcggtaaacacccgctcggaacccgctcgcttttgacgctctatactactaatgatcaaattttgtggtttttatcatttttctaatgagaaataagagttttggggcgccgctgagaacagtttttcatcaaattacaaaattttgcgattttgggccattttctaagaaaaaataggagttttgggggcgcggcggtgccgataggcgccgccggggaaaaaaaaatggaaattttgatcatttataaacaggttttcactgaaaattagccaatttataggtaaaatttttaaaaattttatgggaatttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctggcctgtacctattttttctgtacataagtacaggaaaataaatgtacaggaaaaatccaggttgccgaaaaatggcctgtgcctgtacctggctggatccaggaaaaatacagggctggatccaggtacatgttgatctctaatctacacccataaaacacagtcaaaatcgggaagtttgaaaaaaaaatctagggggttgtgaattttttgaaaatttgaaaaacccattggaaggtaaaagtttttcactttttttgtaaaatttttgatcaaatttttaccttttttaatttttggcttcgcgcaacgagcggcgccaaaacgaccctggcgccaaaacgtgggcgccaaaacgtgggcgccaaatcgtcggcgccaaaacgtgggcgccaaaacgacccagtccccattttagcgtactatttctttatctctattaaaagtgaaaatagaatgtgtttaattgtaatagccaatttaaaatttcccacgccagtagcttttttaccaagtatacaattgctttgacaaatcttctcctcatcaagatatattcttgttgtgaataaattcatcattacttaaggtaatattcaacttctattaagtcaaaaattgatttggacaatcctgctgatgatcaatcaccgttttgaataattacattgaaattgccaatctttgggaagtgtgataattaaataatgacctcatttgacttttaaagttttaattaatttggcattttgttttatttttttgtgtctttcattttcattttatgtttttttcactcgtggcccggacttaaattggtgatgcggattgtgtgtggtaattttaattgtgcttttaattgttgtgttgtttacatttaattgatttggattgctgtggctgtaagtgatttaaaaagtcttccttctaattcttctcccttcgcccgatttgggaattcggcaaagagcaaaaaagacc

SEQ ID NO: 14768 - DNA, 3101 bp, Heterodera glycines
tttctggatgtaaaccgaacaattcagggatagacgccattatgaaaaattgccacggttttttttggactcaactgatatgtcaggcgtaataaataaacacctgaagaatgtcgccggagaacagctcgcgcggctcgttctcctccccgctggcgctcaaccgttcgttgttgatgaatgtgccgtttgatgagcgcgtgtctttgatcatgaaatgaccggcgccattcgcccacagaacggcatggtttcgtgacaaaaccttggtaattaaaattttttgtttaaacagtaaaatttatgaatgtacgccgataaatctgggtccaggtccagatttgggcaccaaaaacctggatttcctggatgatatcttaccaattagaatttgttgtttcaactgaccaacgtttcatttcgagttatcaaaaattgtttaatggatagttcgagatatttcaattaatttttcaaacaattgtttgccttttaaaacaaattaaaaagaaatccaggtccaggctaggcttggatccaaggtggggttaggataaaaataaatttccaatcactttgcagtcaaaaatcgcgttgttcgatgacggctgcagtcggaccaccgatcggccaattttcaccgcgtcttcctccgtccgtgtgaccaaaattctgaccaaaaaatgatgttattataactgtacgaataaaataaaatttagcaaccaattcaacccgggcggatcatcaaaatgaaacagcaaaaacacacctccgttcctcaaaaggatgtgagttgctgcagggcgtcaaaatgcaaacaggaaaaccggtggcacttgtggccgccattttgggtcaatttagcgctgtttcacaaacaaaattaaataaaataataaaaatccaaatccatcattgatgacagaacaataaaaagtttaggcaacaaaaaaatttggcagatcgtaacaaattttgaaaaataatttgtaacaaatttttgagaccaatgaacaaaaaaaaaataattagaaatgaatgtaaaattgaaattgcatgaatgtgccaaagtgtgtgtcttaagcattctcctcatggtacgccgaatgttccactcgttgcagcgtcggataatacacttggaactcaaaatgtgtgcccagtgaaaaggggcccgggtttattgtcagtcgtcgccgttcgtccgctggctcaaaaaaggctttgaaacgatcagcgatcactaaatgtttggaaatttgaatttaaacaatttactgaacaaattgcattgatttccaaaaaaaaatttcccagcggcgcataacgccaccgcggaaccatcattttttacaaatattttttgaaaatttgacctcaaaaaagcgccaaattagtaattttttgtcaaaaaaaaacactacaaattcatgctttttcttcccagcaccgaaaattttgaaaaacaaaaccgataaatttcatgtatattcaaaaacattttctgtctgttgcctgaacccaaaattttgttaatacacataaaattttccattcaagatatgattggccaaaaaatgtaaattttggcaaaagtaaaaaaaaaattgttgtcctaagaaattgaggtttggtggtcattgatttgattcgtgtaaacaccaattggaacatagtaataatgtcaccaatctgaatgacttaccaagagcatcaggagacgggaacagttgaaacagtgggtcaaaatggggttgaattgggttgatgaacagtggcaacggcgagaaatggcgttgggcccaaattgtgtcacagaactgaagagtagagccaaaaaaatacaaaaattgggtgataaaaatcccatttttgcaccaattttggtattcggctggccatcgcgttttttggcatgaaaactgctgaacggcacaccttctccaccacatcgtcacgaaagatgacaatgtgccggtccttgaacaccaatttgcatgggttggtggcaaaatgcacatttttagcctccttaaagcatttttgtatcaactgcaacaaagtgggcctaaaaatgggggaaaaccggtaaaaaatggctaattgtttttttttgtaatgcctgggaaaaatttgcaacggaggcgcatcgtcagcacttggcacaaaaatgaattcggtggcgtggtaagcgtgcgaaaattcggacaaaatgtttgcaaaatgcctgaacgcgttggccgcctgctccatgtaactgtgcgcccgttgaatgccgagaaaagggccacaaaatacgaactttttttggggaaggggtttaaattaagaaatatagacatgacagaaaatgcttacaatgttcggtggactggctgaaaagccttgtaaaagatggtacagtgctttcaataccttaaaaataaaaaaatgtttttctagcggagcagattagttttgctgacggcgatattttgaagtgcatcggttttctgggcctaggcatcatcattaattgactacttttaattaagcctcgccacccctcccctgcgccgtggatgaaaaattcaattgcaaaaactttgagaccacacaaacccgctcattgtccaaatgcacatcggacatcagcacaattcggtcattcggatcgccgcgtgttcgccgtgccatttcctgtgtacgtgttgcaagccccggggcaccatcaaccgattcagcggattccaaggtggtcatcgtcggcaacgccatccgttccacgtccaagcggtcgccacttggggaacaaaggccctcaaacacaaaagtgccgccttcaaagtaaaggccgtcgtcgtatgtgcaagtgccgagatggagacgaacactgccggtcaaatcctctgcaaaaatttcataaaattttagtgcattccgtctcatccttggttctttagggataaaattgttttgggtgtgaattgtggattggtcttggaaaccggaacactacaactcgccaacaaattttttccggcgtccgagccaggcctgataattaaaaaaaaaaacctggctgattattgtgttgccctgggctggtatttccgtaa

SEQ ID NO: 14769 - DNA, 3144 bp, Heterodera glycines
ttaattaattacttttagatttctgtttcattttctcgtttagaattggttgtgacgaggacaacgatgaaaattgtgctcagctgaaaataaccatcaaaaattgcaacggaagagacgacttccgacggccccaagtgatctccgtcccggtggccccctttttgccgccctttccgccccctcccccgcctcatctccccccgccgctgccacttccggtgccgtttgcgcctctgccgccctttgcgcctccgcctccgctccctcctgccctccctccccctctccctcttccgcctcccgctctccctgcccctcctttccctctccctcccccatttcttccctctgttcctcctccttccccttgtgttgtctccccattctttgttcgtccgccacatcctctcacaacttttctaatatctgtcagaccatattcgaatcagttcatccctccccctcccgctgctgcttttctaccggcctctcctcccattccgtcgccaatttacgcccctcctcctcctcttcctcccattgttcttcctccttctcctcctcttcctcatcctgctgctgttcctcttgctccgccgcctcctctccccctgccagtagttgctcctttcccttctcctccgcccatcgccccgtcgcccgaacaaatttggcaccctcctccgatgccgttgcagcccccactcgccccctccgtgccgccttgccaatttcggtgttgccgtcgttgtgacaattgctggtcaccggtggctttgttcccatgcgagggaaggggagaagccgaaagtattaaagtggaagacaaagtgagagaataattaattaatgggaattaaggccaacgggacgaatgctgtcaaaggagaaggagaaaaaggaagtgggaagagcaaaaggaagaggaagaagaaaaggagggccattaaaaaagatggcatttaaacattctaatggaaaaggaaaaaaggacgagaaaatcaggaaaaagcacccaaaaagcggcagaagaagaagaagcgaatcgacatttaaatattatatttcaaactttattcatctttttgtgtaagcagtgcatataatttgctgccctaattagaaaatacaaattaatttttgaaaaccagtgccctacgggcactgaaagtgacgattttaatttatttttaaaaaattgaaatagcttcgctattaaacactgtctctatagggcgctacgcgccaaaaagctttataagagggcaattagatttttttaatggccgggaatatcctctttctcttcctcttttcctttctattgccctcctatttctctttctgttcgtcttttgcttctcttcctcttctgatcctcttctcctttcccttctcttcctcttcgcctcccttcctcccttcctcctatcttctcctcctgttcctctgtccctttcccttcctctttgccttctattcctcttcgtcttctgtcttctcctcctgttcctcttccccttctcttcctcttcctcttcgcctttcccttctgttcctctttccctttatcttcctctttaccttctattcctattcctcttcgtcttctgtcttttcctccagttcctctccccctttctctttccctttccccttctcttcctcttctcctgttcctctttctctttctcttcctctttgccttctattcctcttcgttcctcttcgcctcccttcctcttatcttctactcctgttcctctttccctttatcttcctctttaccttctattcctcttcgtcttctgtcttttcctccagttcctctccccctttctctttccctttctcttcctcttctcctgttcctctttctcttcctctttgccttctattcctcttcgttcctcttcgtaaaatttttgatctggtgaagctttttagtccatataaatccatattttgggggtttcgggaatattttgcgttttagaccatattttgaccattttttggaaattttcacaaaaaaatgcaaaaaagcgaaaaatatacccctaaagatagactttttagaaatttttaaaaaatacacccccccccccgaaaaagagaaatttttcgatattttggcaaattttcaaatattttgttcgcttccaaaaattgagggtttaaaattaaatctttttcaatttttaatccatgttttggtcgtatttggccatttttgagctttttaatccatatttcgggcattttagtccatatttaatttttttataaattatttagatttgtataattattgttttatttttttatttgattaatatttaaacttattttaaaatttaattaaaataaattattttttattaattttaaataaacgattattttattttataaatttaattaattgacaaaaacaaaaaaataaattaaaaaagcaaaataaaggtgaattattttcattcaataatgagtagaaacacacaaaattaatgggactcgaacccatgacagcatatgaccgacggcaacacataaccacttgaccaccggcgggtcgcacgccgtaatcccctttaattggagaaaattgtttcattttttgatttgacccgttgtaagacatgcaaaaagcgttcaaaaatggggtattcaaaaaaagtgcaaattttgccccatttttcgaatacagttcgaacagttctaaaccaatcggaactgctatagtttttccttatagcccttgaaaaactgcgtcgattgacccctctcgcgacccgtaaaactcgctaaaaactctcaaattagctcagaagcttgaaacaggggtgcaaacttcttataaggggaatttgaaaacaattaattaaaatacgcgttaatttattagtatcaatttttagaataaaaaaaagataatcagagaagaattgagaatgtattttctgcttttaaaaatttgtcatttacaagaatatattttttgttaagttgtttcctgattattattgcaaaatgttgatttcaaattaaagcattagtgaaaatcttactttaattgtaaaaataattaccgaattaaattaataaaaattcttttttttatgtaaaaataattgcaaa

SEQ ID NO: 14770 - DNA, 4780 bp, Heterodera glycines
  misc_feature (4756)..(4756): n is a, c, g, or t
  misc_feature (4774)..(4775): n is a, c, g, or t
aattcattaaaattccgttcttaaaaaccatcatcataaatttcatctattaaattgaatcgttgcctatgatccaattattaggtaattgaatagactcgccaaaagttccattaccattttcaagtatctgttcagcgaaaattggtctttagcccgattatttattgttaatttcatctgctcaaatttactccaaaatattgacttttttattgtcaggtcaataatttcgcttcttactgcaaatttttttacaggtaacgtttgtctaaaatcacctgcaagaattattgttttgccaccaaataattgtttacagttagttaattcacgcaattttttctcgatagcatcaagtgcaaatcgtggtgtcatcggcgcttcgtctataacaaaaaaatcactttttattatttcttcggcagctttagtgccttgaacaactccagaaataatatgagcattaagattaagcggaaatttaaatcgattatgtattgttctaccattttttaataatgtagcagcaattcctgaaaatgccatgtttgtcatatgttttttataactataaatgatataatgcattcaatgtaaatgatttgcctgtgccacccgggccatcaatgtaaattaatttaggattaagtttgcctgatgctatttgttttatttttttgtaaataattttttggtcagcgttcatagacttatacaaattttctgcgattttcttttcttcttcatagtttatattctcgttttcttctgttaaagaggtttcttggggtaaatttttaaaatctttcaaagatttcccctcttgtaataaatttttattgatacgggtcaaagccaatacataagcaatgtttggttgctttttaattaagaaatcttctgataaattatttttaaattgttcccacaaaatttctggttgttttgggtcaccatacaataagatacttgtgaacaaactccttaacgctgctggaaacctgaactgacttgcttcatttaagcaatgcttccattcatcatcgtctttagttaatccacgtgctaaacacgcctttgaaaaatttatcaattgcattatacgactctttacagatttctttttgatgtaatcttatgtaatttaagctactccattcaattctggcagcctggtcgacacaccattgctgaaaaagtctattaccataatgatgaggcaaaaattttccttcatttcagaaaaataatttatattttgtaaaatcgcacaacgatatttttttattgtttgtatctttcatattataatgccaccctcggtaattattaggataaaataggggataacacataggttccaccaatggacttaaagggaaaatggtttcaatttttttgcttccttttatatgcactacaatatttgccgctggaatatcatcatttgcatctcgccaaagaattgcgcatacttcgttagaccttggaatattataacgccttagatctgtaccttcacgaatatcaaataacatcataatttcggggatatttgtgcccatgttttttgtctcttctaccgcattttcatagacatttttcatcatttcgtatgaatgcgagtaaacataattttcacgaacataattttcaacatatgcaattatttcaattatattatcatttgaatcagaggatttttcacccaacatgtttaatcgaaaatcaattgcttggtctgtgtcaataaaatacaattgcccgtttgtcggtaactcatcgttattcggctgggcaactgcattataagaatgataaatatttccttgtattttaaaaatcggaacatttttatcaggaaatttagacctcatacaacccaacgaagcacatgaaaaagaagaatttaaagttcttatattttttataaaacttttgtgtaaatcctttatttttgtgtaattattttcgtcgatttcaggttgaaataatacccttaaacctataggatattcttgcagcaaatcctccaaattacttaattttccataattgcaacattcaaaaaattcgtttaaaccctttggtttgtttcgttcttctggaaaatgaatggccggacaatgattacactttatattcaattctccaagaccataaacacctatatgtagaacatcggattcggctgcttttaaatataagtcaccttctttaattctatctctacgtgctttaacaaccttagcatccatcgctcttagttcatttctctgttcctcactcatttggatgcgcggtatttttctatttctatcatactctcggtttctttcatttttttctttgttcatattaatagataagaactcatcagggagattgtctaaatcaataacttcttttatatatgcctttctttttatcgcatgtttttggataaaattttcatcactttcttgtaaaaattcaatccgcttttgaacggagcttggaaccgtttctatcactttaccgcttttttttacggagctttgaaccctatattcaggtatgatgatgtggttggcgaagaatcatcaacttttaaattctgtttatgtcgaaccattttagcacaaagaaaatttcacgcttaaaaaacacaatgtttaaaaagttaattaaataagcgaaaaaacaaacaaaaaaagatatataccgaaataaaagattgccaaaaaggaattaaaaaactaaaagtgccaaaaaggaattaaaaaactaaaaggttacatctaattttttaacaccaaaataataaataccattttatacaaataaagctttttagacgttggtgagagaatttttgcatttaaatgcagaatcaaaaagcatattttcccaattctaaaaggttttaattgatggccaatgccttttaataaaggcaagtttaaagataaaaataatgaatgaaaaatttatgcaatataaacaaatttcagtggtgaagaaattaatgccttttgttgtttttaatatcgcacgaatttctttcataacaattttttgaaagaaactttcgtttcaaaaaaaactcattttttcattcggaaaaagcattatttttcggaaagacattctcaaataatataatagatatcggcaccgccggaatcttaaaatccttaattttcttaaaaaatgcctcaaattttcaaaaattggctatttttggacataatctgacactgtattgtattcaaatatcaattttttctcggcggcgcctatcggcaccgccggctccctcttcctccctggtcaccaaaaagttttttcaaaaaataagccgcaaaaaattgttaaaattaataaagggagtcaacaaataaattattaaaaaattttatttgaagcaatttgaaaaaatactgattttcgacccataaatgtgatttttttatttcaaatttctcctttataaatttttttatctattttttctttaataaaaggattttccttcaaatttgtgcattaaaaatatttttgttagtttttaattaaattttcgaattactcccgctcccgcccgggactcccgtaaaatttctgcgggattttaacgggagcgggattttcacgggattcccgatcccgctcccggaaaattttgaactcccgatcccgctcccgctcccggaaatttttttttaccggactctaataatagataattatgggtgtcaatttatgatactacacaaaaatacaattttaagggaaaaccccttgttttaattagtgatgtacattcgagagttggactcccaggatgagcgtgctctggttttattgagtgcgcctcgttcttgcgttcgtcttactaaagatgttcgggcatattaaaatttgaatttaggctaaaagttttgttgtggttgactaagaaattaatttcaatatcttaatgaaaacatcaaaatttaggaatgcgttatgcggtttatcgtctgatcgggtccaacgagcgtttgagagccgacactgaacggatggagcgtacaaacgcacttctttttcaaatatatgcacgcctttcaggtttatttttaaaacgatatcattatatcgaacagaaaatgcctcgatttagctggaccgcccaatttggaacagcagaatcttcctgttgctggtgctaatcagccgaatcttcctgttgctggtgctaatcagccgaatcttcctgttgctggtgctaatcagccgaatcttccggttgctggtgctaatcagccgaatcttcctgttgctggtgctaatcagccgaatcttccggttgctggtgctaatcagccgaatcttcctgttgctggtgctaatcaaccgaatcttcctgttgctggtggtaatcagccgaatcttcctgttgctggtgctaatcagccgaatcttccggttgctggtgctaatcagccgaatcttcctgttgctggtggtaatcagccgcagcccgctggtttgtcatttctcttgattttaccaatctccgctcatttcttagcattagcacgttcttattggcaaacaaaaaaaaaatgaattaaaaattggagtttaaaatttcattttattatgatttgtcagtccatccaatttggcgtattttagtccaagatgctggactagtggccgctaaccaatacatgcatcttctttatggtgtatgtttgtacatattgtattattaaataaacanagtatacgaattggaccnntgcag

SEQ ID NO: 14771 - DNA, 1636 bp, Heterodera glycines
  misc_feature (43)..(43): n is a, c, g, or t
tttcattaaaaattgttaattttgcggatttttggactttctngcgaaattggaaaatttgagtgagagaggtcttgggcgtgaagggggggctactaataagcaaccgaaaattttcagtacacatctccctgctgggaccgtccctggcctttttcacatactttttgaaattttggtggcttttaaagagaggtttaatcagaggaggacagtttgccaagctataaaaagaatgaattttaaacagatttagaaatattccccaaattctttttcaaccaaactgatcgataaaatatttactaaatttaagagccaccgatcaaatatgtgttcttgacaccattgccgaacaccatggagatttaccgcaccaaacaaggcgtattgacatgcaaattgaacagtgccagggcaccgttggtttggcaaagggacggaaagccaatcgatgtgtaagaaaattttaattaaatcattttaattgtattaaattatttatttcaaataattaaataatccaatttcagtgatgatccgcgctatcaaattgagaaggatgcggccgggcgcttcacgttgaccatccgtgttgtggaacaaattgaccaaggcatgtggaccgcatttgtcaacaaagacgtgaccaggtgggattttgcgaaatttttaaaatttttatttattgcgcagagcctaattttgtacgaaagtcctaaatttactcctgaggctatcttttttgccttttttttgctattcgcacaactttttttttgcctttttttgcggtcattttttccataagccttatggtgaatatggagtcggcggtgccgataggcggataggcgccgccggggaaattttttttttttggattaatgaatttgttaacagatttcttccaaaaatacctaaattttgcgattttgggctatttttaaatatggcaacaaattttcagcaagtgccaagtgtatgtggaggagccccgtgacacatttgttgtgccgttgaaatcgcagcgtgccaatgaaaaggaaaatgccacgtttgaatgcgatgtgaacgacaaggacatcgatgtggaatggtttcatgacggtgccaagatcaagatggacgggcggcactttaaggtggggaggaggaggcaaatctcttttgctaatcaaagaatacattcatatttttgggttatgaatgatttattttcaaaaaataaggagttatttttttaaatttttgctattcattaaatcctaaaaatccctaattatggatatattccaaaatccaaattaaaaataggtcgaaattcttcaattcaaatgtctatcattgaaataaaaaatataatattagaaaatcacaaataaaacgagtttttattaattttataaaaattttttatttaaatttttttacattatttaaaaatttactttttttttgccaaatttaattctgttttttcctatctctgttttattgcgctgcttcttttacaggaagaacgggctggacgccgtcgtcgtctgctgatcaccaatgtactcattgaagaccacggcgagtacaaatgcaccaccaaagacgacaaaacaatggcccaactcattgtggaccc

SEQ ID NO: 14772 - DNA, 1523 bp, Heterodera glycines
tggtcatcagatttgaattttaattttataatacaaatttcctagggtccagattttcttttaatgttttatgaaacaaaaatatgtcgataaaattttatgaaaaatgatcaatcaaatattttaagaaacaaaaatggtcgctcagcttttaatttaaatttataaaaattttgttgaaaaaattcagttccatgcccggctcaaagtacgagtgccagtcgcgcagcggtgtgcacacaatgaaaatctccaagatcgagatgaacgagggggacaagtacgagattgatgttgccggactgcgcggcgcatgccgcatcaccgtgttggaagcggagcgcaagccggtgatcaagtggaagccgcagaagtttgagtgcgaagcgggcaaggagaagcggatcaaagtgccgtttgaagtgaagggcacgcgccgaggcgacccgaagccgattttgttgcgaaacggaaagccggtggacttgaacaaaatgaaggaccttgttgaggcgagtttaaaaaactctgggcaaaatcgctattttgtaagaaaattggaccatttattttgaaattttaccaaaaaaaaatgtttgttaatttagcgtaaaattttttgaaaatttcggaatgattgacatgttctgagagtgttgataatcgatgccccggtgaaattttgaaaatttataccgtaaaattttgaattatttacaaatctaagagtcttgataagcgctggcgaggaaaattctgaaaatttttacgaaaacccaataattttttctgctatttttgaaatggtgaattattaagagttttattcttttcttgaaattttcttataaaaaaatttttaattttatttttacatttctatttaaaaaattgttacattgcgttatactgcttgaatttgttgtatgtttgttttgttttcaggtgataatcaacggcgatgtggcagagattgtgttcaagaatccgcagaagagtgaggcgggcaaatggtcactgcaattggagaacaccggcggagtgtcggcggcggcaccctttgaattggtggtcaaaggaaagccgaaaacgcccaaggggccgctggacacattggacgtaaagtcggacagttgcgtaagtagtttttgttaaaattttaagttaatttaattatgaacatcgattaatgagttaattaatttgcctaattaattgattgattgaacttgattaatttggatttcagtctactaattgataacttcaattacgtttaattgattgtaaatttgcctttgaatctaatataataaagtatgaattaattaatactatcaattcattattaattaattgattcattaaatttagatttgagtaaaaattattcaatttttaaatcaattttttaaattttttgaaactatttataaaattttattcaaagcggaatttaataatatttaaaaaagaataaatataaaattttcaaacttttttctaaaatgattttaagaaaa

SEQ ID NO: 14773 - DNA, 1527 bp, Heterodera glycines
  misc_feature (32)..(32): n is a, c, g, or t
  misc_feature (43)..(43): n is a, c, g, or t
aaaggagcaattcagtctcaataattaagtgnaatataaattntatgcttgattaggccattaaaattaaattaataaaccacaaagattggacagatttaaggcttttaagattatactgccctaatttggtaaaaatcgtttctgcaatgcttaggttttattttcgaccagaaaaaaatttgtgaaaaattagtgtgcaaatgacagtctttggcatggcccgcaaaaaatccttaaaaattaaaattgagtgaaaaatagagcaaaaaaaaaagctgaccaattaaaacaccctgagccatcggtttttaagatattacacattacaataaaattttacgacaaaacaactaacagcctaagtaatttttcataaattgttttgattacgcattttgatcaattgatagttaatattgtagagattttgccaatcttatgaatatgattttgatcattacactgatctgctacacattttagcccctccggcgtttaccgctggtggcattcaagaccaacggctccgtgtcggtgagacaatcaaatacgaagttgccatttctggcgagccgttgccggctgtcacatgggaggtcaacggaaagccattaaaggcgtggttttgttgaatttgttaaatttaatgtatattttaattttaattttttaatattttaaattatttaaaaaaatatatatttaattttgaatttatttaattaaaaaagtaaattaacttttttaaataacttcaatttgtttaattcaaaaatgtatatgttttctttaatattttgaactttttataatttaattatgtatatttaattatttttaatttttaaatattattttatttgagaaaatttatttttttcttcaacattttgaatttatttaattttaaaaaagtaaattaaaattttttaaataatttaaattagttaaattaattaaaaatgtattttaaattatttttttaatgttttgaatttcaaattaaaaaatgtatatttttttaatgtttaaaatttatttattattattttttttattaaggccggtggacgtgtgaaaatgaccacggagaagggcaaaactgtgctgaaaattgaagacgctcaacgcggcgattccggcaaattcacgatcaaattgaagaacaaaagtggcgagtgcgcatcaaccgcaaatgtgacggtggtcggacggcccgaaccgcccaagggaccgctggaagtcagcaacatcagcgcagatggagcggtgcgttttttaagggataaaattggcatatttgccgcgcttctttgggtcaggggtggcccaacatttcggaggtaaattttcgaatttcatttagagttggcttcacccgtccctgattttttccaaaaatttttcgggaggcaatccgcgtgattaactcaaaaatcaaaaaaaaaattgacggatgtccgactgaattttcaattatttattggatgggtttcgcatttttccttttttaatttttcttaa

SEQ ID NO: 14774 - DNA, 2816 bp, Heterodera glycines
actctcgccgccctactcccgccgtgcccaaccgccctcgtccccaactcgttctgccggccaaccgctctccgattcgccgtccaactcggcctgccccgcctttgtcctttgtcccccaccgccgccgtcagctttcaccctcgccagcgccggtctgtcccgtcatgcgctcgtcaacgccgtcaccgccaaatcggccgctcgcccgtcgccgtctgctgtccccctcgccagttcgttccgccaggcgccagtcaactccgtctccctcctcatcgtcctccgttcgtttcgcctcgtcgcccagccgtgcctccgccttctgtcgatccaccgccccccaaaaaacggttttcgtccggtcaactgcgcacattgctttgtcaacaatcgccaatatgccattgagcaaaaggcgttgatcgggtggactgaacagagaaagagagaaattggagaagctctggacaaggctccgttagccctcagagaggcggtcctcgacagcatagacgtctcggttcatctgatcaaccgacaagcggtccaacttcgctccataagaagagccttgttgtcgaccaatgccgacgaagatgaggatgctatgtccatcgtctcagcttcctccgccgggaactcaattgacgccgggaatgtcggcacagtggccgacgaaaaaaactgaattggctaattgccctttgatcgattttgggagattgttgaatttgtggatttttggttttttcttaataattttctgtcctttctgtttttctgtccaattattcatcatgttttttcctcttttcctaaaaagtgctccacctacgcctcctcccacttattgttccccaaaagtgctcctcccacgtttctttttctgctataagaagggaccaaaatccctcaatcatcactcacctttgtgcctttcatttaaaataaatatttaaattggatattcgtctcgcccttcttcaccctgcccatattcggtgccgttccctctgctccttttgtccattcttagcccaaattcccgtggtcaccctttgcccgcccctttgtcctaacagcttaagcgacaacaagccatttgaataaatattaaccatttttcattgcaaataataaaaattttaaatgtccttggatttcatgttttttaaaggaacattcattcgtatgccttagcctggagcggttcatacggaagatttttggattctaagtctttgaaaattacataaggggcatgcgggagggagtttctcagtgtcgcattttcttgaaaaactctctcggtgtcggattttcggccggtgtcgcattttccagtgtcgcgttttcagggagccgtgccgttgacccaaactccccgcccatcaataatatgaggcaaatataaatatttgatttatttttgatagttaaaaattaacgatttgaagcaagttgcaaaatatttgattttcgctttaaatctgatttgttgagctctggtttctaattttgtgaaattttcaatcgaagccctgacaaaggagaggtacccaagtgacggtgggacttccgaatgaaacttacagggaaggtagattatcccgcttttgtattataaaattttttttatttttgctaaatgaagcttctggccgagatatgaagcttttcctttttgccttttcaatatcattttcaaagaatgtaaagccagtgtgagcgtcgtggcctggtggttatgtcttccatccttttttttcttctaaagttcaattccccaaccctgcaaataattatttttgtaattttgacacatgtgataatcttggtagaaatgagtgaagcaaaggaatttgtcacaccatgcacatctgatcattataaattccgaacaaaaagtgatttggtagtgatcatgaaaaattgttgggaataaatatttaatgggatgagaaaagttggaaaattcatcattttgtgattcaatgtacccccccccccccttatgccaagaatatcgacgaaatgaccgaaattttggagcacaaagttggaaatggattaaactttgaaatttattaaagatttacatgcagatagatcatcaaggacaatgcgatccgaaatttttctgacaattgacttccaagttctttaaataaattaaaagtcagatctgtttttgggaccccagttggacatttctaccaaaactatcactgtgtcaaaattaatgtgaataaaaatgaaaaaaaaataatgcaaaattattaatgttaaaaagcttaaaaactattttggatatgaaaaaaaacaaaaataattatttttgaaaaatgcgggacttgaggttttagtccatgcgggatcccgtcccgcagtcctgctaagttttgaattaataataaaaaagaattcatttcattttccaattcatcttcattagagaatgtcgggtgtatgaataaataatcaaatcaaaagcgattatcttagcgttttgcagggcttcgatctctgttctagtcagaaatgttctgttttttggtatagtgacaattttttgtctttataaatccatcacaaattttgatttttttattggtatagttcacaaaactatcctgcattttaaaatttaacccaaaaattggcaatttgtgatgtaaatgtgttaaaaaatgagctaaaatttcaaaaaattttgctgccgccgcctccgggcccacctattcaaaaaaatcttttaaatatagcgggcagaaaacaaaaaatagaataaagaaaaaaaaagtcatcatttt

SEQ ID NO: 14775 - DNA, 2141 bp, Heterodera glycines
tgccgattttgatgttttaaattaacatattttgacatgaaaaatttaaaaaataaagccaaaacagcagatttctttattgaaaacattataaagtaaataataaatgctttatttcaaaaagataaaatcaagacaaaaaataaatttcatgattttaaaaatcttttgcctaacttgattagatcattcctttatggtgatctgtacacccaaaaacacattgaaaattggaaaagtttaggaaaaattcctatgtgttgagaaaattttcctggacaaaaatgagtaggccaatcaaaaagagcacataatgctctacaatatgcaaaataccgcaagacttgtcggactttaaagaatttttttaattgcttaaaaattttattagttaaaaaatttaacgtcaattcaaatttaaaaaattaaccgctatgagcgggaattgaacctgcggaggaaatgaaccaaaacaatacccactaggccacggtggcaatgctcagatattaattttactttccctttacttaatgataatttggctcagacttccctcattcataatagtgcatttttggaaccagttacgcccgaatctaccggtagggtaccgagaaaggtcgagtctgggtcccgggtcttaaaaaatatcgttggtttattacaatttctttgattattcaacaaggaatgaggggccctttgaacagagtaataaaaatgactaaaatgaacatctttcttttatcattgcattgttccgtcgtcatatcatttgaatatttgagtcattataaagtaaagaggtcaaaattgacctctctcatttgtccgctatggggaaggcgctggatgtgaaagttagagagatttgacactgaaaaaagagactaaagccaaaatgccaataaaaaaaattatattaataaatataatggacgttcgaatcttgtacttaacagatttatttttcaaaaagcttgaatatgaactagagaccgggaatttcaaattggcggatcccgatgcggcattataatattacacatatttatttgagaaattttaaattagaggacaaaatggtagttgaattttgtctttttttctctcgcattctcttattgttcgtggcacatgtttttttttctggcatagttttttcgacctatgatcattgatcctctttaatcaccgatccttctgctggaagtgccatctcagcaacacttgacaattttaagccattcggcagccgtcccgggataaattaattaggccgcgacgtacagaaaaatgccatcaacagacctttgcggatgagctggactgattgatgtgtggtaaaaatgaaggatctattagtaaaataaaatttgcatccaaaaatactaaaattcaaaatttggccacttgaaatttattgatgcacaagtaaatttttgttattttgacgcacatacgtaggaaaataaaacgactttaaaattattatcagaaaattcataacggcacaatttaaaataaatatataaatttcaacaaaactgttaactgatgtagtataaattcatatttcattttctatgcacattatataaaaaataaaatatctacaaaaaataattaagcaattccaaatttgaaaagggattcgaaagtataatataacaaaaaaattctcagaaatacacttatatatttcttttcgttagatgcagtcaaataattcaacataaatatggtcccacttaaagagaataaaccaacgatttaaaaagtcaaaattatcaccctatttaaattattaaaaaatttcatctggaagcgccatctccaagccaatgccaatgcaggagccagagatagcagcaacgatcgaaaaataaataaaattaaaaacattaaaatccaatttatcgataaagccaaaatgagaggaaattaagccaaatgataaagggcacgtaaaaaacattagtaaaaaggttaagaaattgataagccaaagaatgaatagtctttaaaaaatgacaacaatttgtcaaaagggccaatgttgggccctcgaatgccaataaaattccatttgatttccttaattgcctccgccttcatacggaggagaattgtttttt

SEQ ID NO: 14776 - DNA, 3935 bp, Heterodera glycines
  misc_feature (3783)..(3783): n is a, c, g, or t
tgcctttgccttttactttattcattttgctgcttctcttcactgtttctttcgcttctccttcaccttttcccattcgaagttcttccgtccttttttctttctttcattttcattttctttttagcggtcagagggatgggcgaagcattggaaagagccgttgaaaagaccaaagaatggtttgtcagtcggtcgaccatttgtctttgtttgttttgtccgtccgtttggacattttaggcaatcgacggatcgcgacagacgcaataagccaaagttcacccaaagtgcgctcagagcgaacgccaatcgtccgcttcgggtggcggagatggacgtgcaaaggctgaaccgactgcttaaagtggtcgaccgcgcgtggactttgcccaaatttggctcctcggagcccatcgggtccaatttccaagtgaatgaatggaagggtcactttggaattccatacgaagcaaatgccttaagtacaagaagacatgtgccagcatttacaaggcgaggtgagtgagaggggggggggggagggacaaacggcatttttgaaacgaaggcacaacgcatgcgagcaggccgggtttggcattatgtgcttcaatttttggtgggttggggggggggcgaagtgtgtactgtttgaaaaagagggccaaattcagttatgagaaaggtgcgttgggaaggcaatgaatggcattcgattgttttttattgtgaaggcgaaaagttggcgttcaaatgcgaagatgcgagtgaaccgaatttttgcaaaaacaacggaaattatgacaatttcctgaacaaatacaaaaaggacgcgtacagagtgagaattcattttggaaaattcaaaaaaagcgaatgatcgaacccaaaaaggcaaagacgtacatccatcaacagctgacgaggtgagcccaatcggaaggaaacggcgaagaaacccaacacgaacagatgctattcatcagcaatttgtgagggcgcacttttgaacagcaaattactgcccaatacaaatgaaaggggacaaaaattgcagagaaaagtgagggattggcagagagaaagagtgagggagacacaacgcaaattcagcaggaaagacgacaaaggatgtttagagagacggcggaagatggcgcggaaatgggcgaagaaacaatcacaaaaagagtccctttctggcagagacttatggtgaggaagagaatggaagataagggacgaagggagaaagagggggacgaagaaagggcagagaaagagagggaagaggagatacggtggatggagaaaagatacggtggaagaagggaaacagaagtgaagagtacggaggaaaagagacagacagagaaagaggaggagatacggtgggcggataaacaatacggtgggagaggggaaacggaagtggaaagaacgagagagagcgctgattgggacgggcaaaggtgggaagggacaacgggcaaagttaatgcgaccacttttgagttcgttggaaagcacagccttctcacgcagtttgactcagttaacgccagaaatgcacgatcacttacaaatgaagcgaccatcgcttaatccccggactacggaacccaacgaagtgttgtggaggaatttccaaccgggaaaatggtttctctccgagtcctcactttcgattaaatattttgttaaggtttcaatccgtacattatatgaccaacacaggctgatcaaacagttcaccgaaagaatatcagaaattacttattccccttacatacgggtggaaacagaagaaccgagcaaaaaagcattaattaaaaatacaagtttatcgacttctgttcgttattattatttttttggaaatcatttttatcacacgcttctaaactaacaaacaaacaaaaagaaatcatcaaaatttagaattattgggggaaggggaaaattgaatttggatgcgattatttgtcagctaacggttgctaaatcccaaaaagtgacttttccgataaccaacaattgggccagaaacatcgaactcgaaataatcactgttatcataaataaatggaattcgtaaggcatcagcaaaaagaaagcaaaataaagcgaaacgaatcgcacttttccgccggtgattaattttctttaagtcaagcgaaatcggttggtttaacggatggatttgttgtgaaaaaaggatggttgtagaagatggaagaaccaattaatctaacagtgaaagctgagcaaaaccggtcaaagaacgttcgtcgggaatttcattggatgcaacgccggaactaaagcgaaattggaaggaaaaagacgttgggcattgcttcacttgagagcgaaagtgatcgtccttctttccgcctttttctgggccaagtcgatcagtttctgaaggttggccgcgactacgacgagatcatggccatctatgagttcggcggtgacgagttcgtgagcaattctggaagatttggcttaaatatttaaattcggcttgtcagggggagcgtattccgttattcggtttgatttttaaaaattgacccgtccacactgtccgcattcggagagtagtcgaatttgatgtcgttcagttccctttgctggttccgaacccgcaaaacctttaggaaacggaaggtcggccccttgcaaaatgcttcctatttgtaaaccaagttcagtgtttgaagcggcggcatttgttcctcccctttgccttcgctcgatgccctggagacagttggtctttccccacttgcgctttgctgaatggtcgcattttcggggtccgacgaattttcctcgtccgaagtgtcatattcgaactcccaatttccatccttgtccttcttcagcttgccacttgcaaccttcaaaacccatcgaattcaattcgctactggcatttttctgttgttgtgccaaaaccaacctttttgggaatggttgggattgatggagccgagcctaaaaagccattaaggcaccgttgtagcaatgatgcacgtggtccttggaaattcctcaggaattaatccctgaatttcttctattttcttatcactcacaaatcactgggggaaaattaagatgatactgatgattagcgttcttgttcgattttggcgctagtgcgatatttattctcatggttcttggaaagtactcaggaagtatttcgatttttgtaaataaaccatcagctgatataaagaaaagcattgttgtctgtccttttccaattatattgccatttaggcatcggtctaacaaagctgcgcatggctttgggaaattcctcaggaattaattttcgttgtctaaagaaatgcgctagtgtcgggcattttgacattaaaatgccattaaggcaccgttgtagcaatgatgcacgtggtccttggaaattcctcacgaattaatccctgaatttcttctattttcttatcactcacaaatcactgggggaaaattaagatgattctgatgattagcgttcttgttcgattttggcgctagtgcgatatttattctcatggttcttggaaagtactcaggaagtatttcgatttttgtaaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattanaaagccattaaggcaccgttgtagcaatgatgcacgtggtccttggaaattcctcaggaattaatccctgaatttcttctattttcttatcactcacaaatcactgggggaaaattaagatgatactgatgattagcgttcttgttcgattt

SEQ ID NO: 14777 - DNA, 4313 bp, Heterodera glycines
aatatttacttgtcaactttctcatgagtagggccccttcttttatgtgctaaaaatcctgaaatatgtaataaaatacttgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaaattttttaatttgaaaattatattaatatttaggaaaaaagtcgatttttagggggtgtatttttcaattttcttgtatttttattgcaatttttctcaaaaatgccaaaatatgtgcaaaatatgtgccaaaccccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaaatccgggccctactcatgaggaataatattttcgatattctttcttccaatttagttaagattttaataattcataattaatggcgccatttcaccctatttggaaaattgggttgtttgagaagagcaaggaaaacgacaaactggcagaatgcgttgaatgcaaagccaaaaaacagccaaaataccaattcaagctttccgacgggacgggactcccgttaaaaatagacgggatttgaacgggatcgggatttttacgggaatcccgttcgggactcccgtcccggaaaatttttttttaccagactctagttataactagggctgccaaccaaaaatatgtacaaaaagtggtgcaaatgtgtacataaatatgtatgaaatcattcattcacgcataatttcaccagttattttgttaccgtaatgtcttcgaaaattccgtacgtttttcttacatcgtattggatctctttaatattggccggagttgccaagattaaaatttcccatggaattcataatttaatttgataatttaccccatcgatctacgccactaaaacttcataataaaactgaaattccacatttggctttccttttgcttagccactttctttgcttttccattccattcattcatttcccaaattcattttcattggtactttgtgtctcttctgttggtcggctgtggcaccattctttggttcttttgggacaacgtcaaaaaacgacgacgccccaacaaaaaagaaatgtaaaaaacaaaaattaaattaataaatcttttttttcagcttcatctctgccgactgttggctcgaagtgttcgctttacttccgccttctcagcttggcctcggaatcgctctgatcagtcgccgattttaccgccgcgtggacaaacatttcaaagcacgcaaatggatattggacaccgaattgcgaattcaagagaaagagctatggtttggcaggaagcaaatggaaattgtcaatgccaattggaagcgtttgccaatcccacaaaatctgttgcccaacaaagtcatcggatttaaacacattacgttcatgtaaaattgacaagtttcccattggtttgagataacttttgcttgttttagttacttcgaccacaatattctcacatttgtccgccgttttcaccgctttttcacttcaattacaacatctttgggcattatgagtgaaaatgttcgcatttttgagttcttcctgtccaccatttggccaatttttggtgactccattcaattaaagtgtttgaccacttctggtttccgtcgaatgcgccaattagtcacgtccattctcaacgactgtccatcccttcgtttcgtcaccttcaataatttccgcccgatgacagtgccaatgcgacggatggtcaagtggtggttaaatgtttgttcacgcctcgttcggacgtttcaccgaaggtgctcaagtacaccgagaattcatcggtatttaatgaactagacattaatgttttatcagtgtaccgacttttgcgccgcgacatttgcgccgccctacaaaatccatttgcaccgttctaagcaatgcaaaaaaaatttttaaactaaaacttgtaaatataaatgtggcttaatatctgatgtacgcattaacaaaaacaaaaaataggtgtctaacgttggagtcggggtcgttttggcgcccacgttttggcgccgacgttttggcgcccacgttttggcgccagggtcgttttggcgccgacgttttggcgcccacgttttggcgcctgtaggaagaaggacatttgatttaaatattggcgttccattttgatgttcattccccatttattattgatttacaactttgactttttcacaatatttcccgcacttttcccacgttcagtcattatggttttatcattctgatttcgttccccatatttctccatccctctccaatccgtctcttctctaaatatattattttccttctccaaataagtaaatatatatattctccatccatcgccaattgacttagtgatccaaatccgaaccccggcattctctcccctcttcctttaatcgtacttggcgctcctggccgacattcgaactgcaccgccttttggaagacatcgaattgctcgccgattgccgacaagccagcaaagcacgtgaaaaagcagcgccgtccgcccactcaattcgccgaaaatggaagaatattttggtcaggcaagttttcgaaagagaatgttggcacaaggccaccgactgcgagaaagtcttgcctgtgaaggcaacaaaaaccggattttggctgaaactgcattcggtttcggcagaaatgaaggaaattgtgaatttggggggccgtcagtgcattccaatttcggtgagaaaaggatcgaaagatccgggtttgaaggccgaacagagcaagagaaaaatttggtagaaaggctgaaagctgaattggtaagagttaaggccgaacgagacgaagccaatgcaaaaattgaaattttgcgagagaaattgtcggacagcgaaaaactctgtgttttcctaaaggctgaccacaaaaaagtgctggcgcaggcagagaaagttcggaccgaatcgaaggcgatagaaattgagctgaatgaggcaaaagaaaatttggaaatggcagaagaggaaaatggccatttttcaattctttctgtccaacagaatttgatggtgcaggagcaaggccgaaaaataatggatttgattgaagaagttgaagaattgaaggccaaaaagaacgccaaaaagaaggagaaactttccaaaagtcccgaacaccaaattactgaacccaaaaaattaatctccaaatcgccaccgaaaagtaaggcagacaccgccaaagcaaagaaatttgtccaaaaatcggaggatgacaaaagcgaaattcgtcctttaaattccatcatcttccgaaaacatccaaatcaaaacaaacctaattatcggcctccaagtttattttcaattcggacgttcccattgctcaatggcaaaactgttccatttttgagtttttcccaatttgcgatgccgttcccaactccctcaccatttttggcagccgcttctccttttaattttgtttggcttataaatgaaaagcaaatggctgatcaaagcatcccaaattttgtctgctgaacaggaccgatttccctccccttttgccctttttataaatttaagctgaacgtcaactgatcgccatcttccgatcgccatgcgccgggacgtcgcatctgtgggcccgggggagactgatcagaatcggggaccgattcttgtgtcgacgggggcatgtaggaagaaggacatttgatttaaatattggcgttccattttgatgttcattccccatttattattgatttacaactttgactttttcacaatatttcccgcccttttcccacgttcagtcattatggttttatcattctgatttcgttccccatatttctccatccctctccaatccgtctcttctctaaatatattattttccttctccaaataagtaaatatatatattctccatccatcgccaattgact

SEQ ID NO: 14778 - DNA, 2702 bp, Heterodera glycines
cagttgacacacttttttcaggaccaggtcccggtcccgtgtacttctacatttgaaaataaaacaaaaaattttccaagggtcggtggctcctcattaaacttggaagttgccaaacaattacgttcagttggcctaggaggaaggaagatgtttaggtcgagcatgccaaaagtcgggatttcgcccagtggttgcagcgtttcattcggcagctccggtggcagaacatcgaacgtctcaaaagtagtcgggagttgaatgttcctcagagagccgccgtattctatgggcgtatgcggatcttttgggcgtctgtagccacgccttgacctccgcgggcgtccacgtccacgccgcttggtcgacttggaccgcttcttcggcttcgatttgcgcggcacaatccgccgacgatgtctacgcgacgctttcctgacggatgccgaactacgcgtcccgcctctgtcctgacgtctgcgcgacgcattcctgctggcggatgacgaacgccgcgtccctgtgtcctgccgtctgcgcgacgctttgctggtggaagacggaggacgcgttccgcttctgtcctgctgacgtctgcgcggcggtttcctcgcggacggcgaacgacgcgtctctcttctgccctggcctctgcgagacgctttcctggtggaagacgaacgacgcgtcccgcttctgtcctggcctctgcgcgacgcgttcctggcgcgtgacgaacgacgacgcgtccctctgtccctgttgctcgatgccgctctactcctgttgctcgcggaacgacgacccgccgtatttcttgaacggcttcgaccacggccagcagtagcagcagttgaagcagtattggaagtcgcgcgacgcgttcgctgaacggggggaggaaagggaaaaatgaatggtggcggaaaagcgcatgaaaatgggggggggggggggatcaccgatcttgaagaagtcatctcgtcaaagagtgaagaagctgctgttgacgaattggaattgtgttgtgataacaacagagaggaaagaggagaaagggaaatgtgtaacccctaaaattaattgcaacaattaaaattagggataaagtcgatttgaaaagagtgaaagcggtaaaagcaattttctattgaaatttaaaggggagggggaatatctgaagacatatgtacttttagcttagatttgcatccaaaatagtgtacaaaacgaaaaatccggaaatttatgcattgatttccctattctgtgtttttctatgccttaaaatttttttgaaaaaactaataataagcgttctttttgtttttcaattaaacgctctaagtaaatgtcaaaaaaaatggtaggacaattaaaaagggacaaacggagggagaaaatggacagagcggaagagtgaatttgatgaattcaaaccaaaaaatggacaaaaaaaaagttcaaatttctgtatgactgagaaaaaatggcatttttctccgtatttaagcggtgaattccccaccaaaaccatccattcattcaattgctgcactcacttccattcttttcccccatcggtcgaatcttcatcctgctgctgctgtacaataaagataattcccgtcagtttttttttgttttgtttatttcggttttcaaaatgtattaaattttgtgcctttttcaggatggtcagagcaacaacggccaggacaagggcatcagcagcgcgagcacggagcatcaaaatcaatcgtcgaaatgccaagaaagcgcgtgccgcaattggacgagccggacttgtgagtgacgcgcgaggggggggggggggcaatttgtacactaattgattcagtgtctttttttaatttgccgatttttcaggcacgctatgcaaatgcgcggaacaaatgcatgatgtgccggcgcaaagtgagctccatcacgcgtgtgaccatgggctgtgcgcaccaatttcaccgaaagggggggcggcggctaaacgcttttctcccttcccacaatttttgaattcacgtttcggcgaatgtttcgcgtttgctgatcagtgatcgcgccaaccgttccgatcaatttttaaatcatcaaatctacgattttatgtgtctatgattttaaaacaaaatttgtttttttatttattttggttgaaaatttaatggatttttgaggtggcctagaatcccgattttattcatgatgatttcggataaatgcaacgctttttatccccttaaggtgcctgtaccgctggctcaagtacaacaccaactgtcccgtgtgccgcttcaatttcatgcgcgtaattccccctgaagaaccggcggaggaacagcaacaacgagaagaaatgactatctgatcagatccatcattgaaatctctgtactatcataatgttgtgtattgtgtatatgtctgtgtgttgtgtgtgtactcagtataaagatgatgatactcggaagatggaagtttttaattgcatttccctgtaggtgttatgtatttagcggtaattaatggagtccgaattttaagattgttgtcaatttttttttacaaaaaattgattacctttctagctatgtagctattttattttggatcaaaatatgtaaatgacaattatcaggttagctttgatcagtgtcctctcgctgtctctcactctctag

SEQ ID NO: 14779 - DNA, 2326 bp, Heterodera glycines
tgatgagaattttgacggatgcaacatacaacaattccgtcgaaattcatgattttatgacagctcttggtctgcaggtcgaagaatacgcaggaaaattgaatgactacgaaaacctggaagattcaatcatgaatatcgcttagaattgttcatcccaatattttttaattcactttttgaaatacctattttttcctgctaattttattatcttagttatttaattatgctattctgataaatagttagtgaattatgtgttgtgcagccttaaaaatgtaattttccgactttttcactaattttcggcttggcgacattttgactcattttagcttgggcgacatttcgacgcgccgacattatgacgcggcgacatttcaacgcaacgacattttgacagcgcgccgtttgaatcattggcacccccacaactctgatctgtgttcccaattagtgaaaacttttgatatctcgaactcaattctcaggtcctgttttcgagtctcgaaaaatttgaactctcgattacaatttttgccattagtgatgctcgagagtctcggctcggtcggtgtcccttagtctctcagttatcaattactaaacaaaggcatggcaccaacatccttggatttcccatccaacagtcgttgcgtttaatccgtgcaaagaatcgggagcagcaattcaaatctgaaaaagttgactgagtgttcaaaataaatctttttttttgtgcctcagaatcctctgttaaaaaatatttgtttattaataattgtgaattaattattttcttatttattttaattccatttcattttaatcatttgcattttgtcgtacttcgtctatagcgccggatttattttgcacatttgctgttaaaagcaagcttttgtttttaacgagtaaaaagtaaaactaatagtaaaaaattaaaaaaaacttttgttctaaattgatcaaaataagctgaatttagtcaaaaattattgcagcatcaaaaaacggtcattctatacaggacataaaagtgaattttgaaaatttttaatttcgacttttttgttctggtccgggattcgaaattggtcaaaataaatgttggattcgggttccccgaccctgaaaactaccataaacatgttttcacgacttaataaaaccaaaaaaattttatccaaaaagggggctcacccacccaccatctatagtattaccaaaatttcttatggaagtattttcagaaaaatatttttgttcgtcttttttttctaaaaccaaattagacttaaaaacctcatagatatccaatgatcaaagaaggtttaatttggatgtttttattgtacataaatattgtttaataaacatatacatatgtacttaataccacaaaattttatagtatcggaattacaaagaaagaagaaatgtctgtggattgtgctatttatatacagggatgaatcttttgcgcttactactttcggctatttggtcattttacctcaaattgcccctataaaaggagcatattttggctgacccattgcatttccattcgctgtttcgtcgcttccttttcactgtaagtgcattcgcccctttgccacttgataacacatactgctgatggtaccccctcccctttttttggcagaaactttgtttttaagaaggatcagcgatcccaaaaatccttacaacggagtccgatttgcggcccgacttttgctgcccagcatttgcgcctatgtccaaaatcggattcaaactaaaattgtttcaagccctgctcttcatggcttctttaaaaaaatttcctgccaaaaaagggggatgccatcaagcaatatcaccgcgcccttgcctccattttctgtcgttcttcacctccattcatttacagcctttttgctgcaactcaccagtgccgagaacacccgccgccgactgctgtttttgtgtgtgccacttttttgcgttgtgttcgttcgctgccgagccgagacgactccgtcctgacgacgtccgcacaaatggcacggaccggcaccagcagggagagggagagcccgagatgtgtgctgatgcgacagtacgaaatgctgctgcaaaactcgaacgacaacagcggattccgtgcctggttcgacaataacaatgtgagagaagcgaccgaccgactgagtccccacccgtccctttcagtcccacaatcatttagtcttttcagctcttcaaatggcgcattctcatcgacggtccgccggaaacgccttagtgagttcatggagaagtgcagattgatgtt

SEQ ID NO: 14780 - DNA, 1600 bp, Heterodera glycines
  misc_feature (1513)..(1513): n is a, c, g, or t
  misc_feature (1522)..(1522): n is a, c, g, or t
aacttcaacagtcctgccaatgtggatgctgccgtaagtgattgattcgtccgtcggcacgtttttcattgaccatcatcatatttttgcgtctaaatttccagattttgttccgcaacgacccggcacaatacagggaggaagtgcgacggcgcgtggagagggcatcagcatcgacaccgcgagcgaggtcgtcatcaacaccaccgccggtagcgcaaccgccgggagaacagcagcaggggacgccgccacaaccgccggacggacaggggatgcaaccgccgggagaacagcagcaggggacgccgcaaccgccagcgacaccgccgcaagggcaagaagcgccgcagcagcaacaacaacaaacgggcgaatggtacctttgatgtgacgtgatgccctctgcgtgatgatattattatatacttatgtatgtgtatatgtattgtattgtatgcatgtgtctgtcgtccgaccatttcattaattaatggtctctctctctctctctgtgttcgtttgccctgcttttgttcgctgttgtacatattatgtgtattgtcattatccaccaattattgtatatatatgtgtgtacatatgatggtgtatcgagcaataaactgaaattgccttgatcctttccaattatgtatggattttgggctaatactggagaattagtgtcccggcgaaaaataaattaaaaatttaggtcatattcgtcgtcagcgaccctgataaccccaaaatacatcttttcaagttatccttacatgaaaatatatttagaaaaatctcagggtgaccaagtttttttttcaaattcaggatacaaaacactaaatttcaaatttaaaccccaaaattcggattttttgcaaaacaaggggtctgctttttagcgacgccctttttccaaaaatttttgttgtacagggtggtctggcgacgcaataggcgccgccggaaaatttttttgaaaattttaatgcgattttttaacagatttaggcctaaaaatggctaaattttgcgcttttaagccaattttttaagaaaaacagtttttgggggccgctggtgccgataggcgccgccgggggaaattttgggttattacaaaatatcgcctttttacagatacctcaaaattcaggataatcgaaaattcaggacatttttgatttttcagataggtaccctccaattcaggacaaatctgaaaaatcagtacacttggtcaccctgaaaaatcagttacttgatgaaaaatcataggcaaaatcaatgatttttcgaattatggactcagacccgtaatgtttttttaagaaaagaaaaatttttaatttatttttttgccgggacacaaattctccagtactaccgattttggcattcccccacatggacggtaaaaaaagaaaaaaaccggctggcgtgtcttaactgtgatcaaaatactaatcaagcgttaaagcccctaaaacatttcaatgcagacaanacaagtatntttttagagttttttttgagttaattgatctacaacatttattgaaattttttgcatgtattctctgtaacaaaatat

SEQ ID NO: 14781 - DNA, 1969 bp, Heterodera glycines
  misc_feature (1803)..(1803): n is a, c, g, or t
tgctcgaagcgatttggcaattttgctgacgatctctcactgtgatatcaaactgggccaaactcatcccagcgaatgttatcggcgaaattactccgtcgaggtgcttaattttgacagatcatttctccatcatgagaatgtttttcataatttcaacaattatttttgccttttgccatttatttaaaaaattttctcgtaagtatcgagaaaaaaagatatgtgtctcttcaatgcgttcattattcattgaaatgttttgtatcaataaaaagccataccaaagctaaatttatttgccatagtccttaattttagcttaataatttgtaaatttcagacatcaaaaagaattttggacggcgaaacaaaattggcactaattaatgagtttcacaaaaggaaaagagaatgccaaaaaagggaaaagaaactcaagaaaaattataacaaatacaaagtaaaaattgagggagaaattgcgcgggatttgggaacaaatcgtaaaatgatttacaaatggaagaaggcattgggccaaaaatgtaaggaaatttaaagaaaacagcaagggtaaggggagggggtggggtgatcaggttcgacagttccaaaaatactttgattttatcagggtttttcgagtcatcgaacggcccagaaaatcgctttaatccctgtatatcaactgagtctgaaatctcgatttccagatccaattttcggtctcgagtcaaaagaaatattctgtccgaattagcaataatcagcagttttacacttctttagggaaatttggaaaagatgggttaattcgagagaccggcacgatcgatttttgattcggtctttttcgattttgttcgatctttttttagattttgtatcaaaaaaccaatcgaaagaaaagaaaaaccaaaaaaaccgagcgaaatatttttcgcggccaaagcgagaggggggggggcgtagcggaaaagagggaaattctgaaaaattctgctaattcacttccccggcggcgcctaacgaacggcaccgccggaaattaattcctttacaatgaattcaatttttgacaattaatttgtgtaaatttattatatttttaaatttgtttaggcatcccaaagccacaaaactcaaaaaagcataaactaaagataatcaaaaaatatgaaactgttagaaaggaatttgaagcaaaattcgatttaataatgccgaggaatgtgtcagaaaaagttgcgcataaaatcggcgtgaattataacacaatttacagatggaaaaaggaatttggtctatcgagtaaatgaattttacattttttaaataatttgtaaaattaattcctttttaagggaaaaggcgttttagagattccgaaaaattggaattagtgcgaaaattcgacgaaataaaaaggaaaaaccgaatgcttaacagtgacagagtcgcagaaacattggcagttacgaaagaatcaatacgaaaatggagaacagagtttggcatcgaagcaaagtgtaaaatttttaaaagcattttaaatcaatttaatttaattttgccagatttaaatttagggaattgcaattacaccgaagaggagaaaatgaaattaatatgcaaatttgacaaaataaaagggaaaaacccaaggctgaacagtggacgtattgcagaagaattgggcaccacgcaaaagtcaataagaaaatggagagcaaagttaggcacaaaatcataagtttgaagcgaagaggaggaaaagcaaaaaaaaaaacgcaattttanaggacagtcttttagaaatgaattttaaattaaaattcaagcttttgccatctttacaggagcgcttaatttttatacattatttttttatcgcaaatttatttaaaaataatcaaaaaaaaaagacaaatttgatatcattgcgcgttttggacatttcagcatc

SEQ ID NO: 14782 - DNA, 2151 bp, Heterodera glycines
tagataaagctaaaaaacataaaaaagtttcgtataaatggtacagaaaaaaattcaaagaaaaaaatgcgcaaagattttgggcacactctgtgtttctttttgctttttgcatattttcaaaaaaaattttttttgttgttgtttttttttgtttcattatgaatgaattttttttttcatttttttattggcttaagttaagtaaaatcactatgaatacaattgtgtccttgaatgataaggacagtccttaaaatttcccaagtgatggaagaaaacaatgcataaattcaacgagttactagagaaagaagagttgtgctttcattattcaaatcctccattatttacattgtattatttttcgatactaaaaaccgaaataacaaagtaaattaattagtttaaatgtgttcgttcagctgctgcctcatcgatgaagtgaatacaaattggatactaatgaattgttgaccgtacttttccgtcggaaatatttgtacgctattttaagcaaaaaataagccaaaatccatctgctgcttatgaaaggcgcaccatttaacccaactttgtctttcggctccatcattcttccatatttttatctaaattatgaaataattgggaaaaacaaataaaattctcagaaatataaaatataatttaacgattaatgaaaagaccttttttaaatttacaacttttacaatgaaaagcttagtgaatgaagcaaacgaatttaatgaggattgtccgtccttcctttctcaaccgtaaggagaaaacacttttttttctttaaaggtaataaacaataaatataattatcattttacgtatgatgcgcaatccgtcgctttgcccccccccccccgacactttttttgtgtttccgttcctcttcagcggcttattttcgttaatgagatgccaaaaccttcacgttcatttggcattgcattgcgtgactttttgttttcatttgctaatactttgacatataacgcactaattaatacataattatttgctccttattcacaataaattgttttgtcatttcttaataaaatgacagaatcaaagaaaaataattaagttaattaaaagctttaatggaaaatgaataaaaatttaaaaaaagttaaggccgggatttgggacaaggaaagtgtcggttagggacacaaaaaagcgagaatccgagaaccaaaaccaggattccggaacagtcatggatgtcttacagatatttgcagaaaattttgaaaaaaaattcgtgaaaaaataaaaataaataaatggataggccttgtcagtaagtctcttccaatttcagataaaaagaaaagtatttatatcttttgaggcaagcttaattgcaagaaaaattgttttttacaaatttaaaatgaactgaactattatttattattttatcatttaatattaaaaaaataataactatttaaaactattttttcatgaaaatttacttcccgacgaaggtgttgctccccgacatttttagtcttttcaggcatctccaaagaattttcgataaatttccccccgatccccgattttctttcccagagggtaggggacgaacccgacattaaagcttgttttggtgttcatcagggatggcattccgtggtcccgagaagaacatataatattttttcaaaatttaattattaattagcggtgaagcaaaaactgattattatttggcatggacgccgactcagttctgcagcccgtctttatcttcgcttttgctgccgttgagcttctgatcaatttggtttgtgttcccgtgtcggccatcaacttctttctcgtcgccaaaagttcggtgatccatccgaacctcaaacacattctcatctatcagagcggaagcattctcggggtaaactgtgcagaaaatgaacaaaaagagcgcaaagactgtgctaaactgggcaattaaaaccaaattaattaattaattaattaaatttgtaaagaaattaattaaataaacaacaaattaatttcctcctttctcttggttttcatagattcgatcattgctcaattagccttctattttctcgctaaacgccctttttcagaggggaatgtgccggttcacca

SEQ ID NO: 14783 - DNA, 1975 bp, Heterodera glycines
caaatgtaccataatcccggcgtattccttcgggtgacaacattggtagtgatctgatcagaagcattacggtgaatggaccataagcatttgctttgctttaccaatttttgctgcagaagccgcttgttggcgtgtcattgacaacgaattcacctaaaatggggggaggggaggggcggcattggcacaatgccaaaagagtgattgtctttttggcattccgtcgccttcctttgcttacccccattccgagtccgttgcatccgccgctgcaaatgtaggcattatctgtgaattttgaaatgtttaattgtaattccaaaagcattgtttgactgacaaagttttggcgcaatcacaaagttccatccgattgactcaaagtcgatcatcaaatcgtacaggcaacatttttgcgtggtgttttgctggaaactttggcattagaacatacgaatttgaaattaaatacgaattcctttggcattttccttttttggcattaaaattcagcgccaattgaggaagtaagaaaggaatactgtaacatgatggtgagccatcattaatggacagaatgccaaagacgaaagtgggaatttgattgcccaaaaaacaaacccccggtcggcacatttgcacgtgacgtcttgaacgtccactcttcaatgggtacgtctgcaactccaaaaacattgccttttcaccgtcgtccccctgcaactgtggcattattttgtattttgttggcattttgtctatttttgtcattcttttctctgcgacctcttctggcgaatgtatgacgaggttctcgtcatcgtacaatgcctccacataaagcgcaatctgaacacgaatttgttttttaaggtccgattcgaataaaataaatcagtgcatttttaattaaaattttaatcctttttttatgttaagcaaaaaatcgccgtttcgctgtttttctttgattttattttactattttttttgtccatagattttttatttttgcttaattattgtttttttctatatttaaaaaaataaaatttggtgtccaattttctgggcccctttgagtccgtcctccccccaccggcccgcctctcacaatgttcggttttctgtgccgtcggtacgggtcgccgatcattccgcggcgccgcgccccctcttcctccccctcctccccttcgtcctctccaatggcggtgccaaaatcgtttctcgtctccagccattgctgtacgatgtcctcgatgattggcacctcaacccgtgccgtggtcgggagaagactcgtctcaagctcaatgtatttggaaacgagaacagtgctcagctgagggaggggggagggcatttaatagagcttaaatagtcatagtgatcattgctgatcagagtgatcattgctgatcagagtaatcatattgctgatcagagtgatcactgctgatcagaatgaccttgttggtcagagtgatcatactggtcagagtatgtttaatcagattaatcaattctaatctaagtatattttgatcagactaatcactgctgatcagaatgaactttaatgaacttgttagtcagagccttaaatgctaatcatagcgaaatttgctgatcagagtgacattgctgatcagagtgaccttgttggtcagagtgatcatcctggtcagagtatgtttaatcagagtaatcaattctaatctgagtatattttgatcagactaatcactgctgatcagaatgaacttgttagtcagagccttaaatgctaatcatagtgagatttgctgatcagagtggtgaactttaaccagagcatttttatcagactgatcattgttgatcagagagagagaaaaagcatatccgaccagaaatcaaaatttgatttattatcaaggctaatcagaattccaaccgttccgttggcatagcgacggaaaacgtttag

SEQ ID NO: 14784 - DNA, 2497 bp, Heterodera glycines
ttaataaccaaaatcaaaatgccaacattaaatgatcacatgtcgtcctcccaaacttaggtacagtaagacttcaaaaacagaaaaaacgaaattacggttgccgaattttttttcaaaagaagtcgtctggaatttgcgttatctctggaaaatagcttaaaataggtcaaatttgccacaatatataaatatgagcggtattattcattcaaaaaccagataagcaccaattttcgctcaagtgatcaatagagctctgagtcttgaaaaaatatcgatcgcgattcgggattggaatcattccgggatagttttactgggattcaaatcccgattttatcggaatccgatcccggccctttttaagaaaaaagccgcgatcgggattgagaccccgggaaaatcccggcgggatttcgatcccgtccgggttctcgtgatcagaaatcagttattaccattatccaccgacttttgtatatttcaagaatatttagattgaacaaaaaagtatggtttctattgttgataatccaattgaccacaaaaacattggtggaatgtcggaaaatttactttacgcactcgccgatgggtcgcgtgcagcgtccgatcgaacagttcctggacacgcgggtcggggtgagtgatcggtggcaatttggtcaagtcgaccgtcacattcggcttggcgcttaggtccaactttttcagcaggtcttttagaatctgtggcgacggatggtcattaattaattagtgattaattaattatttaaacggaacaggcaaatgtttccattcaattcaatggttgggaaagttagcaatttttgaaatcagaagccttgatcagccaaagtatttcatcagtttaaatgccaaatatttgcctttcaacgataatttctgatcacaggtcaaagagtgattagtcaatgcttcaccgattttctttttgccaaagtgatcaaaacccaactctgatcaatcgatgttttggcaatttgctcaatccaattgccccttgaaaatcatttcaaaagtttacttgctcctgccggattttcttcacttcagaaaatgtgccgcaagttgcgcactgatgggacgagcaaagaatggcgaggggcgagaaaagaagaaactgaagtgataaaatgggcaatttcaaatgaatgcaaggctttctcttttattgaattgtaattactttttaattttgattttactaaacggccaaaagaatttccaatttttttgaaaaaaataaaaaaataaaatttgtatttatatgtaacagaactgctcaatgaactttttggaatgagaacaatgacaaattttcttcaaaggaaatctactattaattaggtaattaattaattagccataattaaattatattaacagcaccagcactcggagcagaaacatttgttgttgttgtttcggtggttgtaacggtggtggcccgtgtttctttctttccaccggcaactaattacccctaattggtttgtgtttgtttacggcggccaaatgcgcaaagacagcgcattattagcatggaaatgcttcttcttgttcttcttctgtgtacaaattcacttaggtatctctctctctcttttggttcacaaattcctaacatcgttatacagtaccaatcgttcaaattgggcaaaaaacaaaatgccaaatttggaaaggaatgcgccaaaaataaaatggggcgaaatatttttggtttatttgtgcaaaaggatatcgctgctgctgctcgtgtacaaatgttgcgagcgtgtgaatgaatgtgttcgtgccatgtgctgccattccgtcccctccccccgtgccgtgtcgtccgtctgtcccttttttggcattggcctaacacttggccaaagataaccaaaaaaagagagagagaagttattactagggatgtcaattttatgtaaatacatattttttcctggattctccatagcctaattagtaggaaaaacactttcttttttgtgtttgcgaacaaaagtttggacttttatttacatatttcgggattttatacatatttggtacatattttggactttttcggactttttcatacattttttacatattttgtggattttttacagaaattttaggaaatcctcaaaaataaacccaaagtttggcaaattttttgtacattttttcatttttttacatattttgagaatttttgaaaatttataaaatttcttgtgaaaaataaaaattaaccaaactaatttttaaaatactaaaatgtgattctaggcttatttaggtcatttttatggcattttgtgctcatttcaccctttccgaagaattttttttccaaaaaataaccattttaaaaattttatttacatatttggtacatattttggggttttcttacatatttcgggattttttttacatatttatgtacatatttttgacatccctagtt

SEQ ID NO: 14785 - DNA, 3640 bp, Heterodera glycines
agtcataatagcaatatttgtaaatatttccttctaattctgacctttttgtgtttaggtttttaaacataaaaaaactcacttttttgattggattctctccttttttccattgcaactttaaattcttcggcctcgttaaaatccgtgaaattcagagcctttatacaggtgtcacactcaaacacgagcagacgaggacaattcgagtaagaattcacagcaaaatccttgtaactgaaaaaactaagtacataagaaatacaataaatggagctaaattcagattttaaaaattaactcataagaattaaactgacagtatctgactccactgcaattctttcttgaaaatatcgtacatgcacaactgataattcctctcgcgataatccttcaccagatagactatcccaacgttagtctttcgccaaacattcgggctctccgcaggcgcgtcgagcagttgggcaatacccgcgaccagagaaattctgtcacggccgagcacttcaaatagctgcgaattttcttctgcactaagcagtgccgagcccttgtgagccgggcgatcctttcgctttttagagcagccgtttgaaactgaggagaaattatgctgtcgtgatattggtccactcatgacatccaaaatctgattttagaaaggaaatgcaatgattaaataaaaataaattaaaaataaaataatgtcatttccgaaggattatacaaaattaaaaagcttaaaatacgaagctaataaattaaatatgtgtagaattatgcactgaggagggatgacgacgaaggaatggtgagtgaaaaaatattgagacatgcggtggagaaaactaaaatcgatcaaatgtggagaatgaacatgaataatgggactgcagcaacagagccgtaggggtcagaacgaaaaaatgtgatattattcatcacatcagcatcatcaccggtggtgtttggcttggcttccaattcaattcaccaaatatcaatgattcatcgaattcatttgttgtgcagggagggatgatgggtgtgaatgaaaaagaatttgtccagaatagccaagtttcaaccaacaaattttaatttatttacaattaaccgcaaatgatatttgtcgaaaaagtttgttttttgaagagtacgagttgggaaaatatgtatgatgagtcgggcagtacgagttggcctatacacgttgagtttttacccaattcaaactgttttgtatgcatttaaaactagctcagctatgttttatccagctaacgcgttcttgctgttacttcctcccctcccccttccttttccattctctcctcgccttatattgctctcgcccatctcgctctatttttgcacttcaaattgcccttcaagggtgcacttcattcaccattactacacgttttccaccattcatatcaaactttcgccatggattttccacagcatcattcatcagaatgtttgttattggcacaatgaattccatccttatttctgtatccaattgctttcatttgtaacctcaactctcttcccttcctattccatcgaagaaaacaaaagggaataattggatgcatgacttgcagcacagaagagtcaaatgtcgcttggtggtcgattagtcagaaaagtgatttgttaagttttgcggatggattgatgacacattacacaagcatcgagcattcaaaggagattgacgtggagaggtggtagcagattggtgggggaagaagagagagaaaggaaaggagattggtgtgtgtgtggggagggagggggatgaaagtgggtggatgagtgatgattggaaattggtgagttgcgggaaagttccccactttgatcactatggagtcgggagacagaaaatacggctgttgggccatttctataccaaaaacgcgcaattttctcattatttctattttccacagattaatttattaaaattaaccgttaaataattcaacatttttaaattttttaataaattctttattctcctcacagctgatttgtgattgatcaaagctcccttacaaattagaagtgaaacaatgataatgataatgggatgaggttacgtaactaagaaaattatgtgccttgcgatagagagagagagagagagtcgatcgatttgtgagcccaaaaggatgaatggttgcccattcaataacctaatttttattgaatcatttaggttggtttaactgatatcattacaacaaacgaaaacaatactaatttgaacagcaaaattgcgaattttgaaaacaatatcctctcattaacattttttgtatctaaaacaaaatctgggtttgaatcgctgctgatcagtgatcacgactcgatcttgaattaaaataaaaaagtatacttcctctgctacataaaaatttgtaaatatggtttaaaaatattaggtttccaattacatatgaatgtatcctcccacaacgacaccacccctaaatagaattcatttcatttccctttccttgcctcatacgcttcgtagtcgatttttctttctttcatttctgccgcctttatctgtcccttccgcttcctgcttctcttcctcgcccttgtaattaaattccatcccctgcgctcgttttggccttccctcccacaaatgactgaagtgcctcccaacgcgcgtcgatggacactccattttggtggattggtggaagcggtcaatggcgcacacattgaccccagtggacgcactgatctactcaaagtgttggacagagccaaggcaaaaaaaaaacaaacaaacaacataaattgaccataacttgactaaattctgagcttaaaacaacggacaaaaaacctaaaagtccattggactcctaaagcgcaatagagccctaacaaataagttcagcgagacggcagtttgcaattggatggtggcgaaataacactgttggaatgcgattgcgattcagtgagagtgagttcagcgaaggtggacgaaagcagcaaacctttagcattcattccactccatcagctttcttctgtgaaattttgatgatgttttaatatatttactaaatttaatttatttaatttgaggttggctttgtccatgaaccaccacaaaacattttggcactgaaagttggtgacgtggatgagaacaagcccgatcagtttgatctgataattctttacacttcaactgaggcacgccaaacaaacaaaagatcggacgaattccttacagaacatttttaatttgaatttaggaaatggccggagaaatttgtcagtatttggccttctgttttcaattcatttaccgagaagcactgtcaacgctggagcaaaatggacacgaaagggaggaaaggaaaaagacgccgcagcaaggggacatttcgggtcagtttaaagagagaatgttgcagatgcactgacaagagactttgctgatatttttgctctttttgtttctccctaattttggcattgtctcccactgcacttttacgtacgtctgctgttgattattttataattacccttttcaccaatcgattggtccccaaatcccccctttccgctccgtctgcacttt

SEQ ID NO: 14786 - DNA, 997 bp, Heterodera glycines
aaaaatgattttgcacacttttggcatttttttgtccaattttggccatttttgctgcagttcgctgctaattgccttgcttttcgcttttttctttcctccatcactggcttcctctgctttgctttgaatcgcagccaatttacacattccttcccaaaagtcgctttctgcctgtgtccgtttcgggcccattcttcttttgacggattaatggggaacattttgccccggcaatgcggaagatgtaagggatacggctactgcccccatgggatggcccaatggatttgtgtcgacgcgcgcatttagcggcgaagattaaatgcggttgtcgcttcatcttctccgccctcagtacgcaattcccttgggcgaatgtcggcatccgccgatggcctttggattagactttgcctttgctgcgggcgtatcggaggagtcaaccaactctttcttctcactccccccttctctcctccctttccctttccttcacctctcgtcatttgttattcatttcactgaccaaaatttctttccttcccataataattgtgtaacaaattcattaatttttttttcttaccgacaattattttcttaacataataatgtttagaacacggaaatacaatttttgacgcgagcatgtgaaaacccttcctcgttccaccaaattcatgcaaatccttgccctttccacgacaatcggttattcaaattcgcaaagagcaaaagttttctccatcatcattcactaaaatcaaaaaaagcgcagccaaagtgggcttttctctccgctctcgagcagcttcatctgtttgtttgttcatcccaaatgactcccgccactccctccttaacattcaattcacctgctttggtacttcgtcttttgtacgctgtcattatgctgtcattctttaacttcttaacttatcgattccctaggagggttattttaagttgcttgtccctttctcattatttttaa

SEQ ID NO: 14787 - DNA, 1593 bp, Heterodera glycines
cttcaacagtttttttttacctcagtgccgtccaatctttggtgactttgaaaatgcgcaacagacgcgcggaacggagcacagaaatgcccagcggcttcatgaactcgaagtagacgagcacaaactcgatgatggagctgatcacaatgaaacagtcgaaccgattgaattggctgttcatgtactgaaacaacggcacggcaaaatcattcactcactcactcattcatcgggatatgccttcgcatttaagcactcttttctaattagattaagtcttagttcttacctatcttttggatttttaatcaaatttaaaatggttttaagttacccaaaaagcaattggtttttagatttaattaattctccgattttttaaacccttttaagcccgatcaatttgtaataagaatcatttatttgccgatccgattttgggtatttctactcgagagtctcggcccaagcctagccagaaaaaatccgaagacctttttttgctctttggaccaaattttttttcccagtgcttttttttcaaaatcatccattctcgacttttcagtttttcagtctcggtccctagcagtcaacacagttgttgtgtcttttaaaatgactgtgaatgtcgatgaaatgagctcatcaatttttggctaaatcatgcgccgatgattggcatttgttccttttgaacaaatgccaaaagcccaattgaaaagcataaaagtgccacctgaagaaggcccaacgagtacattttgagcagcatttccatggtgaacagcacgacaaagaacagattggcaccagtttggaaatggtccaaccactgctcctggccatggtgttcagaggtgagcaccaaagtgttgaggaacaccagcacaatgaccagccaatagaactttaagaaaagatgtaaaataggcaaaataattagggaaaatttaaatttggaaatttataaaaaaatatttagaagaataaatgtacacactatttttaattatcatgtttgtcgcactctaattagatgagagtgtcttgaaatgagtttctaattgtaagacttttttcgttagaaattttttgttttactttttcggatttttttttaatttcctcaaccctccccccccaccccctccctgaatcccctgcgaatgttacggagagtcgattctcgctgcgtcctctcaaatttctgcccgcttggtttgtcaggttgttcgattccaatcgatgcaaaaccgataccgctgagagacctgccgcaaattgtccaccctccaccaaatgtgccggtaattttgggtctttctttcgattgctttttctcaattcccgagtgcatttttcaggcaattcgagttcaaccaatgcagcaacccgtaccaatgagagccgagccacaattcctccaccctccggcaaatgcgccggcaatcgtgagcctcgatttcggcagctttttccaactcccgagcgcattgtttttccagaaattggtgtgggagcaattcatgatggggagcgaccaatggcgctgagagcattgccgcagatagcacatcggccactaaa

SEQ ID NO: 14788 - DNA, 2196 bp, Heterodera glycines
  misc_feature (2188)..(2189): n is a, c, g, or t
tccataaaaaaacaaatttggacctcggaattccgatcttctgtttccgaaaagcctcggaatgccatccctggtgtggtggtctcaccgccgccgcccctccccccgccccactcgccgcgcctaccgtctgcgacttgaccatgcgacggcacccgcggcgacaccggcggttcatccgctgcaacagtcgccactgcgtcagcagcgcggacggtcgctgcgtctcgccgtcgctgtgctcgccgtcctcgtcaccgtcgccggcgcccgactcgccatgttcgtccgcgtgttcgtcgtcgcccaactgctcgatgtcctccgcctgcgtgatccagtccaggtagcccttgaggtcctcctccagctgctgcttctcgcgaaatttctgtatcaaattaagcttattgatcactttagtaacaaattcaatgcattgattgatcaaaatggcatggtttgatcgatcgaagaggatgaccaaaatgatcactttctttccgattgatcattgttcaaatccgactaatcaaaaattagtccataattcatttcgatcaccaaaaattgatcaattccattacaattgctcagaaatttgttttgaaaatgcctgaaaaagtccgcgcgcgttggccttctcccgctccttggagaactctccggacagaacacccaacaccaaattgagcacgaaaaaggagccgaggatgaccaaagtcacgaagtaaatccaaggccattcccggcccaccgcatcattaaccggaaaagggaaatggaaattaaaataataaataaatagaaaaaatagaaaaattaatttaaaaatataaaattatttatttttatttttaaagttcaaatttatttttaatcctctgtcaattattaattaattaaatatatttatttattttaagtataaaaaaataaaattacgtttttataataataataataatatttttttttataattttatttcatttacaaaaatggtttaaaatataaaattgaattattatttgtttttaggcatttttatggaataattaattatttagtattaatattaaattaattaagcctagcctaagattaacataaacctaacataagcctaggctttagcctaagcctaagattaatcgcttcttctctcacccaatacatcacttctgtccacccctccagcgaaacgcattggaacaccgtaagcattgcgaggccaatgttgtcaaagttggtgatgccattgttggggccctgcgcggaaattcaaataaagtgccaatgaaaatagaaaaaataattttaaacaaaatgaaattaattgagaattgtttccaaaattttaaaataattaattaaattaatttttcctaaattgagtttttttgagtgcccccagggtttaaataaaataattatattttggcattttttaaaattcataagaattaaaattgccgcgttttttaaaattcttaaaaatttaaattggcacttttaatgtgcttctcactgactgaccatccatgttgtgttgtgcgagcaaagccatttgtgccgcaccgaatgaatggccgaagcggaggaaggctcacaatggtaggcactggaggcgaagccacaagtctaacaaaaaaaaagggggcaaaatgccaattatggatgccaaattaaaaaatgggaacttacggatggatctaattgcgccaattcgagggtcaccgaatcgatgcttcaaaagaattgttaatgagttttttgggataaaattaaaaaaaaaaaacttttccctattaaataaaaaatgaaaacttttccgaaaatcataaattcaatttcactaaattttcgtcttaaattttccaaattttctcaaatgcccgtcaaccatgtggagtgcagcttgccacagaacagctccaacccgatgatggcatagatgaggatgacgaagaggacgagcagtgcgatgtgcagcaacggaatcatggcacgaagaatggcattcagaacaacttggagacctgagaggcaaaaattggggctgagaaaaagccaatccgaagcaagggatgatatgctcgagtcgagaattaatgcgcattttggcacaattcaatcgtcgactacagtagaaagtatgataacatttcggtaatttcccggaacnntgtaatt

SEQ ID NO: 14789 - DNA, 509 bp, Heterodera glycines
ccgtttgtccgcacattctttcatcctaaatttttgcaatttttgacgggttgaaactttggcattttttcggtttatcgacattttatgagtcaaactctttgtccaaatgaaccaagcagtgttaaatcgttaatttttaaccaaaagagggatggaccatttgacccgaactccaacccttttgaatgttcaaattttccttttatgatttttttttcaactttaggttagtaaaccggaatttagccaaaacggccaatccgttaatctttctgctttctcatgataaccctcaagtaaaacccaaaaaacctttcaagaagtccactctgattgccgggaatagtttggccgaataaaacagttgtttctggtcagacattatatgcttgttgatctgagaatcaattaacattgtataaaccaagatttattattgtatggtgaaaataaaacgggggagcaattcggtgatttgcaaaagtcaattggacgcttaaaatgca

SEQ ID NO: 14790 - DNA, 2843 bp, Heterodera glycines
  misc_feature (2704)..(2704): n is a, c, g, or t
  misc_feature (2707)..(2707): n is a, c, g, or t
  misc_feature (2711)..(2712): n is a, c, g, or t
ctcattctgacacatttttggacaggaagagaaatcctttatgttgtttgacgccaactctttatgtcccatacttcttattttattttgatttttaggctaaaaaatgcttatatgaatcttatcgttgtattttttgggcatacatatggaaaagcataaaaacccaaacaaatgaaatgtattcgaacgaaagaagaaataaaataaatgttaggggcaattagcagatcagtttccgtatataatgatcaatcatttgtcatttcccaataattcgttcagtttttcttacgcttcttgttttgtcccggctttggtggagacattggccttaattaagtgtgatttaaatttgattataaaagcaaaagctactcacccaatgcacttggcattgtccatccaaaagtggacattgttcaaattgttcgaattttcgtcctcccactgaatcgtctccccaatttggcatcgtttgattatcaattggtttcccaattggccttctttctccaatgtcagcttttcgccgatcccattgttcgtcaattcaaatggcccaatttccgttggttcgtaaagttcaatccgaattatgtagctggccgaagaattggtggaaccgagaaatgcctaaacaattgaaatggaaaaacaaattgcaatcaatccaaaatgtttttcgaaaaaatggccttacctctttgaaattgttgagccattcagtggttcctgccggataaccacagcaagtcaattgttttggctttccatcgctaatcggagtgcacaaccattcaaacaatgcttggcaaacagttggagttgcatttggcccattttgatcaccaatattggtaaacaaataatcgagatggattgaattcaactgattgagatcagtgagaattgtgggcgaagtacggcgaagcaaattgtccagctgatcgccttttggaatgcccaagcggcgaatgtttggcacgaaaatcggccaaatttcacggacgaaagcatcccaaattggctggtaatcattggcgtccggacggagccacagactcaaattggtgcctcttccgtcaaaaatttgctgattggaacggaggaatgtgatgacggaatgatcgatacacctgaaaagcaaatgctttacataaatatcagtgaaaatcctttgatttactcaattcgaagacgattaaagcgaattttgttgggcagcgaatggtcaggcaacggaaatggcacagcatcggcattgctattcgtgtcttgcacggatagctgtgtttttgctcccattttgtgaattctgatttgtctccaaattgtcaattcgcttttgccatcgaaatgcgcgtccaccagcaaattgaaacgaggtgagagaagtgccaatttgaggccgagttgaggacggttaaagaatgggaacaaatccatcaaaatgtcattgcaaatccaactaaaactgtgtaaaattactaaattgaaatttgaaagttcgaaattttccttaccgtctgttcattttggtggccacgcgaacactttgtccaagtgatgtcacaactgaaaccaacgattgctgctgattttcaccaattgctcagaataaatgggccgatggtcggcggaggaatgctttttctttttttcagcggatggttctattgaaaaaaacaataatttagtctaaaattaggaaatatttgaaaaaatttgcacaaaaactaagcgaggagttgtgcttcctggtactttcctgttttgaaggtcaccccaattaaaaaaatgttggactcgtatttatgtgaacaattggacgcttaaactgcagtagaggcccgggaagtacacccggacggatttcgggaattttgcatggattttcaaattgacataaaaagtgaaaaatagtgacaaaacgccaaaaaagtgaattttcactattttatgtgacaaaacagcaaaatagtgatttctaattgatcaatcataattataccattaatttgattgcagtccggtgtggtcagagagccgttgtagcggaaaatgagtttttttggatggattcattcatcgtaagcattcctaaaaatttccatgcctttactaagttttctattgcttattttggccccaccatttttcagtttctttttttttgccatttatcccacctgcttttgtcacttgacttagtgcgttttgcagtgccaccaatgggcgtccgatgaatgccgttttgtaaagaattcccaccacagcgtagccatccgaaatttgaagtgcttcttctgctttagcccttctttgatatggacaaggtgaagctaaactggcaaaacttacttttaattaaaaaacttaataatttttgtaactacatgttttaaattatcttaaacttttccggaaagccaatttaattaagtttgagaatcaaacaaaaacgcctttcaagtcttgcaatgaatttatattatttcattaaaggcctcattcatgctttttttttaatgcctgcttaaattttttgcttatttcttcgattttggtatgaaaatctcaaaaagtgaaaaattctttcgtttttgtaatgcacatgcagagaggaaccgattggtgcctatttttgtcgcactttcttgcgtttttgagtcagtggacagttgagtcccaaatgtatttnggncatnnttcggttctgggtctgtaactctttaggcaatggttccgccaatttttcgtttcttgctttaagtcgattggtatataatttgtttaatttgaatccaggggcctatgaactaactatatgtattttaccc

SEQ ID NO: 14791 - DNA, 4218 bp, Heterodera glycines
agagccaaccaccaaggccatttaatcgcggagggaacgcctcagacagaatatagggcgttctccgctattaacaaaaatccggaaagggccaaaaccccagcaaggaaatgggatcggtcctgctcgctctgctcgggaactgatcatctcccgagcgagtgcccggcgttcccaacaccgggagctcgccgaaaacggctgacagaacagcagcgctgcctcaactgccttgtgcaaggtcacaacactgaggagtgcacctcaccataccgttgccgaaactgtggcaacaaacaccacttcctcatatgcttcaagagggaagagtcccattcacggtcaaatgggaatcgttccgcttcctcccccaagtcgggaagagagccaggagggcgaaagttccatcagcggcaggtggaaagccaaacccacctgatcacggctgggtttcaacagaacgatcagtcaaaccctccgccaagagagggggagattgttcaatccatggggatgtccaccgtggacaccagcaaagggagagccaacaaggttcccaagtgcaaaaagccgcacgcgtatctgatgacgcgacggctgctggctaagtcaagtcgcgacagccggaatataatcaaagttgcagtgctctttgacccgggaagccaaacaacgtacggagcggatccgcttatcgataagctccgcccgcacaaactcacctccgaagagatggaggtccacgggtttggaggaaaacgggagccgttacgcttccattcacccatttactccgtccttctccaaagggcggacggaaaatgggaggaaattgtactcaatcggacggagaaaatctccactcacttcagcatggtcgaatggagcgccgatgaatccgtcacgaatcatcacgaagtctgtgaagcaatgtgcttcacaaaggaggagccaatgatactcctcagcgcaagacacttctggcaattcttccaagggaagagagaagtgtctcccgggctgtttgtgatcaacacaacatttggcccgctggtaaatggcgagtccactattggaccgccaaactcaagtcaaaaggccctttcgatgatggccatccacagcacaaatgtggaacaaatgccaaccatcaatgaggttgagcatttcttcaacctcgaatcactgggaatccaggatgatcctgcccaggatgacgaccaaacagctatggagctgtttaacaaatcaatccgtcaagagacagacggaagttactctgtcaaatggccgtggaaggagtccaatccggacctctcttccaatttcaaaatggcccacagcaggctgtcatcggtgctaaccaagctccgacattctccagaaattctggagaagtacgatgccaccatccgcgatcaactgcaacagggcaccatcgagaaggcccaaagggctcctggacagcttgagcacttccgccctcaccatggagtgctcgccaaaaagctacgcgtcgtttatgacgcgagtgctcacacacgcggaacaccaagcctcaacagctgcttcttccgaggcccagtgcttctgccagatttggcaggcatgcttcttctgttccgttgcccgacctttccgcttctcgcggacattcaagccgcatttctccaaatttcattggagccggaagaccgggaggtcacgaagttcctctggctaaaggacacgtcaaagggactgactcccgacaacttggcaatatttcgattttgccgagttgcgttcggggtcgtcagctcgccattcattttggcggcgacactccgccacacttgcaacagttcgactccccactgtccagggagatttcggagtccatttatgtggacaatgtactcctcgagtgcgagacggtacaggaagccttggaaaaatacaaattttccaaggacatcctccaacaaggatgcttcaacctgagggaattcatctctaactcaaaagaggtgatgaaacaaatccctcaggaggatcagcttgataagccgaaggccaaagtccttggccttccttgggacaccgagaaagacgaaattgtcttcaaattcccaacaactgatccattgaggccagtcacacgaagactggtcctcagccatctagcatcgctcttcgaccctttgggggtccttggaccatgcaccaatggaaggacgaggaaatcagaattcctcgccgcgcaatgctcaatgacacacagtcaattgagctccatgcatttgtggacgcatcggtccacacattcgcgaccgcgatatacgtacgctacgctcaaaggcaattgcgtcgtccaattgccagccttaatctttggggcgtttcgcaaatcgctctatcatgggtaaaacccatgaaactcaaccacaatttgttgagcgaaggctgaaagaaatccgagaatgtctcggatgtactttccactttgtccgtactggggacaacccagcggacctcgcaacacgcggagcaactacttcggagctccgcaaccatcatctctggtggaaagggccaacttggctcacacaagagagccatctttggcccaacgaattctgtttcaaagtaacagagtctgaccaacaaaactcggagaatgttggcccgagtggtgcgtttctcgcatacactcactcaaagcagccaaatgagcaggtcttaattgacccctcacgcttcagctcatggaagcgtctaatgcgaacgacaatgttcgtattacgattcctcgccttaatgttcaaaaggggcgaagaaacaattgcttcactcgagaagcacagaaaggaaattcgccaaatttccaagtctggggaattcaaggcggaagacttcgcactcgcggagcgagtgctcatccgcctggaccagatggatgatgctgaagaattccaacactttaaaacagtgtttgaagacgacggaattctccgtctgaataccagactggagatgagtgagaagccatacagcttctctcatcccattcttcttgccaagcattcagctttggcaaagctgatcattttggatcggcaccaaaaaaggcatcaccttggagtggacaccactctgacagaattcctgagcgaattctggatgccaagcgcgcgtttaaatgttaagcgggctcttcgggattgtcttctctgtcgccgaatgaatgcacaacaatttgcattaccaaccatgccacccttgccgggtgagcgagtacgccgacacgcgccatttcagtcaattggaattgactttctcgggccaacgacaatttcgttggccggagaaaaaataaaggcatggatcctcatcataatatgcctcgcaacgcgcgctgtctaccttgaggcaacattggacctcacatcggaatcattcatcaatgttctccgtcgattcataagtcgacggggaaaacccgacatcatttggagcgacaacgctacgaccttcaaactcgctcagaaaaccctggagcttctcagtgctccggggccggatcaggaagtacaaaacttcctgacccataaccgaatccagtggcgattcattgcccaaataagtccttgagcaggaggcttttacgagcgcctcgtgaagctagtcaaggactgcttcaagcgaactttgggtcgaaggattctttccttcgaccaactcaacacattcgtggccgaagtggaggccatcttcaattacagaccgattaccgcggtctcagacgcagtggatggaccagttccactgcgtcccatcaatctcttacaaccagagattcatagcaattgggaaacaacaacggacccaattgattcagaggaaatgttttcctccacacacgaacgtttagcttcccgaatacaagcactccgggaagccaaagacattttctgggccaaatggcactctgagtatttaacattactcagagaaagagcccagtgggaccacaaaggtccacgactccaaaacttcggtgaaccgaagaaagggatggtggtcctaatctctcaggacctcgttcctcgcaatcaatggccaatgggacgaatcgttgaaacacacggacggcctggagccatccgaagtgttaaagttgaaatccctgtccgagggaccaacaacaaaaagccaaaggacatgccacgaaagaca

SEQ ID NO: 14792 - DNA, 914 bp, Heterodera glycines
tcccaaacagtagtggatcaaatttttcagaaaatcacaaaaaatctggtagcggtgtcggggaaaacgatcaggttcaaaaaagggtctacgtcggggaggggggggggagagaaatcaaccgatcatcattcgagcgcaggtgttactctgttgttgttgttcatcgccggaccagacaacctgtacaaagtgcagtagtgctcgctcaccttcaccggatgcggatggtacaacggtggttgtggacaaattggctgttaaatggggaaagagagagagagagagagagaaaattgccttgactgtatgccccacccattttgtcaaaaagaatccatggccagcttgtcaaaaaaaaaatatttttttatggactggaggtggccctggttcaagtccaccatgggtgaatttatttattttttaaatattttttgctgggcccaatattatttacaattgagtacaattctaaggcaatatgcacattttgttgtaaagattaaaaaattcacacgatacatacattgctccttcggcattgacaaaccgcctgtgccgttcggacactgctgtttctgccaccgtgacgaacggcgtcggcattggatccgttggcggactgaggtggaaagcggacggtgcacgccgcgcaggattgtcccgaatggtgatgtccaccgcaaacgaggcacagcaaaaacgatggacaaagagaatgacgagggaaaagcgaagaaaatggacgacgacggcacggcatttaggaggggcggcgccgaaaggtgcgacggatggcattcgacgatcagttttatgaaaaaacgataaacaaattggccgagacaaaagcgttctatctgatgctagtgtgtttaattgtgatgaagaaattgatgaaatcccatttt

SEQ ID NO: 14793 - DNA, 3339 bp, Heterodera glycines
attaagaggttgtgccaaaataaagtgaaatccaattgtaaaaatgttggaccatttgtaataaaaatccaaatgtggccacaaaaatcacattccgaagcttcgcttggactgcgctcgggtggacgaaacactgtgcttccccgcctccgcaatttgagtgccgccgacccgtcgttgcgccctctccgtttggatttttcgttcggatagctgtttctgcgcctcctccatttctcgttccattgcggcggtggtccgttcagtgtccttaaataacaaaaattttagtcagaatttcgattttcgaaaaatttttgggcctcggaatgccaatccaggaacgtacaccaattgaactgacccgaattttctccaaccgcgttttaatggtctctttgaccgagtagaacatcggccccaattcggcgagccattgcgcgtcgaccgccgtcacactttgcatgtactccttggccgtcatcaccaattcgtggtaaacgacgtactgtgaaagacggagatagatatttgtaatttcggatcggaattttccatattctaaaaaaaccaacgtcaggcgtatagcccatgccaaacagtgccgaagtcgggtggaggaagcagggcattcccgtccgaacattcgcatattcgccgattcccttcagtctttaaaacgggaaaataaaagtagaaaagctcacaagaggtttggctcacatcatttaccctggatcatttcctcgaaattaaaaaaataaaataaacagaaaatattttaaaaaaaaacaacctaaaatttgcaaaatctttttcatttcttagaaaaacatacataatatttaaaagattctaagcctttggctttaccgtgccgcgttgtaaaagtatgccgagcagacgcacttgcgcaccacgtcccaatccgtcccggaagagagcatttccaagcgctgactctccataatttcggccaattgcgcgcgcacctcgcgaactttgcgcatcgcttttgcgtgcacaaaattgtcggtgcaccacttggagctgtacttgtgcttctgccattggatgtacgtgttcaggtaggtcagatggtcactttcggggacctaaaggcaattgtcggattatttccattctttagaaattgaaatgtgagtgcctggaatttctcccgtcgtgcgtccgcctcgtcctcgcgccctttgggccgaaaaaacagcgaaggaatggaaagcatcgacacaatggtcaaaatttcgctgctgcagcccatgtccacggacatcagcagcattttggacagtgttgggtccagcggaactgagaaaaacgaaaaatagcattttttggggggaaagtgggatgaatttgcttacattccaccattttgcgtcccaaatccgtcagttggccaatgttgtccagtgcacccaatgtccaaagctggtacatggagttcagcatgttgtccatcggcggtgagtccatgaaatggaacagcagcaaatcgtcgacattgagggacttgctaaatgagaaaaataattattttaataaaccatgaatgttcccggaaaatgaaaaacattaaattagaaaggaccgaaagcgacgaactctaattgcaagcaaaaaattaaggagaaaaactgacagcaaaaggacgacattggcaaggtttgtccgttgaatttccggcacagtgctgaccaacatttcgtccttgaactgtcgctcggtgtacagtcggtagcagtggccaggccccgtacgcccggcacggcccgaccgttgattggcggacgcttgcgaaacggggaatatctgttcagcaaatggcggtttggattaaattgcaaatgcttaattttgctgacctgcagcgtgtccatgccgattttttcggtgaataccttcagcttgcagtagcccggatccaccacaaagaaaatgccgtcaacagtcaatgaggtttcggcaatgtttgtggccacaatgcatttgcgcatccctcctggcgctttttggaaaattttggcctgaaggtcgctgggcaactgcgagtaaatgggcagcacggcgagcggaggcgcctcgtccaactcgcccaatttttctttgatcagcgcacaagtcaccttaaaaaggggcaaaatttagcataatcctggaagggtcaatccggttggtaatttttttcaatataaaataacaaacggagcttttgcgaaaaatggggaggggagggaaccccaaggaaaccaatgagaaatgaattgataaagccaacgtgaatgctgggactgacttcgatgtcctcttggcccggcatgaaaatcaaaatgtcgccctccatgccgcccaagtgaattttgaccgcctgtttgaccgccgcgtcgacgtggtcttccacgggaacacgggcgtggtaaatctcgacgggaaatgttcggccaggaatttggaaaattggcgtatgtccgccgaagaaattggcgaatttatccgcatccattgtcgcagaagtgacaatcagtttcaagtcggaactaaaaaggaaaaagtaagagaaaatttggaaaggaaaacgacagggaatgattaaccgaaaaaaatgaacagcgaaagtggaaaagcactcaaataatgttgaaaattagatgtccctacttaattccgccacagatccgtaaccagggggtgtgtggggaattgccaaacgcccgaaatgaaaaactatccgaaaaatgggaattttaaattaactgaatttcttaaaagatggccaaattttcgtttcctcggcagcatctaggtttttttttctacggcgctggaagctcttcggttgcctccccccaccgaatttttttctggttatgagcctgtttatctatgcaattttaatttcatttcttttaccgtcttgccaccacatctctcagcagtccaaacagaacgtcggtgttcagtgaacgctcgtgcgcctcgtccataatgatggcggcgtaggagtccaagtcggggtcactgaaaatgaattataaaatctaaaaaaagaatgcgtttgggatggcacctcaaacattctctcagcagaataccatccgtcatatactgaaaaaaattaaagtgaaatgcaaaaatgaaatacaaaaaatgggaaatcgaagttactttaattatcgttttctcggatgtgcagtcctcaaaccgaatggcataaccgcactcctgaaaccgaacatataaaggcaacaatcatctgccacattttctagagaatgaccgaggagtgtgtttttgttagattttatccgtcagaaacaa

SEQ ID NO: 14794 - DNA, 3525 bp, Heterodera glycines
tttccttttgtttttctctctaatgtattcctatttttctcaatcgatattcctttgcttttcttctcccttgtgctttcctttattcattctatttggtgttcacaaatttggacctcagacttttctcctctaaatattttgtgtgtggactcttaattttcgtcgtcttcgcattgaatttaaattaaataaattgaactgtccccgactatttcgccgtccttaattaataagcattggccccgtttgtcctttctgtgctaattaattatttggcccgagaagaggaaaagccgaacgaagcaaagcaaaagagacgagcccctccgacaaattggactccaatttttgcacgattattttaaaatttcaaaaaaaatgaaattacagttcagcaaatcggatcatttcccgaaatgaagtctttccagtgaattggcctgagaattgaccgatcgcttcttcgtcaacaacaataaattcgtcaaagatttccatttaatttatttcagttgaaaatttaaaaatatttttatttaaatcgcattttaatagaatttttcggaaaaacgccaaaaaaggcatttaaggcacgaaaatcccgaaaaggcaaaaaaaaggtataataaaagtcaatgtataagcctcaaaacaagtgggaaaatgcctcaaaagtcaattttgtgtttgcgaacaaaagttgggacttttatttacatatttttacatatttcgaggttttatacatatttggtaaatattttggactttttcttacatattttcatttttttaacatattttgaggatttttacggaaatttttaaatttaaaaaaaaatccaaaatttcggcaaattttttgctcatatttttttcaaatatttcgagaaattttgaaaatttatagtgaaaaaataccaatgaaaaataccaaaaaaataatttttaaaatactaaaagttcttctaattgtaagactatttaagtaatttttatggcattttgaagcctatttcatactttacgatgatttttttccaaaaaaaaaaccatttaaaaaaaattttatttacatatttggggttttttgtacatattttgggtttcttcttacatatttatgtacatatttggaccactttttgtacatatttttgacagccctactaattataattaatagagaataaaaacaaaagtgattttggaaaataaataatttgaaaatttaaaatgaaatttaccaatttaaataattttgttatttaagagtaaataattttatttaaaataaaaacattatcacttattagacaactattttactttcatttatactttttgggtgagtcagtggtaattggtaatttgggaaatgattgatgcccaagggcaaagaacagcactaagcagtagagatcggaccggtcggttttttttcggtttttttcagtatttttcgattttcggtttttaaccgaaaaaaaccgaccgagaaatttttgagtttttcgggttttttcggcttttaaccgaaaccgttcgaccgaccctcttgtccggtctctactaagcagacagactgacccactgctgcagacatctcgcagcccctgagggggaaattgggtggacttatatactggcacaattggggatggactttggatgggatggggggtaatgacggcaagacaaaaatggatggcaaatgcaacagagcaacagagaggggaatgggatagaatggcacgataagagtggaaaatgagaaggattgggcattggcttgggattgggggccgaagcccgccccatacgaggtcgcgaagcggccgagtgagtaccttaagcgcaggaaaattagtaaatgggggaggggggaggagtaagggcgggggaagcgaaatgaggggccgaaggccccataccagggatggcattccgaggccccaaaaattttcggaaatcggtaccatctctgcccatatgaggcctcgatgtggccgagtgagtaccttaagcgcgggaaaacttaaggcccgcctgtgttgaaagctgtccagcgctttccagggccctggttaactagtaaattaaaaaatcggcggaattccgtttcccgttattactaattgtataagaaactgataattaaaacaattaacaaatttattcataccaacattagttgacttcataatggaaacccgtggctaattgatcccactaattggcatgctttgtatcgccagttagcaccaaaaattgagcaaaaattaaaaaaatcattttatgaaaactccaaaatcaaattgatcaaagcccggccatcgctcgtacagataaagcgtacaaaaattctttgctgattacaggaaaaaacaattcatggttcacagcaaaaaaggcacgcaatttgttgacatccaaatgcaaaaaagaattctaaaagcggaaaattaattaaaatcttttaaaaatttaaatattaattagtaatcactttcaaattgtcgagtccgtagcgatcaatcagaaggaaacggtcgatcagcggaatttcatcgcaattgatcagatgcgtttcgcaacgcgacttcaacgcggtcacctgaaaacagaatagtttgtttattagaaatagcaaattcattagcaagttttgagtcatttgatggcaattaatagtcccaattagcctaccaaattaaaaaaaattacgtaaaatgacattttttcaccactttgtttgttataaaaaatgccaaaatattcgccaaattatcccatttgaaaataaataattttaaccaaaaagaggaaaaacaatttgtttgaaaaataaacaattaatgaaaatgccaaaaaaatcaatatgatcaaagccgataatttaacaaattcatccacaaagtctgacggacaaagcgtacaaaaattctttactgataaaaggcacaaactgttcactgttcgcagtgaaaaaggcacggaatttatcaacattcaaatgcaaaaaataattctaaaaatgggaaaataaaatttaataaatcatttaaaaactattttaaaatattaaaaaattaaatatttgaaaattaaatcactttcaaattgtcgagtccgaagcgttcaatcagaaggaaacggtcgatcagcggaatttcaacgcaattgatcagatgcgtttcgcaacgcgacttcaacgcggcaacctcaaaacagaacagttcgtttattagaaatagcaaattcattagcaaatttgggatcatttaatggccattaatttaaagtgagcaaatataaacattacaagcaaattaaaattaacttttggttaattagtttttggaaaagtcaagtaaaaaagtgacaaatattatggtggtttaatttaatatttaaattaaaatgatcagacagaaagaaagaggatgtgataagtgatcagaggactcacctggaaatagtcagccaattcgagaagcatcagcacatttttagctaaaa

SEQ ID NO: 14795 - DNA, 3649 bp, Heterodera glycines
ctttgattttgaaaaatgttaaatgtttgatgaaaaagatgaacaatttaaaattgaatgatttgtggtcccgacaggcgccgccgtgagaaaattcttaattttgcccaatttgttacagatattgcaccaaaacaatagcttttttaatttttcgtattattacattactcagactttgtgctttcgaattatatcaaaaatataggttgggttcgaacatgaacaaagttattgtgtaaaaactaggtatatgctctgtaacaaaattataaactcaagaattttttatcacttcagctatttcccgtggacgaatcgagatgaaatttttaccaagcatacctaccccataaatattaagaaccacacaaaaaaatcggaaagtgtaaaagaaaaaaatttatgaattttttccgaaaatggtcccaaatttggcgtaacaaaattatataatatcaaaattaccctcgttttcacaagaatttggataaaattatataattatttctctgcaagaaaaaacgtaaagcataaaagacagaattaagtatatttacctacattcataaatcatacatattctgttaaattacatatatacaacataattatgacatttatttctccattttttcggtttccattagttgttttgacttttgtttttataatattttgctcatttcttttctcatcatccgccgctttgtcttcaaattttgcttcgagtgggccccgtttttcgtcaattttccgcaattcttccgcctcttcaaattcatcctcatcatcatcatcattatctgcattggtggaactttcgtccgtgttgacgcggtattcgtaataaaaactgaaattaaatttttattaaagccatttattcaattatttttgcaataattggaggcttcccaaatatatctttaatattcatgaaaaattcaaaatgacagtgtgcattttagcgtttatttgatttttaagaattttgagtttttatgaaaaataactgtcaaaagcctacagtcgaaaattttgaaaaaatggcgaaatatttaatataatagtttaagagaaaagaaattatacattgccaaaagtgcaaaaatgaagatgaccacaagcatagcaactgagaaaataaaattcgaattaatattttttttaatatattatcttttaaataattatcattattttattccaaaattttattcaccagcatatgcaacaaattggacagccatgtcaccaaaatggaaaaatgtaacaaaaatgatgatcatatcgccaatggcaaccgtcaaaaaccagcaagcttggagcagagttttcattgaaggtgcggactgttggaaaattggaaatataaaacgtgaaaattaattctatcaattaaataaatatttttttaaatatttatagcatgatttcaaaatatttattcacttgggaatatgcgaattcgtagcctgggattgagaacagaatctctgctgctgtgatgatggcaatttgagggatttgccaaagaatgctcactgtgttgggcggaatggcacgaaaaacgcgttttcgaggcttaacagtagactatgtgttaacatggtaatgattcaaaatccaaaccgctaaatgactaaaaaaagaaacataaaatgcttagaaaaaggggtaggaccgggttccgtgctcaaatcccgtatgtatggaccagggttctattgggaatttttaagaggatggagtttctccattcggtcttttctatacgtttttattagaaattccgtgagaaaagccgaaaaagctgctgtatctgcagcatccaaatttcaatttttttacaatccaatcaaaaaatttctgtctgttcattccatcccaagcagggctgggcgagcttcgaatccagctcctctcattttcaatgattgtgccatttctatcccattaacctctgttgcatatcccattcatttctccaacattccctttgtgattagtcctcatgattcctcaccctacccaaagtacctctctcgcaattgtacccgtatataaatcctctccactgccccctcggagcaattctttcccaaatattataatacgccctgtgattgtcattgacccaaacccattcccgatttttattgctatttattttttaatgcttttcctttaataaataaattcctctcccataaattggtgattcaaattggtttaaagccttaaatccggggacacaacaaaagcaattcgtacaaaaatttgtttcttcgattttaccagaaggaaaatttaaaatgggaatatctgaggctcattttcaccttttccattgttccgctgacaatgattgcataaatgccgccctggtcatgcatttcgatgtttatgtccgaatatgtgacgttcagtgccgatttgtctaagcggcgatgtgcggcatccgtcgtcgcatcattgtgcatgtaaaagaggccccaactgaatcaaaagattaatatttaaattgccaaaaatcatttcaatgattagttttaaaaaattttttaattggttataaatttatcaatttaagaatttattagctaaatttttaaaaaaattataaaattcgtaaagttgaaaatttcctacaagcaataaaaatgcttttatttaacgctcgcttaggttttgaaaattacacaaaaatttctcttaacttactttcccggacgaatatgcttgaaattgaacagagaagcttgctgctccgattcggaagaagattgcaataaatagcgcactttggctttcaaatcggattttaggccgcttcccactggtgcgacagactcaagcgcataaaaatcctgtgaataaaaatgagccttattttcatggaaaaagcctaaaatggcatgcaatttacttaaaagttttttgtggccggaaaatgcgtcagtaaagagatagaattatgataaatttaaattatacagaattgatatgctaacaaacctacaataatccaattacagtatgtttgtttgtttttgtagggatttggtaatttttttcaaaattttattaaagttttgtgttccaaaaattgaattggcgaattcgttgtaatagtacgaagaacttgctggttttttaaatttggatcgagagtctcgaccaattgaattgcttacctcagccctttgcgggtcacatgggtgcgcttcttcgctgctgttgccactgctcgtcccggaatcgcctctaagccggcaaagtgccaaattgcccgtgtaagtgatgtccgacagtgccaaattgactgataaactgaactccccgttgcccccggtgggcttggccgtgtccgattggcccacaaacgctccgtttggaccaatggccagaaaataaattgaccgttcagtgttgaagcgcaggttcaaccgtttcggcaaatccaaaccatccaaatcttttggggaaaggagtttaatagtaatttttattgtaattattcagggctgtcctttttaatgaaatggctttttctgatagtatggaatggaatgacctaaatgcatgaaacttcattttaaggaaatttcagcatctaaagcaaatttttaatttaatttatttt

SEQ ID NO: 14796 - DNA, 1058 bp, Heterodera glycines
ccccgaactccccattcctccatcccatccattttatcagagctgccttcctgctttggtctctttttatttatttattttaaaaatagtctttttttcagtattcgcatttatattttttatttcaaattttgagccgaattcttatttaataaatcgcaataaaatattttcatcaaaatcctttaaaattagacaatttaattgatttaaatggtttaaaaaatttatttatttaaaatataattcattttgaaaaactccctttttattgcatatggtaaaatttgatgtgttaaaaattttctctttgatttaattggagttaaattggcttgtacagcttttggattcgaatttagcccatggcgacaattttcaaatatttttcaggcattacccacaccgttagaagaaaaaaccgcacctttgttggattatcggaagcctgggacgagaagccgcacaaatcttaccattttccattatcttggattatgacacattttttaagatgataagtaaggatgccaaaaatatggatataaaatcgcaaaatatggccataaaatatggaccaaaaatcgcgaaatatggacataaaatggcaaaaatgtcaaaatatggacataaatttttcaaaattgagtgcaaaatttcttcaaatttattggttgaaattgcatatgagatacatttccaaattttttttgactcggtaaggcgctttgacaaagacggctttcgttttggcaattagtcggtcaacattcggaaattggtctcgaattttttcggcaattctgtgcaatcattttagaagaaaaaaaaaacatgaaagctaaaatttattaatttttttagcgcaaaatcaaccacaaaagcgaaattttcgcttttttgcttatttttgacataaatttattaattttttagaaaatttaaatttattccatattctcgagaaaattttggcgaaaaaatgattttttgaaaaattttccgtttttgggctcaaaaggctatttagctgctgggagcgttgtaatagaggtttt

SEQ ID NO: 14797 - DNA, 1885 bp, Heterodera glycines
  misc_feature (1836)..(1836): n is a, c, g, or t
tgccgaaacggcaaagtggtgtgctagtcacaatcccaaaatcagatgctcatgctaatggtctccctttgctgctgaaaacaaatgcattcctgctcactgatggggaaattgcggaagaacggaattttctcctttttgaaaattcttttggcattatgccttttgctgttgttgtgcttgttcactattttgttgcgctgaaaaaagctccttcagattaatcaaaaaatttaatcaaaacccgaggatttcggtcacattttgccgctgttacggcaaaaaaaaaaaaattgtaaatgatgggtcgcgcctcaaccctactatctatcttgtagcctattttgtgctcttttttctgtcttacttaaaaatttttccaacccctaacaattttttctctcgaaaattttaccgatttcatgtttaaattagttcatcagaaagagtgaacttcttcttcttaggtcaacattcaattttgcttatattcaaaatttgaatatgaaaaagtttttcatattaacaaaaagatttaaaaaggtacatttgaattttggatcatttattgtattaaaaaaacagtacaaaaacctctaatggccgatcattttttcactgatcgtttcgtcactgagaaataatttttaaattattagtctcagtgacgaaatgataggtaaccatttaaatgccaaatagaaaaacgaaatgcaaaaactttgtaaatatttaaacagaggacaacgatcgacggaggcgaaaaagggaaaaaattttaatgtaaaaaagctaaacaaataaattattttcctaaactttcatataaaactaaaatgcggcactctttcccatataaaaaccaatcaaaaaagtcaattttcataataataataataataataataaatttaaaaataaaacatttaataaatttttagacattattttctaattctcaaattttcgttttttcattcgcattcgggttatccatcttgaaaatggaaaactttatttttcaaaaaggctaggggtaccatcggcattattagctgaaacccaaaaaccgagaaatttgtcgactaaaaacaatagattctcggaccacccttgagccaatttcttttttaagaacttttgtttattatttttaataattttcatggatcaaaggccttaatgacaaaaaaaaaataaatctaaaaaccaagtcctacccataagttagttattcaaaaaaaaaccaaaagccgaaccgtaagccccctaatcttaataattaaaaacaaaaaattccaattttacccttaatttcaacatttttagttttcccataaacgaagaaattttcataatgctcaacaaaaaatgcgtcacatttgctctgtttctgctgttgtcagctgctgtccttttcgtttcgggagccaaaaaatctgcgagtaagtttcaaatggactaattaattattttaattgcaataaacaatatttactaaggggatattaggtttttttttagaacgctttttatttttaataaattttccaaaattatttttcataccatatttaactatttttgggatttttaattttttaatttaaataaattttgtaaaattttgtcctcagtttgaaatatgtgcgtggtttttattattttctatgcatattttataatacagtatttataaaaacaaagtctgtaaatatgatttctgaaatacaaggtgtgaaaaataagaaactatatagaaaagcttgtattgttgaattcaacttgttaaacggttattttttttaattttgaaaaacggaaaaatacacattnctagaaaagtagagcggggaccgggaccaaaacacggacaactgagtac

SEQ ID NO: 14798 - DNA, 1494 bp, Heterodera glycines
  misc_feature (1414)..(1414): n is a, c, g, or t
  misc_feature (1471)..(1471): n is a, c, g, or t
attattaaaattacaaaaaaaaaattgtttatttaattgcccttttccaaaaccataatgaaaataaacaagcctatgatttttaaatgctttgcaatcataaaaaatgtttgattattattgtttacttaataaagtacatagaaattgaaaaactcaccatagaagagttaatctgttatagaagaaaattgagaaattattagtgaaattaagatttctcttaacagggtaggcgaaaagggctgcaattgaaaatctttttaaatgctttgcaatcatagaaaaatgtttgattattattgtttacaataaagtacatagaaattgaaaaactcaccatagaagagataatctgttatagaagaaaattgagaaattattagtgaaattaagatttctcttaacagggtaggcgaaaagggcggcaatttgttaaaaatattaatacagtttagttccccgtttttagcatagtcgtttagatgtgatcccagtgcaattaagaaagtaggtatgaatgcttgggaaaattttgttgtttaaaacagagcaaatagagcggtgtgcgaggaaatgcttatcgtttaaagtgggtattgaagaaaaatcgacaaaaaatttaatgcgctccaattgcatgggcgcctgtaaattcgaaaccagcacaaaaaataagcctcatggcaaaattccagcgcaattgatcgggctataagccatggaattaccacaaatttcgacgacattcaagactgctttttgttaaaatatgaacacatatttaaccggaaataatgaaaggtgtgtgcttgatcagactttatcttctctatttgttacactatcgattgcttatagaaaattgcataagatttatacaattaataaaattacaaaaaaaaattgtttatttaattgacctttccaaaacataatgaaaataaacaagcctatgattttttaaatgctttgcaatcatagaaaaatgtttgattattattgtttacttaataaagtacatagaaattgaaaaactcaccatagaagagataatctgttatagaagaaaattgagaaattattagtgaaattaagatttctcttaacagggtaggcgaaaagggctgcaatttgttaaaaatattaatacagtttagttccccgtttttagcatagtcgtttagatgtgatcccagtgcaattaagaaagtaggtatgaatgcttgggaaaattttgttgtttaaaacagagcaaatagagcggtgtgcgaggaaatgcttatcgtttaaagtgggtattgaagaaaaatcgacaaaaaatttaatgcgctccaattgcatgggcgcctgtaaattcgaaaccagcacaaaaaataagcctcatggcaaaatcccagcgcaattggtcggngctatagccacggaattaccacaaatttcgacgacattcaagactgcttttttgtanaatatgaacacatatttaaccgg

SEQ ID NO: 14799 - DNA, 1542 bp, Heterodera glycines
  misc_feature (1457)..(1457): n is a, c, g, or t
  misc_feature (1467)..(1467): n is a, c, g, or t
agaagagataatctgttatagaagaaaattgagaaattattagtgaaattaagatttctcttaacagggtaggcgaaaaggactgcaatttgttaaaaatattaatacagtttagttccccgtttttagcatagtcgtttagatgtgatcccagtgcaattaagaaagtaggtatgaatgcttgggaaaattttgttgtttaaaacagagcaaatagagcggtgtgcgaggaaatgcttatcgtataatgtgggtattgaagaaaaatcgacaaaaaatttaatgcgctccaattgcatgggcgcctgtaaattcgaaaccagcacaaaaaataagcctcatggcaaaattccagcgcaattggtcggggctatagccatggaattaccacaaatttcgacgacattcaagactgctttttgttaaaatatgaacacatatttcaccggaaataatgaaaggtgtgtgcttgatcagaacttatcttctctatttgttacactatcgattgcttatagaaaattgcataagatttatacaattaataaaattacaaaaaaaaattgtttatttaattgaccttttccaaaacataatgaaaataaacaagcctatgattttttaaatgctttgcaatcataaaaaatgtttgattattattgtttacttaataaagtacatagaaattgaaaaactcaccatagaagagttaatctgttatagaagaaaattgagaaattattagtgaaattaagatttctcttaacagggtaggcgaaaagggctgcaatttgttaaaaatattaatacagtttagttccccgtttttagcatagtcgtttagatgtgatcccagtgcaattaagaaagtaggtatgaatgcttgggataattttgttgtttaaaacagagcaaatagagcggtgtgcgaggaaatgcttatcgtataatgtgggtattgaagaaaaatcgacaaaaaatttaatgcgctccaattgcatgggcgcctgtaaattcgaaaccagcacaaaaaataagcctcatggcaaaattccagcgcaattggtcggggctatagccatggaattaccacaaatttcgacgacattcaagactgctttttgttaaaatatgaacacatatttcaccggaaataatgaaaggtgtgtgcttgatcagaacttatcttctctatttgttacactatcgattgcttatagaaaattgcataagatttatacaattaataaaattacaaaaaaaaattgtttatttaattgaccttttccaaaacataatgaaaataaacaagcctatgattttttaaatgctttgcaatcataaaaaatgtttgattattattgtttacttaataaagtacatagaaattgaaaaactcaccatgtaaagagtaatctgttatagaagaaaattgagaaattatttagtgaattaangattctcttnacagggtaggcgaaaagggcggcaaaattgtaaaatattaatacagtttagttccccgttttagcatagtcgttt

SEQ ID NO: 14800 - DNA, 2189 bp, Heterodera glycines
tcaattctccggcattccaaacactggggactcaaatctccgttattccaactctctgaggactcaaatctgcggcattctaaacattgggactcaacccaccaactttcaatgacattccaatcactgaaactaaacccaccagcatttcaatctatgggactcaattctccggcattccaatctctgggactcaaatctgcggcattctaaacattgggactcaacccaccaactttcaatgacattccaatcactgaaactaaacccaccagcatttcaatctctgggactcaaatctccggcattacaaacactgggactcaacccaccaactttcaatgacattccaatcactgaaactaaacccaccagcatttcattcaatctctgggactcaaatctccggcattacaaacactgggactcaacccaccaactttcaatgacattccaatcactgaaactaaacccaccagcatttcaatctctgtgactcaaatctccggcattacaaacactgggactcaacctcagcaaatttctttagcatttttaactttttgtgtgccttgggatgttgaacagttggggagggctcggccgcttcgcggcctcgtacgggggccttcggcccccccccaacaattttttgcgccaaaggtactcgctcggccgcttggcggcctcgtactggggccttcggcccccccacaattttctgcgccaatccaccatcatttaatcactgggactcaacccaccaacattccaatcaacgggactcaaccctccagcatttcaatcaacgggactcaatccaccaacatttcaatcactgggactcaatctcatcaatccttcagcaacacaattaccgggactcagttctccgacatttcaatcaccggaactcaacctcagcaacggaatacagaactatttaaaaggaatccagaaattgaaatataacccataaatcaaaacactatggtgtacatttatattgctttttctatccatcaaaggatttttctttcattttttattactatcataacatgctttttattcaaaacaaatatcaaaaaccaaatcagattcttttcatattataagcaaggaaaagtacaaaaaacttttttaagtaacaaacctttttcattcaaacaaattctaatgcattttttaaccaaaaattctccattatcgtttacataagcaaaacaaaagctttcacatcaaaatcaaatcaattaacaaaaacaaaatttagacaaaaaaataatgataaacagcaaaaccacaaattttttcttacacacaaaaacagaacattcatataccggattttccactcaaacaaacagaaaaatgtgctcattattttattaattattttatataataaaagatgggttataaataaggaagggatgcgagacaaatttcccattatctctccctttcctttcttttactctcttttcttttccattgcaatttactctctttttttcccactccctccttctcccacacacacgcacgcgtccaacagactgctgctgcacagcagccacagcagcacgcgtctgttcactgtctgcccctcccatctgccgctgcccgcatagacagacagtcatacagtgcactatttcccaccatccctccctctaacctctacatcctaggaggagaaatcttttaccttctttttctgtgctatttcttttgccttcttcttcttcttaactatttattttcgtctcttttctttatattctcttctttttcaaaacaatttcttttcatctcttttcaaactcatttttaacgcaaaactcaaacaaaacgccacacaaattcaaacacggacacatacatacatacaaacactcaactttattatataggataatggacaaaatggcgaaataccacaaagaaaacacatgccaagtcgaattaatatttattcaaaaagccaatcgatcgaacatttacagtaccggaaaaaagtttctgcgcctaaagaaaaaaatttgactctctaatctaagagcacagaaataatttaagcttatagctaactttttattctaaccagaaaaagtcttttgcaccaacttgatcagaccactcttttcatggtaatgaaaatacactgaaaatcggaaaaatta

SEQ ID NO: 14801 - DNA, 1541 bp, Heterodera glycines
  misc_feature (1470)..(1470): n is a, c, g, or t
ccgaccctggagcggctgatcccgtgcatttggatttcgcccattgactgcttttttgagggcgcgaaaccactgtattaattttgaaattacttcagaaaattcttgcaagaacccaaacgctttcaaaaattgagaaaatttttgatttcctgctggcaaatcctcttggaattttgaaaatcatacaaaatattgtttttttttaaatattggggggggggggtaagaaagattcacgctctttaaaacccaaaaaaatccgataaattttgaatttttgcaataaattttttaacccctcccttttttaaagcggtccgtcgcccccaattgacatacaaaacattccgttgggccccctgctgcaactgatggtggacgacattccggaccaggtcagctggaccaacctggacccggagcacgtggtcagccaagtgaccgccaccttcgacctgggcaccatgcgcaacttcttcatgcgagtacgtctcggatttttggaaatgtttttttcaaaaaaatgtcggctggtaaaaaatgcaaaaaagaaatgttttttctctttttttgaactttgaaatttaaaattttcctttcataaactgataaaaaaatcattcggacaggttcccctcgagaaaattttttaaaaatttaaaacttctggattaaaaagatttttcttgctttctgaaaaatgcctatagacattatttcattcattttccagtccggcatcggcaaaggctacttggaacggttgtgcatcgacccgcttgacccggcatgtccaccgacggcaccgaatcactacggcggcaccgtgttgtgcgatgcaattcggcattttgagcagcgaattgttggcgtcggacaaatgaccaaccggacaattgaggacattttggcgccgtacaaatccgtcgacggcacaaacaatgccgggaacaaacagaagaagcagaacacatcgccattcgacattttgcaagcattttgtgagtattgtttaagggtttatgtgtaaattcgatggaaaaagggcagagaatggagaagaggatgagagacagtaccataaaaggagcaaagagagagtaagagattgggaaaagagtgcgacaaaaataaagttggtaatagagaggggcgatagacttttggtctggaaaggaaaagaacataagacaaaaagaaataggatagcaattctagagagagaggtgaattgagaatatcgaacaagagagagtatagggaaaaggcgagagagagagagagttcggctagtttataagggaatggagagaaagaaagggagagttcggcatggagaaagacgagacggaaagagagaaagaattaggtacagagaaatattgaggtaaagacacagagagagagagagagagcgagagtaaaaatagggagttggcggaggttgaaaaacttcttttttaattntcgggttgaatttcagttggtgccgctgatagtggcgctggtgctgataagtctggccagtcgagcaatgc

SEQ ID NO: 14802 - DNA, 1408 bp, Heterodera glycines
gatgaccaacatcaacatcggcatgaccatggcacagcatcaaaatccgctgaggacgaaagtgccgccgatgagaccattcgggcggaggccttacaatccgtcattttggtcgcctcaccgacggaagtgttccgacggtttaaggcaatttttagcatttttttatgcgaagccatgaccgtttttattgtttaaatttcattttcatggcttaggactctgccaaatttgctgctggaaacgaaagcgacaacataacgcgatggtctccgctggtggccaaagaggtaataataataataataaattgggaaaaacaaaatacgacaaaagttaaactaaaccaatttgacggagtgcattatattttcctcccatacggaaaaatttcttttaaatggaaatttttaatacttttccaacatttttagaggtttttttaactgaaaacattttccaaaataaaatttaaaaatcatatttgtcatttttacgttttttaaattaaaaattgtgaattttgctgaaaattagccctccaaccttgtaatttttggtgattttcgattgaaaaagcgcattttccatgtctactcactcatttatttgtttatttgataggtgatcagtgcctgggcccgtgcgttcaccgattcgttgtacaaccacgcgttcaaccgacgggccggccacacttacattgaacagtccgcacgtgtggtccatccgctcgcgtcgaccagcatcagcggtagagcataaaatttgcatacaacaatttaatagtactggagatttaatagagatttttgcatgttaagtcctaaaatttctctaaaaaattttaaaattttttgaaaacggccacagactcgagacccttcgacaatctctcactgttgcaatctttttccatttttgtcccgaaaatggcaaattttgtgagatttcggcccaaatgctggttccatttcgcttttcagacatgttggccgagttctgcgacttcaattacgccatcattttggccggctacttgctgatgttgctgtacgcgctgtactcccagtgccgcttcgatggctgctgctcgctgggcgtcgagtcggctgttggtttggcgttggccggcgtgttcaccgtcaccatggccagcattgcgggccttgggctggccacatggtctcagtttatgccatttttgtatagatttttttaaaatttttaggcttggcatcaatttcaatgcggcgaccacccaaattgtgccattccttgcgcttggcataggtaaaatgcgaaagaaaaataggggaattttttgggggcaccctaaaatttttgcatccgagctttttaaacttagtaattttttaagagaaatcatcttataaattttttttta

SEQ ID NO: 14803 - DNA, 1452 bp, Heterodera glycines
ccccccccccccccttttttcatgatgccgaggagttttatcccgtctctattttttcattttttgtttttttatcccaaaatgcaaaaaattgtgcggttttgtcggttaaattgtcccgcttgcacaggtgtggacaacatgtttctgctgttgcacaactatccccaagtggtgggcaacgtggcacgcaatgagctgggctttctgatgcgcgagaccggtaggggctgggcaaaatctggcattttaattaaaaaataaaaaatatacatttttcagggatgtccatcctcaccacgtcgttcaacaacattttcgccttctgggctggcaccattctgccaattccggcactgcgctcattctgtggtcaggtgagtgcctttttgattgttttcttgacattttaaaaaaaattgtcatcaaataattgaattttgcactatggaggcccaatttgaaaatggctaatttttcgcgtttttttcccgcgtagccaaaaatttaggcttttctggttacgggcctgattcaatccatttattctgaaatttggaaattaattgctggacagaattttgtctacaaatttatttttgtttttttcaatttctcatttgtcagaccgccattctgttgaccaccaatttgttcggcattttcttcatttacccggcattcattgcgttggatttgaagcggcgcaaggcgggccgacgcgacttggagtttctgtgctattattgcctttgtgtggacgacgacgacgacgacaacgtcgacgcggaaacggcgcacaaaattcggcgttccgacgtaacgggaaaaaagattgggaaattgatggggcatcacccagatgtatctcaatccattaggatccagattgaagtagtacgctgataaactgttctcccccgatgcgcaaaatattacatagagatgtctactgagagttctatgtcataccgtatcacatgaagagaaccattaagtctgaggaagggtcacaacagctacagcctcttcctgctgccgctgtagacaacaaagaaatgccctatgttcctccgactacgaggggggccgaacgtggctaccgcgtatatgatgatgatgaggcgcagataagaaaactagtgtggcaggcgagaagaggaagatctacagtgactctcccgagccaggaccttcaacatctgcacaaagtggtgaactacatcaacgacaacaacaacgcgaactgtttgccattccatcaaatcacctgaccatgactcagcgggttgaacggctatacatcaaatgcaacccattacgctgatcttatgggccgtcgtggaaatacaatcaacaccgcaaacggcaagcccgttggtgcataccaattttgcgaatggtcatccgctatataaaaacagaacgagcgggccgccccacccttagacc

SEQ ID NO: 14804 - DNA, 1899 bp, Heterodera glycines
  misc_feature (1883)..(1883): n is a, c, g, or t
ttttagccgtttttttttgccaaaaattactattttttgctcattttggtctccatttttcaaaaatatggtaaaatggtggtccggtgctgttgtcactcacttttttttttctaaattttcttctccttattttaaattcttcaaaaatttgtatcttctactatagtttgacagaatgccaaatttaaaaaaaaaatgggaaaataaaattatacaataaaaaattcaatttgtcttttcagctcactcatcaattcttgtccactgggctccacgcgttgttcccctcgctcaacggcactcttcccactgcgaatggtgccgaccgtgccgggttggcactgctcgagcgtgacccgctgttgtgccgagcgtccggcggcttccgattgtttgtgcgcaaattcacggaccaacaattgctcaaatgtctgcggacgccggcactgaacacacttggccaatgggcaccgccaaacttgcgctacatccatctgctacgttcggcggtaaaaagggggacgggacgaaatctcgccgccggaatctcaaaaaaaaaaattctaacttagaaatttttgaaggaaaaaactttagaaaattttttttataagaaaattccaaaaaaaaaaaattctaacttagaaatttttgaaggaaaaaattttagaaaatttttttttttgaaatttctgcggcgagatttcggcggcgagattttggggtgcacccgtaaaaagtgccaaaattggccaacagttttaagcattcattaataaaaaaatgatagtggagaaatagcttaatatttattgcatgttttttttatacttcacccccccccccctctccaaaaaaaatttaataaatttactgcaaaaaggtaatcaattgtcggacccaattcttggacatttaatttaattaaacacagtaatttttgaaattttatatttgaacatccaattgaacatttgttaaacaaccgactcatttttaaaacatttttccatttttttaagtggaagaaactgactcaatttgaacgctttgattggcaggaactgtttgaacagtatgccaaggatgggcatgactcgacgctgggtaaagaaaaaaaacattttgccattttttctaatgccaaattaatttaaaaaaatttttgctcaaggcattgtggtggatcagaataaacaactgcttgaggcctcagccaacaaagaggacgagcagcgtttgtgtcagttccaatggctgtccacggtggattctgagcatttgccatgtccattgtgctcatttgggaaccaacgacgatatgccattggacaactcttggtaacgaaaaacggtggcatggatatgaaacacgaaatttgtaacacagaaatttgtaggcattcttttccgaaaaatggaatttatttattgataaaaagtttttgtttttttgtatttttatgccaggggttcgattctacgcataacaactaaaatacgtaaaatgcattaaaaaaaagaattataatttaaatggtatttggtgtttcgaaacaaacaaaaaaataattataaaaaaattgtgacctgaaaaaacgttaccggttgatctatcactttaaagtctgataaatttaaacacataaatcagaattaaaaaatgatcactttttaatcccttttaatgcaattctctatagtaaaaaaaaaaaaattttgttttaaattttagacataaatttttcatagcacaacaacaaatttgccattttttttcgctccaggcccatttgagtctcagccatcactcggcccatctctacgcgtgccattgtttgctcacagcgttcagtcgggctgaagcattgaaggagcancgcaccaattaccaat

SEQ ID NO: 14805 - DNA, 762 bp, Heterodera glycines
tttcccccaaaattttttttttaaaacaattttcaaacgtagaaaatttcaaggaaaaaaatttcagcgatttttttttggattttttttttgaaaaaattgaaatttttatataaaaacttcgttagaatttttttgaaaattttctagggttgaaaataaaaaaaatctaattttttgaattccatttttctttttcagctttcccattccaaccaaagtttgtctctttgttggacgttcgcctccgtggaattggcccaaccgtctgtcaaaattgactttctgcgcccagtgatttttgagccgatgtccaagtgtgaattttgcttacgctccggttggaactcgccgatggaattggaacggcactgtgccatggagcatcggaattgggccatcaacaaccaatgcatgttgcagtgccctgaatgtccagccaaattctacaccgccccactgttttggtctgaaatttttttctaatcaaaattttcattggataatgaatgccccaggctctcaacgtttttagggttacggtagatacagtatgcctaaagaaatttttttttttgcggaattgttagtttgagttttatttgtaatttttcaatcgtcgaggagggttagaataaaaagaattcaaattaaatttttgttttttatacaattttaagagtcgaaaatttatggcatggtaaactaacaaaatgcaaaagttaggaatataagacatttgtccataaaccatggtaaaat

SEQ ID NO: 14806 - DNA, 1254 bp, Heterodera glycines
gtttcgcactttgtccggcattccaactccgtggcaaatcggttgtcgccaaatccttcgcactgggccatgcgacccttctcacatttttgccgttctacgtcagaatagtaaaatgttctctatacgggtcggtggcacccggcgggaaattcatggtgaaaagtctcgtgcatattgcacaaatttcttttttaacaatttaagaaatactttcgtttcaataaaaaatcattttttttcattcaaacgcattatttttcggaatgacatactcaaataacataattgatggttaataagcagctgtctgctcataatcaaacagcaattaatctatcgtgttcatttttcactactttctttttcttggattttgttggaaggaaacacttatgaaatcacctctgcctaaaaaatttccgttcattgctaaagtaatttttaataacaataaaacaagtgccctacgggcgacaacgtttctaaaaactatcaaatgtgtgtttcctcaatttgcatgtgcgtttcagaaaaactgccaaatgagctttcctaaaaattgccagcatgagcctcccggccggtggaattaaggatctggcgttaatttcactatgttcaaaataaagttatggccatgaatgttcggttagtttgttgaaattctttaccgatccggaaaccggcaaattaataaattattaacctttgaaaatttatataaaaatacaaaaattttccgaaatacataacatataaaaattttgaagatctttatatttttcataaaattaaacaaaatgaaaaaatcagcagctctatttgagttttttacaagatacagtttgacaattgtgactgaaaaaggatcttgtaaaacttttttaagtatataattttaatgaaaagcaattttgccgtgaaaaagctaaatttcataggacattgatgaattttttggtccgtttgttttagtatattttagtggtactcagtaatacatatgaattaaggacccagtcaaaacgactgaaaaggctaaacaaacaaaataaaatgaattaatgggaaatagtcagaagaaaagaaaaatggaccaccaagttggtaaacaattagctctatttaactgtgaaaatttcaatcgaagcatcaaataataatggcatttaatgaattaaatattaatacaactcatcattctctttttcttcataatagttttttagtagagcacaaaggcacaaatga

SEQ ID NO: 14807 - DNA, 1800 bp, Heterodera glycines
tggaccaaaaatcgcaaaatatggacataaaattgcgaaaatctcaaaatatcgacataaatggcaaaaacgtcaaaatatggacataaatttttcaaaattgagtgtaaaatttcttcaaatttattggttgaaattgcatatgagatatatttccaaattttttgactcggtaaggcgctttgacaaagacggctttcgttttggcaattaccgtatatgctctaattatagcccatgggggattatttttcaacctcctcagaatacaggggataattggagactgcggtattaatagagactgggctataaaaagagcatatacggtagtcggtcaacattcggaaattggtctcgaattttttcggcaattctgtgcaatattttagaagaaaaaaaacatgaaagttaaatttattaatttttttagcgcaaaatcaaccacaaaagcgaaattttcgcttttttgcttatttttgacataaatttattaatttttaagaaaatttaaatttattcaatattctcgagaaattttggcgaaaaaatgattttttgaaaaattttcggtttttgtgctcaaaaaggctaatttagctgatgggggccgttctaatagaggtttttttgaaaaatgccaaaatatggacataaaatatggaccaaaatgccaaaatatggaaaaatatggaaatatggacataaatcgcgaaatatggaaaaatatggaaaatatggatatagaaatccatcctagaagcttcaaaccaagctaaaaacatgtttttcgtgcgtttcaggccttccacagtccaggaaaaaaatatggatttccatataattcccagccctagtcatatgtttatgatcactctctacttggcaaatcactctctacttggcaaaaaatctaaatatactatttgggtcgtgtcattccgtcacaaaaaatatcgattcaaattaacgcgaaaataaacataatgccaataaaaactttttgtaaataaatttaagaaaattatgcaataataaaatttgagatttttcatcacttttttctttttatttatttacttttatctttttcaaattaaattaattaaatactactatttaacattaaaattctaatccacaaacaaaatttaattcaaattgtacattttttaattattatattgttttgttttttttattaaaatttttgagagaaaagcttaatttttttaaacaaataatgaatcaaaatattatgtatgaaagaatgaaagtaaaaagaaaaagagaaagaaagtgagaaagagagagattgagagagagagagttgtgtgagagagagattgagagagagagagttgtgtgagagagagagagagattgagagaggagagagagagtgtgtgtgagagagagaaagagagtgggagagagagagagggtgtgtgtgtgtgagagagagagagagagaaataataaaaaaaaagataaatagatacttacgaatacagagaaagaaggaactatagaatttaaaggacaagagagagagagagaagagaagagaggaaaagaaagagagagagaggggaggagataagagagaggaaaggagatagagagatagagagagagagagagagaagggagaaagagagaggaggagagaagagaggacaggatagagaggtgagaaagaggaaagcattaagagatagagagaggagagaagagaggaaacgatagagagagaaagaggtgagaaagaggaaagcataaaaagagagagagaagagg

SEQ ID NO: 14808 - DNA, 2639 bp, Heterodera glycines
attcccaacattgacaaatacactaccagaaacagacacaatcattgccgaacatcggctaaaacgctaaaaaccgggatagagatgcccaaacattagcccaaaacattccgcctgtttttggtatgcgcctggcaatgtttttggcaaatgttgggaatctctctctgtcaatgttttcgagttatttaagaaacaggcgcaaacattggcaatatttgctaaatcatccagaaaatatgaaacaaaaacatggacagaacatcccaaacattgacaaatacactaccagaaacagacacaaacattgccgaacatcggctaaaacgctaaaaaccgggatagagatgcccaaacattagcccaaaacattccgcctgtttttggtatgcgcctgttttggcaatgtttttggcaaatgttgggaatctctctctgtcaatgttttcgagttagttttcgagttataagaaacaggcgcaaacattggcaatatttgctaaatcatccagaaaatatgaaacaaaaacatggacagaacattcccaaacattgacaaatacactaccagaaacagacacaaacattgccgaacatcggctaaaacgctaaaaaccgggatagagatgcccaaacattagcccaaaacattccgcctgtttttggtatgcgcctgttttggcaatgtttttggcaaatgttgggaatctctctctgtcgagttagttttcgagttataagaaacaggcgcaaacattggcaatatttgctaaatcatccagaaaatatgaaacaaaaacatggacagaacattcccaaacattgacaaatacactaccagaaacagacacaaacattgccgaacatcggctaaaacgctaaaaaccgggatagagatgcccaaacattagcccaaaacattccgcctgttttggtatgcgcctgttttggcaatgtttttggcaaatgttgggaatctctctctgtcaatgttttcgagttataagaaacaggcgcaaacattggtaatatctgctaaatcatacagaaaatatgcaacgaaaaacacggacagaatattcccaaacattgacaaatacattaccagaaatagacgcaaaacattgccgaacattgatccaaaacatattgcgcctgttttggctaataaaaatgttaaaaattggtgtcttcgagttgttcgaagcagggagcttctcctaccctgaaaacccaaaaacaactaacaatggaacctaacaaactgtcaaaaagtgggtataaatttggtattgtcgacttttattgtgaatttttaatattagccgtgtgtgaagggaaataaaaaaggtatgggacctcgaaaattgaaattttgactgtgttttctgtggccgatggtgacgtgttgaaaacgagcaaagttggttgatcagttggttaaactcgcattttggcaaaggtgcagaattgtgtcccggcgctatgtaatttcgacactgagtaatttcgacactacattttcgacactgaagtatttctaaaactgttgtgactgggatgtatgtagtccactcgtcaaggggccgttaaaagggaggaagtaggtgcaccattcattgcactgaaaagtcgagccgacctttcactgttttcctgcattttcggcactggaccatttcgacattgagtaaattcgacacttagagaattttttagaaagtaatataaaaaatttgaaaatgttagtatttataataaatttcctacttcattttctaattttaaattaactccatctcattctaaacggttgaactaaagccatcggatttacattaaaaaatattctaaacacccgccgtattgcccaggaagagctacagtccaaatatgtagcaccatttcgtcaacaattggctgctggacactgggaggattgacgaattgaagcaggtccgcttgtttcaaatggtttaattttcacaattctcatctttagaattatgaagaaatgaagggtgaggatgacacggacgaagaagcggcgggagaaattgatgacggttgccaaattgatgtaatttagcaaatttggattaaagcgtgattttcataaaaaatgaagaaaacaaacgttttattatttttgtttatttttcattttataagtcgttttttgcttaaaatcaccaaaggggttcgttaacacggtcagggtcgttttcgcgtggccgttttcgcgtggccattttcgcgtggccgttttcgcgtggggacgttttcgcgtggctggggtacgttttcgcgtggccgttttcgcgtgagtacctgtttagaactcaaattggtcggatttgtgcaaaacttccatgtttcgaattccgaaccagaattcgtacaaatttcttaactttttaattttttttgtttcttgcggctagtatcttctacaataattgatcagtttggtcggatgtgcgtcaaacggaaaaaataattaaaattttctaaaaacacataaatagtataacaaaaaataacaaatttcagaacaaactaaggtcgcatttcatagtttcgtgaaacaccagtgagaaagttgttaacgttttcgggattcacattgacatttgcat

SEQ ID NO: 14809 - DNA, 4436 bp, Heterodera glycines
  misc_feature (4392)..(4392): n is a, c, g, or t
cgaaagcatgatggttccggaaaacggcaaaaacccgacgttaccgtctcgcagagctcgcggcacggaagcgggaacaaagagcgagacaaaagaaagatgggcatgtgccacaaaagaaaacaaaagaaaaggataccattattaatttggatgacattgattttgattgagtgaagggaagagaggaaaaaacaaagtgaaaaaataaattgaaaataatcaatttagtttcaataatttactaaatctttccaagttctcgtcctttttctaaggtcatactttcttggttccatatccgtttttttattgattttctccgcctcggcttcaatttctggtcttttttccggccctcgggcttggatttggtctaagttctcatcttttcgggactcggggtccatttcattcctaatttcagacctttccgaactgacttcctccacgcttggtgtattttcaaggcacttttgctcttcaattggttgcattggcgtagtgcacggggggcccaaaatttcgaagcactttttgatttgatttaagtgaagtctttttgggatcgaatttggcgaagtgcaactgatcaaagtaacataaatgccctcaattttgatgacccgaaaaattcctcgccacggtaattggaattttttggatgtgccgacccgtccgtcgtagtttctgatcagcactcgatcaccaattgtgatttgttgtggccttgcctttctgtcatattgttccttcatttttcgctgggcttttgcatattcatcagctgcagcgtgccacgcgtgtcttatggcaacgaccagcttctgtttaaattcattacggtccgaaatggctatcggatcacgaactttcggatcaatgatctgatcaacacagaaaattgggtcacgcccaaacataagaaaaaatggagtctcacccgttgaagcatgcactgacgtgttgtagcaaaaattggcagcatccaaaaattcatcgaagtcgggctgagtcttcgaaatgtatttggccaagatgttgtgaaatgtccgaaaagtgcgttcaattgacgcattgccttgactccaatgaggacaggcatactttttgtcaatgtaaagcatggagcaaaattctctgaaaaattcggaggtgaaggcagaggcattatcggtgatcaattcaacacaaccgccgtattttaagtaacaattagtgagaaaggcgtgggcaattgtttgtgcttttgtgtcggggaccgggacagaaatcacgtatttggtgaaccaacaaacgatatttaaaatgtgtttgttccctttttgggtgactggaaaggggccggccaagtccagcccaactttggcaaaaagtgtgttggctggcaccatgagcatctcttcccggtacgcgggtgttggattgtgtctcaattggcaggtgacacacaatttgacccaagttaaacgtcagagtacattttgggccaaaaatattttttgcacttggcaattgttttcctgtaattcaaatgaccaccacccaaaagagacgagtgaaatgattcaaaaatgagtccacgtaacgaaattgggacatatatcctcggagggagtcccttgtcctcaaaataaagaattcccgaaattaatttgtaattggcagtgcctacagcaaataattctttttctttctcatccaaatcagctggaaattccccatccctgacaaacgaaatgtaggccgcggcttcaggatcagctgcttgttctttcaacaaattaacttcgtaagtgtttccatcctcgtgtcggatggtcaaagtatgcaaaaatgggtccgcgaccaccctggaatgtgctgccaaagcgagacagaccggaaattcgataatgtcctcgagttcatccacattgtatatttccgacaagggcttgtcctcagcggcacgagaaagtgcatcagccaaagtgttggcttttcctgccacgtggacaatcttaacttggtagttttgcaattcaatgagccaccgtgccaattgctgattggtttcggatttttttagcaaaaacgcgaggggtttgtgatctgtgtgaagttcaatgtccgacatgaagatgaatggtctgaattcccttaaagcataaataatggcactcatttcaatttgaactgccggccacttcctctcagcagcagagagggtcctgctgcaataggaaatggcagaaaatgtgccagtcacgtcattcttttgcattaaaactcctccttgtccagtcgatgatgcatcagtgaaaatgtgaaatgctttgtcgtaatctggaaaaattagactcggggcttgagtaagtaattcttttatcttgtcgaaagcgttatgctgttccctgccccattcgaatttattgccttgcctcgtaagcttcagcaatggctctacgaccattgcaaagttctcaatgtgccgtctgtaaaagcctgcctgtcctagcactatctttacttccttaacatttaaaggcacaggcatttctttgagaatttcgattcgacttaagcttggcttaaaaccttcagctgttaaaacaaatccaagaaaattcatctcatttgaggcaaaaatgcatttcttcgggctaagtttcagattataaagccgaaaacgctccaaaactttccttaccgccgttaagtgctctgaaaagttcggactttttgtgaaaatgagcacatcatcaacgtaggccaatgaagtatcctccaatccagacaaaacgatagccatggccctcgaaaatgctgcagttgcatttttcagcccaaatggcatcgtaatcatttggtacactttgtcttcagttataattccacatttccttgacgtttcttcactcaatttaatttgaaaatagccactggccaagtcaagagagctgtaaaattggcaatttccaaccctttccatgatgctgtcaaggcgtgggagagggtacttgtcgggcaccgtaacttcgttgagtttgcgaaagtctaaacaaggacgaattccaccgtccttcttctgtacaatgacaattggagttacccatggggtgtcagactcaaccatgactcctgcttctaaaagctgattaatgtgcttcttcaattcctctttgtatttgtacggcattcgtcttggcgcagatgctattggttcctcagttgtggttgtgatgtgatgttcagcggctgtgaaaagtccaagatcgtacctgaatttgctaaaaacatcagaaaattcttcgattaatgccttcagcttttccaaatctttgtctttgaccatggccctagaaaagtcgactacaaatgtggggtcaatttccatttcctttcgttcagaaataagggtaagaatttcttttgtgctgttttcccttaaaagtccatttcggtcacacaacaattcattgacaaaggccaaatgtgttcctttccaaatccattttggttccatggttgggttgaccactgccacttttatttgtttctggcccgcaggcgagacactattaatgactgacagtcccttcttaataagacttatgtcagggcgatcaatgcaaaatgaattttttgggtttggggatgattcgattgaagcatcgaccaatatttgggagtcggcctgaatgagtgtgtttttctctgccgacacgcgcaaatcgttcagtaaaagaatcgaacgatagcacaatttggattagttgtccccaacaaaaaatttcccgtttaaatgatcgaattttattgggggcaatttttcaaagacatcccaaccaaaaattacgctgtaatcccgggctacagtaaattcagaatcatccacaaaataaattattgaccggactgtgtaccctgcaatgttcaaattcacctgagcatattccttgaggcgaatgacatggcctgaggcactcattgcctccaaatcggatgaaaatgtgcgacaattaagttcatctgcaactgatcgcggtgcgacagtcaaactggcgcaagtgtccattaagcagcggacgggtgtggaattaatcaatgtctgtaccacggcgtgatgcggcgaaatcgcattaagatttgggagcattggaaggtctgaattccgttttgaccagagcagtactgtaatagtgacaaaaatcaaaaaaggaataataagcagataaacgattgaaggaggagtgaattgaattgaaatttggttattcacatcaggatttgcaaaagcattgggaagaaaattactaaaagcctaatgagtacttttggcgcccgaaactgaagcgagtcctttttacggtctctttcgtttccctgcatttgatgcctggggtttgngcgggttcatgagcttacgggactgagctccatttcgttaccaa

SEQ ID NO: 14810 - DNA, 3224 bp, Heterodera glycines
  misc_feature (2684)..(2684): n is a, c, g, or t
  misc_feature (2728)..(2728): n is a, c, g, or t
tttaattatttaaataattttgctaatttatttttgatatgttcattatcataaaaatatagttggtccagcaagggccagacttcttggcatattgttgtagaatagaaaatggggtaatgaaaattttcttatcatttcgatttaatcctaagattctaaccggcggtaataccgctaaattgttgtgagagatgcataaaaatgctcacagtaagtgcccaattcagctggtttcttgaacaaatctaagaattgaaaattgttcgatgtccttttttctgctgatgaactttaggacaattattgctttaattcttcccttagcttaaacaaattgttttaaacaattagtaatacattaaggtataattaatccgaaaccaccccccaccgattaaactatgttatgtgatatgatatgaatgatgtgctattatacacatatgggttacccatatgttgttgtttttgtttggcgtgggtgaatggagtgatctgtgctgtgatgatgggctgctattgctgcttcgcattctcatcagatggggcttttcctccgacaaaatggaaaaagtggccgccgcttcctcccccccccctcccacaaataacaataattctccaacaagaagcacttttataccacgacatgcgtaaacacacactgattttgtgtttatttttattgcttgtgtgtgcttcttgctgcacaactgctgctttgatgatgatggctatagctaatgcgtgagaaacaaaacaaactcgttgagtttgttgcaaaagcattatccataaaaaaaaattttaagggtaggctttatcattacgaccggcaacttttttaggggatcgccataatctctactgctcgacacttttcgagacctttcaagaaattatgaaaatatgaagaaaagtcattgatacctgattgttccgatttgcagagcccatttggttcaaatttttaagaaaagtccaagtgacacgcaaaaactgcaaaattcaaatctcaaaccattagatcgttttcctatttattctttaatggtttttgaaaaaaacaaaataaataacattaaatgaaaaacatttatgaagaacatgcattccataattttttatttttaaaaatttgttcactcactactaaatatttttaatcacttacctaatttccaagtaacatagattatctcatttttcattattacgtttaattgcctaattagtagggatgcgatttttaggttttaactaaattttttgctcaattgatttgaagaaaggagctcaaaaaacgcatttctgcgttaaaattttttcatttggacgtcacttttcgtcactagaaatcactattttggcgacttcgtcactaaaatagttaaaaatcactattttggcgttttgtcactattttttcactatttcaacattttttggaaaattccttaacaaaaacgcaataaaaccaaaaaatacacccctaagaatcgacctaaaattttttttcaaaaaatacacccctaagaatcgacataaaaattttcaaaaatcactcctaagaaatgaaaaatttttcacaaaattcactttctttgcaaaaatttttaattctaaaaattattttttaggaacctattttgtattttttgccctcaaaaatcccagtcctactcatttgcaactgcaaatagtgaataaaaattatttttgctcaatttttggctgaaaatttgtcactattcgtcactatttcggactttttggcactattttctcactattttggcatttttactcactattttagttaactattttgggatttttcgtcactaaaagtcgcatccctaatcatgatgaattttttttaaataattcagtttgttgtacattcaaaaattataaataaaaaagttaaatttaaaattgataataaattataaaatatattgttgttacgaagattctatacttaaaaactatagaaaataaaaaccatggattaattatgtttttagacgtgacggcagtgggcattatatacagttgaaagcagcaatccaggcggagcatgctttgacgatgctttctgcgaaaaggtgaataaaagaatcacaaatatttgagagcgccaaaaaagccatgccgcgcctgttttgtcggctggcgatgaatccaacggaaagtcaatcgaaagggtaagcgaattggaaactcaaatgaaaacaatgccataaataatactaaacctgttcagcacatctcagcgccatcctccggccaacagcaaatcgtattggacaacccaaaggcaaattcaagaaaagtgcgggaatcgattggcactaacactgcggggaatgcaacggcagaagtgggtagtctcgtaaatgggacggcggacgaagcgatgagcacgacaaccgattcgtaaggggggcagtcccgtggcatgaatgtgcggttacctttgaggttaagttggtttcactgcctatgtcgtattaaagaaattgtaaaataaaaaattcaacgcccaatgacagcatttcaaccgaagccctcggttgtttctggcttattctcctcatcttcttcatagtccttgacttacactgcaaggcaaaagcaacactacaacaaaaaattaagaaaacaaaatgagggtntatatgtaaaatttacagaattcgtgcacaaaaaaaacaaattncttagggtcagattttcgtagttgcacacgcataaaactttagttctaggtttcgcaagaatactaaacagcggaaatacgaggtgcggaccatcttgtccacgacaacatacaggaaggatggacaattgcgacggatcttctatgtgcattggctgggtaaattaatttgtttacaattttacacattttttctaattaaatttattcaggctagagccggaagaaattgctgaaaaactcagaacgaaccttgagtatatttcttgtaagtttttatggggaaattagttatataataataaatttgattgttaagtgatgaatgaattgaggcgcaatgtcgacaataggacgacgccaattgggttttcgtcaaacttggagggcgaagagacaaagcaaaaatttgtaagttttgaaaattaattttcacaattcatttcatttatctcattttatttgtgagttgaaccctactttcgtagaattgtgg

SEQ ID NO: 14811 - DNA, 3822 bp, Heterodera glycines
cttgcaacaaaatatttttttccaattgtaaacacaaatttttttttaggattttcaagtgacattcactggtcattcattgggtggtgcgttggcctcactcgcagcaatgcgaacagtgcttgaaggaatgcggaggtaaaaaaataaattttaaattttaaaattttttcacttttatttttaggagtgatcaaatcaaattgtacacatttggtcagcccagggtgggcaatgtcgaatttgcattcaaacatgatgaactcatccccgagaggtgtggttttttgtgttcaatttcaccaattagcttcataaattttccataaatttgtattattttttgaaatggtttttttagtactaaaatatggtgccgtaaaacagtatttatatgaacattgaaacaaaacttctttacagagtgctgaaaaaatttacggaatttttgtattttgggtttttgtattcgattttcaattaaaaactcgatgatttaatggatcacttacgaatgaccagagaaaccaaaaaaaaacacagcgaaaaatggaccattggggtcactttttcaattggttaaaagatttttcaaaaattacttttaaaaccaaataaaaaattatcaaccggtttataatggtcagaaatgttcattgaaaagactggtgaagtaaaatcagcgaaaaattttgaaaattaatattcccaaaatataaaaattctgtgtctttttccgcaccattagttgccaaaaatttgtcaataaaattattggttcattatttgggtttttgtcagtttccgtgttgttttccgcatggacattgtggcacatatgcctccatgtgccaaaaatcagcattacgagggtgtggacgaaaaagatgacagcaaaccgtgtgatccatctgcttctaatggcattgcatatcatcatggaacagaaatttggtaataccaaaataccgccaaattgtaattaattatttgttatttgctattgaccggatatatattaatttaaggtatcgaataattttttaaattcaattatgatttaataaattgatgtttttatattcctttaattttaagaaaacaaattaattcgtttgtttatattcgaaattttaaaaaatttaaataacactgtaaaacatcataacttactgtaaggtacccgtacggaatggaccctggcgatccgtattttgaatgtgttggctcaccacgggacgaagacttccactgcagcgattcgatgtcctttgaaatgtccaaatactccatttacatttcggaccatcgtcattattttggacacaaagtgtgtatatgcagatttaaaaattaaaagcatttaaaagctttttataattaaaatatttatctttttttagacttttaaatgtcacaaaaattattttaactttatattaaaaaccaattttattgattcggtttttatgaaatatttatgaattagacaaataatttaaaatctgttgggatgcgctaaatgtctaaatatccatattttattatttattttttaggttcctgcctggggcaaacttggatgcccgtcaaactcgcgcgggttggaagcattgcacagtgagccaacagatgaagccaacagtgccgagggcgggggcatttttcaaaaattgtctcaaaagttcagatcgatcggcagaatatttggcagtctcttttgatttattaaaattgacattgttttaattttgaaatatctcaaattaaaatcataaaatttatgtaatattttggaaaataataaataaatttaaatatctttaattaaatgaaattattttgagcgcaataaatggtaccggaagccatgcaagagaaattacagtactcatgtgttttttagttcttggtaattcttttcgacatttattcgggtttataaaatgtcttattaattccattggtaggaagccacttacaaaagaaattacagtataccaagtgtttttgagttcttgataattccattcgacatttattcggtataaaatatcttattaattccatctaattataaataagtattcactttttacacaattcaactttacattgctcaattccacaaacacacagtatcactgccgcattttcgcttttcccattttggcactgatttttaatatttcactaaattcaaaaaaaaaaaatttgacacaaatttctctttcgtaaggtttcttttttgtccatccctttctttattcatcgcttttacattttgtcaccctatcaaataaattttcttgcttgcatattaagctttttgctgattcattacttttttctgcttccattttttcctccgttggccgtctttttaagtcatcttctgccgccgatggcgaaacaaatatttcttcttttcctcacattctatcattcatatatgtacataaaattgtaattttatttatttatttaaatttttatttatttatttttctttttttagcaaaaatgttccaatttttcattttttccacccttttttgccttgtttgtgtggcttatgccgtcccagctgaaaatgtaggttcaattgtttggaagagcaattaaatatttaattatgtggttaatttgcttcaaggaggagcgtttctgccactcgatggcagacaattcggtctacaaatgtgtccactgcaatgatcctaaacaagagaaaatttgtaagtttggctaattttaccaattaaaaatttaatcggagaaaaaataattctgaaaaattctcctaattataacgattttatgccaaataatctttaatatctgaaccaaaaagggatttttatgactttagtaggacactgataaaaattgtggtcacaaaatttagcatgattatcactaatttaaatgattatttggcacattaagctgctatatgtgagcgatgacacaggctgcgtgttctaattaatatttcattttaaaataattcaaattctctaagaaaaaaattttaggcgtcaatctgcgcacgcttttcgaaacggtttcggtgagtgccaaatcagagacgcgtctgactttgacgacggaaagtgacaaaacggagactctgccgccatgcatcgaatttgttcaaactgaaaccaatgcccaattgaatcatcgctctacgattaaggcaaagacggaggccaacaaagtcgacggtgcagatggtgaacatgtgcaaattgctgtaatcgtaagtttgagattattagttaaatgatcatattcgggttactgtatttccttccctaatacagtaattaaataaacagaaggaaaccagcaaagtcgacaacaattccgctgctgctaataatgacaaacagctgccagttgctgtggtggtgagttatttagaaattgtatgaattgctatatgaaaccgtaccgggtacgacagaccattgatactgtacattatttctatctgattatgtttgccttgaaaaaatgcccacgagtctagtaaaacaagagttttggtcatatttgagctgtcataatgatacatgtcagaaagctagtccggaatttgtttattaaagtctcgctatacccggtatggtactggattttaggcctaaaaaccaggaactttttgagactggccgggattctgtatttcaaattagggttaagccccgaccagagctgggcgaagctcggcttagcactcgaagccgaaggcgaagcccaaaaaacccgaagttttcgaagccgaagccgaagttttttcaaaattttttttta

SEQ ID NO: 14812 - DNA, 3818 bp, Heterodera glycines
tttaaaactgtattaattcatgaaaacagtatgtgtatttacgagttgtgctttgagtgcgacgtagaaagaagcgcccgacatcagaattgggtccaaatgcctccgctccacggtcgatctcgaattgagttgtgccaatataggttttgccaaaatacgccagtcatccttgaactccaaggggtgccgcgttgacaataattgaaaaagcgtgccgaacgtaaactggcggaatgagtgccaaagaaagaactgatctgatttgtaaaaataaaaaacactttgaattaataaaggacacctggatgttttgtttaaaaaaggacataagtataggtaggcttgccttgctatgactgaaaatcaggacaacatcagattgtccagtcctcacttcacggctgtcataaatgaggacggactcatcattctttatcaaaagaccaggcggaatttgtatgttcagtggatcggcacggttgacaccaccaacgaatttgttctttgttctaaatattgcgtcattattttctctgaattttgtctacctgttcgccatttggtcgagcgcttcattgctgccgagcaattcgaagacttcatcgtcgatgtcagtccgaatttgacatggtttcgtttttggctcctccttgatcaggcgcttcatctgatttcgtttcgtctctgcatcataacgcgatggtgcgcaaccatggtgatgtccttttgcgcccaaaatgcctgtcatcaaatcgttgtcttctaatttggctgtcgctggacaattgcgctgttcgcacctgaaccagctaccatcttttctgtttttgataaatcgaaagcctgaaaataaagaaatacaaataaaaaaaaactattaacaccttgataccaaagacaaagagctcccaggattgtttctccacgtttgaattgaacgggctcacaattttcttcgtcatcactcgaagcgacgtccaaattgttcctggttgaagtgccttcaatttgttgttctgcgtctgtcctctcaacattcagtacgctgtcttcatttgtagcaatgcgaggctttttttactcgcttttgcagactcttaagtatttcgcgaacagttggcatttcttattagaatctgaaatttctttgtttttgaagaaaatttgaaatgacataaaaatgaaatgaatgatttatttgatgcaaaaacattatagatattgtatattctctctttttattttctcattggcattatgtatttccaataggcgaaatgaatgtttctggcttagtaggcgaaatgaatgtttttggtttggtaggcgaaatgaatgtttttggtttggtaggcgaaataaatagtaggcgaaatgtcagtaggcgaaatgaatagtaggcgaaatgacagtaggcgaaatgtccggttttgggttagtaggcgaaatgaatgtttttggcttagtaggcgaaatgtcgagtaggcgaaatgtcatgtagccgtcctgaaagcatccaacaaaacgaatatgtaatagaaactgagcaattttcgagccaattttcacacatgggaatgatatccaataaaaaagacactggaaaaattagtcgaaatcaaatgacagaggaacaacgacaaattatcatggcaaaaaacgcaatcgccgcaaaaacatatagaaaaaaagtaaaaaacgtagattttttgcttttgcaagcgtctgaacaaaacacttataatgttgaattgtatgaacttagtgaatttaaagtaaagtgtaagcattgtccggctatacatttttcagaagaagaaagtaagacaagcggtgccaatgaattttttgattgttgcaattatggcaaactatgtattttagaagaactaatccaggagtatccaatagaactaagaatattatttcagcctgagcttgacaaaaataattatacaaagattggagaaatgcaccaagattttctaaaaaatataaggatgttgaattcttctttttgctgcgcttctttaggttgtatgaaatttaaattcccggataaaaatattccaatttttaaaatacaaggcggtatatatcactcatataacacatttgctcaaccagataataacgagttaccaatgaatggtcagttatattttatagatactgatcaagcaatggattatcgaataaatgcgttaaataaaaaagtggtaggagatgataaaattattgcattaatagcatatattgaatcttatctacgccaaaattatgtttattcacaagcatacgaaatgatgaaggatgtatatgaaaatgtattaaaagaagccaaaaatgatgctattcctgaacttacgatggtgtttgatgttagaaaagatgttgatttgagacgttataacattccaaggtcaaatgaagtttgtgctattatttggcgtgatgcaaatgacgatataccagcagctaatgttgtagtgcatacaaaaggcaataaaaaactagaaacaatctttcctttaagtccattggttgagccaatgtgttacccaatcttttacccaaataattaccaaggatggaatcatactttaaaaaactctgaaaacaaaaaaatatcgttgtgttattttactaaatataaattattttttcgtgaaaatgggaagtttttgcctcatcattatagtggtaaattatttcaacaatggattgtcgaccaagcagcaagggttgaatgggataggttaaattatattaagcaacatcaaaaagaaatatgcaaagaaacatataacgcaatagataaatttttatttgcaaaagcaactgaagatggtgttcatgttaaaaagaaaattattctgccttcgtcgtttactggtggaccaagaaatatgtatgagagtttcagatcggatattgttgcaagagtgttttatttaaaaataacccaatttttaaaagaaataattgatggtcaaatatttggaagagtttcggggttttgttattcaattgagtttcaaaagaggggtcttccacaccttcatatgttattaactttagatggtttaaataaatggaaagaaacagatgacattgataaatttatatctgctgaaattccagacaaatgccatgatgaaattttatatgagttggttacaacattaatgacccatggtccgtgtgggcaagattttcctaatgctgtttgctggtgtcagaaaaaaaataaatgtaataaaaaattccctaaaaattatcgtgaaaaaactgaaataaatgaaaatggttatcctttgtataaacgaccaaacaatggaaaaacattcttaaaaaaggattggaaaacagggaaaagtatgtctatgacgaatcgtgatatagttccctataaccggtatttacttaaaagattccaagcacatataaatgtagaaaaagtggccgacattaaagctgtaaaatatatttacaaatatatttttaaaggttatgacgcagcaaccgtacgttgtgtaacgagtgggaacgaaaatgtaaaagaattagtttatgatgaagctggctcttttcttgatgcacgttatctgagcccagtcgaagcctgctggaaaatttttaaatttcctttgcaagggaaatctcattcggttcaaagattacctgtgcacttagaaaacgaacaaattatattttttgatgaaaatgatgaggaggaaactattatagagaaaagtggtaaaaagagtaaactaatggcatatttttcttattataaggaaaacccaaacgca

SEQ ID NO: 14813 - DNA, 2349 bp, Heterodera glycines
  misc_feature (5)..(5): n is a, c, g, or t
ctaanttaattgctgttaaattaatgaaagaattgaaaccctttttaaacaaatttaaaatgtaattgattttcaattccaaggaaaataattgaaaatttaacgaaaaatcaccaggaaaatgaaaaattacaaaaatggggaggaaattatttttttatttatgtatttttttcttttctttttgacaacaaacatttgaccaaaagagttgtcattttaaacgcaatccaagcaaaaaatacgaatgaaacagcgaagagaggaacatcgacggagtaaaaggcgaggaggccgagctggtcatcccagggcaagttcagctcgttcaattccccaaattgggcggcaaattcgacccatcggaccaatttgtctttgggctcaaagggcgtcagttggaatttgcgctttaaaatttgcgcattccgacggaaggacggattacggagaatctgaaatttacctgctgaaaacatttaagggttccgaattgaccttgtcaagtgaggcgaagaacacttcgtccgccgcctcccccctcaaagcgtttacgtccaattttatgccgacgcccttttgctcggccaaaattgcgttgtgaagttggtccccgaataaaggaatggccaaaaccggcaccccggcacgcacagactccgtcacactgttcagcccgcaatgggtgacgaaggcacgcgtatttggatgcacttttaaaaaaagtaatgtaaaaatatttacaactaattaatcattaatgcactgacataaaattgctttttggtcggtccatttcattgtgtgaacatttcgatatttggcaaacacttttgtgtcctcttctgttaattcgaatttccaaatgaattcgacctcagagaactgttccattgcgtttagaaaggccattttcattttggagggcattaattgggcatttgtgaatgatccgaacgatacaaaaacggcgccagattttgcattgtccaatagccgactcatattcttagaaaataaatattttaaggattaaaacgcaatttgtgccctggcccaggcacccaaattgtacgctttttcctcaaaatccattataacttttctcaaaaacaacaaaaccaataaattacactgacgtgcgttgattaaaatgaattgggtgccgggtttctttctttttgaattgaactgacagagtccaacgctttttgtcccatttcgaccattcccccgacatttatcactttgttcgaaattggccttggaaattcgaagaactgaaaattaaaatgatgaaattttgaaaaataatactttgaatattaacctcatttgtattaacaaatatcagggaaatatttcttgcaatttcgtccattgttggaaaattttcaccaaaagcacgtcgtacaatttcttcctttaacttttttatgattaatttgcaattttaaactgccaaaattaaaaataaataaatgtgaagcgacgaattaaaaagtcacctcaaatttgattggtaactcataaagataagcccaattgtaaaaagcattgaagaaattgatcattcgcgagacgaaaggcatcggcggaattccgtcagcagttgaaaatatatccaaaaagatttaaaaataataaaatatataaatgaatgaatgaaataataaatgtctatttggggatgccatttttccatgattaattttcccaatttttcttaacttttgccaccgtttctccgtttccctccctttatgcttttgcttaccttgcacatagctggcaaaagtcggaatgccaaagcgatgtgccgtcatttgaaaaagcggcgccgcaagcgccgccaatttcgtttttgccccaattcgatggaacatagcgaaggggcaaatgtcatacaattcggaaattgcgacatcgaaattttcggcctctaatcgactgatcagctgatcattccacgtcaattcttagcaggaaggcatttaaattgaatggcatttaaaataaataattatttttcaatttaattgtttaatattttcaattacctttgcaagtgtttgaacacaaattcaagaagttttcccagatttgctttaaataatttatattggtttaattaaattggtaactttttcatcaaaacgaaccgtttgccaaatgaaagtggcgaattgtttgccgtcgaacggatcatttagcaaactaatttgctgaatgctaatggaattttcagcaaatatttgacgaatgtcgtgaattgtttgcactttgtgcacttcttttggccattgaattgtaaaattatttggaatcaatcgcataaaatgcttaata

SEQ ID NO: 14814 - DNA, 1603 bp, Heterodera glycines
  misc_feature (34)..(34): n is a, c, g, or t
  misc_feature (1581)..(1581): n is a, c, g, or t
ccccccccccccccccccccctccacgtcatgcncgcgtcagccaaagtgtccgcaattgtgcccatgaattgcatgtgactccatgtcaaagtcggcgaatacaccaacacttttcagccgtttttttggcacttcagcgaatgcgccgaaaagtgaaagaaatgccaattttaatattagcaatgaaaagaaatccatcggatgagatgtaataatcagctaaagcggattaatttaccatttttttattaagagatgattcaaaattaaaaaattattaactaacattgaacagcgtacaatttttgtgataatgtcaaacccatccgagtgatgattgttctgtttgattgttaatcggctcttcgatttcacttttttttcgtccgtcattcacttaatttcttcttatcttttcatgttcgtttatttttcttttttttttgttcggagtttgtttttgtcttttaattaattaaggaatttcgaattaatttataattttgaatttattctgctgaaccttcttattcacattgaaaaagcgacaattgcgaattaaaaaattagattaacaaaagaaataataaggactatttgcgcatcagcagaaaattacaaagccaaagagacaatcaaatgatttaattaatgattaatgctaaatatggcaaattttgtaaattcaatcgtcgaagttttctgattgatacaaaaatgcaaattcaagaagaaaaaaaagtgggaggcggtgggcattggcatttcatttgcacctttccccgtggacagggcaatatttacaagaaaatacgaatcttttacttccgccttcctttggttgccaccaaacatcgcctaaggcagcaaccaattaattaacgaacgaacgaacggatcgaaacggaacggacggacggacaagtgggaaaagccaagccaaaaagagaatgatggttggtttatccaatatcattcatcattgtttgttttgtcagcaatcaatcacttttaaaaaactcaaaatcataatgatccctcccctctccttttccacgtgttctctgttcattcgaacgcctttttcccctatatttgctaattcgtagaaacagtggaggcaaaatggcaaatttaaagtaaagcaaaaataatataattttgaaatggaaaaagaaaatttaatttaaattaaaaaaaaaacctttagcaaaactaaattatcaagaggaatcaaatgctgatcagcagcgacaattctgttggaatatcagaaaccgcggaacttttttgtcagtcaaattctgacaatgatacattttgccaatttcaaaccgccaatgccaatggaccgaatgccaaacgctcatcttcgcagccttcttccagcggcaccattggtaatcatttatatttaaatatatatttaaaatttaataaataccattcctgcaattaagaatatttgtttgaatttcattttctttttcttcagattgcgtcgtctgtggagcccgagagcttcgggtgtgcattacatggtttggtcttgcaacggatgcaaaacattttttcgccngtgcgataatgagaggtgaagc

SEQ ID NO: 14815 - DNA, 2853 bp, Heterodera glycines
ccttcaccgccccccccccctcccccaagggcgtagcgagggggggggaaagccctcccctccgcccgaaactgaaaaatgaacatttttaatgagtaaactattttcttaaggaatttctcaaaatttccttaaaaatttcaaagtagactcaaaaatcgccaagtagccccatagctgaagccaaggatctggctacgccctcccccccctaattcgtccaccgtcctctcatcccttctccctttttcagattggaattggcaggcgccgccggcggttcttttctgacaaggcaaagctcgtggggcaatttgttagtggcaaatgtgcgattggaggcgggcaaagaaattggcgttcggttgggagggcggggcgaatgtttgtgcgatgaaacggccacagtcatttccagtgaaagtgccaaattggtcagtgccattcccccaatttggcccctggcatttccccttcagcaaaatgttctctgttctcgccctttggcactttcccctgagggcttcgctttttctgccgaccaattgccgggctgtggtggtggcggagcgagtcttttcttttatggacgaaatttggtggcaatcgctggcggcggaggcggcgattttcccacgcaaacttccgggtaattttcaacttattttagcattttgattttaattttaccaatttagcgatttggcaagcaaacggcgcgtgtcggggcgcggcgtttccctggggaaaggcgccggtgccaattcaaatgcttcagcaaatgatggctgtgagggcgcagaatgcatcgacggacatatttttggggataatttgagcgatattcgcgccggaaaatgcccgcaggggacaaaatgggcacacaacgggggaaaaggcgggggagggtcagttcatttgtggccaatcaaacgaagtgcagaattggaatttagcgcgagttgtggccccggaggcggtggcggcgggggcttcaaaggtaccgccgcaaatggcacctcaaacggcatcattcggactatttgaatttcaattttaggtggcgatggcattttgctgggcccgggtcagcccggctcctcccttctcctgctgttcccctcttccgtccaccgaatcgtcgtccccaatgccaaccctgggcctggtcgtctgcttcttctggcttgtcctcaggcgctttgtccttcgtcttccaattgttcattcgctccgcctcaatccaaaattgccccgcaggcattttgcatttgcgctgggggatataaagtgccattgaatggttcttgtgtcgagtgtaagtcttagcgcagcgtgccattggccattgctttgtcggttcagtgccctcccttctcgaccggctgctccccccacatgatcaggtcccgccgatgcttctcttctgtaagccttttctttcctcgtctgtctctgtactgtctcgtccctctctttttctcagcctctcttctcctcgtgctcctttccgctcttctctcacttctctgctgtgtccaattgtgccgtcgctcaaaatcctccacccattgcaccgatgtgcacgaacttatggctatcgcagcggaggcgggagggccggtggtgtcggatggacgcggcggacattgcggtggcaatcggatcagcgggttcgctaattggtcatttgagtgccattccaaaaccaaatcatttaattggccatttgattgtccattccaaaaccaaatcatttaattggccatttgattgtccattccaaaaccaaatcatttaattggccatttgattgtccattccaaaaccaaatcatttaattggccatttgattgtccattccaaaaccaaatcatttaattggccatttgattgtccattccaaaaccaaatcatttaattggccatttgattgtccattccaaaaccaaatcatttaattggccatttgattgtccattccaaaaccaaatcatttaattggccatttgattgtccattccaaaaccaaatcatttaattggccatttgattgtccattccaaaaccaaatcatttaattggccatttgattgtccattccaaaaccaaatcatttaattggccatttgattgtccattccaaaaccaaatcatttaattggccatttgattgtccattccaaaaccaaatcatttaattggccatttgattgtccattccaaaaccaaatcaaatcatttgtctttccttcggtcgctcatcaaatgccattctccactttcattaagcaatcccatttatgagccccttttgttgtcgtcgttgcctcaaattccacggcatttgctacgcactgaaaagttcgctttgcttttaaatgcccaaatcgctgctgcttaatcattcagaagcattggccacggtgcatttggcgaagtgttcgaaggatatttgaccgatgcgacgggttcatcaataaaagttgccataaagtcacttccggtggagtcggcgcgagactttagcgatgattttgagacggaagcgcggctgctcaggtaatcccttcacaaatcggaccaaattgcatttttaagccaattcaaacacgaaaacatcgtcaaatttttcggcgtctcctttgaacaacagcccaaattcattgtgctcgagtttctcgagggcggagaccttaagaatttcttacgggaaaatcgcccccggcaggtaaactcctctctctcacctctctgcccctatttcctccccccacccccccccctctctctctttatctctctctctctctctctttatctctctctctttctcctccccccccctctctc

SEQ ID NO: 14816 - DNA, 3058 bp, Heterodera glycines
gattcacgggaagaaataatagttagtcccttttgtgaattttttagaaatttttcccgtcaatcggctttttggaattttaatgagtaaatcagtaaccgtaaatgacatttttatgcttctcttgttggatacacgggaataaataatagttagtccttttgttgaatttttagaaattctatccgtccaatcggcttttggaattttaatgagtaaatcaggaaccgtaaatgacattctatgcttctcttgttggatacacgggaagaaataatagttagtccttttgttgaatttttagaaattctatccgtcaaatcggcttttggaattttaatgagtaaatcaggaaccgtaaatgacattctatgcttctcttgttggatacacgggaagaaataatagttagtccttttgttgaatttttagaaattttatccgtcaaatcagcttttggaattttaatgagtaaatcaggaaccgtaaatgacattctatgcttctcttgtttgatacaccggaagaaataatagttagtccttttgttgaatttttagaaattttatccgtcaaatcggcttttggaattttaatgagtaaatcaggaaccgtaaatgacattctatgcttctcttgttggatacacgggaagaaataatagttagtccttttgttgaatttttagaaattttatccgtcaaatcggcttctggaattttaatgagtaaatcaggaaccgtaaatgaaattctctgcttctcttgttggatacacgggaagaaataattgttagtccttttgttgaatttttagaaattctatccgtcatatcggcttttggaattttaatgagtaaatcagtaaccgtaaatgacattctatgcttctcttgttggatacacgggaagaaataatagttagtccttttgttgaatttttagaaattctatccgtcaaatcggcttttggaatttttatgagtaaatcagtaaccgtaaatgacattctatgcttctcttgttggatacacgggaagaaataatagttagtccttttgttgaattttttgaaattcaatccgtcatatcggcttttggaattttaatgagtaaatcaggaaccgtaaatgacattctatgcttctcttgttggatacacgggaagaaataatagttagtccttttgttgaatttttagaaattttatccgtcaaatcggcttttggaattttaatgagtaaatcagtagcgggtacgtgaaccgtcggctatttagctggtaaaaagcgcttcgcgctttgggagcttcgctacctaggctgtgaagcgattcaaattgatcgaattggttggagagattttttgaatttttaaaaaaattattagaggtttttagtccacattgaggctcaagacgggcgcttcgcgcccgttttttaaatttgttgaactcatacgggcgtttcgcgcccgttttttagcttgttaggcgcttcgcgcccgtttttcaatttttgttggccttggacaggcgcttcgcgcccgttttttaaatctgttgaacttatacgggcgcttagcgcccgttttttagctggccttggacgggcgcttcgcgcccgtttttcaaattttgttggccttggacgggcgcttcgcgcccgtttttaaactttgttgggctttgacggccgcttcgcggccgttattaaattttagaacagatacaaaagtgattagaagaggtacaacattggtcagaagaggtacaacggtgattagaagaggtacaactgtgatcagaagaggtacaacagtgatcagaagaggcaaaacaaatgtgttaataattttttaaaaattaaaaaatggtagttattaattaaaaacaacgttggaaatttattcatttaatttgaaattaaatgaatttttttacaaattcaaaaaataaataatgaaattctttaattaaaaaaaataaataaatttaaataatttataaaaaatatttgaaattaataaaacatgtaaaagcaatcaaaaaatacaaagaaaaataatgtacaccgcccggcttcgaacttggcccccccctcaaaatgatgcctcagaatccccaatcacacagggattctgaggtcttgactatgtcaaaagtacaatctgttacgtattcgtgatcagcaccctcaaatagccctaatgacatgttttttgaagatatttggtgaaaaaatttttcaactcaaaaatcctatgctcacccctttggtcccgaatctcaaaatcacttttatttttataaaaattcttaaaaaagtgataaaaatgccaaataaaatttatattatagagaaaaaaattgcggatttttgtagtattttacttttcccgaatagcttttcagaaggcagctacgaatttttttctgaaaaatcgaaaatttccagaaattctgaaataacttttttcttttttgaaataaaaaactcaaataaatcccataaaattctccttatttttctctatttttaaagctttattatagttaaatcgatgaaaccatcaccgagttatgaattttccaatattaacccaaatttccaagggccaaaaaattgccaaaaaataaagaatttttaaaaaattccaaaaattatgaaacttaaaatagacattatattcgtactcagcaccttattttaccccagaaaaatatttttcacccccattttcgtccgaaaaaaaatttccgaaaatttctagggggcctagctcgaaaatttttgaaattttccagtcattaagcacaccattcgatagcatttaaaattctctacaaaaatgttctaatacaatttttcgttaaaaccaacccctgacgagttatgggcccaggactcaaatgtcccgctgaggccaaaatttttttctatttccgggaaaaaatcgaaatttttccgaaaaaaataccagtcgatagagctcgaaaaactatgttttggaagtggtctccgttttgcccagaaaattcgttaaaaaatcctaaaatt

SEQ ID NO: 14817 - DNA, 1426 bp, Heterodera glycines
  misc_feature (13)..(13): n is a, c, g, or t
  misc_feature (1339)..(1339): n is a, c, g, or t
ttaaatttaaatntctgaattataattaattacatatttaaaatttataaatactatttttcatgaatatgattttgaaaaaatttaacaattttttttccttataatttcacagacctctggtcaactcaatagagtctgagcaagcgctatatttgaattatttgtattcgtgccaaaaaatctttccttttttggacatttcgctttttattttactaagtaaagcagccttgcaaaatgaatgtatgttttatataaatcactaaattctatttgtttttcacagttccctccggcgttctgacaatggaagaatttgtcggcatttaccaattcaattctcatccgaatctcagcggtgtgcccgggctttatccattgaaatttccaagccacgcgcggatttccgattggaacaagccgaatgtgaacagagggacattggcgatggaaattaagaaattgtcagaatttgctcgagagaaagaggggactagccgattcagtgatgctgtgccaataaaaggatttcagtggaaaatatgggcacagataaggacgaaaaaggacagcactgagaaatggctgggctttattcttaagtgcgatgcttcaaaagaaggtgggatcaaaataaaatttacagatcccattgcgaggtatttcacatagaagttgtgtttttctgattaaatcgtattttctatacaaaagcaggcacagaacaaacaatacagggccgaatgcaagaatacgacaaaatttagtaatatattttttggaattcagatgaaaattggaattgcatttgttcggcaacatttcgaattgtttcgcaaatgcgaggcactgaagatttaattggaaagtgcaatgaccacttttttaacattaaaataggcatctgcggtttccacggtttcatcacttttgaagtgagcggcaaatttggaatgccttttaaatggtttttgttaattaagcaattaatggacccaagcagaggattgtatgacaaaaatgaggacaaagtgacattgaccattgatattgctgtggaagatcaaaaatcgaagaaattcgattcggacccaaacaaaccaaacggaaaaattgtaatggaaattggaaaattgtcggaatttgcgcgagagatttttctcagcgaacggagcagcgaacccgtgataattaagggtttaccatggaaaatattgacattgataaatatgaagaaagacagcacagaaaaaagtttgggctttttccttcgatgcactgccccaagggaagggtgggataattaatgacaattaagattaattggtagaattanaattaagatgaaaattggaactgcttgtgttcagctacacttcgaattgtttctcaaaatagcgaaacggaggatttatttgggaaa

SEQ ID NO: 14818 - DNA, 2665 bp, Heterodera glycines
  misc_feature (71)..(71): n is a, c, g, or t
  misc_feature (86)..(86): n is a, c, g, or t
gtgatgaaattgaaaaatgtcggaattgcgcgagagattttgagagtgaacggctcagcgaaggcgcacanatgcagcgatttctntgggctgtatgggcaagtctaaatacggcggaaggcaccactgaaaaatgtttggtcttttgccttttgtgcggtgctcaaacaaaaggtgggcataaaataccatgaaaatagaaaacctttaaatattttgcaaaatctgaattttaatttttttaaaattattgttgaaaaattaagtgccctcggggtttaatttagaaataccataatctaattgttattaagatgaaaatgggagctgcaaagttacggcaacccttcgaatagtctcaaaaaaaggcgaagcggaggatttcaccggcaaattaaatgatcaaatttttgacaataaattggtcattttttctatcggtcatattactttgacggtgagtgaaataattaactgtttttaattgtttaacataaaataattaagcaattaatggaccaaaacagaggattttatgacaaagacgaggacaaggtgactgtgaccgtggaaatcactgtggaagaggagaaaaaagggacgaagcgtaaattgccggatgagtaaaagcatcaaaatcaatttatttgtttaataaggcatttttcttgcaattattcctccttttgtatttaattacttttcaaaaaccgcttgtttttgtaattttaattggtactttccttccccttacgatattcatctcaaaaattggctttttctagaacaatttgtttgtttaacttcataaattcaccacccaagcaaatgataaggccatggacaaaaaaatgttattttaaaagacaaaaaaatgagacatttgaattaataatttttctcagtttcctaggccataactttttttttcttaatttggcattacatatattcttggtatcaaaccaaagcttaatgtctcaataatttacaatgagaaaacacaaattcaactttttatctattgccttgagatcagaatttaattatacaaaactctatagaatttaatcttccgattgatacccaataatgagaaattgacgaagaaaaaaagctatggcctaagaaactgagaacggttcactgatcggacgcataaactaaagtagagcccaatttttgccagtaataaattaaataaaaaattgggatggcgcgccggggactcgtttacggcggggattggaaaaacggggacggggttcaaatcccggtgatccccccgccccccatcaccatgcaatcctaattttaatgttcttcgttctgtttcaaaaagacatatacccttccaaatcttccagaatttttattgtttgcaaaattactggttgcactgtataatgggggaaatccttttataaggtataattaatacataatgtgtactttctcagtgttccaatcggcagagttcggttaggaggacatttcggagttggacattcttctgttaaatgtgcaatttttattaaattacacggaatatttaaatctcttcctcgaaaccttaacaattattattaggaaaataattgttttgtttgtgtaatcgaatttgccacttttacatttaattttttgaccggattatctcaaaattcctaaaaaatgcggctgctatcctcaatttaaagttgctaaatgcattgatcagttttattccagtaattttagtgccatgccaccatcgcttttgtgcatttttatgcctttaatccctttttcaaaaatcagtcattttcacaccaattttagccaaattccaaaaatgttttgctaatccaaatgagcctttatcacattttcctcttcgtagctttcttttatgccaacgttctcttccgagtgccgtcgtcctaatgctaattacttctcttttttgcgcacgccgccgcattcgccggagggagcaaaagcgcgcggcaaaagacggcaccgccggcacaccattggtgccatttttgtcttcatttttgccttggcccagccataaatgagtgcacttttaaccctcccgcaggggtaattttgaatattcatcaataaatttatgcttatggactagttttatgtaaatttaaaattctatgaaagcataggcaaactccggcactgattataaaatagggcaaatgtttgtctgttttctgtttgatttaaattcaagaaaaatgtatggaggcagtgaaaatcagttgtgatgctccagggttcccgactcagaattttttgggtccccggtgatttgccggtctcggtcggctcccaattcccgtgtaaaatcctttcgctcacatcactaataagctgcaaaacgacaaaatgattttattattttttacattttttcgaaccaatgatttagttgaattcaaaatattcctttgcattttgcaaataattagataaaaaagtttttatgttacttttgtttaaaaattgaattcttttctaattaatccttgaaattttcgaaattttttgtttctttcctgtctacgaacaaaattaaacaatgtacctgacaaatgaggcacaaattccttttacaattgattgcttctgctctggatattgtcctacattttcccgattgtat

SEQ ID NO: 14819 - DNA, 2015 bp, Heterodera glycines
  misc_feature (1187)..(1187): n is a, c, g, or t
  misc_feature (1198)..(1198): n is a, c, g, or t
catagtaaattattattttaccgaattccgctttttcatttttggcgtcaaaacggaacattgccgcaaaaacttcagaagtgtgcttcaaaatcagtttatgggctgacaaaagctgaaaggattaaaatgtaagtaaaaaatcaaacaaaaaaaaaagaaagaaaaatttactaaaattaattaattaaaattttaaatttgaatttcgcctctttttcgtcttcgtcgcccaccaaaaaataaacatccgcgtcctcacccgagctcaacaaatgcttcatcagttgaatcacttgattggacattataatcaattgtacttttgtaatttgatctaattgtgaaaaataattggaaaataagtgaaatattgtaataattcaaattagcaaaaaactaaaataccggcagaatccttagaatttgttaaaactttttaattattttccttttaattatttttttttaaatttctgttccactagactaatccagcagtaggttaatcatcaaaaatacccaagcccacccataacaacgaatgagtgaatgttgaaggctacaattttgatggaagctttcaaaatcaatcaaaatcccatcatcttccatccaaagtcaatcaaaacaaaaatatgcaaatactggcaatagcgtcagaagaatgaaataagtttgttgttcctccgcattttacccttttttcatcgctttgcccctgctgtaaaaaaaagttgatccaaatcaatgcaaatgtaaacaaaaaagggttttcatcaaaacaaacaaattggaatgcatatacacgtacacctgtctttaaaaagaagttgtgcagtaagttcccccccccccccgagaaattaaaaaaataaaattttttactaacttagaaacttttcaagaaaaaaatctagagttttttttttaatagaaaattctaagattttttgagaaatttcagcgatttttggaaaattttttgaaaaatcttactatttcatcataaaaatttatcaaaaaattctttcttaaaattttcttataaaaaacctttcgaagacttttttcttgaaaaatttctaagttagtaaattttttaaaaagatttctcccgggggaaacgatgcggggggggggacgagctgctccgaaaaagtatgtttaattttaatgttaataancagataatttnagactagaaaaaaacagaaaatttattttttagattagcgttttattcgttaagtttttgtcaataaaaaaaactgaaaaggatataagagattatgattagtagggaacggatttttaagcgcgaaaaagtccaaaataaggccttaaataagtgcgaaaaatcgcgaaataagtgcgaaaataagctcgaaaaaattccaaatttaggggtataattttttaaattgctgttttttatatgaaaataatttaaattaaggaaaacaattttatttattgactacatacagttgcaaataattaaatatacaaaataagcatttctaagttcgaataagtgcgttaaaacacaaaattttcgaacaaaaaatgtgtttttcgtacatttctcgtcgagttaaagccgcacatggacggtaaaaaagaaaaaaaagcggcaataaatcttttttatggataattatgggaaaaaattggcgttctgtcacatttactttttatctttatttctctcacttttacgtactatctcttcattcttaataatgtaaagaacaacatttacttcatcctgtttaacttttttcctacttgttaaatccacaccaaattttacatatcgatagagaaaaaaattctgcatcgattcatctgttattttttgattctatctgttagtttatgaattatttaatcattaataacaaattatccaattatagcttttatggataatataaagcaaaatttaagaactaaaaacgcatgacaacaacgtgggacagcccaagggagaggagagaaaggcgcagacg

SEQ ID NO: 14820 - DNA, 2008 bp, Heterodera glycines
acggctacccgacatttgaggacttgacatttgaggacccgacatttgaggacccgacttttgaggatttgacatttgaggacccgacttttgcggatattcccgacatttgaggacccgatttttgaggacccgacatttgaggatatacacaatttcaaaaaaaaatgaaattaaatcattataaaaaagagaaaaggcctttcccaagggccaacgggtgcaatgtatcaaaaagcattaaggacaaccgaataatttaaatatttacagcacaaataatgctttcaaatttaattttggagattaacagcctttttctttcttaatgatttacaagtcatcctaatattcaatttgctcagactaacagcaattgaacacgatataaattataccagctgggaagctcctgtcaatctttgatcattttggatcgcatttaactagagtgccacgggaccgggaccgggccgggaattcccggtcattcgaggtcccggtcccggttcccggaatttgaaaagctcaggtcccggtcccggtagggcaaccgggaaccgggaaaaacaagcactggtaagaatgggggtctgagtgaaaaattagtgaagaaaattggagttaaaaagaaaaaattttaaaaatatattaatatattctttaaaagtaactctgtaaattgtgcggatggcctagtggctagtctccttgctttcccttcttctttcccctggttcaatccctctacagaaactaacatgtttagaatttttttttgtatactcatggctttcctatcgacaaaatatgattactcataattttattttaattaacacatttttatcattttttgaagaaaattcgaacaaattgagcatagtaaacccaaaaaccagccttttttgttgaaaatctgttaacaaattgcactcaaattttcaaaatttcccccggcggcgcctatcggcacagccggaccctcttcatccccaaaagtttttttggaaaaagcgcgccgaaaaatttatgtgaaacgtaaatctgaatttctaataatattcgatcacttagtccaataatgattaattgtttgaaataattgaagaaaattcaacattttcattaatttaattagctttaacttttgggttttataaaataaaaataaaataaaaaaataattttatattattttcactttaaaaaaaaattaaaatttgaatttttaaaaaattttttttaatttttttgaatttttaaaatttcccggttggtcccggtttttcttgcggtcccggtcccggtcccgaagaaaaatcgaggtcccggtcccggcttctcaggtcccggcaagtcccggtcccggttttgcccaaaattcccggtcccgtggcactctaatttcatgtaattatttagtaaattattttttatcactttttgctgcagagttatactcttttgaatttccaatgaaaaaaagattgccacattttaaaataaaattttattcctcaaatggaatatacttttcattatttttttatattttccgtctttatcggattaaattaccatttggccgataaatttgtgaatgaacatattttgggaatgtcagacaaatttttgattagcaaaaacagtaacatgatcaaattaaagaagtaccgtatcagtcgcctttcattgaggataagccgagattgtctatatttaaattatataatattttaggaaataatttaaaccaaataaatttagttggcttttacgagccaaaaattttatggcaaatattaatgaagagctttcgctaagtgaagaagcatcaaaacacgaactgctgtcggtccgctttcatcagctattccatgcccaataatttgcaatttgacggaataaattagccaaagcattactttttagtaattcattaaaatgacataaaaccaaagattggattttcagctgggggatggatggcattacgacttgattc

SEQ ID NO: 14821 - DNA, 1373 bp, Heterodera glycines
gtgataattaatcaccaccattcattctcacatctcatgtgtcatctttttgtgtgtgctcatcaccagcaccaagcagtgatgagaaatttcatcgaaagtgatcaaattcctttaaaaaaccgaaatttatttgtgggggactgctgatcacaccgtcccccccccctcccccttcacccctttcccgataaaatttcgttgaaaaccgataaatcgtaaattccccctcaccatattgtacatatgaatgaatgtgtcccgtcccagcatcagaagaaaaaaaatggaataattttcactctcgtacagatttaatgtaataaacacattcattaattccactcactttctccgcctcggccaccaattaggcaattgaatgattgcataaattaatcaaatgcaaatgtatcgtatctgtggcacagatttgtacacaaatggcatatatcgcattatgaaaattttccaaaaattttggatgagtgcaaatgaatttcaaatagtctgaaggaataactcagttcattgtttatttgtttgtgtctcttgtgctttatctatcggcgccttctgctgctgcttgtgtccccaattgccccaaattccaatttaatcacaccaccaccatttttcatcataattaattgtcggaaatcggcttaaataccccccacccctcgggcgacgagggtggggtggttgtcctcctcctcctccataaacaccatcaccaccacataagtttctctcattctcgtcccaaatgctgcacacaaataaatccacaacaaatttccgctttacctctcccctcccgccactcttggcaaattgtgtcgagaatttattactataaatttttgtaagagcaaaaatttgtgtttgccctccctccttcccccgtccctcatgctgctgcttggcttggtggtgcacacaaatcgacgacgcgaatgaaccaacccctccctcgtcaacacagcagcagcagcaagcaccgttttcactttcacgacggtggcgatatgtgtggcgggcacccgtcgtcgtcgccgctgccgttaccgtcggcggcgctgtgtggtacatcattttgtgtatgtgtgcatgggaaggagaggagcgaaaaaagtatatttgtgtgtgtgtgtctgtgtataagtagtgattgatcgttgccgaattttcaattattagttcactgagtttattggtggtaacccagtcaactcgatttctcttcctgctgctttccccgctgtttatgaggctgcttgctaatgagggccaatttaaaatgttttttttaatgtaccccagaggcggaacgtggagaaaaaaatcccccgggcccgcatttgtcgcgt

SEQ ID NO: 14822 - DNA, 1487 bp, Heterodera glycines
atcggcgaaccggcttcggcgaatagtcatgtacccccccccccccccccccgcaccccggcacccccacatttaacgcattttgcgacggattttgtgaccgatttgaaaggaatgaatgagtaaatgaatgcatgggttggtgtctgcttcaatgcctgaaattgaatgacgagctgacccagcgttgttcccgtaatccctgggaaaatttcggatgagaaaatttaaaaaaaaacgggcaagaaagtgaaatgacaactctaccaattttgatgagatttgctagtagaatttaggaaattgttttgaaaaagtgaaatttgatgtgaccgacgaaggcaaacgcaaccaaatttcaagaaaggtgccccattagccaaattttttaattttttcacctacttggttacgtatgcgtaaaataaacccttgtaaaatgttagggaaatatttattccaatcgctatgttttatttgtgacacaaattcaggacgaactccaccctcagccccaacaacaagaccaacagcaaccattgttgctgttgttggacgaagacgtgatggataagccgcgacagcggctggcggaggcgaacaccaccgcaactgacgacgcggcccattgctccgccaactgcgacgaacggcatgacgaccacccgctgctgctgtcattcggggaggatgaggaggagggcacagcgaccagcgccgcagcggacaacggcagggacaacatgaacaaccacaacggtggcgagcaggtcggcggcactgccgcgaatggcgtcggtggcaacgagtgtggcgattcactgggcgtttccgccggcggcagcggcggcgggggtgccgatgacgccaactttttcttgtgctcgccgctcatctactcggagccggcactgcccagcgcattcgccaatggcggcgccggcgccggtgggccaacaattggcgcctcgtgggcctactcggaaatcgcactacctcaggtcttacaatttagtttagtttgggtgatgatttagtaattacccaactaattagccccccgttaattagctaaaaattagccgttttttgatccgtaaaatacattctattttgtacacttgtaaatttttcaaaatgtgaaaaaatcctgttaaattattatagattttgcccttaaatagccaattccaaggaaataaattgaaaacttcggcaccgtcgggaaaatttgaaatattcaatttggccaaaaatctccttgattttacggctcccaaatttttataccaaatggaattttaattatttgttggctaatcgagcctgtcagctagctctataaaagttggttgtctttttgcagggagccaacattggcactttcccgatgccattgccgtcgaacaacagccacaacggccagaagcagcgacgacggcaccacttggacagcgagacgggcgagggttgtgccgccggccgat

SEQ ID NO: 14823 - DNA, 1159 bp, Heterodera glycines
tcagcaaattccgaaattagcttgggaatgggccccctttaggcaaccttttttatgaatgttgtcccattttactttgtggtctgcggcctatggacgcttcagagccatttacgccttcttttcaatattcgtatgtaaaaacgactatctctttttttcggaacacttttttgaaaattttttccggaagagattttgtgacacgcaatataactaacattcgaggcttctgtcatttcctttttataatgcgtatataatttaggctatttgattttatcagcaaattccgaaattagcttgggaatgggcccttttgaggccaaccttttttatgaatgttgtcccattttactttgtggtctgcggcctatggacgcttcagagccatttacgccttcttttcaatattcgtatgtaaaaacgactatctctttttttcggaacacttttttgaaaattttttccggaagagattttgtgacacgcaatataactaacattcgaggcttctgtcatttcctttttataatgcgtatataatttaggctatttgattttatcagcaaattccgaaattagcttgggaatgggcccttttgaggccaaccttttttatgaatgttgtcccattttactttgtggtctgcggcctatggacgcttcagagccatttacgccttcttttcaatattcgtatgtaaaaacgactatctctttttttcggaacacttttttgaaaattttttccggaagagattttgtgacacgcaatataactaacattcgaggcttctgtcatttcctttttataatgcgtatataatttaggctatttgattttatcagcaaattccgaaattagcttgggaatgggcccttttgaggccaaccttttttatgaatgttgtcccattttactttgtggtctgcggcctatggacgcttcagagccatttacgccttcttttcaatattcgtatgtaaaaacgactatctctttttttcggaacacttttttgaaaattttttccggaagagattttgtgacacgcaatataactaacattcgaggcttctgtcatttcctttttataatgcgtatataatttaggctatttgattttatcagcaaattccgaaattagcttgggaa

SEQ ID NO: 14824 - DNA, 934 bp, Heterodera glycines
gtaattaaatgttaccaacatttttcacccccatttaaggcactttttttttatttgttttaattattttcaattaccaaccggtattttttttaaactttatatattgtattcccagcttaataagttttaatcctttttttgcactttaatttttaatttaaaaataattttattcaacattaataaaaaattaacagatggtttttctgatcgatatcaagaaatttttttattgtatattcctttttttaaattcaattcttccccccccccccttcaccctcccgtccccactctcgttccctgcccctcctcacgcacgcgcctctgacggcttgtttttggcgtctcctgcatttcttccccctccttctccaaccccctaggcttcttacccgctctcgccttctctcgctttctttttccactgctgcgattcgtgcttttggtcattgtggtgcttgccattgaccccgcctttgtttaataattttaattttaaatttaattttcattttcactaccatgctttgcatgtcctccctcttcccctctctgctgtcccccatttctcgcaaagaataggaagtcttcttcttcttcttcccctccttctctttgtgctttcttagcctcttccgctctcttcttcctctctctctttctctgccctccccctcttttgctaacggtgctttccccagccaccgctcacccccggtaattttgttaatcacccccttcaccggcctatatgcttttttgtaaagctccaggttccggcgtttgaggtccatcatagccggtgcctgatgggtgcctgggcagtttttgatttgctcttttcgagcactgagttggcgattccgcttaaggcggctcttttcatcttcgcactcgaagcattccccgcatttgcacaacatttttt

SEQ ID NO: 14825 - DNA, 2404 bp, Heterodera glycines
attcccgtctccctcttataaatgcataacgaattgatgtttatttatttatttttcaattaataatgtttattgattttttttggctgagtttaaataatgattgagaattgctaaggccaagtggcaatcaatgaatcgtttacaaaaattgtgataatatggtaatgataggatggacaatgacaaaggggtccaagaattatcaaatacatccatcagcggacaaatggataaatcccctcaattcgcgcacgacagagcatacaagtcgcgaccttgtggatcaccgcgttcaccgcacatgtcgagcacaggtagatgtgtccgcaattacggctgtagaagtgtgcgcggttgctggtgcagatgatgcattcggtctcccaatagagctgggctggcgggacgagcactgacgaggcacctcccctttcaaatcgttgcgactcacgcagctgcagtcgaacattacgttcgaactgcagctgctgatgacgaatcagcggttgaggttgcggctgctgctgagggggctgtggttcgatgttctcgtcgttttcctgctctgctgcctgcagttgttcgtgaagaagctctgcttcctccatttgctgatcaaagtgttgctgtctttctcgctcttatcgttgctgctgctgctgcgcttgctgaagcaacagatggtgctggtgttcaagttgctgctgaacagcacgatgaaccatctcgtcgcgaatgagacgcatccgcgaacggttcatgtggccttcgatgacagcgcttagaacggggcctgtcaaaatgcatttatttgggtaaaattattaagggttcatctcaccgttttcacgttcatcgtcaccatcactcgccgtacttggcccagccacattgctcactaaaaaaatttttttttctttttcattttttttcaaaattagcacaccattagtacggttttgcagagtcccattgcttcccgaacgtgaacttagcggagtcagctgctctgcaaaaaaaaaatcgaaatttaattaaataaaattcagggtttaagattttcattcggtctggcacgaacactgccatcacttggacccgcaccattattattctccacttgcactttaaaccatttattatcttaatttaaaaatatcgcctacccaaacgagactgttgtcggcgttctcgttcctcaagtcgacggccgagcagcgaaagctccactcccgccatgggagagtatctcgggctgaatctctggttcccgcgagactgaaataatcaaatcactattttatcaaaataaacgaaattaattattttaaaatactttgtttgaaaattaaacttacgttggctaagtacccctccgttgattcaatccgcgtcatattctgaagcaacactgctctctgatcgatgatctggcttctcagcaaaaagatcatctgctgctgttcgcgcattgctcgttgtaactgacgaatagcatctgatgccgagtccattttttcagaattaatttaattgctaaaaaatttaaaatttaacagataaaaaaaagggaaaagaagatgccaaaatgggctcaccgaataaatgacgatcttaaccccacccaccaacagtctatcacatttttctcgacatctcatatttctgcgatgcgcatttaggggaatattgggacgattaaagtgcttgaactgttggccggtaaatttctttttaggttaccgccaattatcccaacaaggcaataaataagcacatccattgcagtgcggagccggcgttaaatcaagagaggaatgagctaaaggtcaaattgcttccgcgctcggcattttccttgctatgcaaacataacaaatttttgccttttttatggggtttgggaggtaatggagattaggggcgaaaagttgtgagatgaccaaaattaaaaaaatgattttattaaaaaacatttattatgaattaactgcaaacaattaaatatcgaattatcattacaattattgaaattatcattacaaaaattgaattatcgaaattatcattataatcatcgaaattatcattattatttaaaaatcaaaagatcattattttggcttccgtcacttggtctatttctttggcttgaatggagcgagtatgtcggttgcacgacagttgtcggtcgtgcatttctcacacaattcaaagctgacaacagttcgctcgccattggttgaatatttgtttgtattgttccataagcacgaaagacatgctgattttaacaagtatgccatgttaaaatatattagtcaatagccgtcgcaaaaacgaaaagttagcatatattttcttaggaggagtttccaggattggatgcttctggggtttt

SEQ ID NO: 14826 - DNA, 990 bp, Heterodera glycines
  misc_feature (798)..(798): n is a, c, g, or t
  misc_feature (802)..(802): n is a, c, g, or t
  misc_feature (906)..(906): n is a, c, g, or t
tttatttatttttaatttctgcaattttagaccttcggtggccatacgctaacgacacacttttacccatgggtagtgtttgtcaaagcggtccacgagtgtaaaaacggcgaaaaaatgtccataacatgcactgggcttttgatttccttacgccacattgtcacggctgcacattgtctttactggaaaaaagagttactcgcagaatgtgatggaagggccggcaatcaaaccaaaaaagggtttgttgaaaaaaactagcaaacattgtttaaggtgtaaatttctaacattttttttgtttattacaacctattttgagagtgactctcaagaaaattatttaactaatttcagatttaaaatggtaatgccgaatgaattattcatatcatatgggtcttatgatattgaaacagcatggacaacggaggcacggaccatttccattccacacaattttcggacagacaatcggcagccaagaaagcatgactttggcattgtacatgtaaatcacatcactcatacatcaaatattttataatttcaaaaaggtggattgttttcactattacacatacctgcccaagggggtagtcaagggtgggagtcatgacgtcgaacgtaaggggtcagcgggtgtcgaacgtaagaaatcggcgggggagggtgggtcaaaagaggaaaaaaggagagaaaaaagaaagaggaaggaaaagggggaaaagcgagaaaaggcagcgtcgaaatcaaggaaagtgccgttaattacgttcgattaaccctgagganctgngttttgtcgaacgtaaaaaaatgaaattaactaatttcttttgctaagtgtttcaattcagttacgttagacactcttttctttacgttcgacgaattctgctngaagaagattcgtcgaaacgtaagaggaagtggctgaaaaattcctaaaattttttcctgttttttaaaaaataaaaaattcct

SEQ ID NO: 14827 - DNA, 1853 bp, Heterodera glycines
aaagcactaatggtgaagtcgtcttccttgaccaagaatacacagaaagcgaagtgaaggccaaatgtgaagaagcattcaaagaaatactctttgaaaattatcaagcgacttgcgcttctctcgtagatgacgaagacgaagaaagaggaaatgattgtctggaatcggttggccacccccacgaaacccagtgattttgaaatttgaaagatgaacacactgtgatttgatatgtctgtgtcaaataaaaactggcaatttcatagtcttaaaagaaaatccattcttatccgtgagtttgtagcagcgctaaatagagtggatagtcattcttaagttctcactagaattcagctaaaccaaagctccatatctgaaaattggtttttgttattttttttacacacaatgatgaatgccgaatattaagcattaacagcataattatgtcgaataaaagtatattatattctgtggtcaaaaaaaaaaaatttaggcaaaaatttttcaagtctcctctttacaactagcgcctgaaatttttcaagtcaatgttaacattgtttgctttgattagaaagatcgttgtaaaatctgagcaaatttttattctcaagaaaaacatagccttagcaacaacagctgttccggtgatagcttaagcaacaaggggaaaaaaattgaatttcatttccgtttcttttcaactccgttcattgtcttggctctttctcggccgcttccttttccttcggcgtctctcctaatcttttgcctgtctcctccaatttgttagcaaattcttcagcggtcgtttggtcacgaaatttaagcaaaaacacttcgtcaattccctcggagctttcgctgaagtcctaaaagaacaaataaacaaagataattagttaattaattatgatagtgccaattcctactcggcactgcaaagttcgaacgttcggcttctgaccagtgatacggcttatcattgtggccaagacgggaaaattagcgaacaatttgcaaagttggtcatcactgcgaatgacgcagcgataacggcccgtctctttgttgtgcaacagctgaaaagggcaaacgatttcagcacgaatggaatgggataatacagtggaaaatttgttttaccggcccaaccctctccccaagtgggacctacacaagccgtaattgtaagacatggaatttgacgagttttttgtttacatggcccacaggcgacgaagagaataaatttatttcatttcctccctcatgaaaccttctccaactcttttttaaaaggtcccaattttaggccatttggggcggggggggggacaactcactttaagctccccaattccccgttctttgttctttttgtccattgggtcgtagcgaaacaatttacaacgagcactgaaaaggacctaaaaaaaaaataaataaaaaagatggaacaagcaaaaagcaaaagcacctcctcattttcttcgccgcttttcacatcgacttttgagggcaacggaacaatcggcttaaaagtgcccgtcggaacaaattcttcggccgcttcgtcgtctgaatcgccgcctttgtctgtcattttgccagccttagaaacatcagcagaagaaactaaaccaaatgaaaattgaattcaaatatttatacatccattaaatgaatttattacttgtcgtgcgggtgttggcggtggtcgaaccgaagagagtgccaccggcggcggaggagccaaaagaagggaatttggcggtgccgaaagagaaggtggggacggaggaaggcacagcggcgggtgccgtcgttttctgctgagtgccaaa

SEQ ID NO: 14828 - DNA, 3476 bp, Heterodera glycines
  misc_feature (3441)..(3441): n is a, c, g, or t
  misc_feature (3470)..(3470): n is a, c, g, or t
cccttccccgcggcgcatcctctcgcccttttcactttctgctcgtcgcatttcattttcgcggtgcaatttcatgtgaaacggcggagcccatcagacgctttcccaaagaacgtttccttttctttttctttccctcccttttcgtccctttgtttgcaaatgttcggcatccgtctcccgtccatcccttgccaaattttgttcgttttttctgcgtttatggcgcgacttcgctgtcagttcagtccccagtcttaccccgacccgaggttcgtctcctgcggttttggctggcccattgagtggcaattcagaattgaccctttgtcatgccgtcttctgctgccttcccaagtctgtgacccttccgaaattttaacgcccgacgagcggcgcattctcaacgaaaagattgtcagggtacgccgggctttgggaccaatcgttttttgggagggaatgccaacgaatgtttagctgcaacagataacggcaaacatcaaaaacacttctcctgcctgtgccgacacaaccaaaagcaccaatctgttcattatggtcgcgttggtcgaccgtttgagcaatgcgttgccttttgagtgggtgcccttcggcgctttctttgcttattaacattagcatgtgaaattttgaattttaaaacagtggcagcagcgaccattcggcgaacattgagaaattcaccaaccaactccgctcaaaataccaacattttcaggtcagtgatgtcataaagtaaatcaaaaaattgtccaccacaattctcccgcctcacagcacaggacatttccctgtgcgatccgttggtgctcattgtgaacgcccacggggaccgacaagtgttcactgtggccggtccgtccataattatgatttaacacaccattttaaattgaacaaaaggcccagggatgagaggccttattttgaagggcgggatttcattggacatttcccgagagaatttcaggccgagatgccaaactgagcagagaagtgcttcaggcggcattccaacgaaatgtcggccatttccgtggcggaaattacgcattgggcctggagggcatggcggaatacactgtgtcggcctacggagccgcacacattgtgcaggtgccgagttttccgggcgagccgaagtgagcgtgggaaccacaaaaactagccaagcgattaattaattgcccatcaaagcacgaagaaagggacgaaaaacaacgaaagtttctccaatggtccgtcgaccgtttcttacggaatgggacaatttgttgcgcacggagtgcggcagcagcaaaggccaacaacagagaagaaatttcacatcgaaagcattcccgaggaggacagactctggacacgcattttggcaaaggcaatggcacagtgcggcggagaggagcagggcaaaatggtcaaatacgcacagacagtggtggaaggtggacaaagacgaattggacaagcggaaaatgccatcctttagatgccatggatatttccctgaaactgatcagtgacccgcactataacagaattgaggaggattctcaaagcatggaaaatggtctaaatgcccgggaaaaggcgtggcaaagcataaaaggacatttggagcaaatctatgcgaaatacggcggccaaatgcaacaaatgaacgcagccgaacaatgccccggcccgaagagaggcgaaaagacgctgaagatcttacgcttgaattagaggaatttagtatgtatgtaaaaatgtgtaataaaatttaaattaacaacgaatacctttaattattaatgcaatgatttggacggatattcacagttaaataagtcccctgtcagccaatttttgactcaacactaaaagaatgtcacaatttggtcgaatttaatgaaactttggaatgtgcgaaaatttataaacgaatattgttttggtaccataacacatttgacgtaaggagagaacagctggatttggtaggaattgaaagaggcgaaagaaaaagacgacatagtcatgaattagcaagatgtaaaagcgaacatctgcacattttgacgacaaaacggaaagaaagcaacgcacaaaacaaacaaagaaatgcaaatgagtgggagaggggcaaaaagagagcaacgaatgccaaaggacgaaaccgaatgaaggggaaggagggtaaagcgacacaattcaatgttctccattgaaactgatcggatgcatgccaccccctcccaccggcatcacccccatccatcgcatccgccgcctgttcgcttcagttttcgctaccgtcctgctccaaccccgcctcctcgcggttgcgtttcctcgtcccgcctccctcttcattccccgtagcattttgtttctgctgattcgatggttcagctgagttcacttcgttagtctgctgttggctgagcagtgcgtccaattggggtccgatcacttgtccatcctttttggtgctgtacgaattttgctgcgaattcgcagcagcggctgcagctgaacggagcgagggaaatatgagaaaacaacgaaaagataaacggagacagtcccgggacttattgctagtcttgggtgagagcaccttgggaatggggaatataccacaaaacaaaacctgcagccgctgcagcagctgccgccgcttcaacagaagacccgtcgccattggcgcccatcgcttgcatatgcgccgcgtaataactggtaaaatcggcggaagcagcatcctttgaatggcgtatgtcgggttagtaaatttcaagccaaaaccctcatcaaatggccctaccgcagtcgccttgcgcagttcggcatctccgtgggcccatcggcattggtcgccgttgttgcagaagccgcgctgttgccaaaatgtgcagagcgaagtcttgtaatgacggcccatggattcttcttgcctgaaattggcactaacaaagggcgtgccgattgcacagatcgaaaggaaaagttggcaaattttcgtcagtggtttttgtaagatagtaaagggacaaagggtggtggttcgagtccgttgtgaaacatgaatattttcatttatttttgtccaaaatattaaaaaatcacgatatttgggaattatttttgaaggtttttggcaaccaaattggataatcttggtatctttcgaaagctcttgataatgagaagctttttctaagcaaatgctaagcgatttggtgtatcagagaaaagttatgaggctttaaaattttgtttttcttataacttttgaaatagagcattaacaaaaataaattcagcattaatcgatgcagaatttttttctctaacgatatgcaaaatttcctgtggacctaacatatagaaaagaagctaaacatagcgaagtaaatgttgtttttcctnaataataaaaatattagatagtacgccanaaagga

SEQ ID NO: 14829 - DNA, 882 bp, Heterodera glycines
tttccggggttcccaaaaatccgaaaccatgctttttcgggttcagcctcaaacggtttgctcatctttcccagtatttggctttctcccccaccctccattggctaccttccgttagcatttgccttttcctcagccaaagtgccttcgctcgctgatttctccgatttgtcttcttctttgatttgcccattgctttcgcttcccattttcgctcgcttttgactttgctcaatgtcactccgtccgccctttcctccgttttcgtcggtgtcaatttgtgaccctttcccccaaatttgttcttcttccgtcccactgtcatccttcccatctttggcctcgtcctcttcttccaatgcttttttgatcagcaactgaagaaaagaagagtttggatagaatgcaattccgtaataatccgtcaccgccatcgcttccaattggaagggtttgtgggcgacgcattgggacggcgagtcgggcaaatcggacggactcgcgggcgaaccggcgccgctggaccgttgagagttgaaagaggtcgaacgcaccgagggccattcttcgccattctgctggtgtttataaatgaatgtaatgtccgcggtttctttccttcgacttacgacggcatccatcgaccgcgaactcagcggacttccgtcccgggtgcactgtacgctggtggcaaggtcttgaccggcctcaatcaacggctccgtcacaaatgcgcattcgtccatcgtctcctcttccgttgccgtttccccgacgccgtttttgccgtgcaacttttcgcaattttcctctgttgtgatttgcgcgttttgtgccaatgccatgtcatcgctttgttctgtaaatacccaccaatttaca

SEQ ID NO: 14830 - DNA, 2069 bp, Heterodera glycines
caatgttcccaaaaagttttttggaaaggctgaacctgtgcttatcattttacttttcaaaatttaactagactcataccattatgagcaagtttttaaaaaataagctttactgtcgaaaccaacactgtcgaaaactaacagcaccgatttctaagcctatttaggtcatttttatggcattttgtgcgtatttactctttacgaagaatttttttcaaaaaaataagcatttaaaaaaattttatttacatattttagtacatatttgtggatttttgtacatatttaatgtgttttcccgccggactctactacaaatccataaaacattttttctaaatttgaaacttgttagttttgttctttcttgtcattttcctatgaatctttgtttgtttttttgaccccattcgaatcttcgttgtcgtaaaatgcttagtgtttgatttgtttgattgttaatgcaatccaatttttagcttcacacattgaattatttatttccatataaaaaaggaacaatgactgatggacaggaggaaaaccagcaggtcactattatttatcattttgtcaatttgaagggttaatgggtaaatttgctgactataatagctgttttaatggattttcttggtgtcgtatttttgggcatggtcactgtatagaaaagttgtgtaagacgtggtcattggttcttttttcgaagtttttggtttttcaaaaatccaaatccgcccttcccatttacgatttgcggagatggttctgtcatcacattgccccggcgtttgagtggggtgggaaggttaacgtgggcaaaacagaaacaccgtaaatgctccgtgggaaggcgcgtccctccatttgccgtataaaacaacggcattcacattccctgactcactctaacccaaaccaaagtccatcccatccctgattttgctctaatgacccctaaaccgctccccactgaacttctttttgaaatggtccattttacaaaccctaattatgatttcactaatatttgtacctcctcttgggttgtccgtttttttatgcttccccgcgtcgtcaaatggagaaaatcttattttgtggtaggaaatagagatttagctaattcttttactccttttaagatgttcgatgacctgagccgcaacatcgaagcgtttgaaaagtcaggggtaataaaaatatgttgtagttcgattcgtggctggttaagaatgcatctaattcaaaactcatacaaaaatttcggattttggcactttttgcattttctgcccgacttatgaaataaccaaagggcaacctttaattatatttctttattagcctatggttcaggttgttttgtttgatcagtggcacagcagcagcgaattggccgaacaacaggtcgattctctgagaaatgcggtggctaaactggagacttgtgacgctgatgctgttgcccgattgtctgcctcggtcgcgcgtttcgaaactggaaactttgcaaaattgaaggagtcaggtcagaggatcattcgtccactgagtcttgaacggaagcgaaagattgaagtgaaggtaagcggaaattgatagcgttatgtgaggagtatgtgttttgttgcataaattgacgttcctcagtttagctgcatttaggaaaatcgtaaatctgttttcaacctgggttttccattttagcaaagagcattaagtcttaatttaagactgtatttaaaaaaaagaaatttcaatcatatgaaccgctgtgagtctcaggtggccgcgatcgaacgagagctgggctttaacaaatcctcaattcaacatcactccaaaaactctttgcaaatcattgacaaagaagttcttggggtgagggaatggatcgaagaaagagacaaagatgcagatctcgttggcactttgttgaaacacggtgagaagaagcatattgacgagattgacgcactcatggcgcgttccaaggtcagcggggaagtggacggtcaccgattgatgtcaatgctaataaattcaggaaaagataagaaatt

SEQ ID NO: 14831 - DNA, 1401 bp, Heterodera glycines
cagtgatccgtggcccccttatgattcgtttgatttcgctgtccgagcataagcaaatattcttgggaccattttttccagaattgccgaattgattttgctgtggcccaccaacgagcggctaatttttctgcctgagatggccgataaatttcttccgaaatctcaggttcttcaaaactcaggtttactttaggggataaaaaatcgattggccgtaaagggatgggaccatcaatttcatcagacacaaaggtgataggtctcgaatttagtgaggcttccacttcggtcaggaaggtaacaatttcctcccaattcaaaattctgcgtcccaaaatacgccggaagcaatttttgatcaatgcattgaggcgttcataaacgccccctgaccatgggctaaacgctggaatgagtgtccatttaatgcagaattctgtgcatttgtcaaggacatttttagaaagcacgaattgagacccattatcggataagatacctttaggcagtcctctacgggcaacaaaacgtctaaatgccaataaaaagtggtcggcagatagggaattaaccaattctaaatgtacggctcggcatgccaaacatgtgattaaaagaatccatgctttatttggccccgaattgaccgctttataaagagttgggcctaaaaagtcaatcccaacattttcaaaagcaagagagggatgagtgcgtgattttggaaggggtggcatcggaggaagaccgaattttactgcccgatccttcttacaagtattgcactcagtaataactttacggacagttcgtcttgcttttttgcaccaaaattttcaaaggaaatctgttaaagtagcatctacaccagcatgttttaacataatatgagaatggcggatcaataggctgagtacaggcgaatttgtggggatcacaatcggatgggcaaaatctttgtcgtcaatgttggataatcgagagttcaacctgatcactccatttttgtcaagataagtttgggtcggggggttcattcccctttggattattttaaacagccaatttttgataaatttttggtttacgtactcaaaaattccttctccctctattttggtgaacagttgtctctttttccctaatttggacaggaattttacaacaaaagaggccgttctaataagcttctcccatgagccgaagcgatcaaattcaaaaacaatagggggtggaatgacggcagcacacacaattggttcgggtgcgacactttctgcaggaggtaaaatgaccgtctgttcgtcgggccaattttcaggtatttgggatagccaattcggtccctcccaccacaattttcgcattcttaattcctctggtggaattggccgggtt

SEQ ID NO: 14832 - DNA, 740 bp, Heterodera glycines
gagagagagacaaaaatattctggactatttttgttttataaaatttgaaaaattacaaaaatttaatagcatttaaatttggcattaaaaatttgtcacatacgtttgctgcggtggagtatgcacaggaaggcgatgaaaataaagatgaaaatgttcattttagtaatgaattataattattttttcgttttcattttctgtttttatacggaaattttcacatgagaacaatggaaatagcgtttacagaaatgagaatggaaaagaaaaaatacaatataaaatagacagttggccaaatgaagagtatgacagagaaaacgggcgaaatataacctgtggcataggtcatacaattgttggcatatgcagcataaaagaagatacacgtattacttttgagaataagacgaatgaagagttatgggggggggggggagaaatatgaccttttagaattgaaaatatggatatatgagagcatatactttgttggcatatgcagcatcacttctatttataatcaatgaaatagtgtttatgcaaaagagaggtggaaaagaaaaaaagacaataaaaattatagagtatagaaaagaagaaatttgtattagtgggaaagaaaaatgcaaaaattaaactttgccaattgcttaatttatgagaaaatgtggctaagggtggcatggataaagaatgcgtatgagaaatttatatttttacatttacattaatg

SEQ ID NO: 14833 - DNA, 2956 bp, Heterodera glycines
  misc_feature (34)..(34): n is a, c, g, or t
  misc_feature (54)..(54): n is a, c, g, or t
  misc_feature (59)..(59): n is a, c, g, or t
  misc_feature (66)..(66): n is a, c, g, or t
  misc_feature (73)..(73): n is a, c, g, or t
  misc_feature (1466)..(1466): n is a, c, g, or t
  misc_feature (1520)..(1520): n is a, c, g, or t
  misc_feature (2936)..(2936): n is a, c, g, or t
gatgatgatgctttgaagagtgccagtttaaatntcgtttggatcggttaaatntagtntaatttntaaattntcggttcattatagaaaaaggtatatgttgcgcaccaatagaaggctcattgccagtttcagtcggatgagtaatgtctataaattaaataaaaaataattttatttgaataaaaaataaataattattttccatcttattacgagcagcagtttgttgttcaattggtgctggaattgatggaatttgtatctcaacattttcaattgtaattgctgcttgaacatttgctatacaaaataattaaattaaattattgttttaattttaaaaactttatttataaaattatttatttttctttaacaattatttaccgtcagctgaaagtagtggaacatttaattcagaagataccaccgattcagcatcataaggagccggtagagcgaggcctaaaatttacaaaaattctgatttttatttttgaattttacctgagctaaaaaacgctgcagttaaaaaggcgacaaatataaagttgctcattttgtacaaaaaaacttatattaggaaatgaataaattctatggttgaatgaatttttgatgatgagttttatgaaaatttttgccgtttttatatgcaacttttccattaaatatttttgccggaaatacgtggaaattttaaattttgtaaacaggaagtccggtgaaggaaaaaaaaggtatttttcacatgaaaaaatcaagtatgacaaactgcgcaataaaaatgaaaacaagtaaaccaattaataaatttaaaaaataaataaataattttcccttttctgaattgtttttctaatcaacagatagattcaattaaaaatccatacttattaccagggattcttttttatgtaaatacttgtttttttcctgtccatagcctaattagtaggaaaaacactttcttttttgtgtttgcgaacaaaagttggacttttatttacatatttttacatatttcgggatttttctacatattacatataatgtacatatttttatacatattttggactttttcgcattttttcgaacatattttgaaatttttgaggattttttaaggaaattttcattaaatgtccccaaaaaaaaccccaaaatttcacaattttttgtacatatttttaggatttttgagaagtgatagaaatttcatatgaaaaatttaaaattttttttgaaaatatacccctaaaaatcgtttttttcaaaaaagagatagtaaaaagggtgcttttaagcctatttaggtcatttttaaacttgaaggtttttcgtcttgtctatattcaaaaaaataaataattaagaaaaaagtaaattaatgaaatctattggtgtcaattttccgtggccatctttcaattgttcttttactcatccaaatatttgtntaattttttctttcttcatttattttgacaattaggtatgccttagtcatttcnctgggctgtgcgtgcaaatccgagttcaatttttgtatgcgcttcttgaacggctaatgcactcggacttgaccgataaaaaataattgaaatatttctgtttataaattaacataacattaacaaatttttggcgtgagcccagaagtagcaatagaatcaattctaccaagcgtacctttatcctccaccacggacataacgtcgacgatgacttaaagcagtaccagcagagccaattcgacaattgacggcgctctcctccactagtaccacgggcacagagccaacgacgagttcaagcaataacagcagcagctgaagatagagtgcaatgggaagaaaattacatttcccttcttcgctgttgtgtttggtcatagacggagaattatcattatatttctagtgactataagaagagatcaagcaataccgcaataccagcaacagctgaagaagcaccacgtctatgaccatgagttcaagaagtaccaaaacaaaagaacaacgaagacaagacaacaaaaacgcactcaaaaggaaaacaaatgcaacgagattgtacccatcaagtccatgaggcagtcgcagtgtggatggtcgtaaaatagataattcttagaccaatagggtttacgatagatgagcagtagaattttaatatttcaaccatattttataccacaattattgtgtttaataaatgattgacatttgattttgtgcgttattttaaacttaaatatttatgcttcattctttttcgcccttggttaagaaagaaaattggtagcacgcatatttgcataaagctatcatcgcatatctcaatcatgggtcattcgttttttcaattgtctgaatatggcgcttatgtgcctttttgcgctcaaatattcaactgtcaaccaaaaatctatatgtgataagaccatgcaccccgaagggacgaaggcaagagcttaaaaaattgcttggacgaaaactacaattcacctaccacgaccttaatgggctgaacaagacttttttcattgatgaaatttctgatgaatgtgtagcaactagagcccggcgggatcgggactcccgcgggattttacgggagtcccgctccgactcccgcttttttcggtgaacgggatttttaacgggagcgggatttttgcgggattcccgttcgggactcccgtcccggaaaattttgaactcccgatcccgctcccggaaatttttacccaaaaacgggagtaaaaatgcactggtaagaattgattttttttggtaaaaataatgatttttcattgaaaatctgttaaatatatagccaaaatttcaaaaaaatttcccggcggcgcctatcggcaccgccgggcctttaaaatccttaaaatgataaaaaactttgctcanaaaaattgcaaaaattggtc

SEQ ID NO: 14834 - DNA, 1787 bp, Heterodera glycines
gataatttatagaattacttatgtcgctctttgcaattcctgtagggcgaaaaagataaagagtgagatttttgaggatttttgtgcataagcaatgcgcattttatggaatcaaataaatgcacctttcaggcaattaaatcacaattgtaaaacacgaataaataacaaattaattttctggtatcaaattacaaaatggcattttctgggatcaaaaaataattgtaaatgctcaacgcctattatattcttagtatcaaacgaaagctttaaagaataggggaatataaatacaagaaacaatttttgcacagaaaagaaaaaatcgtttttaaattgcttgcttcgaaagatatctaaaaaagggattttaattttggttttttggaattaggatataaaattgaggggtccactgcgtttgggcgctcacgtttgggcgcgctcgtttgggcgccagcatgttttccattatagctttctataacttttttcaatatcatccaaatcgaaaatttttgatatcattcgaaaacttaacatgtttgaaagctttttctaagctattgcttcgcgattagacaattaccaaaaaagttatacacttaaaattgcaaaaagtcgaaatttttgaagatttttcttaataaaattttttcaggcttgaaaatcctttttcttttggtaaagctaatagagcatgttaagagctttcgaatgataccaagattgttggatttggatgccaaagaaaaaagctatcgtggaaaaacgagctggcgcccaaacgggtggatcccaaaattgagtgccattttcagttcaaaaataagataaatagaaaactgcttggtataaaccccatctttattcatatattttgttgaatttttaaattttgaggtgcaggaacaaaagaaattttggctaattttttaggtaccgtattatctctaattatccccccggggggattatttttcaacctcctcataaaggggggggggatacaaaaataaagaaaactcggaagaattttatttttatctctttttgaagagttaaaaataaaactcattttgggattcgggaccattgacaaaaatgtcaaataaaaaaatattaattcttatataaattttttcatgctaggaatattcaactgacaaatgagtttactgtttcaatttatttagtatttggtttgcaattgttaagatagaaaatttggcattttttaagttaaatacattaagtggtagtttttagtgtatttttaagtcggttaaagcaaatattgaataaatatacattttttggaatttttgaggatttaatacttatattttgggagtttttagtccatattttgagctttttgagggggaagagatttctaaaaatgcaaaacatacattctcaaagaatgtataggtatgttgtttatttacttatacaattttgtttttttttgggagatcatttccaaacttcaaagaacggacaaatgtgagcaattaatttggggaagtgaaatgtgattttatgttaagagaggcgtaaatataaatatatttcttctgatacctttttggtgctgacattttatatttttttaattaagaaaaaacaacaaattaggcgaatttcttttacttttgtctctcctgtaaagtgtgagaaaatcagccgaattcttttcgcaaattttctttacgccgcccgccaaatttggccttggaaaagcctaccgatgtattcattcgtgtgactttttttcggct

SEQ ID NO: 14835 - DNA, 878 bp, Heterodera glycines
cccccccagctcagttcccccccccgcatcgtttcccacccgagaaatttttaaaaatttttttgctaacttagaaatttttcaagaaaaaattcttagaaagttttttagtaagaaaattctaagaaaaaaaaatttttatgctgaattactaagaattttcaaaaaattctccaaaaaatcggtgaaaattttcgaaaaaaattttttcttagaattttcttactaaaaaactttctaagaattttttatggaaaatttctaggtttgaaaattaaaaaaaaatttttttgcggcgacgtttcggccggcaacgttttggggtgtacccaatttttttatgggcgctgatttgtcggcaccgccggaccatttgttttgttttttttctttgttcatcatttaacgcacttcgaacagcagacagcagttgggcccggcgtcaaaagtgtacgcgagtcgcgtgccgtagcgcgtgttgaagtcgtgcacaaattcgatgagtgcatgcgaagtgacgttcagatactgcacgggaaggggcagggggatggggctgattattgttaatattagttttatgcaaaagggtcggagcggggccggatagagctaagaaatgccaaaaaattgcaccaaaatgtttaaaattttcctggcgtggcgcgcctatcggcgaccggcacattaaactatcgctttttgtttcaaaatttgacaacattgtcataagttggccggataaaactagtatataattcaatattttaacaaataaagcaacaaaattgattgtttgttttttgaagctcacaatcagcagtgccggcaattataaaatcgttttcaagaattttccaaaaaaaaaaaaaaattaa

SEQ ID NO: 14836 - DNA, 3210 bp, Heterodera glycines
ctcctccaacattttcaacatttttgtctcatgtcatgttgatcatcgctcaatgcgatcaccaaaatcatgcattttagctgctcctttgtcaatgacatattagcattctcgcatgatgcattgatatgagcaattagcgtcgacacgtcttgatttggctgctgacgaatccggaaacattcataccggcggacaaataatgaccgggtttcggaaaacaaacccttcaatttgtcaatggactctttccaattgactgtgtccggttgcgttgggctaatgctgtccctgtacttgttgtactcttcgtcagagagttttccaagcaaaagcctaactttcgctagctccggcaaatcctttccgtcctcttctatcagaattccaaaccttttgaaccattgctcgaaggtatttcccgactcagagtcgtaatgaaattttgaaattcgtccatcgattgagctcgccaaatttgcatggcttaggctctcagaaggtccaacattttgctgcgcattcatcatttgttgaatccgcttttcggattttgccaaaactgcatcgagaatttgcttcagttggtccgcgtccattgccaaattgttgaaatccaaataaccacacctggtggctccctacacttgctgagtgttaaggatttttgaagatttgaagataaaaccgcgtattgcggaacctcaccacaattgtgtcttttggtttttagttgaattgaactgctatattagcagacctcacaccacctgggtgctattggttttcgatgaattgcagtgtcttcagtagagaagatggctgctgactgcgccaatttgttgtgttcctccaattgaacacacaaagaataaaaatatttattgatcggtcggtggacaaatgcaaataataataaaaacgaatgaatgagggaagagtccaaaaaggaggggaatggtctccttataaacacaatgagaaggggggaaagggcgtggagaacaaagtacaaatatgaaaataattaaaaaggtcaaaacgccaatttaacatttccaacaggcacaaatgtcggggctccgggtaaatttagggaaattttgaggaggcgcggaattgccaaagacacatcgtaaaaatgacgcgattggtcagcagattttccctaattgttgcaaattaatgcacaaccgagccatttggcacttctaaaaatactgtttttatgaaagttttccaattttcaatgaattttcctgattttctcgtattccccccccctttttaagatgggtggacaccgccttttggcatttgttcttctgctccattctcattgtcattatgtttctgtggcgcccttctcaaaacaaccaacgctacgccttcacgcctttgttggacaattcggaagacgaaaatgaagacgaagttgaagaggacgaactgttcacgaaaagcggaggacaaaggccggcgatattcgacgcagtgcaaaaaaggggggcgggggaagcgaaaaatgaaggcgaaaaagcgacggcggaaggagcgaacggagccgtgggggacgacagattggcagtgagaaggggggggggacacatccgggggtactaattttaagttaaccgccgcgtcgtttcccgccttcccaaattgaaattttttttttttttaggaaaaagttaaaaaaaatctttggagaaaatttctctcaagaaatcttgaaaaaacctctgagaaggttagaaacccaaaaaaatttcggagtgcggcgaaattaaattacggcctgaaaatccgagggggttggggattcgcgaaggcatctcaaatccattcttctcgtcaggaggatctgaaatggatcgaaacgaatattcccacgtctttggctgaggcattgattgacgacgaagaggaaaaggaacagagggaattggaaatgtccaaaatgttgtgaagtgatcggagcggagagagttaatcaaaattctatttatttttttattattttttgtcacggatcgttcgcatctcaatttttaagagttgcttttgtcattgtttccctttttctctgtttgaccggatttatgtgagacaattttaaaaggtgtacggacatttcgcctactcgacatctcgcctaccgacatcttgcctactgacatttcgcctactaacccaaaaacattcatttcgcctactaattagtaggcaaaatgaatgtttttggcttagtaggcgaaatgaatgtttttgggttagtaggcgaaatgaatgtttttggcttagtaggcgaaatgtcatgtagccttttaaaattcttcatcaaattattgcattgttattgagtttttggataggataaaaattattccaagttctttattgtgatctcagacttgttttttatatatattagagtagagcgggaccgggaattttgggcttaaccgggaccgggaccttttcgggttgaaaaaccgagaatttttggctgggaaaaccgggaaaaaacccgggactggtcccggtcccggtcaaaaccgggacctcggtactcagttgtccgtgttttggtcccggtcccgctctactctagtttgaacttccgccactgcaaaaagggctgatgtgcaaaaagggggagttggacatggaaggatatggcgaaacgaagaaaggaatgtgcctggatgaagaccaacactgcttcatggccatttgttcaaaaggcagggatatgattttatactgggagaaattaccaaattcaaaagttttaactttgcattacggcactaactagaaatcaacgcgggactcccgcgccagattttgctgggtacaatcagcaacatcattttttgtcaaattatgaaacggataataaaatcaatccggcaaaaattttgaatcccaatctcgcaactgatccgcaattttgaattttataagatctggttaggaccctcgagttaacaacccaatcccaaatgttcaatttcaaataaaaaaaacattgatttttaggcaatgaacactacaaaactgtgtggggatgcactcctgtggccagcaaagcttttattagcgccaaaattggcgaaatggacaatgccaaggtcaactgtttgcctctttttggcagaaagggcctcgatttttcgaacgaaaattttacggaacaaatgatga

SEQ ID NO: 14837 - DNA, 3657 bp, Heterodera glycines
  misc_feature (70)..(70): n is a, c, g, or t
  misc_feature (211)..(211): n is a, c, g, or t
aaaattttttgaaatttgataaaatttgttgacagattttcactaaaaaatgatcaaattttgtgatttntatcatttttctaatgagaaataagagttttggcgcgccgctgagaacagtttttcatcaaattaccaaattttgcgattttgggccatttctaaagaaaaaataggagttttgggggcgcgggcggtgcccgataggcgnccggcgggggggaaaaattggaaattttgatcatttataaacagtttttcactgaaaattagccaatttataggtaaaattttgaaaaattttatgggaatttaatccaattcttaggggtgtaaaagtcgcttttcgcgccaaaaagcgaaatgcgaaaagcgaaacctcggcccatccctggccgacaggcagtcatcgcagtaaaatattttgaaaatttttcattatatttttattttggctgaaaacaaggtttttggtgtattttctggaaatttgaaagttttaaaggaaatgataattaaaatcggagaagttgatttactatacagattttgcacaaaattgattaaatattcaaaatcggaaaaattatttttatgtcaaaaattctgttttcggtatggaaatgtcagggatcagggtctggagtcataccaaatagcagggagttcggggtgataatgacgagaatcgggttccgggatgaggccgaaagtgccaagaaatttgccatagaggacttcggggatggccctagttgatattcatttttttatcggagattctctaaccccaacaattggtccctcagcttcactccatccgaacaaaatacgataagctgctttgaccagttccattgctgaactcagctgcagctcgcccagctgcacttggaagcgtggctttacacacaaacagtcaaagcgaaagaattcgacatctttaaaaggttgatgttaaaattttcagcagaaatattaaaaacaaaggactcagaatttacgcactagttgaaatttttcatttaaatgtctttttgtctgccgaatagattttttctgtaatcaaaataatgaatatattacaaaattttttaaatattgccttttgtgaaattttgcactatttttgaactagcgcgccggattttaattttggcgaccgaaacgtgagcccagaaaaatattgaagccatctcaagcctctaatcattgaaaatcgaaaacttctacacccaaaaatccctagaaatcgagaactggatgtcgataaacggagcactgttttctgtatttatttctctcagtgatcaaacagatttgaacaattggatctatgttatgtattctaataatttaatatcttaaccattttaaatccaattaaccaaccctcctctctcatttggtcatgaatgattgctgtagaaattgttgctggtgctgaactcgttgaacttgatgctcctccattcctgacatgttgctgttgttgctttttcaccatacattcccaacttttgacatatgcgtcggctgccaacgctttgattttccaactttcacaaatccgtttcaattcgtcaacggattttgctcggatttggtttggttggattttgatgccgtattggcagccccactttgccatcatattacgccaaaagaagcggttgcttaatgccaatgcctttgccatatcgtcctgctctgagctgtcatctgtagacacaacgaaaaatggatcggcaccaacaacaacaaaaatgaccaactgttgaaatataaatgccgaaacgaatgatgcgcggccgtttaacattaacatcgtcgaattttatcagtcaaattaaagcaaaaaaaaaagttttaaataaatatttttaatatgcaatatagaatattaagatataggattattctatgtctttcggatgagaaataaaaatttttattacacatattatatttaatttttatataaaatcgatgttcaattttatatttcctgtcgtagcaattataaaatgtcgctcttattattatgaaacaaattacgtggatattcaaagctctggaggaaccaagaattataaactcaaaatacactcctaagaatcgacctaaaaattttttcaaaaatacaccccttaagcaccgaaaaattttctaaagcacccctaacacatgaaaaatttctcaaaaattcatctccacaatttttttattttcttgacatgggttttggttttaaaaattatttatctcaatactgattttggtagaatttttttacttttttgaataaattttatcattttacacccccaaatttgaggctgcttttagagcctaaagcctacctattttggtgggtttagagcctaaaaattggatccctattcatcaaactgtagaccagcagggaatagacggaatgttgatttggattgcctattttggaaagccggtttctgtcatttctgggctcgtgattccgattttcgattgtcgacatttttaggctcgtcagaattccgattactgaaattcgatgaagatacgtaatttttggcaattttgaaaatacttttcagctttctaatttgagcgacagtgcgcaaatccattctacaaattatttaaatttgaatattaaattttggattttcttgactatttattaatagggcttcgatttttaggtaaatacctaaaatttttgcgcacttgtaacgttgagataagcataaaaaacgagtttttagcttggtttggagcttctacacccacttttataatacctatttttacctatttcgggatttttctacctattaggtacctatttttatacctatttcggcattttggttacctattttaaggattttcaaaaaattcttaacaaaaatgcaataaaatcaaaaaatatacccataagaatcgaccaaaaaaattttcaaaaatgcaccctaagaattggaaaaatttctcaaaaatttatcccaaaatttatttattttttctattgacaaaatttttaatttaaaatgtcaatattatctaagaaaatattaatatatttaaattttcgtttacaaagagatatgtagaaccaaaattttccctctttgtttgcttttttccactaaaaaatcgttaataaaaatttttatttacctattttggtacctattttggaatttttgtacctatttaatacctattttgagatttttttttacctatttaagtacctattctgggatttttcttacctaaaaatcgcatccctattcatcaaacatcattaaacaatatataaatttatcgaaattccaaaatgtaaagttggcatttttatccgcacgccttttcaggcacattgtgattggttggaacacccctttcgagacgaagtgatctgggacattgaacgcatttatttcgtgcattcgcaacacgaattggacctgaacgatttcaaccatttgccagcaaagtaaaacgaaaaaataaaagaaaaagtgttggaattttcctagcaattgctgatcaattatttagcaggaaatgtggatcaaaatattattaattatccctactaaggctaatcgtcgacctttgtggcaaaaaaaaaatcgaggacaaaaa

SEQ ID NO: 14838 - DNA, 4576 bp, Heterodera glycines
tcagtcaaaaagggaggaatgtttgaggaaaatacgacattttggttctttgccgacggacacagcgatgggcaaatacgacacgatgggactgaaacagctggacaagaagctgacggaatgcatgaacgagttgaagaagtacgaaaacgtcaacaaaaaggcgctggaccaattcatgtgggttttgttttttatattttctttgcgagttaattcgcaaaatgtccaatttaggcgtgcttccactcaaaaagaggagctcaccaaacgagtggaggagctgcaaaacaatgaaaaggtgtgaaggcattcgtttaaggggggcgggactcattttgtatgaagcactgaaattctactaccattttttgaaacattattaatcaaatttttcggttgttcaccgtttccttcccgttagtcccccacccggaatttttttttattaaaaatctaaaataaatattttttaaactaggatttataaacttttgcaagtaaattattaagtatttagaaaactaaaaaaacatttttgatataggacttattttgatgtgagcattatttgaacatgacttttagacgatccaagacttactttccgtactggaaaaccgacgttttgaaacccttcaattgacttttaaacaagtggcaaagaatttcgaggacgtcttcaaaaaattgattccgcaagggacggccaatttggtgatgcaaaaggtggacccgtccatggtttgtcgagcaactctttcattccctctgattttgattgagttcaggacacttcttcccaatccgacgcttcgagtcaaccaagaaaatcacagcccaaacacgtattggagacatttgtcgggactagcattaaggttaataggaaaaattattgaatttgaatctatcgttactatttttattgtctgtccgtaggtttctttcacgggaacgcaagaagtgcgtgagatttccgcgttgtcgggtggtcagaagacactcgttgccttggcgcttattttcgccattcaaaaatgtgacccggcccctttctatttgttcgatgagatcgatgcggcattagaccaagagcaccgacgtgccgtcgccggtaaatttatgggataaaattcaattgttcttcattttaaaagtagttcaattgaatttttgactgattgtgagataaatattgtgtatccaattagtcaacaataccagtttgttttggctataatcttttaatgggtctagtagtaagtcgcactgtttcaatgtaaatttattagtcgaaaggactcatgaaatgaaatctgctaaaataatgttttagaaatgatccacgaactgtccgaaattgctcaattcatcacaactaccttccgtgccgaactgttggaacatgccgagaaattttacggtgtccgttttagggacaaaatgtcgtacattgatgacataagtcaacaacaagcgcaagactttgtgcaggatgatcagacacactcctgagaattatgacaccttttacattatgtcttaacaagttgatcgatctcactttttacattttatctcgcgcatataaaataataaaaagggctttggatttaaaactgctgattatgttttcatgctttgtttgagcagaggttttaattagagtgcagcgggaccgggacctgaacacggacaattgggtacaactgagtaccaaggtcccggttttgaccgggacttggaaatttcaggttttcccagccaaaaagtcccgggttttcaacccaaaaagtcccggtcttgcccaaatttctcggtcccgctgcactctacttttaatccataaaattttttaaaatagtggcgacgtgttttacggaaaatgaattgacgttttgttttttcttgtccttgctgatttggctgtttgctttttcttttgaattgcttcagcaattactcaattcatatttccaatttattaattcttcccttgagaaactatgaaatataaaaattctaaaaatataaaaaagtgcatatttttattatgtaggtatggattagctttctttgttttaagtaactttgttgctttcttttgtccttttcctttttggtcctttggtttttcttttgttgtattttttccttttatttacataatttccattccttcaattactttctttggtcagtcttcattaaccagttaattcctcctcaacttgcatatttcttcgtccaattacacttgcattttctacaaagtttctgaagatgaaccaattccgtgtgggtggtcagcgtgaattgttgggcgttgctgaggattatgcggacgatgtgagtgggggaggggacaatcgctgacaagggctggtggaatatgaattgttttttatttttgtgctacaattttgctgctgttttttgtcgaaccattaattctcctgtttttcagattttgcgtcatacaaaaaagattctgccgcatttggcccgacttttcctcgtttccacattcattgaggatggttgtcgcatgtgggtgcagtgggacgaccaacgcgagttcatgcaggtgacagaaaatagatgggacggatgggcgaacctttcagcgtccatttttgacttttaccacatttaaaatgttataaaacctttacaattttaggagtcttggtcatgcggttggtttcttgccatgctttttgtggttttcaatttcttcggccaaatccttcccgttgtgatggtgatgatccgaaaatatattgggattgcttgtgccattcttgcgggaggtttgtttggctttttgttactttattttattggacttttcagttgttgtgcttcaaacgtttgcttatcatattatttgggacctcaagtttcttgccaggtttggcaatatgctcgaattctttctttattattattttcctagaaatgtggccattttcggtgctctcgtcctcctctatgctgaaactgtagaggaacgaaagtcactcttcgctggtgtgcctcaaatggacgaccaaaacaaacccaaatcgtacatgattcttctcgggcgtattctcctcgtctttatgtttttgttggttttttgttttttatattcaaaaactgatacgcttaattgtaggtctctcattcattttgatcatttgtccttcttcaaagtggtaattaatgacataatgctgaataccttttcttaatttttataacccaacaattttaccataagtgatttggcttctgttttagcttgaactctcagttggcattgtgctaatgattcttgtaacaattggtttcaaaacaaaggtaaggctgaactaaactgttcatattttgtttaattttagtgttaatttggcttttttattgatgcctgacattttaattgtgctttagaaaatgaaattttattcatttttcttcagttgtccgccatgtttctctctttttggctgttcgctttaaatctgtggctgaattgctggtggaccatcccatccgaccgtttttaccgcgacttcatgaaatacgatttcttccaaacgatgtctgtcattggtggtctcttactggtcatttcttatggtcctggtggagcgtctttggacgcatggaaaaagcgcgactaacacaggattaggtacaaatgaaatgaaagggaagaggatgaagaaacgaggagagatgtagggggggggggaagaggagggaagagaaagggagttggacgttgaacagaaagggacaagcagatgaagaggcagagagacaaaccaagagaaggggggggggaagaacgaatggaaagggaaggaagaaaaagagaaagaagggaatgggtgggtgagcgagaaaaatttgaaaatgattatagttacctaattggcatttaattttgaattcatcatccttttccatgaccgtctaccgaaaatcccgtctaaaaattgttttcctattctttgatattcgagaccctttcacatttttttcttattttcgtttttgtcctttaccatattggaacataaacacgtatttattctctccatctttcgcagattcctttattattttatgtaaatctctcctctttcacgcgtttattcttttgctgtttttcaaaagcattcttttaattgtggatttttctatttctgcagcatttcttgctgatttctctaattgtttccattaacaaatggcaaaagtacatggaatttttttttgtttacccccccccccccccctaattgttgtgattaattcttcctgtttaattttgccagggatgtcatgtccacacattttatccgatcgttttgtttattcgcaaacaattgggtataccgttattttgatagtaaaacagtaatgaaaagtgataaccaattgttttagcatgaatggattgtcaatgtgttttattatgacaaaaaaagattgttggcttttaaatcttctttggctgaatttaaattttctcaaacaaagacttatgagagctaattacagattagtgaaattataa

SEQ ID NO: 14839 - DNA, 839 bp, Heterodera glycines
tctttttttattataccctttcttattattattgttcatcacattttaattcatgctttaagtacaattccattagtgagttacttcattatggaaattaattttataattcattttaattaattagattaaggacaataggctaattgcaattatgaaaggacataaagaaacactgattagtgaatattcaaaccaaaaatacgaagcacatcttggcattatgcattatatgagaaagaattggcaatgcgacaaaatagcagatgaatttgaagaatatgaacggacagaatgccaaaacttccgaaattattgggacattttatatgaatatttgagcagagaatacgtcggaattccaacaatgatgccaaaatttgtatttaaaatgcaaattgaaattgaaggaccaataacttatgcgctgaattgtttggccagaatttggcatttttattttacattatggagtaaaatttatgaatataaatttaacaaacttttcaatcattggtttgaaccaaaatgattgaatgagaagcgattgaattatggaagaataaaattggaacatgaaataaaattaccaattagcgaaatgattttgcaattggcaattgaaacagcgactgaatgggggccaacaaatgaaagtttagacgcaataattagacaaaaatttgacgaaaatttagtgaacattttcaaaaaagcggaagagatggcaaaaacagacaatgaaataaatgaagacaaatatataataattagaaaattcgacgatcaatgtacatgggtgagattttttaaattcaatgaaatttcaaaaaaaaaat

SEQ ID NO: 14840 - DNA, 639 bp, Heterodera glycines
taaataaagcatataaatccatttttagtgaaatggccccacccccggtgtttttaaattttcaataaaatatgttgtttggcttaatggaaaatgctcattaatttatttttactttttaaaaagccatccaaatctttcaaagtcgtttccggccactgaaaaacaatcgaaacaatttgaacagctttgttcaacaaatcgtccatctaaaagacaactaaatttacaaaaataaatatttgaataatttgggataaaattatccagatttacaaaaataaataatgaaattgagtcataaataatttattccaataattttggattgaaaattgcgcgaaaataaatgcaaccaaattcccaaaataaaataaaaattgactcataaataatttattccaataatttgggatagaaaattgcgtgaatgtgatattattgaggaatttaaattattttggcgttttgttcattaattttgtgtcatttttgtttgtgattttgagtgatagttagttgttagtagagaccggaaatttcaaatttgcggatcccgctgcgggactggactcaaaattttttgcgggacgggatcccgcaggattaatcccgctaatcccgcattttccaaaaatg

SEQ ID NO: 14841 - DNA, 1943 bp, Heterodera glycines
gtcttcggcattgggctgtgtttgcattgtgtttgctttgggctgttgtctgtattgctgtgtgctgtgcaacaacaacattcttaaagcccccaacaacaacaaccccctcttttttacgacttgaaaaatgacgcgcacttcggatttaatccaccttaatttgcattttggatattcttaatgtttcgaaccaatttttagtcaaaaagtttacggggaataataatttgaatatgtgtccacagtttttaattcttactcaccgtaaaaccgtcgaataatggcacattgccaacattcgaaggtggcgcaagaccaacaatcgctcgaatatttggcggagatttgagacgatcaacggcacaaagtaatcctaaaatattttaatattccattgaaaaagcattttattttacattaattttcaattataataatagttaattgttttttcttcaccaaaaatttctcttctggtttctagaaattttataggagtttttgtgtcaatgcttttcgggtggcggatgaagaaagtgccgtccaactgcattagcaatttacatatcaccagtatttcatccagacaattcaaagccttaaaaaagcaataaaaattatagggttaagcctataagcttggggataaagatatgggcgaatatttagattagttttcccgtgtctcagtcagttcgagtatatccacggttttgaaggcccgtgtgttcgagtcccagcgggcgactttccatttttcgtattactatagtcaaagaaaattttttaaagtattttattttgatacattttgatttgttttttttcatgtttttatgggaatgccgcgctaattgaccacataacattggcactataaatttatttcgatcaatccttaccgtgtttttgtaactgatcaggaactgtgccattcgcttaagcagaaagtgatcaaatacaacacacacacgaatggtggaccattttttgtggaatgggacgaagcaaattgcctcaaaaagcaattcatttgggagcacaatttttggcttcatttttaatgggaaaatgcaaaattattattatttggtcagcatttttagtaattaggaaaagatgattccttatgctgataagataattaggctgggaaattttaattgaggttttgcgcggtgggcgtgccatccttatctatacgtatgccatctctccagcctctcttcctagccctcttctcaaatgggacaaaattccccaggaaaatgataatcatatttttttggcaaacaaaatttattaaaatatttaaatgaaattttttagaaaataatatttatttattaatgggccattagttgagaatttatttagcaaagggagagaaatgaatgtgtggcaacgagttgtttaaagcgtataacgaagaaaaaaatcgcatagataaaaggacattgattaagaatattatggaagaaatatttcggagaaatataataaaagaattactataaatgtgtaaatccgcacaattgtatgcaactgtatgcttttatgcgatttatttctaaaccatttttttaaattaattaaactggtatgaaaatttattttttttgaatttattattttaaattttgttttaattgggtaatagtggataaacttgtttctgttttgcgctaaaaaagacacatttttgccctttttgggtcaatttttcaaaaaatttcggctcaatggggtccatgcggtgctgataggcgcctccggcgggaaagatttttgaaacttttaatggaaatatggcacataaaatgttttaaattttcaagattttgcccattttttcctgaaaatttttcaaatttcattgggcatgtgccccccccccccccacccctctggatacggcctggcgaaaggcctgttaaaaa

SEQ ID NO: 14842 - DNA, 1771 bp, Heterodera glycines
ccctatgtgtcctctattagcctgcaaaatttcaaaaaattcaaaaaagtttatggccaaaaatattcgtaaatctggcctcttgtggccataattttgctcaaacttgaccaaaatttttgaaatttaggtgagataatagagaactcttagggttatcaaataataccaagaattaaaaatttgagttgtctttgacaaaagttataggcatttttttttgtttaaaagtttttgcgaaatcagttttataaatttttcaaaaaaataacataaatagttttactgaaatctattaataaaattcatgaaatcggtaaaaatcgcggtccttttccgttttgtgacccccttgaaattttcaaataaaaagtcatttctagggtaatttgtggtgcagatcacggatatgactagggatgctaattttatgtaacaaaatttgctaaatatgtaaataaaatatgtataaaaaatgctaaaatatatatgaaatatgtacaaaaacctccaaatatgtactaaaatatgtaaataaaatttttttaatgattattttttggaaaaaaattcttcgtaaaaagtgaaataggcacaaaatgccataaaaatgaccaaaataggcttagaatcacatttgaatattttacaaattaatttttgatatatatgtagaaaaatccgaaaatatgtaaaaatatgtaaataaaagtcccaacttttgttcgcaaacacaaaaaagaaagtgtttttcctactaattaggctatggagaatctaggaaaaaatatgtatttacataaaattagcatccctattaatcacttattttttgtgaaaaattttcaatttttttcggccatttcttaggggtgtatttttcgtttttattttttgttaaggattttttaaaaaccgaaaaaggcacgaacaagaaaataaatattcagaacattctgacaaatcagaacatttttggtaatcgttacgatgattgcccccctatcatttaactatttttggactaaaaatgggaatttaaaattttgaattttcgactttttgttattactcctctctaaatggaaaactctcgcaactgcacaaatttattgagatttacaaaatgttatgtgattttgacatttaattaagtttttcgctaaattcaaaggaaaaatcacatatcatacataacaaaacccggaaaaggggaaaatgagaaaacgaaatgtaataacaaaggtgagaaaatgaaaagtaacatcagtgggagtaaaatgcttgcgatccatgtgaatgaaaacaatttggagacaacgatttttgggcaaataaaaacgcaagattagctgaaaagataggccgagactacacacaaattgggggggggggggaaggacgctttttaagcgaaacattgtgagaggatgaagggagtagtgataataatatcagtggccaactcgtttagtcagcttcattcattcaaaactgtcccacaacgaggagacggacgagtccatccgcagcaccaccaccaaaaccattcatcacatgtgcacagatgccgagtatctgaacacggaaaaagaatgaatctcgaaatctcgccgcccgaaatttaaaaaaattttcgaagatagataaatgtctaatgttttaatgagaaaatttcaagaaaaaaaaattcttccagcgttttttcgattccaaacgtggtaagacacttgcggcccggacatttgcggcctgctgaaaatcatacatt

SEQ ID NO: 14843 - DNA, 1347 bp, Heterodera glycines
  misc_feature (27)..(27): n is a, c, g, or t
aattgtcaattggtttgtcggtgattnttcttgggatcgctgtttggttcagcaccagcaaatttttgccaaaggaatatcagttagtaaataaattaattattttacaatttttttataatatatattttttcatttagcttcctcaccccattttagagggggcggggatccttatttgctaactatttaaaatttaaaaaaacgagatttttttagcctaccaccacctccggcattgactggcctcctaacggtgaacaaaccgaaggtgttagaaaaattgttggagggacaagttcttgggcctgaatcggctgtcatcgaaaatggtaaaattaggagaaaataaaatgtgtcagggtcgtatgagtcccaaaacatagttagtcccaaaacatagtctcagccgtgtcatttgggaaaaagtcaattaacttttttttttaaacatgagtctttaaggaaaatgaaaactgtcaaattaaaaaaaaaagaattcaattaattaatatttattctatttttctaaaattagggaaaaactgaaaaatgttggttttttacagaaaaaaaataaatttctcaaaatattttgtttttttaaattattggcacttttccaaatggtgccccccccccccaaaaaaaagaagcaaaggaaggctttttttgcaaaattttttatcataaaagtcgttaaaatttcttcaagaggttttctgggtgctgattacgaatctgacatcaattttaaccaatccccaactcgaacaaaagtcgaaaaattcttataaatttcgttgttaatcaaattattatgtcagatttgtcaacagctagttcgggaccgggaccaaaacacgtacaactgagtacctaagtcccggttttgaccagttttgacagggaccgggaaattcccggtttttcccggttttcccagccaaaaagtcccggtttttcaactcgaaaagtcccggtcccggttttgcccaaaattcccggtcccgacctaccctaccgaaaactcctaagaacaagctttctcgaattttgcaagcccacattgtttttaataaaatttatataaaaaaaaaaaattcgggatccccacctggaaaaatgtcctttgaaatctgtcagatgtgatttacacctgcacattggatggaatgtgtttgaaaattgtggacggcaaaattgagaaaagtgtaccagtgacggcacatgcgacaaattgtgatggtaatttaatattattgttttaaaaatattgggttattaaactaacttaatatttttttaataattttcattatatgagctttgatgtcatggcaaaat

SEQ ID NO: 14844 - DNA, 2222 bp, Heterodera glycines
  misc_feature (22)..(22): n is a, c, g, or t
  misc_feature (36)..(36): n is a, c, g, or t
  misc_feature (50)..(50): n is a, c, g, or t
atatatggactaaaaaacacanaatatggacataanatatggactaaaanctgccaaaatatatgttttaaccctcaaaaatttcaaaaaagttgtgtatattcaatatttgcttaaataaacttaaaaagtacaataaacaactaaaaaatggatttaaaacttaaaattgctaattttttattgtcgtccgttgtttaaaaaaacattctcaagtttgccaatttcaaaaaaaattcgcattaaaaaaagaaaaattgcaaaaatagcgaaaatatttattaaaaatgccaaaatgaccgacgaaaactcaaatttttcgtatttttggggtgtaatttttaaaaattttcaaaaagtctatctttaggggtgtatttttcgcttttttgcatttttcttgtgaaaatttgccaaaaatggccgaaatatggactaaaaacacaaaaatggcgaaatatggatttattcccgaaaatacccaaaatatggaatttatatggaccaaaaaccctcatcaaatcaagaaattttaacgtagaaatgctatttttaagcccttttcttcatagcatatgcgcaaaaaaaaatatgttaatccatacaattttgagccctagtaatcagaagcagagaagggaaatgatcgaatttcaatcgaaaaatttttggtgaagtgaccagaaaatatttgtacttttttattttattttttcaatgctcaaataatgtcggcgcataaagaaaatttggaatttttaccatattgtttaacagattttttcaatattttttattttatttttcaagtttgaaaatttttcattaaaattttgacatgtcatttttattgtcggcggtgtcgaaaggcgcggaatggtgaaattcttaaatccaactgtatgtaattaggcgaaactgagttgccgggttggtcatttagtgttcgcgaatccacccgtcctcccattaaaattattaataattcactttaataaatgtcaaaaattattttaaaaacaattcaacaatattcaataagcataaaatattttatgtatcaaaatattaataaaaaaaaattcgggtagttaattcagcaaaaattgtaggaggcctgaaacgcacgaaaaacatgtttttagcttagtttgaagcctctaggacggatttctatatccatattttctaaatttttccatatttcgcgatttatgtccatatttccatattttggcattttttccaaaaaaaaaactcttagaacggccccttggcctttttgaccctctaaagaccagaaaattttccaagaataattttttagcaaaatttcccacttaaatttatgtcaaaaataagcaaaaaagcgaaaaattagatattcgggttgagttattttatggccatatttcgcgtttttatatccatataattacaagccctaattatataattcagtaataatttgcttgtaaagcataaaatgattttataaatgtaaaatatgaaaaaattcaatgcttaactcagctaagtattgattaatgtaaaaaatcaaaaatttactttgatcgaaaattaactgccggtgacgtaaagataatggcataaaagaacaatgctttcccaagtgagaagcatcaattcccgatgccattcctaacaatttcatctcccttcaaattatcacccacccataaattaattacccaaacggacagaccgataatcgtttaaatgtctgtttcctgaataacaacataaaggcaactcccccggggggccttaaacccatgctcttataaacctgaaatgctcaaaccgactgatcccccgagtctcgagaatatatgcgtgtgaaaatcatcaaatttctaaaattctctatctacaaccttagatgaaatcctttttgatgtctgcaattccgaatactcatgtcattttcacgcttgataaagtgccaaaatattgcttctcccctctaattttttgagaggtttaatggcaaattgatcaatcattaatattcactttcatcaaattaatccgtccatatcatcttttcaattccgtcaaattgcccaacatttactgaagggattatacaaaatccaagattcacataaacgacttttgaaagcaaatgacaaaactcctcaattgccgcggttttttaccaaaacccaaaaaagaattgtagcatttcttttggctaa

SEQ ID NO: 14845 - DNA, 1649 bp, Heterodera glycines
  misc_feature (32)..(32): n is a, c, g, or t
  misc_feature (80)..(81): n is a, c, g, or t
atgcaaaatgatgccagggttgccactcgtcngaaaatgaaccgggtccgacttcgctctctcgaccagaaactcgaaannccgagccgaaaaacttggtcgtggttcgtgataaaagattagatcggtaaataattgcgagagcaagagtcaaaatttagtaaactaatattaatattcaagggcatggtgccaacgcgccaaacaaacaaccgtatttactgaagggggtgcaaatcagggctgcacgcaattacggattacggatttccgtaactgagaaaatcgccgtaattacggatttccgtaattgcaaatccagttgcgtgcagccctggtgcaaattcagtaaatatgttaatttcagtgaagcactcattcatttctcgcaccctacaggaaaatatgtcatcattttaaataatttaagaaattattaacatgaaaatttcgaaaaagtcgaaattttgaagttttttctttgtcatttttctattatcatttctccgaaaaaagtcaattaaaaatcagacaattaatgaaatattatatatattaattagttttttttagcatgatcattattaatttctctgttattttatttgttttaatttcacccattttgccatcggcatttatttcaatatgcgtacgaccgaacactttgagttatgtgggacgactgatgtgtaaaagcaataacattatgcacgagattaacaaaaaaacggctgaaaaagaagatgcagtaactggtagatattcatgcatttccttatgggtggattttcgaaaatgtgatcagaatgaaacgaacgcaatgatcaaaatcaccaaaactgacaccaatgaaacggttggtactgcaaatggatgtgatttatgtaatttatcaatcaaggtcgggttgggataatccatcttgatttggaattttttgaatatccaggatttaactgtatgagcaaccaaaatttttgtgtatatcaatgcatttttagaaaatattcgaggtccaaaaaacggatctttctttttccgacttaccgattgtgctccccttcggcgatcaaccttcaaccgacaaaacattcaattttaaaagtaaaattccatggatcaacgaaggagatactcttggtattaaaattggatgcgatgttggtcttgaagattatgaacactatgcaattggaagcgcaatttatccggagaagatcaatggacagcttgccagtattcatatcaccgtcaaactgtacggtgatatgattaaggttgtgcatttatgtggcatgtttggagatatcaataacaaaattgaaatcgctattattcaaaatgggaaatggaggtaaaataaatttaaacaaaaattatttttaatttggtgcaattccttctttaaatacgtcacctctgatagttttttggcggattttttgtttcgaaaaaagatagtagaacctctaaagtgagcgtccattgctgagttgttttagtgcattttacggtgaggaaaggccgtgggttcgagtcccaccggcggagttaccttttagttttggtgtctaaactttgtgcgccatttaaggcttagtttatctattaatataataccgaggaaaaaaggtaaatttattaat

SEQ ID NO: 14846 - DNA, 1483 bp, Heterodera glycines
  misc_feature (46)..(46): n is a, c, g, or t
tgagtccctgcgattgaaatgcttgagggtcgagtcccagttatgnaaacgcaggagaattgagtcccagtgattaaatgcaggagaattgagtcccagtgattgaaatgcagaattgagtcccagtgattgaatgttggtggattgagtcccgttgatcggaatgttggtggattgagtcccgttgatcggaatgttggtggattgagtccctgcgattgaaatgcttgagggtcgagtcccagttattgaaacgcaggagaattgagtcccagtgattgaaatgcaggagaattgagtcccagtgattgaaatgcagaattgagtcccagtgattgaatgctggtggattgagtcccgttgattgaaatgctggtgggttgagtcccagtgattgaaatgttggtggattggggaccaggtcgttttggcgccgacgatttggcgccgacgttttggcgccgacgttttggcgccagggtcgttttggcgccgacgttttggcgccaagccaaaaatgaaaaaaaggcaggaagaaattgtaaaaattataaaaaaatgaaatttttcgttaaatataataaatttaacaaaatgaagaaatggaaacaaaaaatgaaatttttcgttaaatataataaacttaacaaaatgaagaaatggaaacaatttatgggttcatatgataattgcgcgaaattccacggagaaattctaaaataatatgaaaatttggatttatgtggtaattgtgatcattttcattgttcgggttcaccgggatgcaattctgcaccaaattgaagaggcgctcatcagccgcttggtatttcttagctttccgcggtggctcaagtccagcaagaaatgacgcatacttcccatcggtgcccttctgctcagctctttgatagacttcgtcagaaaaattataacgatttcatcatttctacccccccccccctacatggcgtcaaaacgtcggcgccaaaacgttttggttgttttaatctattttagaaacaaaaagagaattttgaaattttttattttcgattttttattcgaatttcggctccgggttccgaattggtcgaaatggatgcctggttcgtgagcagcgaccctgaaaaccattggaagcatgttttcatgacttttgaaaacaaaaaaattttcttcaaaaaggggggcaaccaacaaccatcggcagtattaccttcgcgaaaaatacgtttttttgttgttttacaaaatttttcgaaaatttttaaatttgggtgtttttcttttttttattatggcttggcgccaaaacgtcggcgccaaaacgtcggcgccaaaacgaccctggcgccaaaacgtcggcgccaaaacgtcggcgccaaaacgtacggcgccaaaacgatacggaccccagtttttgaatgtggggtggcgttttgtatttgttttgcgttaaaaatgaattcaaaaaaaagaa

SEQ ID NO: 14847 - DNA, 1154 bp, Heterodera glycines
  misc_feature (10)..(10): n is a, c, g, or t
agatcaattnaggttggttttcaaacacatatccaacagggatccaatccaaaaaaccatgcaatgtgtacagagtagcatatacgagctgagcattgtcagaattctcctaaacaaaaattaagacaaaattaagggtgtgaaaaaggcgcaccaaaatctcataacaaagtcggtacacttcttcaaactgcccacaaaattgctgcttcaactgtatagccctcgacgaggtaaggccggtcccaaagtcaaagacttcttcgctgagcagacgaagaatggccatgttgttcatgcacagagactgtccatttcgactggacccaacaatgtcactgatgaaagttggccaaagacgtggccactcatgtttcacgatctgaaggaaattagtgccgaactgcgaaaaagcgcaaaataacgacctgcaccaagacgaggttaagtttctgaagcaacagtttcattcgttcacttttttcggggtccgcactgatgtccaaaatcatgttgacaatgtaacctttgatcccttcgcattgatcccttggcaaagccttccatcgtgtttggatcagatgctccaaaatttgcaaaccaaagtatttcgtctcgagcaagtcactgaaaaaaaaacaaaataaaagttagggcttaatggcacaaaaattaaaaatgacagtacggacaaaagagtaaatttctaaacgagttcgaactcttttctttactttaaatgcaaaaatccgctttaaatatactaaaaggtttagattttcctttgtttaacgaagtatttacagcttgcttttatcaaaatgaacgatttgaagctttttgtaataattttgttggtgggaactaaaagtattaatggagaccaaaccattataataatgaatggtataataaaaataagaaaattaacctgaattccaaaattgtgtcaacttttgtccaagaatctgcgctttctttgaagcgggccaaaatgtcagaagctgctttctgtgcttcgccagtcgaacggttcataagggtgacgaccttagaaaatgtcattagttgcctcgtcaatgcctaaccaataaaggacttttattatttgcacattaaaacaatcgaaatacgaaggcaacaataaaaaaatg

SEQ ID NO: 14848 - DNA, 696 bp, Heterodera glycines
cggaccccccccccccccctctgtcccacaaaatttttggaaaaagcgcgccacaaaaaaagcgtttttaaagcagaaaaaagtcgtcgtaaatgaagaaaatgataagtgaaaacaaaaaaatgttggaaaaaatccattccggtgaaaaatacaagccatttgaataaatattaaccattttgcattgcatataataaaaattttaaatgtccttgaatttcatgaattttccccactatgtccttgcaaatcggcatacccgtccttggaaacggagcatggacgatggcaaccctggtttatagcttatttattaatatgacaatatatcctctcgcggaccatcatcattagggagtggatttataagtttttgcttattttttctgcggctttaactcgacgagaaatgcatgaaaaacatcaacccaaaaaaatttcgaaaaatatgccccctacgaatcgaccaaaaaattttctaaaaaatatacccctaagaatcggcactaaaattttcaaataataggctcataagtaatgacggtccttgtttgcatccattcaaattttgtgcaattaggtgaagcaattagaaatgtggtaggtcagggaatgccaatttttgatgcacatgcatgtattcgctagtgttcacaaggaggtggacaaggtttatggcgaaaagccaactga

SEQ ID NO: 14849 - DNA, 1053 bp, Heterodera glycines
cttaaaatgtttcaagataaaaagctttgaattattacaaaaatcaaaaaaaaaacgaaccttatcactgttcaattgttcagcacaaagtgcgcgatatatttttgaaaacgcccggcacaaatcgcgacggcactcgaattgcccaacactctgtgccgtggccatattcagacgggcgaagtcactgaatcagaaagaccaattcaacggacagtcgcggcgtaatggcgacagaacacaacgaaaaagcgtttcagaagttcttcgcttttgacaatttcttcgaccgacaaatgattaaattggcggagtcgccctgaaaatttggaagatttgtcaaatttaagtcaattttagagggaggggtgaaaatgcactaaaccagggctcccatccgtccttgaatggcaaggacgtccttgaaattgggccctctttcttgaaaataaaaaatgtccttggatgccaaggacgtccttgaaaatgaacatttagaaaagttttaaaaaaattcaaagaaatttgagaaatctttgtaattttcaacgatattttgattatattatggcattatgtaaataaaatgcaatttttcaaattttctcatgcttgtgaatgaatttgttacgcaattttatcgcgtttgcgacataatttatattttagaatgttcccaaataagcgcaaatgttctttcaatcccgattgggaaaagcaatatacttttgtcaaaagaagccgaaaagggaatggatttttttattgttccttttgtcaaaaggacttcaatgtcgaatcaatgggagtttcagccatcaagtcgcacactgaaaacagagtccataagcaaacggatgaagaaagacggaaaaacacaacaattgagagtttttctcgatccaaatcgacgcttaattcaattgaccttcaagttgcaacggctgagggtcatttttaatcttttttaagtgtaaaaatttgtttttaggcacttttgcttaccatgtgtgtaatcatcatcaatcgtttgcgtcaaatagcgcaattgga

SEQ ID NO: 14850 - DNA, 1530 bp, Heterodera glycines
tttaaaatttggattttcgatttttttgttcgaatccgggttcgaaatggatatcagattcggattctacgacaccgataacctatagaaacaactttttataaatttcaaataaatttaacaaaaaaaaaattttttgttgacacaaaacccacaagtacccgatttccttttaaatttaaaaactcaaaattttttttttggtattttggtaacaaataaaacaattgtatgatggccaattcttctcaaattgttccgagcctttctcttctcttcgcctccttttctttgctccgttcgtccttttctttccatttcttttctttcggtcccaaaagttcgtcctttttctcaaattcaacagtcaggtggcactttggcggaagagcacttaaatttagttaattaataatttctaaacaattagtcagtcgattgtctaccggatgatcatcggggcgagacaatccgccactgctgctgttcgtgaccggacaaagcggcgacaactcagacatttgttgttgttgcaatttgtccatcaaccgtcgctttttgaaccacttgttaactaattttttttaaatttgattcaaacgatgatttgttgaagagagaaaaagtggagagagaaaaatagtgagagcccctgcgctagagagaaaaagaggagagcgggggggggagagatagagagaaaatagcgagcgctcctgcgttagtaattaattaccccgtactcgttaattaacgaattaccccgcattggttaactatctaaattaccacgaatttattaattatctaattacccggcactgattaccatccattaactgattaccctgcttctccgtaagacacctctcttgcgccaaccgctgcttcacgaccgggctcgggtcggggtcggtccgataatgttctctgagtattttgctctgcaaaaatggcattttttcgaaaaagttcttcctccgctaattatgtgaatggtgacgatacgtcagtgtgaaaatgcgtcagtgattttacagtatttttaaacgagataccatagtattcattgggtgccatttggtacccatactctcaattttccccaaaataaaatgaggttctttaatttcttcattccgaatgttgaaccctcaaatgtacatggaagtgggaagtgtggccccagcggggaaaagacagcgtaaaaatgatcaaattaattgtacggtgctaatagtgaagggcgatacacgttgcaaagtgatctgaatttttaagtgtgatttgtatgagaaggaactacctacagtataccaattacagtatatatatattcacaaattctgaaaatttacaagttttacagtcttcagttacagaatttattttttaaaatacaatatcattgacgcatttgcactaatgagccgccaattatgggataattattccttgtcaatttgcactcaccgtttcttccctaaagcaaaagtccgttcttttcccggtccaaattgtgcgcggcaa

SEQ ID NO: 14851 - DNA, 1947 bp, Heterodera glycines
  misc_feature (51)..(51): n is a, c, g, or t
tttaaatgaattttttgataccgtataaacctgcttttccctacgtatganaagctggtcagagcacgcatgttttcgctgataccgtatgaactcccctctaatttatttccctaccgtatgaaagctgatcagagcgtgtgccccgagggcagcttcatgtattggcacatcccttagcattggaagagggatttcgttattgtcccatctcccgagctgttggtatgagttgagaagctgaaaataggccgtttatagttgaatccgatgtaatgtttaggcgatctgccaaacagcccggattttggggatttgctcttttcatagtttcccaaattcaacaaattggtcaactattcgcactcctaaatgttctctctctatagcaaccacaaaaaatttggttaatttcaaaaaagtcaaggccaaaaatgttcggaaaaccaatttttagtatgagtgttttttttgtcataacttttttgaaaaataaacaaaataatttttaatatgttcgggaggagctgagaaccgatgacatttgttttcgttttttggcgaaattttcaaaaaggtacacgaaaaagctttttgtttggggtatgctttttcaacaaaaaaaactttcgatgaattatgaggggcgggcggagaaaattttggaaaatattattttataaaatgatgaaaggacgaagacccagaccccaaaaatcaagaaatttcttgactcaagactctcgcgttttcctcacagtttgtgcattagcaatttacaagacaaatttcatttattaattataattatacaataaatcatttttatgtggtttctgcttttaagacttacttttcgaattctcacatcgacattttgaagaaaagcccgttctcttttgacgagaaagtaatacaaaacggaggaagaatttcggagaacggaccaacggaaatagaaaggaaaaatatcggccaattcggcaataagttcagggggcaattgaattttgtggggacaatccatggcttaaaagcaattaaatacttaattaattaattagggggcaattgaattttgtggggacaatccatgggctaacagtaatttataaattataattgattaacgggaagtgtgcttatgtatgttgaaaaggttggcttgggattggggagggcaatggaacgcaaaaatggcgaaaatcaattagactaattaatacaaaacgaatggacaaaggcgttgttggttcttctcacaatcagcagagcagtcaggggtcaatgacaaaatgtacaaaaaacggtgattcaaaacataatttttgtagcaatgaaagctttaacttatagagttcgaccttggcctggctccaagcctgacttggccatgctttttcttggggttttgtgcagataacaaaccaaatgaaaaattaaggcccaattatggttaggaacgaaaaacctgctggttaatattttagatcaccatgacacttttctggaatttgtttgagtcattaactaattaatgcccagcaaggtcgccgaaaattccaaagggtaagaccatttttgggtgtcatggcagttcatacaatgggaggctttaggcctaagcttaagcctaggcttctgggcttaggctttgttgaaaacttttaggctcttctgtagtccttaagatcgcaaaaaacaatttcattggggagggcaaaggaaaacaaaacgacgaaaaaaaatcaattagactaatatgggaaaaaagaagtaaacggtgttggtagcgtaggaggtcaattgcaaaacgtaaaagaaagccgaagaattttgaaaatacacagccctaaaaatttaaaaacaacaaaaaatgtttgacttttctgacagctatgaaaatagatccatgtcgctttatttaaacacctcatcataacaatt

SEQ ID NO: 14852 - DNA, 2058 bp, Heterodera glycines
acggaaaaattggaattcgaaataagaaaaattcacttcacagcgaactgtgatactaatataatttaattagctaatcaatctacaacgtatttccaataaatatatagtcaattatgatgaatagccaacatataaaaatcgatgatcagatttattaatttatttatattttttaataaataaatacaaaaaatatttctctaatttgcccaaaacattttattcattttcgtcaattatatttaaaaatgaatttgtggatgttaattttaatgtttggccctattcattcagttcgaattcgaaaacattgggtaaaagggcaactaaatgatgaagtaaacagaaaagactttgaacataatgtaaccgatcattcttgcgcaaatgccaatcattctgctgatcagattgcgaattttgtcctttctgatcaatcaaaaaattgtggtaaagacagaaatgtttttgatcaatcacaacaaagtgatgaacccaatgatagagatgaaaaagccaatcactctgttgatagtttggagagtgatcaatgtcttagcaataaatccaaaagtgagaggaaatgtaaatttgctgatcaccaaaaactcagaattaccaatcaatacaatcattttatcagtgcctatttgcgaaaaggaaatcattcgaaaaatgaatggggaaactttttgaagaaattggccaatgttcttggcgtaaaagggcgtacaataataaaatggaaaaaacaattgggcattgatgtggagaagaagcacacggacgaggagagaatggcaaaattggaaatatattacaaaataaagaggcaaaatccgaaaatggcacttatggacgttgcggaggaattgggcatttccatgggcacattaattaattggaaaagcgaatttaaagacattggccaaagtgtcaatcaaagcgaagaaagcataaaacagcaacggaagagcagcaaaaaagggtaattatgtttaattaattgagttaggtatgttcaaatattttggtgcaaaaattcataaatatttaatctctataaattttgttaaaaatttatttataaaacattaatatttaacagaaatgcttttttgagcttctttcgcgaaatcattcaatttataaccctaggtaattaaagcttaatacaaggacatttctgactaacgttttttgttaaaattcccaaattttttagtcaggcttcgatttcaccgactaaatcgttctcctctaacgatgctttttgggcgtggaaaaagtcggcaaagaaaagaaccgttagaattgtattgtgaataggatggaaaaagtcggaagaccgagtgacgattcaccgactgtaattagttgccgcaatcagttctattgtatttcccagtttgtttccctagcgtttttcaatgtaaagtataaaaaagaacaatgccttgaaattcgggaatgaaattaaaagtcatttggtgtcatgcgctgcaaatcggaccttcttaggggtgtatttttcgtttttattgcatttttcataacaaattttggcaaaacgccaaaatagttgaaattattatttttttttaaattttgtaaaaaaaactagaaaatagttgctaataactcgaaaagtagcttaacaacagccgaaaaaacatgtttttcgtgcgtgcattccaagctatgggaagctcaggaaaaaaatagtgaaaaaactataaattggagccctagttattattgataggaattgaataaaatagttgaaaaattgcatctttcacccttcaccttccgacattttcacctttttgggctttcacctttttcgtctctttcatatccttttttggaccgaagaatcgctttaacttcttattttgttaattgctggtaattattgatgcggtaacactttcgaaatttttcctaaaaataagttggggtcaaaaagccccatttttcaaattaaatgttcaaatgttatattttttgattgtccattctcagggatggtccccaggattttttccaaaa

SEQ ID NO: 14853 - DNA, 1857 bp, Heterodera glycines
  misc_feature (701)..(701): n is a, c, g, or t
aatcccatgatcggcattggcatccgcggcactcgtcggcacaaggcgtctttagtcagccgatttgtcgaaggaaattggatcatcagacactcatcagccattagcaaattttcatgtgatttggcccagaagtgtgcgcaactctctaacggaagcaaatgaaaatttttagaaagaaaccaaataaataaataaaaaagaacagcgaaatagcagtaaaatgaggagagcgagagagatagaagcgagagacagcgagttaaaaagagagagagagagagaaaagagagtaagcatcaaaattactcatacatttcaaaaaatcaatccatttaatattattaaaattgctttttttaataaaagtgcaacaaattaaaagtgcgaaaattgatcagcaacgaaagcccagcggaaatcggtggaaatttaataaattgtgggagggaagttgcgaaaatggaaatgttcacatgaattccccaagcttagctgatttttgcagagccaagacaatataaaagtcgggaaatctgaaggaaaaatcacttattaaatttaatttaataaaacaaaattttaaaaaatcgaaaatggcaccactttttatttttctgttcgttttgttggcagtcgaaaaaagcatcggcccattatcaccaaattgcagtaattcatttactaattaatacctattntaatataattaattatttttcatcagttcatttgccgcccatttcttccgttggaagtgccaatgtttcacacaaaatgtttctgttccacaaggcccaaagctaaaaatatcagcaggacaccaattattagcaaatggccaatttagtaaaatcgattaataatttgtttttatttcaccgatttttgctttttttagaattgccaaaaacggaaagccaacggaaagtttctgtaaattctgcgcagcaaattgtttctgacgagcgaaaagtttcttcttctgagctcgaaaaagtgccgggggcttttctcgaattttctttgcccgttgaaaagcaccaaaattcgcttggccaatatttggcggaactttcaaattattatcattctgcgcgactccacgttccgccgagtacaattgcgagggttttgctacggatgaaaaatgaaatgaattttcattgtatcaaaacttcggccactgaactaccgtacccccaaccttggaaaactttcgtgtcgaaaaagaatcgaacgattccaacggaatgggcggaaacattcgcatcactttcattgacgagtgccaaatttgtagtcaaagtgaattgacaatgagcaaattgatcacaatgagtccacagcaaatttcggtgacaaaaattgcgcaatttttaaaagaattttaaaaattattttaagcaaatgagacttgactccgacgaatcggacatcgattggtttttgggaagtgtcattcatttgttggctttccaaacttatccgcttgaggaatggcacagtcggaacaaaacattggctgaccaatgccaattggacggcactttcaaaatgccgcaggttttatttaatattttatttaatgtttaattttattaattttgaatatttattcagacttccgaatcattttgtatgtttctgctccaaaacagcgtcaacaaaatgctattttctgctgaaaagctccaaattcctactgattttcctcatggtttcgagaaagagtacgccattcttggccaaataatgatggtattattattaattaattaattaattcaaaaactaaaattctttcgtttttaattcatttttagaatgctctccacgccgattcggaaaagagaa

SEQ ID NO: 14854 - DNA, 419 bp, Heterodera glycines
ggggacctctagagtctgactttctcgcagtgattttgagattaccgagtcggtaaattgatcggtttcttttttatggtccctcgcattattttcatgttaatttctcgagtctgaagtccgattctctcatttatcttattgtttggcctatgcctctgatcatttaatcaacattttccctttgacaaatttaattgtcttcttttgtattcttcaattttgataacattttccataaaaatacactacattttatgttttttcaaataaataaagtaaaaaaacaaccgaccgaagggaggggggagggggatgagtggaagagattgtcagaatgataggtgaaaagggggaatatgacgagaagggaaattggcgagagagggagggggaagggaaggaggaggggggggact

SEQ ID NO: 14855 - DNA, 1450 bp, Heterodera glycines
aatcattttgcaattacattttaaaggtccatcagagtaaagaaatggcactgaggggaggtgctgcgacgtggcgaaggtccgtcccaaattgtgccgacaaaggcactgattggtgcgtccactttcagacatgttcgccttaagcatttggccactgatcagtatttgtccataatgcccatttcggaagagcgaaaagagtcggacagtcggagaccgtaaaatgggggaaaggcaaagcaaaggccgtcctcgtccccccgttcagtgcgtcgtccgttgttggccatgccaattctgccgcggatgcctttcaactcgactcgtccgccttcgttttggtgcccaaacattcggaggatccaattcgagacgacaatttgctcttctctttggacccatgcgcaaaatgcagcacagtgagtctcttctcacattggtcgacctttgtttgcttaatgcttttccatttgtttctcatcagaaagagtcgcgcgtgcccatcgacacttttggcaatttccaattcccatggcttttcctttcattttctccttttcagttcggctttaccattacaaagtgagtctctttgatccgtttccgcctgttttgtctgtctttcattcgttttgtcttttctttcccaatttatttgctcattagtccggctgttgggtgcacacgacaaacccccaaatcacctccaatttgttccactcgagcaaaaacgagaagggatgggtgaaggtcatctgcgaagggcacaaagttgacaaagaggcatttgcgctgttgccggtgccgcccaacgaagtgcgcgacttggactttgccaacgacgcgtgccgggcactgtcccaatttgtggatttgatcagaagcggacgaagtgttggaaaggaggcgatcaagtggggagggattttcgatgggaaggcaatttggataggttaacattggcacccaattgtttttcgatttccattttccccactgttcactcgacctttctttcgggactgatcgtccccttgatttttttttaattttcaaaatttttggaatttaaatttccgaggggctgggtaacgtgtggtgcctttctttcagctccaccacccaacttttggtggatgccattttcttcgtcacaaatgcgtccaatcacttggctgatccgttgcgtctcttcaatttcaccccaattcgcgatcggcaaaagttgcttcgtgagcagggagttcttgcgcaggttgaccacttccgcctgttttgccgcaatgtcttcttttgttaaggtgttcgctctgcttaaagcgcctttcatgccaaggcaagtcaaaggaatcgatgctttttgattgcattttgtgaaaatgggtcccatatttgaaatttaaatttgtgccactttaggcaaggctctggcgaagtgcaacccctt

SEQ ID NO: 14856 - DNA, 1902 bp, Heterodera glycines
tatacatcaattttaaaacgagaaaaagccaattcaatcgtcaaaatccaatgaaagagaagtatcaaagaaccaaagatcaaaaaaagttcttttgaaatttgaaaacaaaatgacaaaaaaattgccaaaaaaattttgaaattttatttttattcgaactcgaagtaaaaggtaaaaactagggttcggaccccgcccccgtcacccccgcccccgccgggggcgggacaggttttttggcttcaccccccattttttgtcaaaaaatatattcactattaaatgtgaaatgaatgctccgtgccacggcacaaaattttattgaataaaagcaaaagcttttcacatccgtcggagggataaaattcaatttttgtttgtttgtctgttcttttctgtgtgtgtgtgtttgatgaagaattcaatttaaagttcaaacattgagccgttttcacaggaggagaattttgtttaaaacttataaattttttgccaatattttccaataaaattttgggggatttaaagcgtttaaatttaaacgctaattgatttggaagattaatgtgatttatggcattttttaaaccaatttttcattcggttcgatgacatcactcaaaatttaaaaaaaaaatgaaaagaaattttttcttaaatattatgctgtagcctctaagtgttctcaattaacgattgaaaaattgtttattttgattgctaaagtcaaaagttatggtcaattattttttgattttgaagattaaatccgccgccgatgaattaatttatttgagggattaattaggtaattaaatgctaaattttggtaagccaaagaaaataggcacaattaaaatttttataaaaacattttaaaatagaattgatcagccatttttaaatatgtgcattattaacatgcaaataaaatttggtggattttagagcatattttttgaaaaaatatttataaattaattttgcaaaaaaaaaaatattaaaataatgaaaaactcagaattttttcaagaattttaaaaccaataagcgttgaaatattttcaggttaagaaagggttaattcaaaattaggcaattaatttttaaaaatttgatcatccacaactcattttaattagagttggtcgggaacgggacgggaattcccggttttttcaggtcccggtcccggtcaaaaaagttggtcccggtcccgacttttctggtcccggtaagtcccggtcccggtttttgtcaaatttcccggtcccgaccaactctaattttaattgatcaaaagctcgtcaaattttgcagagaaacgtaatggaacagttcaaaatgtttacaaattttcctagaatttttttcacccgaggaaaatttatttaatttacaacatttgcatttttttaaaataaaataatggaaaactcaaaatttcgaaaattaaaaaaaaaaaaagcgttttgctctaattgaagcagtgaattttttaaaataatttttcgaagtaccgtattccttgaaaaatcacaaattaagcgggtttaaaaattgttgaaaaaacgccggcggggccttttttcaaaatttaaaatacccaaaaccatgccaaaatatcatattttggatgccattccatctattgggcccctaattttcccattagcctcccccccccaggcccatcgtttggaggagagtaacaaattaaacgcgcttttgggagcggatgggaaaaatccatcttagaagcagccgccgccgctccagcggtcaaaaaatacgcgccgcgcctcatgggcaaattttttatgttgtgccgcttaaaaaatgccctccggggcaatgcgtgtgccgtgccgtcgtcggccggaacaatgaaacaccata

SEQ ID NO: 14857 - DNA, 1995 bp, Heterodera glycines
gccgccattattggcattttaagtgtccgtccgtcgatttggcaaacccttaaaaatcggtgaccccgcggggttattagaagcaccatttttcatgaaaacatttttcaaagcgtgccttgtgagtgggggggggggggctaaaaaactgcagcaattaaccccggcgggcacacaatgcgtaatgaatgaatggttggcacgccatccgccgcctccggcgaaaaaaaataaaaagggacgggcgaaagacggacagcggcccctcgaggcgctcattttgaagttgggttggcaaggagcgttttgtccagttaatgaaccttatatggccgaaggaaaatggtgccatggaaaaggcggcggcactttttataaatttaaaaaatttggcaaaaaaaaaaatttaatttggaaaatttggccaaaaaatttaatatttagtgtgcaatcaaaaattgccaatgaggaagagtgcctaattagtataaattaattaatatgaaaaaattaagcaaaagtagaaaagggagaaaaatggccgtacgaaatgccaaaattggaaaaaataaattaaatgccaaacaatgcgaaaaaaataaatttaaatgccaaaattggataaaaaatatatttaaatgccaaacaatggggaaaaataaattttaaatgcacaatttgattcactggacaaatggtgccattgcatccaacggagggggagaaaggccattattattcataggactaaagccttcttgacaagcccagaaaatcccccggggtgaggagcaaataaatattaaatgcaaaaacaaaatacgaaaaaaaaatattttaaaatgcatttttatgaaattaaaatttatttgatgtaaatttttgattattattgtttataaaatatatttaaagcataaaatttaaaaaaaaatgtaaatttaatgaaataaaattgaaaaaataaaaactatattaaatattaataaaataaatttttcaatatttttcgaaaatatttttcaacaaaaatttttttaataataaatttaattaaattccttcaacaaatagaatatttatttttgggacctcggatttgtagggatccagttttttttttacacatttatatcgatctaaaaatcaaaaatatattttttaataatttatttattttaagataaagaaaaaaaaaatgctgcgtgctagcgggaccgaacccgcatttgataatgtgatctgtggctgcgctgcgactgcgctatttgcatgccgccaggaactattataaatgttataaaacatatattatatttaaatcatttttataaaaaaaaaatcaaatcaatttttaagaacaaaatctcaagggaaaccagcagaaaaaatgcatattaatataaaaaataataatttaatttttaataataattttgcaaatacttaaaaagcaaataaaaatagaaaaatcatttaaatcattttgactaaattcccaaaaaatccaacaaattaataaataaaccatttatttatcaaaacaaataaatatttatttaaaaaaaaagtctattaaaattgcaactattgcaacagaaaatgccaaattaattggcattttttgccaacaaagaaattccttttgcctccgccccccggcgttttggcatttgagtgcgtcggtcggttttagcggtgccgtcgcccctcctcaaactttaattgtttatcgagtgagttttgcttccattgctgggaaaagcatgcttttcgctcaatgccttaggctcttttaatttttttttttttggaatttattgcatttcaattcgattttatgccgaggattgcgagaggcctggggatttttttttgaaactcggagccatagggccggggcacgtcagaatttttagaaagccggtgttttgccgaaaatgggagaacggcgctggggattctaaaaaagtgaacaaacaaattaaatttatt

SEQ ID NO: 14858 - DNA, 985 bp, Heterodera glycines
cgtcatttcgcctgcctaacaaaaaccaacttctgaaccgtattggctttaccagtactcattttttgaatatttccagtaaaaccgtaattttaacaaaatttagacaagactttttatttttatatccaatatgtgaatttggaaaaatttcacttttgattttttgttagaattcgggtagtggattcagaattgttcgaaattagcataatttgtgatcattgcccccctaagagaacgcttcagttaatgttttttcttttattacccattagcggagtttacaaaataaccaagtatcgggttaatttataatttattatttcgaatgaaatcttattaagcacttgcggatagttaatttggtgttaactggtgaaagttgattgaataaaattagtccaaatttaagagaggctatatgtacgtttagcaaacatttttaaatttttgaatacattcactaattacgttaaaaagaagagtgatcatccaaaaatgtcaaaagtttttgatgaaattaagttttttactcttttcgtgataaattctttaaaaaagccaaataattccaaaatagttgatttgctaaaaattcgccccaatcattcctttttttttttgtgggctttctaatgatataatttaatttttggaataatgattaataataaaattacacttgtgtagaccaacatgcctcccattttaggtggtcatatgtttattgatcactttattcaatcataataaaatcaatattatatgggccaaaaattctgaaaaaatacttgctaatctaacttttatgctgatcaaaaaagtcttttacaccaacttgatcagatcactgcttcatggtgatctgaaaacccaaaaatggcttgaaatcgggaaaattttcgaaaaaaccctagggggttggtaaaatttttctggaaatttttagtaggcccactgaaaagagcacaaaatttactac

SEQ ID NO: 14859 - DNA, 873 bp, Heterodera glycines
atgctacaaaaaatgccaagagactgtgccgttatgtgttcatcttcggtttttatcaaaagatttttagccaaatagagagtgatcataaacatatgaccatgactgtattactaaacaaatattgtctcatatagttcgcttagggttaagtagaaaaggcggattagaaattagaacaaaaaataatccttgaaaaacttaaaaaaacggaggttgcattataactgaaaagtacagaaaatcctagagagttgtaacaatttttgggaaaaaatgaaaatataataaattttcacaatcaactgaatcgcctttgtctctttgatttgtttcactgacaaatcagataggaatgatggattttaggccttattaatgtggataccttgaaataaagttatgttttgtgaacgtacagtacctttccttccggtctctacataataaacatataaacccagctaagaatggtactgatgatatacatacaatcgctttcaccagttagcaccgaacgagattaccacaaaagttgtttaattagaatctcattataaaatatatcgcaacatacatttacttaaatgagttcaattcatggttttttgtagattactgtacctaaaacgactttttgattaaaattcagatattaaaaaatttatttttttatttacgagagttaacagggaccaggtgaattcaaaaatttcactttagagtataaagcttatttcatgatataaatgttcttaaaaacttgtagaattagaaaaaaagagtaataatagacaaaattacgtgtatcaataatctaaaaaggtgaaaatttgcaggcgaaatgacatttaaggtatgggcgaaggacac

SEQ ID NO: 14860 - DNA, 2357 bp, Heterodera glycines
catgggcgaaatgtcacatactgtaagaaaatgttggaatatcttttagcacgcaattgcaaatgcctatactgtcgctagacaagtatatgaacaccggaacgttggtggcacattctttgcggccaaacacatagagatcgtgttccaacccgctgactggccgatcagcggtggctcatgtggtgcggcagcggcgattgcccttctgtcaaaagcagaaaaggaacttgcccgagtggacactgtggtgtcgggaggaataatgccaaatgggcacatttcacaagtcagtggcctggcgttgaaaattgaagggtccagacagcaccacatgcgccggatcctacttccgagcgcaaattttcaagaagttgccgaattgccgccgaatgtgacacatgggattgaaattgttttcagagcaaatatttggcaaatcatggccgatatgtacctatcgatgacaaaccttcctgctgtttagtttttattgttatgaaaaatttaccgctttttatttttggctttttattactttattgcttaaatttaaaaaagtaccatcaaagctttaggtcgtagtaaattgtcattgcatctgttttaagcgatgtttttaagaatttcagactcgagccaattgcaaatttaaactaaaaaatgaaaattataacgagaagaaaggacatttaaaaagaggatttatgggaagagagagaaggattcaatatgacaaatggcaagaggcacggctggttcccatgttttgaaaattgctggcatgtgaattttaaaatattctttattttgcaaacttttaggtgtcaagatttcgtgtttatttgctggggtttttccaaattttttgaactgtggaaggtccggcggagccgttaaaacaccgctggaattatgaatttagtgtgtttttgatattttgaaaatttggcattttcaacttttaagccaaaattatgaaaatgtaaagttccggaattttgtgctaaatggtcgaaatatggaaccggaatatggaaccagcccttgtaagcagcaatcaaacaaattttttatgaattttgtttgatgtataacagagagaagaaccatatatatgaagaaggtaaacgaaagataccaagaatgaaattttggtttgatttgaaaaaaaacagaaataagtttggtgttgtgttgtgtacgaatcacggactaacaggcattgcagcgtattcatcggagaccatttcgacggcgatggcaccggcggtgtttgtgtcggtcagagcaacggccggtgattgggtgttggaagaagaatccataggacgagagaccgacgacgaagaaactgttagggatgaagtgattttttttctgaacttggcatgggtatgggataggccgttatatacccggctgaaacgtcgccggatggttttccgaccattacttttttttattcaaattaagctttgttgatgttttcgatcaacgtttcgatcaacaacgttttgtcctgctccggaaattataaaaccattatttaaaattatatcgcctgcacaatttttttcaatattaaaaatttcagtgccgtatatttttgcgatttgggcaaggagtccgacagtaaaaacatgcgccctcggggaaaattagaattttgaaaggattttgttaagaaagggtgggtcaatttcagaaaatgctccgatttaaacaatcgcgctgaaaaattttgtttgaaatattaagtgacaaatcgcaggtagcggcacgcgctccgccccttatggccatatggccacttttcacaatgagaggccagcattgtgacggctactcctcctgggattggtcagattcgtagtcgtcctcaattctgatccgtttcgttgtcggataatttgtcgaagcagcaacagctcgatacgcagttgttgctgttttttgatatgtatgtaaaatcatcgattgcttttgtgcttatttcggggtttccccccccccccccccctcccctcgtgtcgtttcgtcccgagaatttttaaaaactttaccgagatttttttttttagaaattttccaatgtaagccaagacaataaaaaaaatccttgaaaagtgaaaagttttatgaaagaaacctttttaaaaaaattttgagtgcaaaaattaaaaatttttgaatagaattataacataagcttttgtttcatgttttttaaggaaattcaaattttcgccagattgaatattatatcaaaaattgggctgttcacaatttgcggacgatgaatttacggaatgcagagcagacaaaaatttttctcgggactcaacccttctcga

SEQ ID NO: 14861 - DNA, 1061 bp, Heterodera glycines
  misc_feature (982)..(982): n is a, c, g, or t
  misc_feature (1038)..(1038): n is a, c, g, or t
cgcaaaggagcatataagaaaatgcaaatggcgaagaagggcaaggagaggaggaaggaaaagaacggacagcggagaaagggacgcgacggaggaaagacaaacggcgcaattgccacgaacggggcgaatactaaaggaaatggggggggggggatattcattggattaagaagaaatggaaaagctgatcaaaagaactggcttaactgatcagaatggctaaaactgatcaggagaattgatgaaactgatcagtcaatgtccctcctcctcctccgcccgcgtccgccatactttgtatatttcatttgctccagtccaactaagccaagtgttctccaattgcgaattgctatcggtttgaccgtccaataggcgaaaacaaaggacgatgaaaccgctatgaatggtcgaagccaaagacggaggaaccgaagcagaagtgccgaaaccgttgtcacctgctgctggacgctccaaggcgatcacttcctcgaagctaactgaaccgaaattcgaagcattgaacaatttgatcgccgctatttggcccttttgcttcttctctgttgcccccccccaccgaattcggcttttcccgcgctcattcggttcatttcctccgccatttctgcgctcgtctctccgctgtcaaaagcggcgcaatgaagaaacggataaagtgctaacagagccattagttcaattgatagattttcgttgcttcattacttacgctccgggtccacacaacgcaaaagcaatgcgcgggagagagacggacactgacggattgggtcaatttgagccaaaaaatgcgactcggagaaaggcggcgaatgattggaagaaaaccgactgaaagaaatgaacggaaatgccaaaggaataggggaaacgacggaatgagcgacttgaaagaggacgaacgcggcccaaaggcaaaaccaaacagaacgaactgagaatgaccacttgngggcattccgtccgtttggctgcccgaaaggcattctctgctcatccgatttgtgngcggcgttcgctgattgctgtaa

SEQ ID NO: 14862 - DNA, 1715 bp, Heterodera glycines
cgaatacgaagcggaaaaatatggacttaaagaagaaccgggaatggatgggaaagtaaagaacaaacgagaagcgtcaaaacggcagaacaaaggagaagcgtcaaaacggcacccaacggatgatcccaataagccaaaagatccattttttggacaaacattgaaaaggcactccttccgtgtcccaaataaaacaactcatattccttttattttcttcaaattaatttttgatagtttatttctttccaattttaagttaattaaagttacatttaccaaatactttttgtaagtacttgtcacagatataagacaatatgaccgaattccaatgcaaatttaaaattaccgatatgatataatagtgaccgggaattaatgggaatgaaagacagtcaaattgtacaataatgagctgggttttgagtgagtgacaacgtaaggcgtacatatgaacaaatacaataaatcctcacaattatatggtcaagtaactggtcaacgaaattaagagagttgaacattcagaagaggagggatagtcgggcttcatttaatgtgagttttcccaaaatttttatgttattaaattgtgccttaaattttttggagtttttaagaccagtgaattggaccagtaagaagcgcctaacaagaactatcagaatcaaagtgttaatttctcaagaattcttcactgggacgaaatctctacgcttcagaattatttcgctctctgaccaaatagcttaaattgtggttcaatttctccagaatttcgtcttcatggcgcaaatactcacattctttcaactgaaaatcttttttttttttttagaaaatgaaggctttaaattttctctcccctccataaccaataaatagggaacgggacattcccatcggaatctatggaattgtttgtatcaacttgccagtctttgctcaatatcaaagaggtgttcatcccacgctttcgggaccattctccgttgacagtcggccaatcgcaaagcgtactccaaattgcttccgcttggtcctctgcttcgaataatctaaaagccaagggaatgaaaggccaataagcagggatgggaaggatggtacttgtttgacaatttcgtcgatgctcgtgggaactgagtgataaatgttgtcgcccgcttccgagatgtacacgcacagttcaaaggggtcagacccattgtccgggtaaaactggacacattttagctgaatttaaggtaatactggagaatctgggctccacccaaaaaaaaaatttttcttgtaaaaaaatgaacccggggttttcggtgcttctgatcacgaatatgatatcaaaatttgcaaaataattgactttatcatttattttgaaaatcatagattttagaaattttgaccaacatggcagggtaataaatgttgattgtttatgttttcgattgttctatgatcatctcattggttaataaatagtgatgatcatatatggttgcctcactcggaaaaatgcagcatttgatcatgttggtcaaaatttcgataaatctatattttcaaaatcaggataaaaatcaatgatttttttacaaatctgatatcatattcgtgatcagaagctccggaaacccccgagttgaactttacacagcattaaaataatttttttaggtggagcccagattctccagtattaccat

SEQ ID NO: 14863 - DNA, 1659 bp, Heterodera glycines
  misc_feature (1516)..(1516): n is a, c, g, or t
ttggagattttgaagtggaaattgtttaccacaaagacattaaattaaatcacaccaaaattgacaaatttaccggttgtcggtgtgagttgatttaatgagttttgttgtccagtttgactttgccattgttgcaatgcactgctgattggcatacctttaacatttaaaactaatttattataaatatttgtcttaaaaccttcttctgctggctttggtggaccaaacgattgtatcagttgttgttgaattaaattgtttctttctacatcccattctaatttgtaatttttccattgttcttccactaggttaattaatgcttctttgtccatgatgccgtatttccttgccaaattaaataccgtccattgctgttgtgccgggaattgtaggtaagcttcgatttgcattaattgttcaaccaacattcttcgctcatcgttcgttttactcttctccttgtccttctgtttgtcttttccatcattggtagtgttgcaactgaaggcaaataatgccaaaaacaccagacacagaagaaccaagggataactgatggtgcctttcatctttaaataattaaaattaattaaacttttattaaaggaagtaattcaaattgaaaacacagaaaaattaattatttaatttttaaaaaataattaaattatagaaaatcaaataaaatatagaaagaatttttaaataaaatcataaaaatatgaatataatatatttaatttattgatattttttctgactattttctttcaataaaatacgcattaaataggcagaaattacatcactacatattttttaacttatatgggtaaattaaagcttcataaataaaaataatatactatgcacaatatccgaaaattctctttaataatacaaaaaagaaactctgaaaatatggctaaaatttccggaaataaaaaaatcagcagtctttaaagaaatgtagaatgttgcaaaaatacacttgtcctttattgttcaaaataggcaaataatattttacattttgggttttaaattaaagttccactatgatgtctttaattttgtacatcaaacaaaataaatgatcataagaagcaaatcttaatataattgggtgatttaaattgattacttcgaatgaatgaagtaatgagttgtttttattcacatttgctacgacaaatttttaaaaatatatcatttcaatgtttcggcgatgaatatttaatgatactatgacacaatccaactttggcaattcagctttatctcaaatccctgcccaaatgtatttaattaatttttaaaattttattaaaaaaattcaatagaccttttaaagcaatttaaaagcaaattaaaaagattgggcgtgtcatacagtgcgaatagttgttttataaaaaaaataatcttacaagaaatcgtcttgaaaaatatccaaaaaatcagctacggatcaaaattaggaaaattccaaaaatccttacttctttanaattcagacactttttaatagaaatgaaataaaaatgtttttttacgcgatgacatttaattatttttaccctcttcttgtattttctctctatctctctcttttctattcgccctaatcatttatgtccctctttactctat

SEQ ID NO: 14864 - DNA, 820 bp, Heterodera glycines
tgaattattaacagattttattaagaaaatgaccaaattttgttattttcgccaatatatttacagaatttctaccaaaaatgttcaaatttgctttaataaatcttaattttccgggtctgggaaccggtcgggtacccggacccgtgcaaaaccctaaaataaaccaacaaaaaatatttttacaattatttttacataaagtaaactattattgctcatacattcgaaatgcttactacctattatttgctaaaagttgaatgttcattagttataaataaaaattaatattaatttttatacactaattacaaaaaacaattgcttttattttatatttattcacaaatatattaattataaatatttatccataagataggcaaaaaaataaaaattttcaattcgttgatcaataacaaagcaacatgtaaaactctccttgagcttgtgaaagtaaaccaatattaaattaaattgactaacttaatcacaaataatttaagttgcaattattcatattcccggattacattttaccaatatcgcaataataaatatttaactgaatgtaaaattaataatcatcgttatgtattttaaagaattgaaaaattttaaggaaaaaaacattcagcaaataaataaatattaactagtaaactatatattcattcatcacaatattactgaataatttttgggtttttttagagaaagcctacgccaagctatatggaggctacaagggataaaaattggcaaaaataatttaaaaatatttttcatagatttataattaaagttgatcctttaa

SEQ ID NO: 14865 - DNA, 979 bp, Heterodera glycines
aaaatgcgtcagtagaaaatgcgtcaatgatacaactattttaatatttagttctttagtattgctactgtaatatagaagtataattctataaaaaatctttcagaatttcgaaccccgaacccgaattcgaacaaaaagccgtaatccaaaattgtcgaaattagagtttttgttcaaaatcggtttaaaatacacggaaacaaactcaaaaccatcaatccttcaataagagatcatttatgccatttttgaaccaaaaatgctaaatttgaaaatttggactttagagttttcattcgaattcggttccggggttcggaattgtcccaaatggataccggattcgtattcagtgccctcgaaaatgcaatgaacttgtttttatgacaaaaaaattttcactgccccttttctactgacgctttttcccactgacgcatttaccgggcgccttgaaagttcgtgatttgaaaattaatttaataaaacaatataaaaaaccaaacaacctaaattaatgaaaatatagtatatttataaatttataaaagtgaattaattgaaaacatcttaaacaatgtactactggctactatattataaatttataaaatagttgcaatcgtcaaactgatcatgattttaacgaaaaatttcttttttctatattaattatttgctgattttttttaaatttaaaaacactaaaataaaaattaatccaaaatttaatgtaattaattcattttaaaatgacttaaagaagattaaacctgaatttaaagttagtaagaatgaataaataaacaacaaatattattaaatattatgaaatatgtgcgtgagaatttttataataaaacattaactaattaacagtaattttttttataatattttacttattaaaagctaaaatacaacattaaaaacaaagaaaaacacacgttcataactgaattaacttatgtgaaaa

SEQ ID NO: 14866 - DNA, 1461 bp, Heterodera glycines
  misc_feature (1362)..(1362): n is a, c, g, or t
  misc_feature (1417)..(1417): n is a, c, g, or t
  misc_feature (1451)..(1451): n is a, c, g, or t
tttcgattcacctttattacaactattttatttacagataatttttaaaatggatcccggaactggcttctgtgttatctatgaaaagcacaaactgccaaattgcgtgtgccccgttttgcgtcgtcgctttgattttgtcacattccgaaggatttgcattttggcgggttgtgactacttgcagggcggccttcaaggcgttggattgaagacagccgaagaagtgttcacaaaggcatccagtcatgccactctaccgagtgtttgtcgttcatttcggtttcatttccttaatatttgcttttcaggtcctcgttcgtctgcaattgtacacaaataaacgactcaaagtaaaagtggacgctgattttgtggacgcctttgttcgcgcggagaacacctttttataccaaattgtcttcgatcctttgtatgttatcccttttccattatatttagaattctttttaattcgtagaaagcgagaacagagaccattgaatgcctatcctgagacaggggaagaaaaggttttttgtctattttattggtaatgtaaaaaattattattattaattcattcaattgcttttttcaataataaataaatttaggaaaatttgttggacaatgaaaagaagtatcattatgcgggagaagtaaggtgatttggtcagttaaattcgtcgtttttcggtcgtttctccacggaatgcccttcgccttgccttgggaaatgacgacctttccaagtcgtcgcttgaggatgaatttgttttgcccagtgaaattcccgtgtcgtcaatttggaacagcaattacaaaaaagtgttggaaacggaaaaggaccaactagaaaaagagttggacaacaaattcggggcttttcgggtacgattttaattatttaaatttttacaaaaaatttttagccaaaaaaatcactcgtgaaaagatcggctgacaatgagtcaatctctactcattgtcatgacgaacgcaaaagaacgaacaaaggggaaattgatacgatttttacgaaaagacgtcgtttctctgagattcaaatcgtaagtgatcgtttttagtaagagttgaatacctttacatgagatttggtttttaagggaagtgcagcaccgcggaatggagcatatacaaattggacagcaagggattggatgcgaatttatggccaacttacgcaaaaggaaggggaagaagaggaaaacagctcctccagaagtaagttggcttacataaaacctgcaaattttcttgaatattcccttttgccatttaggttctgaaatgtcttcccaatgagcggtggtcacttgtcttttgattgtgttttanagacttcgtttcttgaaagtttcaatctcttttttattctcttattccgaattgngcactttctttctcttttttttgaagtatcactntttcatcttt

SEQ ID NO: 14867 - DNA, 1605 bp, Heterodera glycines
gttcagaacaaattggtctcggcagagtcaagtgtctcctcctatccgttgaatttttcaaatgaaatgaatgctcggcgctccaattctccccccgtgccgccccttcctttagcccctcctccgcgtcgtgccaacaaccaacatggcaatttatgttgcaacaatcacaacgatatcctcgtcgacattttcggacaaaacaacgcacacgttcttcctgcagtgaatgccaatgaaatattcgacgacgaattcgacccgcgagcggacgagaaaaaaatgggacaaaacggtggtcagaacgacaatggagaagcgatgcctcacaatcagcaaaacactgtcgagcagtttgaagcgctgctccgtcgtgttgacaagcagtacgtttgggcaaaaatggcgaatttgacgggtatttacgaacttattgttagttcattaaaaaatctttaggtcacaaaaaggaagggtttttcttaatttttgatattttcggcttttcacacgaggaaatttttttatttaagacttgctgatgtgcagaacaatttggacgaatggaatttggagagaggcgaaacgggggactcgggccgagattggtccataattgaagacgaagagcagcaaaaggaatgcgaggaggagagagaaagaaatgactgtccgcgctaatcgaatgacagcgaaacaccactgacaattgacccatcactttcacttttcacccataataaatccgaaattgtgatgatttaataagccttgctggataacgatctacttcacttttaccctgtcagtgcaaaacctgaaaattttcagatttaatttcctaaaaatttttgcgcgctgacatttttaatacttaaatccatctaatcataatttaagccagcttgtaatttgctttctattcagattgaattttataaatttgtacacgcttttgtattgacaataaaaattagacaaacttcggaccgaaataaataattcatgtaataacaatcaatgaatatatacattttcatctaatttgttgtttatttgattttcattgctttcctacagaatatagtgaagatgccacgcgaagagaataaggacattgaggaggaaaggttggggtttttttggtatttccaaattcatttgacgtcatttttcaggcgcgcgaaaacggcctacgatttgatgcgcatcagactgaagagactggagaagaacattgtccgttgctttgctgcgcaatggccttagttttttctgtttcaggacaaacccgtgccgataccgaccaggcgagaagagcccaagccgaggcctccgccggaatttgtgcggaatgtcgtcgggtcatcagcagcagcaggcagtgccgagttccacatttgtgcgtgtttaaacaaatttataattgatattcaattaatctaatttcaatgtgcagttcgcaacaacaaacgacgggaattggaacggttggaatacatcgaaaaaatggcagtaaaagatgaaaaggacaaagaatttgaggagaggagaaaggcacggagagatgaggaggagaaaaagtcggccaaaaagagggagaaa

SEQ ID NO: 14868 - DNA, 1123 bp, Heterodera glycines
tccgaacccgaattcgaacaaaaaaccgaaattcacaaattacaaggaaaacatgtttttagggagcttcgaggtcgctgaatatggatatgaactttattttgtcaaccgccattggcgctcgtcagactgcttcctccgccctccgtctcgccccactacttgctccgtcttcgcatgctcccttttgcgaaaatttacttcattttttaatcagttcaaaaaccggtttatacttgtcggataatcccccagctaaggaaattttgagcacaattcgttcatacatgccaccaacttagcctgcacgcttttctggattatgaaaatattttgttgattttcatttgttgaaaaaatccaatttgttagagttcggattttttatttgtaaaatggatgtaatatccatattcagcgacctcgaagctccctaaaaacatgttttccttgtaatttgtgaatttcggttttttgttcgaattcgggttcggggttcgtttcgtgatcagcgccacaaattaccccagaaatggctttttatttgaaaatttcaggggggggggtcacaaaaccgaaaagaaccgaataaacgagtgaatgaaatttttacggattataaacacgggcaaagtcaacttgccatgttcgaatggagagaaagtgccagcatcgacattgatgtacgggtcgattttgatcacagtcactcggtaaccgcaacccttcaataggacaccgatgctcgacgacacaatgcctttgccaacgccgctcatcactccgccggtgacaagaatcagtttcactggttcctctgccatcgaaattgagcaacagcaaaagcagtccaattaataaatttaaaaagaaattaaaaatgtaaaccaaaccaatataaaaatgaccaatcccaaatttcagatctcgactcaaagggacccaagcagaaatattttctttcctatttttccttaaaaatttataagggcccttaggggagatggaggaggaattttcccgcaaaaatgtcaattacataatctcggaaaaggcaagaaattcaaaaagaaaacaaaaaagtatgtgatcaaatatcgtggcattttgtctgttttataaa

SEQ ID NO: 14869 - DNA, 885 bp, Heterodera glycines
ctcgcgattgcctcgcagtgatcaggaccgttacattgtccgtttttcgatcatttcttgtttatttttagttttttataaaacatttacaagattgaactctcccgttgtcgttctgccgattttacgtctgcttcgccattgattatttttgctattggaagctcctattttctggattctaagatgaagtttggtccattcagagtgcctttttacattttaattggtgtcggcacagcagcaatttctaccattctttacaagaacagttgcggacaaagagttcgtcaagccttggccgaagaactgcgcaaagaggtaacaatggctggtttgcctgggttttatggcatttcgataaaaaaagcaccgaattattggaccaaaaatattcatttttccgggtccttatttcgtaatttggcctggggttcgagcatgcttggctgcagtttatttttatgatacttgataaaaaatcatagaaaaaacattgattttcgaagtcagattaaattcgttaccagcacattttttagggagcagctcgttcccccccagagaaatttttcttaaaaaaatttgctaacttagaaatttttcaagaaaaaaacttagaaagtttgttcataagaaaatgctaagaaaaacaaatttcagcgattttttctaagatttttcaaacaattttccaaaaaatcgctgaaaatttctcgaaaattttttttcttagaattttcttatgaaaaaactttctaagattttttcttgaaaaatttctaagttatcggggggaaacgatgcgggggaaaatgaagtgcaccccattttttaccccagaaaagactaaaataaaattttaaatttattttttcggaacca

SEQ ID NO: 14870 - DNA, 1170 bp, Heterodera glycines
caaatacgggggagatggggtcacatacaataattgcatttcgtacgaataaaaaataatattaaaaaataagcaacaaatatagtaatatgagtatcgccgtcactcagttctaagcattgaatcgcgtaaatgaccacaaagtctcgtaacaaaggcgctggttgagtgaaacatagtcaatttgggaggtaccgctgagaaccgggatgaaatggggcatattgctgaaaagggagagaatgcgcaacttctttaaatggatgatataagggggtaaaggttgtaaaaaggcatatcgagtgtttaccgcttcaactccaggtaattattgcgaccacgctttgccaactcggccgcttgacggacgggagtggggagagcgggtgccaaattgacgatctgccaattgcaacacattgcaagcaaaaacctaaataggaaataatacataaaacagatgggagaacgtcaaccaaaactggttatactgtagttacccttctccgcttgaaaatttttttatatgaatttcattaaaaattaaatttttttaatcatttttttcaaaaattgttccaaccgccgaaatttctttcaaaatttagccccctcattgtcagttcattgttcttatatatgtgaatgaaagattcattcattgaattgacataaaacagctaaaatgtaacattcttttacaacacaacaacagatttacccctgaagttcttcattgttcgcattcatttggttgacagggaacacatactgcggaattctagcagtgccctaaaaatagaagcgatggaacaaaacaacttcaattgaaaaagaagagcactttaagcggagtgtgtgcttggagccaaaactcgtgagtgtccacgctggtgaccttcgaatcaatgacacatcctaaaaaacgcacagattaataaaaaaaaataatgcgatctgtgtcgggaatttatttaattgtcgtaatcgtgaaaggaccgggcgttgtgttctccgcttggtgctgctggccgcgaataaaaaagcgtttgttgtgccctttgtccacaatacaataaacgaacttcgggcgccagttggcatcgcaacgatggcacgcctccgcatacaccggaaactcgtcatgaacattctaaacgaaggacaaca

SEQ ID NO: 14871 - DNA, 1604 bp, Heterodera glycines
  misc_feature (1558)..(1559): n is a, c, g, or t
caaatgcctgcaccaaacgacattccatctctccgatcattccttggtatggtaaatcattaccaacaatacgtcaaaaacatgcggttcatccgaaaaccgctcgacgatttgcttaaaaaggaaattgattggagttggagtgaaggatgcgaaaatgcatttcgaaaaattaaggaaattttggcatcagatttgctgctaacacattatgatccaaaaatggagatcattgttgcagctgacgcttccgaattgggcatcggagcggtcatttatcacaaatttcaggacggaaacatcaaagcaattgcccacgcatcaaaatcactcgcccctgcagaaaaaaattattcacagatcgaaaaagagggcttggcattgatttttgccgtacaaaaattccataaaatgatttatggacggcatttcacattgcagactgaccataagccccttgtcagcatttttggcagcaaaaagggaattaggcagtgcagtgccaatcgtcttcttcgctggtcattaatccttttggcctacgattttaccatcgaatacataaacaccaaggattttggccaggcagatgcgctctcgcgcctcatcgccaaaggaaatgagcccgaagacgagaaaatcatcgccatgatcaatgcggaaacagattttgagacgaatttcgacaacacaatttcaaaattgccattaaaattttcggacctaatcgctgcttctgagcgcgatgaaaacatttttcaagtccaaaaatttgtcaaaaatggctggccaaatgaaaaggccatggacaaagaaaatcaaattgtccgtgatttatgtcgaagaaaggaagaactttcaaccgaaaagggatgccttatgtatggagaaagagtggtgatcccgaaagtcttccagtcaaagattctgaaattgctgcacaaaggacatcccggcatgaaaaggatgaagcagctggcacgccaatacgttttctggccaaaaatcgatcaggacattgaagattttgtccatgaatgtgtgccatgtcaggctgctgcaaaagcgccgattaagacaaatttacaatcatggccaaaaacaacaggcccttggcaacgcgtgcatatggattttgccggtccgtttttcgggaagcatttcctaattgttgtcgactctttttcgaaataccccgaggtattcgaaatgtcaacaatttcgacggcaatgacaattgaaaagctaagatatttggcttcacggcacggaattccagaaacattggtttctgacaacggcacacaatttaaaagcacggaatttgccaaatttacagcggccaatggaatcaaccattttttctcggctccatataatcccatgtccaatggacaagcggagagatttgttgacacgtttaaacgtgccttcagaaaattaaaaggggagggaatgtcatcagtgaaagaaataattgagacatttttggtcacatatcggaccacccccaatgattcgttgccgaactcgaaaagtccagccgaaatgctcctgnngacgaagccacgaacaactttggacctgctgaagccacctccaat

SEQ ID NO: 14872 - DNA, 3110 bp, Heterodera glycines
gtcgactgggcgggcgacgactcggcgctgcctttgtccgccgctcccatataaattggttcaattgcgcttcatccgccgctctctccgcactttgctcctccgtccagctgctgcacgtcgactgtgccaacagttcccaaagtggcgtatcatctattaggttgtcggtttaaagcgaaccgaaagtggaaaaccgagaaaactcgatttcgggatttggttttctctttggatcgggggaccgaatcgacgcggttcggtttcggaccgaccgaggcatttgtactaaattgtaagcggcaaccctggccccgtcatcagatcagctttagcattataatcatcgtcactaccatgttggctattccgcgtgctcgttccatggcggtggtggctttgtgaattctgtgccatggcacttttttgctcgcccatccctccgagtgctccctttatctgttcctgttccgtgtccgaatttgtccgccaactgcttgtcggggaagcatttgatgagccagcattagctgaaactgtcaacattcaacctgttcattttttcaacattaagcggtaaataattaatgaattatcggagttattgtaatttgcttttgtcttatggcattttttggactaattatttaattgctctcttaatgattttcacgttttttagtacttggatttgaagctagtgcgcgacgtttttgctgaatttgcttgtgtattttttcttgttcagcaacaacgcgttgtgccgcctccgttctccaaaaattcggtccgtaattttctgtttgttcggcagaagtgtcaattctaaatttggcaaaatcagtaaataaaagctaatagtttctcttttttcttattattattatatttgattgttaattgttttattcgcctttctccagcttgacgaatcggcgccgttcgaatgccggccgaaatttcgtcgctgtccgggggactgggcgggtcatcgatgtcggggacggcacggacggcaaacaaatcgggatcatcatcatcactaaaaaaagaagttatggacaatttaaatcttgtggattttccatcacatgaaatttacaaaggaaaaatcacgagaaaccccacaatcttttgttttcatcaactacataagttcagcctttaaagtattttttaacgtgtaataaaaatatattaaaaattgaatcgatgtattattattcaacacaatgcaattcattaagggtcggataactgtcaatttttaattgctcttaattaatcatcagaccgaaaaaaatattttcaattgcttaatttgtttttaccattcttcgaccggtggaaactgtccatcgtcggcatcattttgatctgcggagtcgaacacatctttttccgtgtttaagatgtccaaattgtcaacctcttttattgtttgattgaacatcattttgaccgcctcattcctttttttaaatttatcattttttgaaaacattttaattaatttatggtaattataaaaaggaatgataaaacaatttaaaaattaccgttttgggtaaaaagtatcgagttggtaaacaaatttcgggcggccacttccgttttgaagcaccggatgaacaagtgagaaggcccacatttggcttaatgttgactcttgcgcctagagaaaaacatcataatttcacaaatttaatttttaatatttcagaatttttaaatttatcgagacctattgatagaaaaaagattctctcgccttaaaatagacaaagtcgcagtaatccgtcgtttgtccttcggtactcttaaaagttttgttttaaattattattgggaaggatcctaaagaaatattatgttgaagcgcagtgccctttcagtgtaattagtccgttttattcaatcgttaaaaaaggtattgagacatcgccgttccgtcggtgttttaaaagaagaatggaaattggtatttttttcttaacaaatatcattaaattttcatttcataaattatttcactggcaacgtttcacaacagccggtttctctataagcaaattatgccaatcgtacaataagaaatggaaaaatgttaggcctcgggtgggaatcgaacccactcgtgcaccatttccgtgggcagttctaccattgagctaccgaggcagttcttatcaactcccgctgcttttcgctttttaaagcgcccagtcagcttcttccttacagtatgccaattggtaccggctccctcaaaccccttccccccccccccccccgggtgaatgaatcatttcttccatcaatcgttttgcactttacctgctgctggagataggactgtttccgcacttgctcaaactcttcctccgtgatgtattccgccgagcctttttccatcgcattgccttccgcatcgcttgtcataatctccgccgcgcgttgcaaaatgcctccatagtcccgcgggctttcgtccctcgtctgctcgtcagtttgccggacgaattcgatgtccgcggcacaaacggggcatttgaattggttccttcggtttttcgatgtttctactctgaacgctttgtaaattaaaaaatgaaaataaaataaaaattaataatttacgaatcgacgaggcaactttcgtggaagaaatgctaaaatggcaaatttaatcgcgaagtttgtcgccactgacctcgcaattatgcaattgtctcgtcaattccccgccttcttttaaaacacttagacaaatcgagcactcggattctctgtttatctacaacaaaattgagaaacttgtaaaatatttataaatttttaatcctaattttgaatattattatttgacaaaaatattgacaaaaagttacgaaaaagtccaaaaaaaaattattattattattattagtgacgaataataacgttaaaatgaagcatttctgagcgtttttttttttgcatttctccccaaaacaaagtcgcagaaaaaaaaatagtaaactcccaaaattgcaacaaaaaaaattctccatatttttcttttatttctaagccacgtaaatcccaccggtgcctcacccgcaataaat

SEQ ID NO: 14873 - DNA, 924 bp, Heterodera glycines
  misc_feature (910)..(910): n is a, c, g, or t
aaacctaaaaagtacaataaacaaccaaaaaatgggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggagactaaaaaccttcaccaaatcaaaaaattttaacgcagaaatgctatttttaagcccctttcttcatagcatatgcgcagaaaaaatatgttaatccatataatttacaaccctagtaattaaaaaatggttaaatagcaaattatgatgcaaaatggaacgtgttgttattgtcctctcgaaagtacaaaatagggacgccgaggttaaaatagaggcaaaatgtttcaaaataggagaggggcatgaaatttggtgtccggacttttcgacaaggctgtttcaacaaaatcatatcactaaacaaatattttattaaaaattgaaaaattaatatagaagaatagtaaattagttttaaaaacaaagaaatgattaatatttaaaatagttgagtaaaatttaaagcacttatcaataatgagggatgagttttttaggtgaatatctttttctgtgaagtggttatggcaaattacgaaaatttccattgctttttcggggcttctcggtccacttgatatgcanattttgcggttttt

SEQ ID NO: 14874 - DNA, 2151 bp, Heterodera glycines
  misc_feature (942)..(942): n is a, c, g, or t
ttattagtttattaccgtttagctaataccgttttttaatcctttttttgtttagaacattgtccctgcggacgttgtgaaaattgcgccatttactcttttcccgtcgcccttcccacgcgaactttttgtccaagcgcagaaagtgcacaaagtgaggaagtgaataaagacaacaaaataaaaagatttagttattttatttataaaataaaaggcaattaattaattatttttcattaattaggccactcaattaattcatttttcattaatgaggccatccaattaatgtattttctcattaattaggccatcctttaatgatttttcattaattaggccactcaattaattcatttttcattaatgaggccattcaattaatgtattttctcattaattaggccatcctttaatgatttttcattaattaggccatccaattaattcatttttctattaattaggccatccaattaattcatttttctattaattaggccatccaattaatgtattttcgcgccgcgtcgaactttgaatttttgaaagatgtgcacaagggactgctgaaaacagaccaaaatttcatagaaacttttaaaagcattgaaagcagacacttggaaggcattaagcaaccgctgactttgttctgcaacagagcagtgagttgctgaaaattttgaagggataattaaattaattaatttatttttaatgttttagaaaaatattttaaaattgcaatattttagttacaatatttttaggattatatggcaagcaaagtcattgacgaagaaaccaatgaagagaaatatgttctaaagcaggtaagctaaagcgaatgattaaaatcaatcaattagtcaatgccaatcaaaaaaatgcaattagccgacactaaaatatcctttttcaattttgcaaagcatntaattattgccaggttgaacaaatcacggcgctatgggcggccacggcacttctccgcgtattacggcactccaccggcgaatgctgtccattgccggcgtcgactcgtcactgtcggtggtgccggagaatcaaactggcaaaatgtttgcgacggcattgtacaaagcatggtaagagcatgagaaaaagaggccaaaccgtacaaaaacatttggaagactcggataacaagaaaaaaaaacgaatgaatatcatactgtaagttatttaggctcactaaatgggtaatatatgaactaaaatgtgccaataaatgggtaaatgcaatttatttaatttattttttccttcatcgaggatttgaaaaatccccctccacatatgaatatttttattttttagtaagtcctatccccgattttttctgacgaatgatgttggaacaaatacacattaaaaaatttaaatcaatcctttagtcttataattaaatttctgtcgttcgtgtgccatttatagtcattaaattcatcgcaccctttggcacttttttgatcatcgaaattctattgtataattttgcccattttcagggaggcattcggcaacactgaggcggtgattcttttcctgcacaatccgtaccgcgactatttgctgatcgaagcgcgcgaggtgcagcacgatttggagaagattgcagacggaaaagtccaatgctttttcctcacattgaagcaggccaaagagcggtcggtttgtttaaatgaatttaattaattgaaattattaaattaatttaattaattaatttaattacataattactaaaatgattgcatttattcaaattaagattgactttccccgacgactcagactcagcaattctggacaacaaatacgttgtggctgttgcgctgagtcgatacactgcttacgccacatccgatgaaatagtcaccgcgcgtgcgcttcgccgttcaaatgccattgtaaaaaagaaaaatatttttatttaataattattttaaatataaagggatcataatccgatcgatgcctaaaaaaatttcccaaattctgtcctcttcatttttttctctgatattttccaaattattagagtattggaagatttggtgattccgagagactccgccggggggggggggtaattaataaatgaattagattaattttaaa

SEQ ID NO: 14875 - DNA, 1400 bp, Heterodera glycines
  misc_feature (21)..(21): n is a, c, g, or t
cgccgatttggtggcactttntggagcgcatcggtgccgccctctgtccggcgcttgtccaccgcgtggggcgtctgttccgcatccgttgcagcggcacgtgtgccgcaacatcggcggcaatgccatttgccgaatttgacatcgatttacgcgccgggaatggctggtgtggatggacatggcagcgcatttgtataattttccaacaaaaaaaaaacttgggaaacttttctatagttttgggcagatttgcatcaaaaaattgctaatttgtgaatttttggaaaaattgaactaaattttttggaaaatttaggcgaagtagatttcggaggtggtaccaacaagcaaaatcaaaaattttaaataagaaactatttttgaaaaagtcggaccgcctagccctaaaaaagcttcaaaattattttaagcaaaagaaaataactgcaaaattacctcaccctcttcgattttttctttttctaaaaaatcacttgaaaaattttaagcgactttttctgaagtttttcctagaaaaaaattattaatgtttttataaggttttggatttttgtgctactttaaattaatacggtttatgaaatacagtgttttgtaacttgcagaaaaatttgaggtatacgaaaaaaatgtgattctcctcgctaataaaatattctctttttttgcattagtgcccaaaactcaaactttcctttgcaattttcgcattttattttttggcacttttgtctatgcttttcctctcctctgaaggtccccttccgccatgcgacgtgcttttcacgctgcacaagggcactctgttcgcactgctcgacggcaccgtgtcgccgctgtgcgcctatttggagggccgtgtccaaattgaggggccagtggcggacgcggcactgctcaaacacttggcatacgcaattggaggagtatcagcaacacaaccaccacaagcagcagaggaaggaatgatggggatggaacatgcgcaagaaggagaaaaggggggaggaggacagattttggatatttaatttgtatatatggaatgacggatgtggacataaaatgccaaatttggtaaagcgaattagaagaaataaagcaagagagagagagagtgagagacgtcctgagctgaagcagctcgtttccccccatgaaattttttttaaattacccaatttaggaatttttcaagaaaaatattttagaaaataattaatttggatctattgcactttatgagtccaattaattaacaatacctggttttcatacaataactttgttcatgttcgaacaagccctatctttttggtaccgttcgaaagcgggggaatctgaataatgtaagaatacgtgaaaacaagaaaatt

SEQ ID NO: 14876 - DNA, 1091 bp, Heterodera glycines
  misc_feature (23)..(24): n is a, c, g, or t
  misc_feature (87)..(87): n is a, c, g, or t
tgaagcgcggaaattttgtgacnnatcgcaatggaatggtaaaatacttatttgctttctgtatacttcttactatacttcattttntcctaaagaggatactgtagcgttttccatttctaccaatatttagaccatttttctgattccacctctctctctgtctttctctttctctctttttctctccctatttctatcgctttttctcctctctctcgcttgctctttatctctaccgttctctctcactcatctctttgtctctaccattctctcgctttttctcctctctctctcgcttatctctaccgttctctctcactcatctctttgtctctaccattctctcgctttttctcctctctctctcgcttatctctaccgttctctctccctcatcaatttatatctaccattctctctttctcctctttttttctctctaaccccaaaatgcttccaataactctcccaaacagatcaacgtgtcgccgattgggcgcagctgttcccagtcggaacgtgatcaattcgtgcagtttgaacgcacgacgcccattcgcgcccaatttgtcgaggcattgcgccaacgattcccaattgaacagtacggactggtcttctcaatcggaggacagatcagcattggttggtggtgcaactctctgttgaaaagacggttacaaattttttttagcagatttagacaaaatggcaatgacgtattactattaaggatttttgacataattttgagattttcgagaagttttatgaaaatttatctagaaaaaaaaattttttttttttgtctattgcgttgtggcctttatgaaaagtggacgcagctgcttctctgtatggcacctttatacatttttgatttaaaaaatatattattttccaaaaaaagtaacatttttttaaattttaaattgtgactttaaggcaatttttaagaaaataaaggatttaaggacccggcggtggcgcaataggcctgccgaaaatatttttgaaattctggctggttttttgaacagatttctgccaaaaaaaggaacaaatttttcgtcaaactttaaaat

SEQ ID NO: 14877 - DNA, 2043 bp, Heterodera glycines
  misc_feature (1963)..(1963): n is a, c, g, or t
  misc_feature (1977)..(1977): n is a, c, g, or t
  misc_feature (1996)..(1996): n is a, c, g, or t
atcggttcggggggactgcaccgaaaacaaaaaaatcgatttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaaacccaaaaaaaaattttttggataaaaattatttaaataaactgactagataatatttaaaataggttatttctcttcctttcagtatccctgcaaagtttgctgcgcttctgatcagtttctgaaaaaaagttaagcctaacatcggttcagggggactgccccgaaaacccaaaaaaaaattttttggataaaaattatttaaaaaaactgactagataatatttaaaataggttatttctcttcctttcagtatccctgcaaagtttggggcgcttctgataagtttctgaaaaaaaagttaagcctaaactttttgccctgtttaaaaaggaattaaaaatttttaaaaattttattcatctccctttttgatagaaaaagcatcagagtgcctaaactaacatgtaaataaaatttggtgcgtttcagaaccctttctgtaaaaatacttatgaattaattttgcaaaaaaataaataattaatgaaaaactcagaatttctaaaaattttgaaaaccaattatgggccagattttttcaggttaagttagtccttttacagaggagtacgcctgtaaaatttggtgagtttatattgattttagagtgcgctagattcaatgaaactttttaaaatttaagcctaaactttttggcatgcttaaaaaggaattaaaaatttttaaagtatttattcatctccctttttgataatataagagtcagagtgccttattcaacttgtaaataaattttggtgcgtttctgagcagtttctgaaaaaaagatatgaattaattttgcaaaaataaataaataatgaaccctcctccttaataattttcctgcgcccaaggtactcactcggccgcttcgcggcctcgtggggggccttcgccccgcacgcatgattccaattttccaagcaccccaccgaaagtagaacgaaataaccaaaatataaggaaaatatttttaaaagatgttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagcgcgctaggttcgatgaaactttttaaaatatgagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactagaaatgcttactaattttcctagattttttaaacccggtgaaaatttttgcagacaccaccacttttgcacttaaaaaaatttcaaaaaactttaaaaattcatagaaaatttaaattcataggtactactgctaaatcaacgcagagacgcctttccttgacctttttaggcccctgcaaaacctggtgcgcttctgatcactactcgaaaaatgagtgattgaattttcactanaaagttaagcctanactttttggcctggtttanaaaggaattaaaaatttttaaaaattttattcatctccctttttgat

SEQ ID NO: 14878 - DNA, 1631 bp, Heterodera glycines
ttatgacattttggaattatggcaaaaaagttaatttaaaacttttaataaaaaatgaaaaataaaatttaggaaaaaatatttttgacgaaaatattggccattttaatgcgcaagtgatttgcataatgctgaccaaagtgtttctgttattccctggcaatgtttctgtgccatttttgttggaaaagtttttcctaatttattcaatttggtaatttgaaaagatcggataaaaatatatttaattaaataatattttattgaataattttttaacataaattattaaaatatttctaatggtttatttaaaactattgatttatttgccatttttaaatttgaatatatttatatttattaattttgaagatctatttttagacggtaaatcgaatataatttacaatttttaactaaattgtattaatattggccgaatggaaattaaatatgccaaaagttcttagtatttttggtggataattttaaaattaaattttttaaaaaagaaaacctctttcttcctgaaaatttgccaaaatttttgataaaaatttggtgctaaaacaatttaatttaagatactgatgaggataaagtgctaagaattttggacgagcttgataaaatgaaaaatgaggaagaaaagaaaaaacatgaattgaaacacaattcggctgaaacaaaaacaaagcaaaaaacaaaaatggaaaagaacagaaaagaaattgagaaaatgggagcaaaattgaacaatttacagagtaattaataataaataaataattttaaataaatgcattattttaaatatatttcattttaattttttttaggacatgcaattcaactaaaaatattggaatttctattgacaagcgatgaattgttccgaataaatcatcgttttgatgaaagggtgacaaagcgaaatactttacaacattcataatagcttatgacattttggaattatgggcaaaaagttaatttaaaacttttaataaaaaatgaaaaataaaatttaggaaaaaatatttttgacgaaaatattggccattttaatgcgcaagtgatttgcataatgctgaccaaagtgtttctgttattccctggcaatgtttctgtgccatttttgttggaaaagtttttcctaatttattcaatttggtaatttgaaatggataaaaatatatttaattaaataatattttattgaataattttttaacataaattattaaaatatttctaatggtttatttaaaactattgatttatttgccatttttaaatttgaatatatttatatttattaattttctatgaatattaattgatatttttaaactttaccattgcaattgactggcattaaacacaaaacggaagactaattttgagttggacaacaacgacaatttctgctgaattgactaaaaactaataatttggaaaattctgtggaaatgccaatcattgcgccgatatttcctgaaacatatgttttgagtctgatcagtgcaagtgatgcgagaaaattaaaaacgaatttttgaatggtaaatatttaagaaatcaattttttatttttaaataatgcaaaaacatttttagcatttaaa

SEQ ID NO: 14879 - DNA, 1683 bp, Heterodera glycines
cctcctttttgtcttttttcatgccgctctcgacccttccttagcaacgggtgggcgtacagcagcggcaactgcagcatttaatgcagctcttcaaaagctgtccgaacatatttgtctttcgtttctaacgcatctccgattgtgagttactctctttatttgggcccggaatttttggactcgatatctcggattaaaaatgacagatgaatggcatgaccattaaacgtcgccttttgtgtcaacgtgtgtgatttgcccaggaggcgtatcagattccgatgatgcgacgctagttgttttgtggatcgtcggtagagacggtcatcgtcatctgattggaagtgggttgagacagtacgaggcgtgggtaggttgcaagactagataaaacgaagttctactgattccttatcgttaggaatcaaacttattcaggatttcgctggctgtttttcttttctaatgaacctcgaaatttgctgacgacgtatattatgcgtgatagagatttggattaatataaaaaataagtgctttttatggatgacggatatgtcagggcttcgatatctgaggatttttcctcattttgtagtcttttagagggtcaaagaggatttttgttggaaaatgaggatttgcggatttttgcggtcttttgaaaaaaaaatgacaaaaccgaatgattttttgaaaaattaggtatatttggcaaaatgttcgaactttttcttcaaatctaaaaatttttttgaaaaatcatcattttgcaataaattttaattaatttcctttagataatttttatacaaaaaaataaacagagattcgacagagggggtcaaaatctttttttttaaatctgttaacaaaccgcactcgaaatcccaaattttttccggcagcgcctattggcactgccggaccctctccccccaatgttcccaaaaagttttttgaaaaaccgcgccacgaataaagcaatttaaaacaaaaaatttaagagattatcaatttattaaaagatacaaattgaatttattttttttttgaggttttaaataagattaactattatagatttttatcaaaaattaccaatttgcgattttgggccaattttttaagaaaaaataggaattattggggtcaggcggcgcagataggcgccgtaattgttacaaacgaaaaatatgatagttaactgattttgttcgcaatttcatgtgttttaaaaaatgaggatttttcataccaaatgaggattttcaaaattttgagatcgaagccctgatttaattcattaaatccccaaaacaaaaatatttttaaaaaactgaatgactaatatttgttcatacacaaaaaaatcaataccgtatatgctctaattatagcccatgggggattatttttcaacctcctcagaaaaggggggataattagagactgggggattatgatagagggattatttttcaatacacctcgtagactgggggatcgttttgttgattggtcgtcgattgatttttgttttaatttattttgttattgacttattttaatttaatttggattgtctttttaattatttatcggataaatttattttgttttggtgtttgattttaaaagcaggtgttggccaattttacaaacaattagtccccttgt

SEQ ID NO: 14880 - DNA, 2104 bp, Heterodera glycines
aaaaaattacttcatattttcatttatttccaaattttttaccatgtagagaatgcgtgtgtcgtaccgctcaacacccggagcagggccatacacctttttcaacgattccagcagatggattcgcgcagcagaggtggtccatagggcaatggccacctgagaacggcaaataaattttaaaaatttaaaattttttcttacgttgctcgtgctgtgttccaccaatgctcatccttggccttgtagcagaccatccaaaacttttccgtcagcttatcgatgctgctgacctcaatcttcgagtcgttcagcagtttggccagctccgcatggcactcgacgatttcggttttggtgagccgatttctattgatttttttaaaattttttatatatttttctaaaaagttttaccgaagtgcgaaccggccccacagcgaattcaaacacagcttggacaggtagcggagcccggggttgtgcttgatccggtccgcctcaaggtggacttgggccttttctttggccttgtcgatgtgttcctgctttctccgtgccgactcctcctcgctgatgcccgcctcggtgcacttggctgggtacccgcttgcttaaaattttgttgattaattaatttattactatttcaaaatttaccttcaaatttcattttgagaaatttgagcaggtacgagtggaacagcccattgctccaatcgcacacaagccgccaaatgtaggcacggcacacgtgcatcaccttgtacccagagcggagggcggcctccagctcaatgtgcgtcacagttgtcgaaaatcctatcaagaaaaatatttgcttaattaaaagttactaaacccacccctttcagagtcctcaaaatgtttgcatttgtattcggggtcgatcaaaccgcgtgggtacatttccgaacacgtccggcacagggggaacagcgtgcggttgttgagccggtacggaaggaccgggatgtcgtagtgacagtggcggggcggcacggcgtagcacttgatgatgccctccaagcgaatgccgtcatcgccaacaatgtctgatggactccttcattccacgtccttgtcaaactgcaccacggtcgggtggccaaccgggtaattggtgtacatattccttaaaaagccaaaatttttcaattattaattttttccggcatttcataccgcgatgggtaaagactgttaaagtctttcactttgatcgttcggcttttccagtcgcccgtctcagggttgatcaccgatgcgcccaaatattcgggcccagttcgacctgtgccgaaaattattttaaaaaaattttaaatggcaaagtaccgccaaagaaggcgtcgtggaaatcaatggggccggagtccgggcagttgtcgaagtacgccttcatggctgggttgtcctccagcattgcgttcaggtggcactcccagatcatttccacctcgaactcccgcgcaatgtcccgggttcgcttggcatcacgggccctgagggcaccggctgtttctcctccgcccacaattgccgcatcgtcggggaagcagcttgggcatccatgccaatagcacctttttcaatgggtaaattggcacattttcaaaaatttttccttacccattgacctcaatggccaaatttttgtcctcatctggacgctccatcatcccatccaagctgtagttgccgaatttgaactcccctccagggctttcgacatggcggaggactcggccattctcccgcaactcttcttcggcacgccactgagagagaaatgaaaaggtaaaataaatttaattttttggtacaccttcaaatatttcctggcgatggagctctgtttgcctcgcttctcgtatcccaagtgtgggatgatggcaacccgttctttgtcgtggtgagccaactgcacccaatacttcatgcaaccggacgggatggtgaccgaatccgtgatgtcatgccgagtctcggacaagaacagctgccgcatctttaccataccatgcgccaggatttgaacatcttcaaaattattattaaaaatttttcttctttttataat

SEQ ID NO: 14881 - DNA, 2510 bp, Heterodera glycines
  misc_feature (67)..(67): n is a, c, g, or t
  misc_feature (2479)..(2479): n is a, c, g, or t
tcatcagggcgctccatcatccccgtccaaagctgtagttgccgactttgaactcccctccagggcntttcgacatggcgcaggactcggccattctctcgcaactcttcttcggcacgccactgagaaatggcaaaatgtaaatttataatcatttttaggcaccttcaaatatttccgggcaattgtgctctgcttgccgcgcttctcgtatcccaagtgtgggataatggcgacgctctctttgtagtggtgcgccagctgtacccaatacttcatgcagccggatgggatggtaaccgaatccgtgatgtcatgccgtgtctcggacaagaacagctgccgcatttttaccataccatgtgccaggatttgaacatcttcaaaattattattattaaaaattttctttctttcttttttttttttttttttttataattttttttttacccgtcttgcagtaatccgcgatgacctcactcagctcaaaaccagtttcccggttctcgtcgtaccactgctcaaactttgcgcgctctgccgggaagagtccacctgggtaatagttctcaattggtggcagggtgtccagcacagtgccataattttccgcctaagattgtattaatttttatttatttttttttttttataaattcctcttaccttattgaatttgtgtggaaaatatttcttgttttccacgccctcaatttccaggccaaacgtcttgacaaaatttgccaatttgatcgggatcagcttgtagctgaaaggacaaaataaaaattattcagtttgaatttttacctgtcccgaaacacggtgggtgtgtagactcctgttttgcgcgccttcatttccaggagatggttgccttggcggatgagttcagggcggacacccatgcgcagcatttccccgtatatcagcacgtgatcataccgagagcctttaattttgtttattttatatttcaaaaattttttttaaataattgaatttaccggcatgtgcatatgcgtaagtcgtcaccgactccggcttttcccccgcttcctcataacccaacatccaattattctcggcgtcctcatccacggcatcctcttcctcatctgcttccatggcctccccgtcggtgttgtcaatgtttttcctctttctgcgcttctttgctccgggctccatgccgaggacttccgtttcgaagttcagcaaccacttggtgaaggctgccagtgggtcttcgacgaccttgcggcattccacgtccgtgtgccagaattcgaacggggaccaggcataagttcggaatcggccacaaagcgcgcaggccttttccaattcctgatcccaaacgcccttctcaatgcagcgggtgcatgtgacatgggcaaagcagaagttgacctttgaatttttcataatttgctaaagttgaaaaaacaaaatacctggtgcttaaaccgcatgagttgcgggtcgggcttgaaatccgtagtgcactcaaagtcaaagaagacgaagcgcttctccttcttgactttaggccggtatggtatgtagcagtctcgcgggtcatggaagccgagacaaattttgcagaatttttgaccgcaaacatgcccctttttcttgtcttgatcctgtgatatttattattttattttacgaatcttaaaatacaaggcctaccgccattcggtaaatcacaccacagtcaacacatttttttcgagctcatgcagattgattttcccacaatttcctcttcgttgtcacgtttgacccggcagtttgtgcatttggcatggtgttcatagcaatcacgacttttaaatgtctaaacaaaaaaattctttgaaatgaaactcaaataactttactttattgcaccccaagcaggtctcaaaaaagttgtcattgccttggacgcagtttcctcgaaaggcagacccaacacgcaggcagttgtggcatttccatttgcattttgctgtgtgttgcgtttgttgatgaaatggcatctcacactgtaacatatttatttaattacagtataaaatatattattattatagatactccaaaacaatagttgcgggcactgaacagttttccaacatttttaaccgggtcgtaatgcccgtcaccgccgttttcgccatcgataaaaagaacgcaaagctcatttttatactattccacagttgatttccacgaaggcttcatttttccaaacgtctcaaagctgaaaagccgaaacattccgggatggagcacctcataatagtccttaatgataaatattacgaagaataaaataaattttgtgcctgaattatttctccatattcctctatggaatagaagggtaggtgcatgtcaatgttgcacccctggcccagagcctgcacgccttcaagctgttttctctcatccctcttatactcagagaagcgttgtcgggcanaaatgcatttcattcgcagcattcaaacgca

SEQ ID NO: 14882 - DNA, 1897 bp, Heterodera glycines
tgctgaatgtccaattgagtgagctgaacgcattggccaatttctaaaaagtaaaaatatgaaataaaaacaaaaaaaagagacaaaccgtcgggaattcgtttcaactgattggaggacaaaagcaaaatggaaagacaatgcaactccgaaattgaggtgggcaattccgtgattttgttctcccgcaaatccatcattttcagtcgcttcaatcgcctgaaaaaataaaattaaaaaagacaaaaataataattaacaatcaaatggaaattaaagaatatttgtaaaggaaagataaagacgacctaatttctgtagaaacatttttgattttattgtaccgcagccataagctgaaaagggacaaaaaatagaaaaggaaaagggaacaaagcttttacgtttcaagagattccatctgaaaaacgacgggaggaatttcctaaaaatggaaaataaaataaaagtgacgcaaatggaaatgcctcgctgattttgttgtgccgaaggtccaaagtttcgagttttttcaacgaagaaaggctttcgggaagggtggacagattattctggcaaaaaaagggaaaatggcaaaataaaaaaaaagcaatcgaacttcgcttaggccgaggatacgcaaattgaccaaatggcccaattcggagggtaaattagtcaatttgttctaaaatccacgtaaaaataaatttaaaaaaagggagagaaggaaaagactttgtaaacgaagagttcggtcagttgagtcaaagtttggatggacgagggaatggtggccaactgaaagggcaaagaatgggccaaatcgaagggaccaaatcgaatccgaacgaacttcggatgaattgaggtccaaccgagtctcgcccatctccttgcacctcatcagctccctgccgatgtcctgcaacacttctccctcattcgattcgtttgtttttccatggctttgccaattattccctcggctcactcactttgcgcactttctcctccgcccccaccgcgttgctctgccgttcgctcagactgttcctgtacttgccccgtgcaaagttcgatattttgttgatgaggtgtccccccggcgatttgctcctcggccccccgccctctccgccctttgccgtgccggcagaaagtgcccttccgccgccgtcacaattctgcaggaaatgacagtcccccgttaagccaatgaatattcatccaatttgccgcccttacgctgctgttgtgctgcggacggaactccaacgtctgttccatggcgccattctccgactttttgtccatggaattgcttgaggaacggattttgtcgtccaattttctgccgacgagcagtgctttctgaaagtgttagcattattaatcagtttggataacataaaaacaaaaaataagatttttgtcaaaagtgccacctgaaaacagagagcgaatttgtcggccgggagaaagtgctcccgccggtcgtcgttgcctttcggttcaaacgaaacaacggaactgtttgtgctggtgctgatcacacttgacgaggacgaacaccgctcctgctgcagcaattctttgctgtgccttcggctcaacttcttctgctggtgatggctgtgtctgtggtggtgtctgttctgatgttgtccgttttgccttgcgctcgcttccacttctcctgagaattaaaaaataagcaaaagctaaaaaaagataaattcaaacgcaaaataaaaattaaaactatgaaattaatttcaaatattttcattaaagtgagaagcatattcggcccttaacaattgacagctggcggaagaagcggcgatattcgattagccgttgcaaagggaaagggcggggggggggggcaaac

SEQ ID NO: 14883 - DNA, 1030 bp, Heterodera glycines
aaagcatttgatggaaaatggcgacaaaacgaccaaagaaaaaaggaaattctgtttttcattttaagtgcgattccctccatcagaagcgaagcccaatcaaagcacgttgcagcccttcttcttctttttcttctgctgaagtgctgcctgagttgccttctcaaatacttctcggattccctaaaatcagccgaattattttttgttttggtaatccgacgaagaccaacaaacagaaaaacaaacacacctccttggtcttcgcactgcactccaaataagcatatgcaccttaaaataacaaacttatgattagcgatttgggaaatggtaaaaaaatgcgatagaatccaacttttttatttcaaaattttgtcacaaaagatcataagttttattgagtctcgagaccgcggaacacaaatccgtcacccatttcactcacttcccgcacaaaaaatggaaatctgtagaaaacagccatttgatgctgttatacatgcttttagttttcacatacttcaaatttttctgtcccatgaaaacgaatctcgaaaatttgaactgtttattctgtggttcggaaccgacaaaaactaaggccaaattcgtacaccattgaaaccaccgattactgttgaattcgagctcagaaattaaaaaataacgtttttaaaaacatttgtttatatgtaaaagcaattaccaaccaatttgttctgcaattgcctttccctgctccgacttcaccggttcctgtttgttccgtgaaaggtcgcgaatggtctgctggtcattgcgcaagtctttcttgtttccaaccaaaatgataggcacctgagtcaggggggggagggaggggaaaatttgaccaaatgaaaaattgaggttcgtagacgacaaactaacattattactggtttaatttgattaccaaaataatgtttggtacaattagtgaatttattacaataatttttacgtttgaaattgggagagaaatttagaaagttagaggatgagagga

SEQ ID NO: 14884 - DNA, 1336 bp, Heterodera glycines
ccgtggggaattggcgcaccctccgcacaaaatgggcggggaatgtgcgggaaatggcaaagaatgggggaaagggagaggaaaagcagccaaacgacaagctaatcgctcaaaaacacattcttgaattgtaagttttaagtttaattataattcagagcggaaataaattttaaaattaaaaatgattttaaaattctaaatatcctttcatttttgagaatttcaataaattaattacttttaattatattatgttaaatgcaattgaaaatgggaaattaccaaacaatggaattaatgggcaaagaatgcgtcgctttttgatgtcatcagcaatcattcgtccctttatatggtaaataatccataaaaacaaagctccttttctcaaatttgctgcattaaatggaaaacaacttatttgtttgtttgtgtgttgcttaaattatgttgaaattatcccattgaaattagccaatgaatgctaatctcttcggcccatctttcccccccccccccccgcccgtggttatccgattttgaacaagtgttatggcatttgggcccggaattggccattgtcaagtaaatgatgacaatgcccgggggaaaactatgcccgacaaaccgcaaaatgactgacggagttgcacaactcggggggaattgtaagctgattggcccaaagggatgaatttggacggagggggggggggaggaaacggtagtgggaattggaaaatgggggggagcggattcttgtgaagaattgaaaaaagaagaactcattatacaactatcttttataagtgagagaaatgataaaaatgttgttctcagaattgaagagtgattattatattaaataagacattcaaaccctattgaaatataattccaaaaacatacaattgtatgacacaatcattaaatgaattgcaagaataattgctcaaatattattcagaaaagaatatgattaaactacagacccttttttacttgcaaatccatgtattttttgcatcaattacaaggcagttaataatcacttatccattgtgtaatgagaagagatggttgaaaatctattgtacttttttcagttggatctttcccagcgactactgaatgagagtatacattttatctttcttctcttttcacattcaacaaaatgaattcttctaaccccatctgataggccgaacacaatagtgccgcattgaccgcgaaatatatcaagacgcatttcaactaattcatcagcatgatgcccagatcgcatgcgctctttatgcgtatgacgcgcttatggaactttttggagtga

SEQ ID NO: 14885 - DNA, 1814 bp, Heterodera glycines
  misc_feature (1654)..(1654): n is a, c, g, or t
ttgtatctttctaaatatgcattcaacttttgttcttaattccgtcgagtgacgtttgttttttccatttcaatcaaattttaagggaaggaagaaatattcataattcgtttaactgatttcacaaatttcaatttttcgccattctttttgccattgtttcggcatttttaccatttttcattattaggagtttgataatgatctcgtccataatgatcagcgctgtatatgaaaatataatcaaaattaattaaaactaataaataacgatttattaatccaactttacgagctaattatgttttgcttcaacaaaagcaataatggcaatttgtgtgattaatccaaaatgatcaaatgtgatcaatccacccgtccttcattagctttttcttttcacttttatgctgcttcatccttttccccacttttcctttattcttctcattcctcctcttccttctgctgcgattggcttttctcggctttctctgcaaatgtcaaaaatgccattctttcattttcttccccccccctttttttgccgtgtgcgaagcgttctttgtcctcctccgacttctgtgcccatttggctttctcagattccggcaatcggcgccactcagcgccttaatttggggatgatgcttttcatcgtattgataatcggctccccgtttctctttacttagccctatttccccaaaaacaatccttcgtccgactttgtgacatggaacaatatgaaaaacactacggatttcaagaccgaactccgttttgggctttgtgccgacctgcgacaatcgcattgaaaattgaaatgcttcttaaaaaatgaaaaataaatgcaaaattaacggggaaatggttattttaattggtgaatttctcatttatttataggctcatttttatttaggtatttgacaacagatttttgattgcttaaataaatgtggaacaaataacaacaaaaacaaaatgatccacggaatatttatgccaaatatttccattttatttactgtttatgaaattattatttaatattatttattattccgaatgaaaaagaaattgtgagaagaaaaggccaacaaaatgaaaagtgacgaaaaaacacgatgatttgttaaattgtgattttaaattgaaatattgatatattttaattgaactttggaatttgtttcgccactcatgagaggaaaaacagcggaattcaaatcagagaaaaataaaagaatatgattaataggatgcggaaaattaagttggatcacccacctactcaagaggaaatatttattttcttgtgaatctcagttttttacccccgtttttcctggggtccccggctgagtcatctgcgctttcttaaattcttgaatttttatttgttttcattccaaaaaaaattttttttcatttttattatattatgtgtcaattatcatccttatttagtgatttattaattgttttattttaattatacaaagcaccagtagattatttttaaattaattctataaatgtataagacacttatagaatattttctaatttaatagttacaattacacatatgtattaattataaaatataaaaattcaattcgccgcccctgctgctcttgagagactncgccccgattctggggaaattttagtctcgggtcttcatattagtcccgagtattagcactgctgcattcgtattaatattagggactaaaaactctattaaatgcggacaaaaacaacctgaaattttccgttctttcggatgaacgaaagtttggaaa

SEQ ID NO: 14886 - DNA, 4992 bp, Heterodera glycines
  misc_feature (18)..(18): n is a, c, g, or t
  misc_feature (4940)..(4940): n is a, c, g, or t
attaaaagaaaaaaaaanattttgggcatttcatcaccaagggccggcaattaataaatttcccgatgttaattatccaaactcatgcgagttaatcatttatgaaaatgtgaaaaacggtaaacaaataataattggaacaacatgaagagatgcgaaagaaatatgccacgaaaaaagtgatcagagctgacataatgccaaaaatgatcggagagcctctaaagtttatgcactttgatcaacgacgccgtccaaacagacttaagagactccaaaagtcgccactgccaatggagagcaaatcggtgccaccgccagcgcctcgggcgccgaccagccattggcgacgatgccgcaccaacgcactctcgactgcagaaggcaatgtcgagaagttgagggaaagcatggcgaatgtaagcagcaaaagtgtggcacagaatggacgacaaaaagcattttaaaaataaataaatactaaaaaataaaaatgttaattttggaaatatttcgcctcgcgtttatacgggagatttgtaccacttttgtgccctaattagcaaagaaaaaattgcgtgggatttttcacatgaaaatgaataaaaaagtaattaaataaaccatggcgcaaaaaaacagagcaatgaaattgggtaatattctcttcccaccaaaattagcacaatttcaaccgatgcaaagagaacaaaacgatttttgatggtcattttgattaattgctgcaatgcaatgtcattaacacagattcattttgcaaattgtcattatcattagatcaaaaatgaccaaaaaaataattaaaagaagcgagagaatgcgaaaaggtgaaaataaccactttttgggacccattgggcgaaattcgggcgattcggcgcacttttcaggcacaacaaatttcaatgaattttgtgaaattttttgttgagactatgtgcccctcaaaatgctttgaaccaattttaaggggcgaaaattctaattccttcaaataaacagcacaaaaaatccaatggacttaaatttttgaaacagttagtggatgcattttgcttgtttttgttttatttgggtgtttgttttctgtgccattgacatttatttttgtaatttgtcgggtgccgcgcttctgctgcttcgctgcttcggcttgtcacgaaaaatgcggtgatgaaggttaagcacttttaactcattcctaaattattttggttttaaatttcgatcatatagcaattaatttcttatccacttttactacaaattctgcaaattgtttttttttacttgggtcttttttttggaaattgaccaaaataacagttattatgtactgttaaagcgaattatttttgttggtaattataatacataattattgaatcagtcagtgtttattattctctaaaaaataaaatccatatacagtcatggtcatagtgtacgggcactcactatatacaatttaaaatgttgaaaaccaatcaaaattgaaagtgaattaaaaaattttattttgtaattttgtagcgttttttatgggctatcaaatagcaccattcattattttgtagatgctctttatacatttagcaaattctcaaattttggttctttacggaggcattagtaaacttaaatttcccttataagtcacctgaagcgacaaccactctaagtgccgagaccgaatcccgtgtcattaccagtgccgaaactgttgccgtttcatacgacggcacaaaaaagaacgccgtatttagtggcattgaaactagaatttctttttaacactggcaaaataatgcaaaattttttactaaatttgaactaaataatttttgaaaattttatttaaaatttttttcattaaattgagattaaatacaaacccatccgtttttctaattataaatattttctttttagtcccctgaccctaattctgtgccggactctactgaaactgtgaaaatgtgcgacttcgccttcgctatttcagccattttcggtacgaataatttataattttaaatatcattaaattactaattgaaatctgatgatgataataattattcatttaagtgattatgactgtgcatttgctcattaatgctgcgtaatgaagtgaaaatgaattcagatgaaaaagaaagaatttttgttttgatcaaccaaaactaatatttatggttataaaaactgattataaaaaatgtaaagcacattttgtaaaatttattctgaatatttgtcaatatgacaaaaatgttgaaaaagttgtaataaatttaaaattccaattaaactgaaaagcagagatttttagacattttttggaaatttagttatcccgtaaaatatacaaaaagagaatgattttgtattaatctcgttgtttctgggcattgaaagaccagttttttgtctcgattggcacggcactttcacggcttttcatcttttgccgaacagactccaaaaactgccggagtctccgccggcaccgcgggcggccgacagccattgcctccgatgtcgcggagcgatgccgacggcactggcagaaccgatgccgggggcagcgtcgggaacgacgccttgggcattgtcgagaggggcacaagaagcggaaggcaaaatgatcagagcaatggcagcagcaacgagcagcagaaaagcaaacattgaagggaacgaaggacggcacattttgttgattgggagaagagatatattattatggatatttgatgctaaaattctaataaaataatcattaaaatggacaacatttaattggtttactaatgagcaaaaccaaacaaaattgccaatttgttagcatttgcaaataatcaatttaaattatttaagcttaatggtaaaaagaaaatggcaaattgctgttattagttggacaagacaattgactaattatttaaatgttgcgaaaactgttgctgattgaggcaattcactttgcttaaatacaaacagagtttggtcactggttgttatgcaacctttacgccatgaagtaaacaaggggcaataaatattctttcgaaacacaactaattagccaaagggaacaattagtccaattaaaaaccccctgaggggctaattttggatggaccgtccatttgcaaagactgatgcgcagtgtaaacaaaaaacttcgacttttgatgatcaacagcaaccaaaagcaataaattattattgccgcggggggagagaccaacgagcaaagaaaagcccacggcagaagaaccggtagagttcgtcgactttggtcggagaagcggcgcgggacgaccaaacgcagcgccattttttgggttggaaaggcggcgggggaggggaaaagtcactgcaaagatcactttgaaaagcgcctcagacgaggtgacaatcacgtgatcgcccgattattatgccaaatcagtattgagataacaaaaatacttgtcaagagagtaaataacgcatttttttaactgtattttggtcatttactaaataaatgatgtcacccgcccctcccccactctttggcatttgaatggaatcatttttttctttttttccattttgctactgatgaaaatggtcatgagcgtattgtcagcttaaaaaacaccttcagcagcaggagagtgtgatggtcccatgtgctatttttgggtgaattcctttttagaaaaaggtactgaaatttcctcaaaaactaaatcaccaatctctgaaacagaataattcgattggcataaaaaacggctgagagtcacacattttgcaacgtgtatatcatatgcttgctgagatgtttcgtagttctgccattatgtgcatttttcattttttaaagacatttttaagatttttgaaaaaaaaattcatggtttcacttaaaaacaaataaacaaattaataattcgaatgacttagtcatttattttttgatgaattttctttcttaaattcaatttttccctaaataaatttaaattcattaaatgaaaaatgaatttacctaacaaataaggggaacaaaaaaaaaataaaaaataataatttattttaaatttcaaaatgggggacaacaaacaccaaagttcattttttgtgacgaaaacggaaagagaaattgggacggacgacggggcgaaactttggtgcgcgatttttcaaaattgcatccaaagaacggaggagttaggccaaaagttaattaaagcagaggcgtccattactaattttacgcttttcatttactaattaattatcgcttctctcgggggtaaaaccaacggaagattcgtaaacatttccaagtccctccgttttttacatactttttacatgtttttcaatgttatttttgccattagaaattggtttagtgaatgaaatttccattgaatgacttataaaaaatgggaaaaatgcaatacaaatggccagcaaaatctctgatcaaagtttcgagtgtttattccatattttattttttataaatctgtgctattttccgatcacttttagcagcggatcactgtttgaccccctccggcaacaacacttcgacgcggtattctttttcgggcggaggccattgagcattaagtttacctttttttaatggaagatgttttttaggcgtttaatttttgaaaattgttttgacttaaaaaatcccattcttatattattacctctgagtggaatttgttctcgcactggcgttgcttcagcaggactctgttcaaaagcgttcaattaataattaattttcgccttttcctctaatagaggcctaataggatttttttggttgtatttatttgttattcattttactgtcatccagtcaatgtcccccaaacgttttggggtttggtggncctgcccctaaataattttatggataaatgaagaataaaaagaacacaaagt

SEQ ID NO: 14887 - DNA, 1679 bp, Heterodera glycines
cggcgaattgggcgcacttcgccacgggaaccaaatgatcaggaaaggagaggacgagaaaggggccaaaataggtgaaaattttgccacggtctttcatccaagtgccaccgacgtcctaaaaaaatatgggaaaatttggaataaaaaaatgcgcatttttttttttgttgtaaagctaggccttaagataattctgaaagaaatttcccataaattccccagcgatggctaaaccatgtcggattttgttagccaaatttatatttgaatttacaaaaatttcgttaaaaatcacaccaagacaaacaaaaaatggttgtatttcttcgctaaattttcaaaaattagactcaaaaattgagtgagtctaggtaaaaaaagcacacttaaaaatttttgcgatttaaaatttcatgaatttggtttttaagagtttttgttaaaagcgggagattcgctcgctacctgcaaatagccaaaaagtgggtcattgatggcattccaaatcagaaacaacagctgggaccagttgaaccaatactcgttgacttggaaaatgttgagaaacacctgaaaattggggtaaaacaccttttatagacccattaaaaataagaaattcttaaatttcatattttttaagaataaaataaaaaaccttgacataataaaacataaaagttgtgtgcatcagtccaatgcctaaaaattacaaaatttccggttttttcgtgtcattttttttaccaaattgcccaaaaaatattgccaacacggcattgttgttgttgctgttggcattgtcagcgacagcaactgccattggaaaaatgcagatgatcgaccaaccaattaatatacaataatagaatccaatataacgaaaaaaaattcaattcattattacacattaaaaatttgaaaatcaatttttaattttacaattttccagcaggttgcaaaaggtagcaccagccctaacctaaaatttttttccaaaatatttttttcaacattttttcttctttgaatttaagagcaacaatatgccacgccaatattttgaagcgctaaaaattcatttaatttacacaaagaaaaaaacagaaaaaaaattttcattttaatttttttaaactttgataaattgctaaaaaaagtttcaaactcaatggggacttaattcttcatttttctgaatataggcaaaagaaatgcatttacaaggatcaattttcgtcttttttgcatttttactcctccaatttcttcccttttccatctcggacagtccaattttggttaacaataacagttccattgccacgcgtggtgacgaggactgttccggttgcaaggcgtacaaatgcatggacgagagcgatgcccattgtggcaaaaggggctatttgatcggatatggcgagccgaactgtgaacgattcaattcgaaaggtccccaaatccatgggcaattcgttgaaattttttaaaaatttctgaattttctcgaatttcttgtcagaattcgaaccaaaaaattcctaagtttttagaccaaaaccttgaaggaaagttccctttttttagaaatctacgaacgtttcaacagaattggcaagaaattcatcaactgtaggacaaatgtcttatcccatgcatgggagcatacattt

SEQ ID NO: 14888 - DNA, 2385 bp, Heterodera glycines
attctaaaaccaggaatatgaagtacaaaacagaaataaaaaatggtcccggaaaatcccagtcaaaataagacaaaaatgaacggtcactcaacgaacacggaatgatgagttgagtgagagaaaatggaatgttttttgaatccaatgatttgtgaggtaatgtcagccattttgagccgtgacatttgcaattgtcactcactcatcatcatcatcatcatcacatcctccttgatagttcaaaaacatttgcactgtgagatgaccccaatcgattgttatatgtcagtgaatgaatgagaacatgtcattcattcaattcaaatttctgcgactaatgaatataattggacgggaaattaagtaattacataattttaacgatggactcatgcagaatttgctaaatctttttgaaagaatccccaccgaattttgtgcatgtgtaatgaatgcttaatgttagcgaaagtttcacaaaatctgagttgactgacattcatcagtgatcagctcatttatagggtgaatttcaagcgggagggcccattttcaaggaaagttttcgaaaaaaaattcctgaaggttggatacgccaatagaaaaagcacaaaattctttaccggattttaacatacatacaaacaaatacaacacaaaaatagacacacagtagtggcacacaaataaatatggtacaacatacagtacaatatatatacaatgaatgagtaatacataattggtagtggaatcagaaagacgtgctgatcatctcatccgtgcataggcgagcgtcatctcacgggcgcgtctgttgaactccgcacggtcattccggtacaaattggcagcttccgcattgagaggcgagttgtccgggttcgggtcattcagcagaacgatgatggagatcacaactgtaaagacagagaaacaaattaacgatttctgcagccaaaaattgtatgtgaaaaaattgatcactcaaactgcacaaataccacacaaaaccaacgccatcaaattcatgcccgattaagaccataaattccaaaaattcgctttttcgctaactctgatgaaacgcaatgaaatcttttgaatttgctaatcaaacacaaaaatagcggatcttaatgcccctgaaaaaagttaagagcattaaagtgatcaatccatttaaaaggtgatcaaatccatccaccaaatccacgccacctttttcgatggtcagcgtcggtgcccagtgcgtttgcagaatgtccagacacactttgccccgtgtgtcgatgttcgggtggaagatgcgcgtggtgaacgtgacttgcggcgctttgaacgggtagtccctcggaaatgacatgctcagttggaagttgccgttttcgtacggtgtgccggcccggcctcggatggtaaccgtccaggtggtcatggtccgttgatcaagtggccgtgcagtgcatccctcaggcagtgggttcttctccatgtccttgagttcctggaaaaggaaaaaagaaatcagcattggatgacagacagtcctgccctggaagaacagatttccagggaatttttgggcctcggaatcacaatttccgaaaaatttcgctttttggcagttgcataaactccgaaaaaatttgcatttttattggatttgatcggattttgattagattcatgagatgccgccaagaatgactttttcaaattgaaaaacaacgtcatccccaaatgagtgacacctgtcgaagccgtctcttggacattgcgctcaaccagcagcttgacgagtgtgtggtgaagacaacaaataataatatgcagcagtcgacgacgaactgtcgtaatatgtacaaatgctgacgtcacaaataaaattaggcacaataaatgtacttgtgacaaatgagggaaatgtgtgggtcggtcggtggaaaatgcctccttttatagggcgtcgccggcggggaaatagaaaattgagtgggctttttttaaatgaattttgtcataatctgcatttgattatcaaaaacagtgcttacatatagagaccggaaatttcaaatttgcggatcccgctgcgggactggaactcatttttttttgcgggacgggatcccgcgggattaatcccgcaaatcccgcatttaaaatttgcgggatcccgtgcgggattgcgggattttggaaaattcgaaaaaattcaattaaattcaaaaaatttccaaaaataaaaaaatgctgaaaaataaatttttaggggctggcgggatgcattaaaaggtgctgatgagtcgactaaaattttccgattggatccgacggtaaaatgtgatcggaaatcaaattattaacggttcataaatt

SEQ ID NO: 14889 - DNA, 2452 bp, Heterodera glycines
aaaaagaaaaattaatttttcttcgattttttgaaaagtcagtaattggacataaaattttttggaattttttacttgaatttttttataaaaaactttaagatttttttctagaaaaatttctaagtttttatatttttttttctcggggggcgggggaggcggaaacgagctgctccccaaattaagtgccaatttgaccatttgtccaagtgaaaatggcacatttgccttttttaagggcactgaacggccggcgcatccgatcgcagcgaacgcaacgccaaggacaaacggcggcagtgacttaagccattttgggacgccgactccgtccccaacccatcgtacgcctttcacaaaattccttttacagtactccaaaattactgtagggaccaggaattcgcgggcctttttttgtttttcggtttctgcattttcgtctgaatttgacttagttttttcttttcgacagaatgtgcccttttcgtccgccgattcgcccctttacgcctccgttcagaaagaaaacggccgatcgaacgctttggcgacgagtcgacggcggtccatcgacagttgggtctgatgaaagtgaattgctcttttacggattgttttgcgtgccaatcggcgggggtgccaatgccacaaatcgtctcaaaaattggtggatttatttatttggccctctgttgcaaaatggcaccccattctcgcgttggccgatttctctcgcttttattttccattcatcgcagtgcaattcgtctcccctctttttttgtcattcccttttcgtctctcacactctttctttatgcgctctttaacagtcacttggaaatgcattttatttacacatttttatctcaaattaaatgttttattacaaagagaaaaaatataattaaaaaagtttttttctctttttttttgattttttgagtatgcgaaggtaaaaaacaacaataaaaacaaatgacaaattctgcaagaattgacaagtccgccgtcgtcatcgttcattcattgctgcattcgcatcacttccgccgggttgaacagaatgttgcgcttctgctgctgttggttgcctattcgtccctccaaaaacgactgtttcagtgccgcgctgttcgtcgacaccaaatcgctcactgtcgccacattcattgccagcggcgcagcgattgagtcacactgatgggtgaacaacgactgaacacactgaacaggttcaccgttgtacaacaaacagatggactcgttgttgagcatctaatggaaatggaaagggacgggggaacatcgaaaacaattaattgccacttttattttttacatgcgcatcgaattctaacgcatcgttttgtgcctttactcttcgcaattgtgtcaacgcttctttgaagttaccatcaaaaaccgatttaaataccctgaaacgaaattctgaatatacaaaacaaaggcaaagctaattgtaagtattccgagaaaagccttggcctggatttcgtgtggaatggacctggattagatgaatttggttttaaaaaaaacaaagtttaaaaaatgagttggttgcttatttaaggaactctaaatactcaaatgacaataaaataatcttaatcaatttaaaaattgtttagtgttttaaaataatacaccggtcacttaagaaaaaattgataacttatttaaaacccaggtccaggtcgaactctaatacagtcaaattgtataaaatagaaaatttttaaatttaagaaaaaataccaacggagtgcgtcatctttgccaccatttctatttttgccaagttcgtccaaatatttgaccactttctgctcgtcgcctgtgtgcattgccatcaaaaacagcattttcaatacattcgaatgcctttgtgtcgatttggagttggcccttatccattcataaaactcaaaggcagccgaatattcctaaattataatgacaagcataattaaaggggataagtaatatttagattttcgaaaaattctatcgaaattttaggaaaacttggctgatgtaggtcttggagggggtaacaacaagtaaagttcaaaattcagcaaaaaatactatttaattggccccattgcattcacttcaccttcagtcggaacagcacacggcccttggccatccacgcctcttcaagtcgttcatgccaaatgccaagttcagaatcagtggccgcaaaattccgacgagcaatttcgatagcttttacggtattctcaataagtttgtgtacacgaaccatcgacgagtaaggcaatggtgaaaatgaggacgcttcggcatgcaaaagtcgaagagaaaaaggcaccatcgaacctttgggggatggcaatttggacgcattatgagttataagcatttattgttacgtacttatgtatttatctat

SEQ ID NO: 14890 - DNA, 2152 bp, Heterodera glycines
  misc_feature (2043)..(2043): n is a, c, g, or t
  misc_feature (2046)..(2046): n is a, c, g, or t
  misc_feature (2056)..(2056): n is a, c, g, or t
  misc_feature (2067)..(2068): n is a, c, g, or t
  misc_feature (2113)..(2113): n is a, c, g, or t
ttctgttgatgcatgcggcgtgactcggtattgcaaaagaaattgcgaaactgccaaatccaaaccaatggaatcgcccatcatgtgccgaagtccatttttaaaagtctggacgaaacgctcagccaatccgttgcttttcgggtggtatggcggcgtcagtgtgtgttcaattccgcgtgatcggcagtagttctcaaattcagccgaggcgaattgtcgtccattgtcggtgacaatttgttgaggcaatccgtgtgccaaaaacaattcgaatggcctctatgttgcattggccgtgatgttcttcattttgatcacttcaggccattttgatttggcgtcgacgatgatcagccacatgtgtcccatgaaaggaccacaaaaatccatgtgaagtcgctgccaaactctgtcaggcgtttcccacggatgcaatggaaccttcctctcctcgggtgcatcagattggcaatttttgcacctctttcgttccatttcgatgtccttgtcaattcctggccaccaaattttctgtcgagccaacgctttcatccgaacaattccagaatgggtggcatgcaaaagttctaacatttttccgtgaaattttctcggaataactgttcggtttcccaacatgatgcatccatttaccaattccaaactgtttttgttcggctcgaatggcttcagctgatcactttcgacctttttcggccatcctctttcaatgagttctttgaccttcttcaaaatttggtcttttgctgtttcactggcaatcgattttgcggtgacaggcagcgagtcgatgttttccaattgtacggctctcacttctgcactgtccaaatcaatttttgctatctccggacatggaagtcgcgatagaccatcggcatttccaaattcttttgttggacaatattcgatgtcaaagtcgaagttcattaaaatgagtgaccaccggtgcagccttctcgccgccaccacgggtatttcactttttggcccaaaaatctttttcaacggttcgtgatccgtctgtaacacgaattttcggccatacaaaaattgtttaaacttttcgactccaaaaataattccgcggccttctttttcaatttgcgaatagtttcgctccgccgcattcaatgtccgtgatgcataggcgatgacgccttcctttccattttgttgacttttatggaaaagaacggcaccaacgccataatcagacgcatccgttgccaagtataatggctggctgggatcataatgaacgagcacttcggttgatgacaaaatttctttaatcctttgaaatgctttctgctgctcacttccccaatgccacttttcttccattctccgcaattggtttaatggctcggaaacggtagccatagcgggcacgaatttgccataataattaaccatacccaaaaaggattgaagctcctttaaattttggggcggtggcattttgcgaattgcttccagcttttcctctgaagcatggactccgtttttgtccactcggtgtcccaaatattctatgctttcacgcataaattcgcatttgtcccgtttaactctcaatccatttgccttgagccgctcaagcacctgcgtaattcggcaaagatgttctgcctgtgttggtgctgtgatcagtatatcgtcgagatacactgccactccttcaattccttgcaaaatttcgtccatgacctgctggaaaatcgccggtgctgacgctacgccaaaagggagtctcgtaaattggaacaatcctttgtgcgtgcatactgccaaatacttttttgcttcatcatccaacatcagctgcagataggcgtctttcaaatccacttttgaaaatttctgaccgccatttagcacactgaataggtcgtccggtcttggtagtggatattggtgcacgtccaaccattggttgacggtcactttgtaatcacagcagagccgaattcggctttgagcgcaaatggtacaggacgagccttacaccttttncgntgcactccangcttgaatttnncatgaatttgacgagtgcatcggccccattcgtctcgaatacttnctgaaatttttcgagaaatttgtccacctctttctgatc

SEQ ID NO: 14891 - DNA, 808 bp, Heterodera glycines
atttcaatgaagactctctatattcgaagatcaaatccctttttggaaagctgatggaactgatgttaagaaatttgaatgctgttaagtcattatttgtgtagaatttctattaaaaaattaggtatgtttaaaaatgcgtataaaattttgtcccttaaaaaatcgatcgaataactaaaaaaccaacgcatagccaaacaaaagtttttagtgaatgatactaaaaaaacgacgacaaaaaaaaaaaacattaccaaaatggtaatattcaggtttgtacccccccccccctttttcgggagaaatttttgggtaatactaccgatggtaggacccctttttgaaaaaatatttatcattttaaaagtcactgaaataagtttctaagccaatttgtgttaagtgaacgcataaatttgggattgaacgcggtaattgtgattgaatgtgtattttttgatcattccaacaaaaagaacaatttttatgggcacgataaaatagcctcaaaattcattttgcaactccaaaaattcaaattgatcgaccacttttaagcaattcattcgcttctgctgatcagtgatcaattgggtcgtgcgtgagcagtgttgtgaagactaaaaatagaaaccgcaataaatttgaatttcgaataatttattcactgaggtcgatgaaactaaaaatgaataggaagtatgtaattgagtttgcagaattggcaatgtttctccatcgtaatttacaacataaaattttctaaaataaaaaaatttgccaagaaaaaaaatatatattaagt
